United States Patent 9,029,636 (ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS) - sequence listing, part 13

SEQ ID NO: 50773 - DNA, 1269 bp, Glycine max
  Peptide Sequence Number=SeqID_167551
atgtggcccattctcttactcgttgccgtggccggatccactggtttcgccaccaaacgcttccttactcgcagaaacaccattgaaggtgaaaacgtcaatctccacgatccaagtgcttttgacttttccagttcggaaagcacttctcagatgcataacaatgatggagtgttcacgttttccagttcaaaatctgaatctctgacacaacaagatggacctgagagtagacgatcccgagcttcaaatgacggagttagggctccgaaggttgaggcgcgatcggagaagcggaacggtggaactaaactacattttcgtatgaagaagagggagattacaaggaatgtcgctgcaaaggctccggtccgttcttctaaagatgactccttatttggtcggggactttgctctggcatcatgtgtatgatgtctgctggaaaagctgagatcaataagctgaacaagaccatggacgagacagctaaacttgttcaggaactgaaatctgagctcaacagaagaaaatcgtcacatgctcttcaaaatttggattctgttggcaatggtgttacgaactcttgcaaaatcagtggcaggaacgaagtgatgctcaagaagacaaacagtgagctcagagatgttgatgtcaaaatttggagtccttgtgtaaatgattgtggtgaatgtggaagcagtgctcttactgaagaaccagaaccacaggttctggaaatggatcaactggaagcagaacttgagtttgaactccaaaagctttctgggtgtgctactgacggcccttgcgatgaaaaaataaagcctaacttagatgagcttgaagctccaggtgaaggctatcatggaacagatcatggagtatcagcatctgaattgcatcagaaactaagccacttgctaataaaacagcaagaaaatcagatcatggagctagaatctgaactgcaccaagctcagtcaaatctgcatgagaaggaggctgaacttcaggcactaaaggactgtgtcaaacgccttactgaactctcgttatccacagtttcaggcatgattatctctagaataatgacacattcttcatgctcacaaactcctcatagacttgcatatgatgaagctcaggttctctctgatccaaagggaacaagcgattatggcaacaataacatgcactctgaatcaaaacattcagttattgggacgaaaagacctcttgattctgaatctttctcgtgttacatgtga

SEQ ID NO: 50774 - DNA, 564 bp, Glycine max
  Peptide Sequence Number=SeqID_167552
atgggatcactagaaagatcaagaaagaaagtcatgttatggaagaaagccatggtgcacttttctctatgttttgtgatggggttcttcactggctttgctccaacagtgccccagttgaagcctagaagacttataatcattgtaactccaacaagcacaaaacatcctttccaaacagtgattttgacaaggttggcaaacactataaagctggttcctcaaccattgctgtggattgttgtggaagggcaaacagattccacggaactttggaagatgcttaggaagactggcatcatgtataggcatttggtttccaaggaaaacttcacggacttggaagctgaattgaatcaccagagaaatcttgcactcaagcatattgtgcatcacaggctaagtgggatagtacactttgctgagctttccaatgtttatgatcttgaattcttccaacaactaagacatattgagtatgattcttccctttctattttatgcactagttctatttctcttattactttgatgatgatgatgatgattataaacattgattaa

SEQ ID NO: 50775 - DNA, 684 bp, Glycine max
  Peptide Sequence Number=SeqID_167553
atggccgattctggcttcaccagtgacaggagggaccccattaagtcctcagttggcaatgctgcggctagtaggagacgacagcatgcagtcacagtggggaaagaaaggagggaatcgctgatgcgcgcgaaaagactctgtagggtgggcattggtggcggtaatggcgaattttccgttgacagtgtcatgttaactgatgaagagcaatccattttggagtcccagactttagcggcagtggaaaatttgaaatctgcccttgcttttcaggggaagggtgcagtaaagaaaagagttggggctcttcaagagttaaggcgtttgctgtcaagatctgaatttcctcctgttgagtctgctattaatgctggagctgtacccttgcttatgcagtgcctttcatttggttccccagaagaacaggtgcttgaggctgcttggtgtctcacaaatattgctgcagggaatccagaagaaacagaagctctgttgcctgcattgcccttgcttattgctcatcttgggggtgaagagttgaggaatgttctgctagttcaaggggcattactacctcttgcaagaatgatgctaccaaacagaggttcaactgctagaacagctgcctgggctttgtctaacctaatcaaggatttcagtttcatgaaaatgaagatctga

SEQ ID NO: 50776 - DNA, 141 bp, Glycine max
  Peptide Sequence Number=SeqID_167554
atggcatctatgaagagagcagcagagcacactgacatggtactacggacctatgatgtctgtgatgcagccgatgtgagacttgggtattttcccaatacacccctttcacgcccagcacttattgggcttggtgcgtga

SEQ ID NO: 50777 - DNA, 237 bp, Glycine max
  Peptide Sequence Number=SeqID_167555
atgccactgccagtggcaactggcaaccaagaaccaaacactgtcataagtggaagcaacatcaacatccacagaaaggggtcatcattgatcatgggacacacggttaacaaggtatttgctgaaccagctggtttctctttccatattctcttatcattgagagaccctttgtcccttcttctcaagatctcattgcatttccctccctttacaggggagatagaatttagatag

SEQ ID NO: 50778 - DNA, 1605 bp, Glycine max
  Peptide Sequence Number=SeqID_167556
atgggcattcagcagaatgacatgctggtggagcgctttacggaggatgaggtcaaaagggcagtatggagttgcggaaatgataaaagcccagacccagacggacttaattttaaattcatcaagcaattttgggatatcatcaaatcagacttcctaagattttttgatgagttttatgtcaatggagtttttccgagggtcttgaatgcatcctttatagcattaattccgaagctagtggatcctcaagtgttgaatcattatagaccaatctctttgatagggtgtacctataagatacttgctaaggtcctggctaacaggctgaagaaggttatgcatctcatcattaatgaaagacagtcaacatttatacaaggtagacatatgctccacagtgtgatgattgcaaatgaggtggttgaagaagccaaaaggtgtcaaaagccatgcattattttcaaggtcgattatgagaaggcgtacgattctgtgtctagggagtttttgacttatatgatgacaagaatgggtttttgcaccaaatggatccaatggatagctggatgtctaaaatcagcatcggtctcggtcttggtcaatggcagtccttcatctgagttcctaccccaaagaggactcagacagggggatccactatcacctctactatttaacattgttgcggaaggacttaatggattaatgtccaaagcaatagagaaaaggctatacaggggattcttagtgggcacacacaaagtggacattaatctcctccagtatgcagatgacacaatattttttggggaggcatctatggagaatgttagaactattaaagctatcttgagggcccttgagcttgcttcgggtttaaaaattaattttgctaaaagtagttgtggggcttttggagtgtcggatttgtggataagtggtgcagccaattacctccattgtagcgtgatgtcttttccttttacatatcttggtatacctattggggtcaatccgcgaagacgccagacatgggaccctatcgttactaaatgtgagagaaaattagtgagatggaaacaaagacacctgtcgtttggggggagagtgactctaataaattcagtgctaacatccattcctatctattttttctcttttttcaaggtacctaaaaaggtggtggacaagttaacaagactacagaggaattttctatggggaggtgcgtcggagcaaaacaaaattgcttggatccgatgggaaacggtgtgcttgccaaaagaagatggaggtttgggggtcaaagacatcaactcttttaatatatctctgttgggtaaatggaggtggaagctttttcagaatcagggggagttatgggctagggtaattgagtcaaagtatggtgggtggaggaatctaaatgaagcaagctcgatagtgtggaaggtagggcgtggggataaatttaaattttgggaggactcttggataggggaagataaccatttactagagaaataccctaggctacacagtatatctcttcagcaagatcatttcattcagcaaatgggagacttcaaagattcagggtag

SEQ ID NO: 50779 - DNA, 849 bp, Glycine max
  Peptide Sequence Number=SeqID_167557
atgactcgtgtgcctgagatgaaaatatctagagttcttaattcttactgtgcagcaatgttggctcctatgattaatccatatgacacagacatgactaaggaggagacaaagagaacttgggagaagtggctgcaaaggaggaaaatgatgtattccttggctcgtagatttccaaaacttctcacttttttctatcggaaaagcttcttgcctgaaaagcatgacgagattgataagctgctatctttctcactaggaaagaaggataaacttatgattgaagaaccagaatttgaggaattttggcagagggatgtggaggagtcagttcgtcagggaaacatacgcccatttatagaagaagctgttctgcaggtatcaaattggggttttgaccttaaggaacttcatgtgcaaaagaagtgtcaaacaagaggcatacttctttggttgaaatccatgtacagtcaggcggactgtgaattagcaggatttcttggccttacacatatatggcagggactggatgatagggtggtcccaccatcagtgatggaatatatagaacgggttttgccagaggctgctatccataagcttccaaacgagggccacttctcctatttctatttctgtgatcaatgccataggcagattttcgccactctctttggaactcctcaaggtcccgttgaacgacaagaagaaactgcaactgtattggaggaagaggtttcacaagcgcgtcttaggttggatgtaaataccacaggcggctccactgctcggtggagcttgaaagaaaagagaatgatcgatatagttctcggaattttgaaccgttaa

SEQ ID NO: 50780 - DNA, 192 bp, Glycine max
  Peptide Sequence Number=SeqID_167558
atgcgggatttcaacggaggagattcacttgttgtgggagtaacacacataaacataatgagggtcaccgaagacgaggatgtcacgcccaccctttgtcgaaggtgtgtacgcatagtctctaagagtgtcaccattgatgaattggggttggtccctaaatctgatcatttttgtgtggttcttatgtaa

SEQ ID NO: 50781 - DNA, 225 bp, Glycine max
  Peptide Sequence Number=SeqID_167559
atgtctaagacatgggacaacagtagtttcttcgatttgcaaaatcttttcaacgtagaagggcaaatgatggttattactatatatacaaacagaaagagtttaatattgggagactttcaagaggctcagatcagagtgagaccactactttatgcaagcgtgactacttcttctctagacacgattcggataccagaacacgtgaacagggagacaggctga

SEQ ID NO: 50782 - DNA, 405 bp, Glycine max
  Peptide Sequence Number=SeqID_167560
atggaagcaatgctttccaagtttattttgatgatgccaaagactcaagtcaagaatcaaaagtcaagaaagtttcaagaatcaaagagtcgttcaattaaagcaagtttcaagaatcaaagagtcattcaatcaaagcaagtttcaagaatcaaagagtcgttcaatcaagaattaagattcaaagttttacactctggtaatcgattaccagaaggcaataatcgattaccagttgtagcaacctacccttttgcgggtgagcgagggaaaagagggagaagcttgccaccctgctcgcccaggcgagctaggttgcttcctctagaaggcaccgccttctggtggaacttcctggaaggcctaagtgggtctggttgctatttgcacccccctgtttactaa

SEQ ID NO: 50783 - DNA, 240 bp, Glycine max
  Peptide Sequence Number=SeqID_167561
atgccagtttgtggaagaagcctcctagtagcatggacaagtaacgggaatgagctaagggctacattcagatggaagaaatgtcgagattccgaaacgaagttcaacaagctggacaaaagcacaagaaaggagaaagtagcccaaggaccgacctacataagtcagataagcgacacaaactggaaaaacgtcaaccccttcaaagaggatcaaggtatgattgcaatacacccttga

SEQ ID NO: 50784 - DNA, 867 bp, Glycine max
  Peptide Sequence Number=SeqID_167562
atgaaaacgcgtcagacagctgaacaggtacccaccaggcctcaatcctcccccccggttccggctaagctccaggaaatgctcaaagactatccggagtatatcgaacgactgcagaaggctctcaactcggtgaaggacaggaggataaagtccacccctccttttgaggccgcagtctggctattggaagaccacctcagtggctttatcgctgaagcgcgagctgaactagccaccgccgaaacgtcaggcaatccgcaggccattgcacaggcaaatgagaagctcgaactgatgttcatggcacgaagcggtggcggcgggatgctgaacatcactcccagtgccgttcttgcccccgcgactcatgcagaatacctggagcggcacgtcatccctcggagtggattcaattccgcaaaccatcatgaagtaccgcgcgccatcgtcttggccgggcaaccaggtgctggcaagagaaaactgaatgatgcggcaaagatcgacctggggtatgacgtagtgcccatcgatcctgacgatctacgcgatacacatccggacgtcgaacgcctgcgtcagcagcacccatacacttgggccggccacacccacgaagacgccagccaatgggcaaaagagctgcgatcggcagcaatcggtgggcgtagaaatctcatcctcgataccacgctcggcaacggtgatagcgcggtcacactgatcaaggaccttcaggccaaaggctacgacgtagagattcggggcgtcgtcgcgcatcggctggaaagcgaacttggtgtggatgcgcgctttgcggactctttgaatagcgccggtttcggccgctacgtccccgaagac

SEQ ID NO: 50785 - DNA, 438 bp, Glycine max
  Peptide Sequence Number=SeqID_167563
atggtgggagcaggtttgaaaaaggatcttagagtgtctagggttgtgccaggagggtctcttaaggccttcctttttcttctcatcggagttatttcacaaagacttgccatggaatctattgattctctcccaattggttggactgtaggtgcgatgatttacttcacgggcgaggtctctgctcagttggtagagctccgctcttgcaattgggtcgttgcgattacgggttggatgtctaattgtccaggcggtaatgatagtatcttacgggctgtcaagaacgtagaggagggtttcctcatttgggatcctggggaagaggatcaagctggcccttgcgaacagcttgatgcactatctcccttcaaccctttgagcgaaatgtggcaaaaggaaaaagaatccatggaccgaccccatcgtctccacccc

SEQ ID NO: 50786 - DNA, 405 bp, Glycine max
  Peptide Sequence Number=SeqID_167564
gcggattccctcaacactttcctggagactctggttattctagagccaggggagactcttcctacttactctaagttctgcaaactaagaccagaccctcaggagctggctgcccaactttgtatccctggtaggggatttgttctgaatgctgagggcctgccatggaagttgctgaggaaggacctcactactctagcgcagacttggagcattctgtcttatttcaaccttgcccctacatcacacacttctaatctgaacttggacagggcaagcctagccattaacttggcttacataaagaagaacagctggaacttggacgacccaacggtcagctttccagggacccgtaaggccagggctagaggatctgagagtccatcttctactactccctag

SEQ ID NO: 50787 - DNA, 498 bp, Glycine max
  Peptide Sequence Number=SeqID_167565
ctagggaaggcaagactcgccaaagaaaaattcaggtcagcagctacaaacatccggaaagagtgcgctgagttacgagaggaaaacgcagccaatgcaagagtccttgaacaagaaaccaaaagggcccgcaaggaggaacatggccgagacaaattccgaggagctttgtggggcagcaacaatgagctcacgcttcggagaaaggaaagggaccagtcacgggtgcatggcatgatcttaaaggaagggttagctgcttgctctagatccaagaagagtttggctcaacacttggaagccatggagcaaagcatgctagctatcatagggcaatacaaggaagagttaaaccagtcgttgacccatgaacaaaagctagtagaggacttcgcacaagcgtacgccgagaaggaagcaagagggagggttcgccttgaccttgaatggaagtcaagacctcctgtgactactagccaaagcaatggccatcgctga

SEQ ID NO: 50788 - DNA, 405 bp, Glycine max
  Peptide Sequence Number=SeqID_167566
atggaaaagaaaaggaaagggattgcactgaaaactagttcctcaaaggaaaaccacaaagaagactctagtgatgatcaagatgctgagaatttgaatttgattgtcaagaagtttggcaaattccttaaaagatccacagacaaaaaattctctaaaccatcaaagaagttgaaaaccaacaacaacaccttcacatgctttgaatggaagaaggatggaaaactgagaaaggcctacatagcctgggaagacaatgtgtcaagatcctctaactcttctagtgaagaagaaattgcaaatgtgtgcttaatggccgattcaacggatgacacctctgtaaagaaccacctcgtcgctacgatatcattactctacactatgttaatttcaatttttaaatga

SEQ ID NO: 50789 - DNA, 774 bp, Glycine max
  Peptide Sequence Number=SeqID_167567
ggctacacgccctcaccttaagaggactacatgtcctcgccttccgagggtgacacgcattcgccttcatagggctgcatgtcctcgccttttgaggactacacgtcctcaccttcagaggactacaagtcctcgccttttggaggactacatgtcctcgcctttagagggctacacgccttcaccttcagaggactacacgtcctcggattcagaggactacacatcctcgccttcagagggctacatgcactcgccctcggaggactacatgtcctcgcttttagaggactatacagggctgcacgccgtcgtctttagaggactatacatcctccccttgagaggactacatgtgttcaccatcagaggactacacgtccttgccttcataggactagacgtcctcgccttcagaggactacacgtcctcgcctttagaggactagacgtcctcgccttcaaagagctacacgccctcgccttcagggagctgcacgccctcgctcgtcttcaccttaagaggactacagggctgcatgtcctcaccttcagaggactacacatcctcgccttcaaaggactgctcgtcctcaccttcagaggactacacgttctcgccttcagacgactacttgtcttcgccttcaaaggactacacgtcctcgcctttagaggactacacgtcctcgccttcagagggctacatggcctcgccttccgaggactacacgtcctcgccttcagaggactacatgtccttgccttccgagg

SEQ ID NO: 50790 - DNA, 246 bp, Glycine max
  Peptide Sequence Number=SeqID_167568
atgaataaaacagaagacgaagaggatgaggatgtgggactttccccggagttagaaaggatagtcgcccaggaggaccaagaaatggggcctcatcaagaagagacagaactggtagacttgggaactggcagtggaaaaagggaagtaaagataggcacggaactacgtaggtctgatttccttatcgcaattaaggaatacgtaggagcaagggaaataccctcgtcgaccgcaaaaagataa

SEQ ID NO: 50791 - DNA, 423 bp, Glycine max
  Peptide Sequence Number=SeqID_167569
atggtgtcaccacaagggaggaacacatggacagctgatgatctcgtgccttatgtggagaagatagtgatcttatccgaagagcaagagaggatcactgagcctctggcacatggtccaatatcagagcgtcgatttcccccacaacagtttcacatgcttcagtcaagtgttgaaactcagggttttgatagacgaagggagatgtatcaatatcctttcgaaggtcatgacactgatatgtctgcaagcgaacattcgtttggtggtgtgttgatttgcgtcacgagttttctgctgaggctgagcaacaagggcggagacagcgcgcaagaagaaatcctgatcgtcaagcccgaaggtgggatcgaccatgtgacacatcctcacgccatcacggacaccataatgactgattttgat

SEQ ID NO: 50792 - DNA, 722 bp, Glycine max
  misc_feature (146)..(146): n is a, c, g, or t
  Peptide Sequence Number=SeqID_167570
ggctacacgctctcacctttagaggacttcacgtcctcgccgtcagaggcttgcacacgctcaccttcagaggactgaacgtcctcaccttcagagagctacgcgccctcaccttgagaggactatgcgtcctcgccttcagaggnctggacgtcctcgccttcagaggactgcacgacctcaccttcagagaactacacgtcctcgccttcagagggctaaacactcttgcctttagaggagtacacatcctcaccttcagaggactacatgtcctcgccttcagaatgctgcacgccctcgctttcagaggactacatgtcctcgcctttagagggctacaagtcctcgcgttcagtgggctgcacgccctcgcctttagggggttacacgtcctcaccttcagagggctacacgccctccccttcaaagggcaacatgccctcgccttgagagggctgcaagtcctcgccttcaaagggctatgcgccctcgccttcagagggctacggctacacgcccccgccttcagagggctacacaccctcgcctttagaggaccacacgtcctcgccttgaggactacacgtcctcaccttcagaggactactcgtcctcgccatcagtgggctacacgtcctcgccttcagaaggctacacgtcctcaccttcagaggactacacatcctcgccttcagacgactacaagtcctcgcctttag

SEQ ID NO: 50793 - DNA, 240 bp, Glycine max
  Peptide Sequence Number=SeqID_167571
atgaggagaggagctaagagaaagacgaagcaaggtcaagaagccaaacacgatgcacccgaagataacaagcccaaagctcagcatcgagctaaacgagccaagacctccaagcctcaatccgaacctaagtacttcgaagacaagcgcaacttgtgcacgctataccttcctctcttctggtttgcagctcttagacatgtgctagtttggcatgttggaagcacaaagaaggaataa

SEQ ID NO: 50794 - DNA, 99 bp, Glycine max
  Peptide Sequence Number=SeqID_167572
atgactctaacacctcacgagtctcactctttaaggattcacttcgggatgaaggataagctaaaggacaaacaacttgtccgaggtaattaccaatga

SEQ ID NO: 50795 - DNA, 896 bp, Glycine max
  Peptide Sequence Number=SeqID_167573
atgaattcattgccaagcgctgttcatgcatcctccaccaacgagtctggaggctcgcgaattgattgcctaacgctgttcgccagttctccattctccacatttattctgagccccatgaattcattgcctagcgctgttcatgcatcctccaccatcgagtctggaggcctgcgaattgattgcctagcgctgttcccctgttttccattctccacttttattcggagccccatgaatttattgcctagtgctgttcatgcatcctccaccaacgagtctggagccccgcgaattgattgcctagcgctgttcgccaattctccattctccacttttattcggagccccatgaattcattgcctagcgctgttcatgtgtcctccaccttcgagtctggagccccgcgaattgattgcctagcgctgttcgccaattctccattctccacttttattcggagccccatgaattcattgcctagcgctgttcatgcatcctccaccttcgagtctggagcctcgcgaattgattgcctagcgctgttcgccaattctccattctccacttttattcagagccccatgaattcattgcctagcgctgttcatgcatcctccaccaacgagtctggaggatcgcgaattgattgcctagcgctgttccccagttctccgttctccacttttattcggagccccatgaatttattgcgtagcgctgttcatgtgtcctccaccttcgagtctggagccctgcgaattgattgcctagcgctgttcgccaattctcctttctccacttttattcagagtcccatgaattcattgcctagcgttgttcaagtgtcctccaccttcgagtctggggccccgcgaattgattgcctagcgct

SEQ ID NO: 50796 - DNA, 2391 bp, Glycine max
  Peptide Sequence Number=SeqID_167574
atgagttcttctcaagcagcaccaaagggaaaccaagaggactacaagctgaaggacacaaagccggagcttggagaaaagtggccacatggagggcaacgtggagggagtggttggatatacaacgagagagccacaagcacctatgacttggtggagcaaatgttctacctctatgtccgtgttgtgaaagccaaggatcttccaccaaaccctgtcaccagcaacgtggacccttatgttgaagtgaaggttggcaactacaaggggaaaacaaggcactttgagaagaagacaagccctgagtggaagcaggtttttgcattctcaaaggagaagattcaatcctcagttgttgaggtttttgtgagggacaaagagatggtggctagagatgattacattgggaaagtggagtttgacatacatgaggtgccaacaagggtgcccccagatagccctttggctcctcaatggtataggcttgagaatttgaggggtgaagcaagaagtagaggggagatcatgcttgctgtttggatggggacacaagctgatgaagcatttcctgaggcttggcattcagattctgcttcagttaagggagatggggtttataacataaggtcaaaggtttatgttaacccaaaattgtggtatttgagggttaatgtgattgaggctcaagatgtggagccaaatgacaaaagccagccaccccaagtttttgtgaagggtcaagttggacaacaagtgctcaagactaagttgtgtccaacaaaaacaccaaacccaatgtggaatgaggatttggtgtttgtggcagcagagccctttgaggagaagcttgtgctcactgtggagaacaaggcctcccctgggaaggatgaggttgcggctagaataagcttgccattgaacaagttcgagattctattggatcaccgagccgtgcactcgcattggtacaaccttgagaggtttgggtttggtgtgttagagggtgacaagagaaatgagtcaaaattctcaagtaggattcacctaagggtgtgtcttgaaggtgcttatcatgtcctggatgagtccacaatgtatattagtgacacaaggccaactgctaggcaactttggaagcaaccaattggaattcttgaagtggggatattgagtgctcaagggctccaatctatgaagacaaacaatggtaaagggtcaacagatgcttattgtgtggccaagtatggtcagaaatgggtgagaactaggacaatcactgagagctttaacccaaagtggaatgagcaatacacatgggaagtgtatgatccttgcactgtgataacctttggggtctttgacaactgccatttgggtggtggtggagggcaaactcaagtagccaaagttgactcaaaaattggcaaggtgaggattcgtttgtcaacattggaaatggataggatctacaccaactcataccctctacttgttctgaaaacctctggattgaagaagatgggggaacttcaattggcgattcgtttcacatgtctctccatggctcacataatctacctctatggacaccctttgttgccaaaaatgcattacctacatccattcactgtgaaccaattggacagtttaaggtaccaagctatgaacattgtggtggttaggcttgggagagcagaaccaccccttaggaaagaggttgtggagtacatgcttgatgtggactctcacatatggagcatgagaagaagcaaagccaatttcttcagaattgtgtcactcttttctggtgcaatatctatgagcaagtggcttggtgaggtgcaacagtggaagaatccagtgaccacaatcctagtgcatgtcctctttttcatcttgatatgttaccctgaactgatcctccccacaatgttcctctacatgtttctcattggaatatggaactttaggtttaggccaaggcaccctccacacatggacaccaaactttcttgggcagaagcagcacacccagatgaacttgatgaggagtttgatacttttcccacctcaaaggctcaagatgtgatcagaatgaggtatgataggcttaggagtgtggctgggaggatacaaactgtggttggagatattgcaacacaaggtgagaggtttcatgcattgcttagttggagagaccctagagccacaagcctatttgtgattttttgccttgttgttgctgtggcattgtatgtgacacctttcaaggttgtggcttcagttgctggcattttctggctcaggcaccccaggttcagaagcaagctaccctcgatgcctagtaatttcttcaagaggttgccatcttgtgttgatggcatgctttga

SEQ ID NO: 50797 - DNA, 496 bp, Glycine max
  Peptide Sequence Number=SeqID_167575
tggttcttccggaaacactccgaagaagggttcttccggaaaggtcttccggaactttgaaacttcttccggaagtgcgcgtcttccggaagaagtgttcttccggaagacgtttggttacttccggaagaacacttcttccggaaactttccggaaaacgttcttccggaacttccggaagaacccctaacgggtcttccggaagattcctccgtcagccattttcgccattttttccggcgtactctcgtcttgtcccctctcgtcttctaccctaagctaagggtaaggggaaggggaactaacctgttcgcggagaagaagaagaaagccttggcgcgcctcgcggagaagaagcttcacggagaagagaagaagcaggttccgggagaagaagaagctgttccgggagagaagaagctgtgttccgggacgggagagaagaagaatttgttcgaaaaaaagtgttccggaaatgatttgcgttttttataa

SEQ ID NO: 50798 - DNA, 207 bp, Glycine max
  Peptide Sequence Number=SeqID_167576
atggagaactcaccaccgaaaatgagacccaggtgcgacgacaagttgcaaagtgctgacccaagtgcacggcgtcgagggagttcgtggcttcatgcgacgatttgcagacccagttggcaattcgggtttgtaaaaccggtcgggtcattgggttccctcaaaactggtcaggtttggccgagtcatcccaagccacatgcatga

SEQ ID NO: 50799 - DNA, 312 bp, Glycine max
  Peptide Sequence Number=SeqID_167577
atgttatctgttgaagccccatcatctcaagcatcatccactccaaatacttctcagaatgttagaaagaaaaatgatccagcttggggacattgtaaacaaattaatgagggtgctacaaaagtgacaatgatgtgtatttattgtgataaacgggttaagggaggtattattaataggttattggaaaaagagtttcctaagttacattggtctccttgtgctgctcactgcattaatttgatgttgcaagactttgggaaatttgaggaaagacacaacagaaggcctggaagagggttgaagaattag

SEQ ID NO: 50800 - DNA, 339 bp, Glycine max
  Peptide Sequence Number=SeqID_167578
atgtggaggctgaagatagcagatggtggaaaagacccatacattttcagcacaaacaattttgtaggaagacagacatgggagtttgatcctgaggcaggaactccagaggaacgagctcaagttgaagcagctcgtcaaaatttttataacaatcgcttcaaggtcaaggcatgtggtgatctcctttggcgttttcagcaatttaactttaaagtgagttttgtaaaaagacaagttaatcatgctattcactatttagttagagcatcacgatctcatgcttggaaccatgtcctcgacaatatccctatatccctacttgtattgcttctttga

SEQ ID NO: 50801 - DNA, 303 bp, Glycine max
  Peptide Sequence Number=SeqID_167579
atgttgaatcacaatcgaaagtttgaagctttgattttgttaggtttggataacgcagttgatgggttatgccggtgggttctattagtttcaagaaaacatgccatgcccagcaaaaaggatgtcgggaggagacttgtgattgctgcatgttggaaagagacttggtggtggttggtggatgtcgggaagaatctatgtggtggttcatggacgcaggagatggttcttcacaatgccttcaagcttgatgatgataatacttcacagaaagaggaatgggaacatatattgaaattttga

SEQ ID NO: 50802 - DNA, 1173 bp, Glycine max
  Peptide Sequence Number=SeqID_167580
atggtgccccactcacctctccttcctccttgctatccgataacggcgaccccttccactcgccgcaaactgacctccgcaacaactcccgcatcatcgtcatcatcgagacaacatcaactcagttcacccaggtcgcgccaaaattcgagcaccgaaacccaccgcggtggaatccttcaaggagttagaccattttcaatctggaaacatcgtgcctttggccacatggaggaagtcatggcggcaatcagagttatgtttgaaaaactaaaggaagaagttgattctgacttggatggttttgctggagatttggtgggcattcttgaaaagaatgtagtgtctgatcgtgaatggaaagagaggttggaggatctgtgggttgttactctacaatgtctctggaaattgtcaaataatccattggaggctaaatcacaagcaaggatgcctgcaacctggccaaaagtgtcaaaggtaattaagtttgcttggattttatgtgtcttatggttcgacagggatatgcaaagatttctagcagaaagtacagtcgggaatgaatcaaccaattccacaatttgtgatgaagtctgccagcttaaatcatctcttctagagggaattttagtgccagtgttacgtggcaacattccttgtagaactgtccttcaatctataagatgtgaaaacatgagagttgtgaacatgaagatagcagaatttccaattttgggttgtatcaggaacaatagagttcgagtgaaggatacaactttctcatcaagtatgggaccagggaaagttatgcaaagagactacaaattaagttcttattcactgaattctgtgtcatcacacttcctttctgagcagaaagaggatgttcatcattcaattatattcgatcttcaaaatggaaatgcagaaattaggaggcgccttgctgtgtattgtttgaagctactttctcaacttcttaggaagacaagacaaaggaatctgctcattcctaatgccaaacaagctgggtctgaacaaggaacatttgaaggttccactgatgcgtgtgattcaacgtcgctggctacaacatcgggtgataaccgatgtagaaaggggaaattaaccgatgtagaaagctcgatttctagtagtgccatctcataa

SEQ ID NO: 50803 - DNA, 798 bp, Glycine max
  Peptide Sequence Number=SeqID_167581
atggggttagaccaagcgccatcttttaaaaagaggttctatcatgtcaaagtcaagaatctagagctagctagcttgtgtaaactggggcagcggatagatcaagttcaacatcaggcttttagcaaggtatatgggaagatttggaatctggtgatgatagaagtgtccattgaagccttcacatctctcacccaatactacgaccaatcactcagatgcttcacctttggggactttcagttagcaccaaccatagaagagttcgaagggatcttaagatgcccgctagggggaaggaagccatgccttttttccggattctatccttctatggcaagaatagaaataatggtcaagatctcggaacaagagctagaccgagtgaagcaaaataggaatggggtggcagggataccaaggaagtgcttagaggaaaaggcggaagctctggccagccaagaagagtgggcaacattcaccgacgtattagctctgctagtttttgggacgatactattcctgaatatagatgggttggtggatctagcggtaattgatgcctttcttgcttatcatcacaacaaggaaagcccagtcatcgctgttttagcggatgtgtatgatacgttcaacttgagatgcaagaagagtagtgcaagaattgtctgttgtacgccttctctttatgtagatatgtctgtcccctacaaggtcatcgcatgtgatccggaaaggttaggctaccctatgagaggtgcgccatcaaaggaaatcattgagcctttcatcgcgtga

SEQ ID NO: 50804 - DNA, 219 bp, Glycine max
  Peptide Sequence Number=SeqID_167582
atgaagatgcttttgataccacatgatgtagctccaagtagagcttgtaggccttggatcttcttcatcaatggagttatttgcttcttgaagatcaatggcagcagaatggagaaggaggaaagtgaatttcagctatggttcaacccactaatccaagatcaagtccgagattctccactaagtgtgcttaggtgtcatgaggcatgtaaagcatga

SEQ ID NO: 50805 - DNA, 948 bp, Glycine max
  Peptide Sequence Number=SeqID_167583
atgtcttcgtcaccagggtcctttctctttctttttgttatcaatgttttccttcctcttttgttgactccacgacatcttgattcagtattccccgaagagtataaaaaagaaattcttcgttacatgtactatcaccagaatgaagatggaggatggggactacacattgagggtcacagcaacatgttttgtactgcactaaactatatatgtatgcgagttcttggagaaggccctaatggaggtcatgacaatgcttgtgctagagcaagaaaatggattcatgatcatggtggtgtaacacacataccatcatggggaaaaacttggctttcgattcttggggtatatgattggtatggaagcaaaccagtgcccccagagttttgggttcttccttcatttcttcctatgcatccatctaaaatctggtgttactgtcgattgacatatctacctatgtcttacttatatgggaagaggtttgtgggtccaatcacaccacttatcttacaattgagagaagagctctttactcaaccgtatgaaaaggttaattggaagaaagcacgtaaccaatgtgcaaaggaagatcgttatcatcctcattctttgatacaagacctggtatgggatagtttatacatatttattgagccactacttactcggtggcctttcaacaagctagtaagagaaaaggcccttcaggctttatatatgcttgcttgttgggtggaagatccaaatggagatgctttcaagaagcatcttgcaagggttccagattacttatgggtttctgaagatggaatggccatgcagagttttggtagccaaggatgggatgctagtttggttattcaagctttgcttgccactaacctaatggaggaaattggtcctacacttgcaaaagcacatgatttcatcaagaagactcag

SEQ ID NO: 50806 - DNA, 456 bp, Glycine max
  Peptide Sequence Number=SeqID_167584
atgtggaggctgaagatagcagatggtggaaaagatccatacattttcagcacaaacaattttgtaggaagacagacatgggaatttgatcctgaggcaggaactccagaggaacgagctcaagttgaagcagctcgtcaaaatttctataacaaccgtttcaagttcaaggcctgtggtgacctcctttggcgctttcagattctgagagaaaataacttcaaagaaacaatatctagtgtgaagatagaagatggagaggaaattacatacgaaaaagtcacagccacgatgacaagggccgcacattatctatgtgcattacagactagtgatggtcattggcctgcacaaattgcaggagctatgttttttgttcctcctttggtggttgcaaatatatttgcaaagatatgggttgaatgtgtatggaaaatggatcagattcaaaaataa

SEQ ID NO: 50807 - DNA, 279 bp, Glycine max
  Peptide Sequence Number=SeqID_167585
atggttggattgtcgtggagtggatgggggtttcatgttagaggttgtggttttgatctgcgcgagtggaatttgcttcaattacgatgcatttcgtgctcggatttcgggggatttgattggagtgggttctttactggatccgaagtaggcagtagcaggaggacaagaagatgcttctctcgcacatggatttggctgagaataatcaccaacccatggaagggagccacttcatgcattgtttgccagagaggcagagagggaataactgagtga

SEQ ID NO: 50808 - DNA, 186 bp, Glycine max
  Peptide Sequence Number=SeqID_167586
atgggagcaggagtcatcacagtcatggcgattgcgaaaattgacctacttttccattatataagatcttttagtcagatcaagttggatcgtgttgggggattttatgacaataccatatctcaaatgtacgtaatattggacgctgaaatttctatgatgtttgatagcttttccattatataa

SEQ ID NO: 50809 - DNA, 672 bp, Glycine max
  Peptide Sequence Number=SeqID_167587
ttgagattgcctgctatcagacaaccattgatattgcagtttaaagctgccttccattgtgacaaggacgccatagaaataccaggcttctatcagcgccaatggttaccaaattatcctgaaattgttgaatttaagtatgatggggaaacctacgaaattcaagtcagacaacagaaagacaaactttactttgctgatggcctaacaagattcaggacagaactgcagatttatgaatctgtcacgataaatttcctggcctgcgaccaccctgcaaaatttgacctccacttcactccaccattagaccagcagaaatgcaaaaggcgccgtgcaacaagaaaacacatctggacatatgaaatcacccaatcaatgctaggcgcaccatatccactgcaacttccaacctctgtcacacaatgcctaatccactgtggtgatcatatgacaattctcagaagattcggacctccactgcaatggaatgtagttgtgctcgacaaaggcatcggtgacaagtatgtcactctcccttggtacaaattccttcaagaaggtgattttagccatggagacgagctctcattctattataggcgtgctgagaagatctgggaggttgtcatcaagcgtgcaattgattgggatgatagtgatatagattag

SEQ ID NO: 50810 - DNA, 333 bp, Glycine max
  Peptide Sequence Number=SeqID_167588
atggagggtggcgccgccgtcagagtcttcatcagaaccgatggcgagggaggaggtggaggaagggaatgtggcagcggtagcggcgacggaggaagaggggcgtttggggccgaggaattggctgagggtttgaatgagtttcatgattccactgaagacaaggcggaggatgttctagaaagggtcgtcgtcggaggcagcagagtaggaggaacagtcgtagtcgaagatcacgtagtcgatgcagacgacgacgttttcgacctgcgggacgagggagtggaagcggtgcttgctctttggagagtgaaggagcgtgaagaagaatag

SEQ ID NO: 50811 - DNA, 246 bp, Glycine max
  Peptide Sequence Number=SeqID_167589
atgtttggtttagggttggtggtacttctgttgttctgttctggtgctgttctcattgttatggcacgttctccagacaagataaagagcatcgatggctcaaaagaaactcttaaactcagtgtgaggatcagtgatctatggtttattggcacgcctaacaaatctgagcaagctgaaatggtgtttgtggactccgatggtgatgagatccacgctgtttgtaaacaagaccaattgaagtaa

SEQ ID NO: 50812 - DNA, 570 bp, Glycine max
  Peptide Sequence Number=SeqID_167590
atgaagcgcaagatcgaggaagtggaagaagagaatcagttctcatgtatgttctgcagcaaaaagttctcgagtcctcaagctctaggaggacaccaaaatgcccacaaaaaagagcgaaacctcttgatcagtatggataaagaaaaagagatgaatgctcttggatttagcccagctaatgttcccatgcaatctagggcaccgttttatccgtattcatcacatttatacatgtcaaaccttcccttgcaagcaaggacactcccttataatggtgcatacatgcaccccatgacagaacctggttattgcattaaccaacgattttccttaccaacatctccattgattactcggagtgaatctacaagacccattgttggttcttcttctagtgttggtgctggttttggtcaacttcagggaagtccaaatggtccttttgtgaaggttgtggtgtggaaactctattatgatgctcaactagcttttggccaattgcttgatttttgttgcgtctctctagcagcaaaggtgctgcgtacgtatggcaagttcactagatag

SEQ ID NO: 50813 - DNA, 505 bp, Glycine max
  Peptide Sequence Number=SeqID_167591
atggacatgaatgttggagccctcatctctggacagatcactcttatggcccagtccaactcctcgaggctcggatttccagccctcatcactaccttatgcatggcccaaggagtcacctcagattccttgacttttaagtcgctcagcccagccattaacctggcttacataaagaagaactgttggaacttggacaaccccacggtcagctttccagggacccgcaaggccaggactagaggatctgagggtccatcttctgttgctccccagacatctactgcaccagctcctattccttcaacatcggttcccgatacttccgatccctccgctcagagcacatacctcatgatggcgatgctacaaagcattcaccagggtcaatacctggtgatgcaaagtttacatagtttggctcagcatcagccaattatgagcatagaggagttttccttacaggtggcctggccaggagtccaaccttcttctcatggaggag

SEQ ID NO: 50814 - DNA, 447 bp, Glycine max
  Peptide Sequence Number=SeqID_167592
atgtcatctattgtttgcaaggatcgcgcccgcaagacacccagtggacctggagaagtccaacagggtcatggggtttccagctctgattacgggcctttgtcagttctacggggtgcccgtcgccgccagcaaggcgtagggcgagacaccacaacagcctggagatggccggcagcgggcaacagatgcaccgccaccacctctaaagcccctcagctcatctacaaaggctggagcgttgcctatgactcgtggtcgaccagcaggcgaccaagtccaaagtcaaaggtagcgaaaataccttttgctatcatgacccgagagttcggtggcatgcggagacacccgacggtaacccgcacacacccctttgccatccagcgacccgagagtccggaagcatgcgggggtaccttatggttatccgcacctttggtcatctag

SEQ ID NO: 50815 - DNA, 414 bp, Glycine max
  Peptide Sequence Number=SeqID_167593
atgcccagggctgttccccttgcatgtggaccttcaaatacatcagttgatgaatccattttgattgagaagcaagaaagggttgataatggtgccaatgatggaagattcagtgttaatcagttccacgggagatcacgacataaagtagatcctgctcgagacctctctattcaagttctagagaagttttctcttgtcacaagatttgcccgtgaaacaacttcacaactttttggagaaaaccaaagtaatggatttagtcccattgacaggaggacccatatccagactaaccttgatcatcctaagtcttccaatgttgaggaaaatacctttgttgaaagtcctgttgtcttggattctcaggagcttactatctactacaaaactggtgttgttaggtgcgcataa

SEQ ID NO: 50816 - DNA, 144 bp, Glycine max
  Peptide Sequence Number=SeqID_167594
atggtcttgtgggttaggattattgttgaagaatcaagggttggtgatgatgtagacccctcacaactatccagtggaaaatttcaaattggagtggaattgcttgttaaatttagagttaaaaattggtatgaaggacaatag

SEQ ID NO: 50817 - DNA, 132 bp, Glycine max
  Peptide Sequence Number=SeqID_167595
atggcgaaacatcatgaaagtagcatttcatcatctaatctgaggaaacatagtgaacaggaacatctcgttgtccatgttagggaaacaaagtttatgacggtaatggattgtacaatctgtggcatataa

SEQ ID NO: 50818 - DNA, 1599 bp, Glycine max
  Peptide Sequence Number=SeqID_167596
atggcactctctcagctaagccactctctggaaaatgaactgaaaggtgctgaagactcagaatttcctctgaaggaaattggaaatgaaggtctcacaaaacggattctcagaaaaggagtcacttggcaaactccattctctggagatgaagtggaagttcatttcaatggacaagttgaaaacggagcatctcttgaatccagttatgataaagggtccccgtttcgtttcaaactaggccaatgtgaagttatcaaaggttgggatgaaggagttgccaccatgaagaaaggggagagagcaatcttcaaaataccacctaacttggcatatggggaagaaggatcccttccattgattcctcccaatgcaactctcatttttgacattgaaatgctgtcttggagtagcataagggatttgactggcgatggaggagtcaagaaaaagataatacgggagggagaaggatgggcaactcccagagaagctgatgaggttctagtgaaatatgaagcaagactagagaatgggatgcttgtctccaagtctgatcagggtgtggagtttaatgtaagtgatggctatctatgtcctgccatgagcatagcagtaaagacaatgagaaagggcgaggtggcagaactagctatgagattctgttacggactcagtcaaaattcaagtagaatcactgagctagaaggtgttcttccaccagattcaaatttaactagcatcaagcttgagctggtatcatggaaaattgttgctgatgtcacaggagataagaagatactgaaaaaaattaagaatttgggtgaggggtttgatcgccctaacgagggatcccaagtgaaaggggaagatggtacgattattgagagcaaaggatcagaggaagaaccttttgagttcacaactcaagaagaacaggtacctgagggtctagaaagagcaataatgacaatgaagaaaggagagcaagctctggtaactgtggatgctgaatatttgtgcgactataataattcaaagggaaacacagctaataataaagtcctttattatgaagttgagttggttgatttcgttaaggaaaaaccattttggaaaatggatacacaagagaaaatagaagcttgtgagaggaagaagcatgatggaaatctgctgttcaaggttgaaaatttcaggcacgcatccaagaaatatgaaaaggctgtaaaatacattgagtttgatcactcattcagtgaagatgagaagtgtcgtgctaataccttacatttatcctgtaatttgaacaatgctgcctgtaaacttaaattgggggagtacattgaagcttcaagactatgcacaaaggtcctagaacaagaccctttaaatataaaggctctttacagaagatgccaagcatacttgaaaacatcagacttggagaaagctgaggctgacattaaaagagctttgattattgatccaaataacagagacattaaacttgagtacaaagagctgaaacttaagcaaaaggaatacagtagacatgaagctgacatcttcagcacaatgctttcaagaatgaactag

SEQ ID NO: 50819 - DNA, 207 bp, Glycine max
  Peptide Sequence Number=SeqID_167597
atggagcattgtagatctggtgttttcgtgatgaaggatagtaggggtgacagtggagagcacaatgtcacgatgatcttgtgccaccatgatgaagcacacaaccttaggcagagaggcacaacaaaacacaaggcaggtcacgagagtttacaatgtcaccaaaaaaaggagcgcaagagaggggtttgcaaagagttagggtga

SEQ ID NO: 50820 - DNA, 444 bp, Glycine max
  Peptide Sequence Number=SeqID_167598
atgatgtcaaattcagtaaataaggatactaccaattcaaaggcacccccaatgccattgccaacattacctcttctcttggtagatgataacaatgcttgcattgatctttcaatgggagaggagaaagtagttaaactgtctccattgtcaccaaagattttagtgtatattgattggtctcagaagcttctggagaagtatgatactcatacacttgagactttgcctgaagttttaaaatatggacctgtaaccaagaaagctcgtactgaacctctctccttgtacacctgcttggaagcttttctgcgtgaagaacctctggtgcccgaagatatgtggttagttcatcctgcagctcactctattctctcttcatatctttctttctcatgcttagtaaccattcaaatggaatgtacattaataattgtgagctag

SEQ ID NO: 50821 - DNA, 1656 bp, Glycine max
  Peptide Sequence Number=SeqID_167599
atgacagaggtgttgatgtgtatcgccagtgtctctgagctgagtccagacgaggagaggatcttgatcagagacattgctctcgcttcccaagctaacagcaaagaaggcgacaccttcttcttaatcactcagaggttgcaaccaacaaaggttggttcagttggtaaggaaagaactcttatcccacaaggactagggttcgattcccattgccaatgtgaagaccttgttggtagaaaggataaaaactttacacttccgcaaagtataggtcttcatatgctcactgcctataatcaaaatcataagaaacagcttccttgtatgtgcctttcctcccaatgtgcccctaaaactggaaacaaatggtggcaacattggattgaatatgtgaaccaagaccagacaaatacttcatatgatgcatcttccttatcagaacaatttgatttggccaattcaagtgcattaaagaggccagctggtattgataattctgatttgatagacgatgctgtgttagaggactctggtacgggtattgagattcatgatacacttttagaaggccgtgactatgtattacttccccaagaagtttggaaccaattatttagatggtatggtggtggacctacattggcaaggaaagttattagttcaggtctttcccagactgaattggcagtagaggtttatcctttacggcttcaattacttatgttgccaaaaaatgaccgtttccctataagaataagcaagaaggaaaccattgggcagcttcacagaaaagcttgtgaaatatttgatcttcagccagaccaagtgtgtatttgggattactatgcccgtcgaaggcatgctttgatgaatgacatggacaaaactctcgacgatgctaatttacaaatggaccaagatattcttgttgaggtcatcaataatacaaacaacacaagttttgctcaagaaaatgggtctgcacagagggaagcaaattccgctcttgtggagccttcaaaatcaagcttatcaattgctggtggcttatctgctagcagaggtgcatctaaaggctacaacacagacctttcttcatctcagaacttaaattctccggttagagatgtggaaaacccttatggaactagtggtgtcaccacaagaagttcattccttggtctcactggattgctgaatcttggcaatacttgttacatgaatagtgcaatacagtgccttgttcatacaccggaatttgctaggtacttcagggaagactatcaccgagagataaattggcaaaatccattgggcatggttggtgaactagccctagcatttggtgagttgcttcgaaaactatgggcacctgggcgaacaccaattgctcctcggccttttaaagcaaagcttgttcgctttgcacctcagttcagtgggcacaatcaacatgattctcaggagcttttagcatttcttcttgatggtcttcatgaagacttgaatcgtgtaaagcacaaaccatatataaaatctcgagatgctgatggccgacctgatgaagaagtggctgacgaatattgggcaaatcatattgctcgtaatgattccataattgttgatgtatgccagactcagttaatggcttaa

SEQ ID NO: 50822 - DNA, 360 bp, Glycine max
  Peptide Sequence Number=SeqID_167600
atggagatagagaagagcactaagggcagtgcggaaataggagagaaagaagagaagaagaagaagcagcatcgacgaggaggcatcagaacattacctttcattcttgcaaatgaagtgtgtgacagatttgcaagtgctggttttcatggtaacttgataagttacttgacccaagagctgaacatgccattggtagctgcctcaaacacactgacaaactttggaggaacatctagcttcacccctctcattggggctattatagcagattcctttgctggacgtttttggaccattaccgttgcttctctcatttatgaactggtctcttaccctctcctttccaatttaatctaa

SEQ ID NO: 50823 - DNA, 355 bp, Glycine max
  Peptide Sequence Number=SeqID_167601
gctattgggttgtttccttgcattcaaagtgaaggtgcaaccaaggttcaggaattctgttgttcttaaatattcagatgaatcagagttgatcaatgttgtgctagatatgattcccgatagtgagccatgttgcaagatcgagaattcaatacttgagtcgaccgatcctacagtgcttgaatctcaatctctgtctattactattgatcatgatcggtcaatgcttggctcaagtgagcctacaaagtttgaatctcaatctgtgtctgttaccgaggatcatgaccctcttctcaggattccattgacaccaactacgcgcgtatcttctgatgagttggataatgagtga

SEQ ID NO: 50824 - DNA, 243 bp, Glycine max
  Peptide Sequence Number=SeqID_167602
atgtggcaattttctaagaagggtcacaccagtaatttaacacatcaaaatgacaataaacccagcaaaagggacaggtggggatcgattggaagcgagacgacgtctaggagtgggcagcggcgcaacaaaatgggcgaaggcatctcaaactgggatgtgacaacaacgcaccggatgatggcgacaaacatagctattgatctgtttgtgacaagaagagttgttgtattgtttgcctga

SEQ ID NO: 50825 - DNA, 629 bp, Glycine max
  Peptide Sequence Number=SeqID_167603
gtagagacgatgaagcagatcgacccggcggatctgtaaaccccgcgtcagcggggatgcagcaagcgccaaaaggcgtcgatcagcggatcgctgaggcgctttttctggacgcagacccccagctcgaacggttcgaccatcgagatgttatccagctgcgagatgcggttgcgtaccggctccgggctgttgtccaccactacgctcgggatcagtgcgatgccgcagcccaaagcgaccatcgacacgatggcttcgtggccgccgacggtggcgtaaatcagcggattgctgatgcggtggcggcggaaccacagctcgatgcgttttcgcgaagggccgtgctccggcaggatgaacgggatctcggcccagtcgggcctgtcggcgaacgcctggctgcgcaccgcgcagggcagcgccggcgcgatcagcaccagcgggatttcgccgattttggtgaacgccacgctggcgggcagcgtttccggccggccggcgatgccgagatcggcctcgttggattgcactttgtcgaccgcgtcggcggcgtcgccggtggtcagcttaatctccaccagcgggtgctgcgcgcggaagcgatcgaggatcggcggcaggtggct

SEQ ID NO: 50826 - DNA, 501 bp, Glycine max
  Peptide Sequence Number=SeqID_167604
atgaagaacgagttcatcaccgtggacgaggaacagccacttccagtccagcgccaccacttcgaccaccagcggcttggtgccgggaggaacctcgcggccttcggacaggcgcgccagcggccggtagggatcgagctggtgggtgctgacccaggtgagcgcgcccagcgcgatgatgatcagcagcggcgccgcccagatcagcagctccagcatggtggagtggttccagtcggggtcgtagtgcgcgtcgcggttgctggcgcgatagcgccacgcgaacaggaaagtcaggaagatcaccggcacgatgatcagcagcatcaggccggtggagatgatgatcaggttgcgctgctgcagcgcgatgtcaccggatggcgagagcaataccgcattgcatccggagagcaacggcagggcggcgaacagcaacaatccgcggagccttgggaaagacggcatggccataccccgaaacgtaaccgtgggagttaa

SEQ ID NO: 50827 - DNA, 207 bp, Glycine max
  Peptide Sequence Number=SeqID_167605
atgttggtgcgcatgatccacactcgtctctttgcagtggcacgggtgaaaccttgccccggggtggcccaggaaaaggaactgataaagggaaatactggccccataaccgggagcgcaagtcttggcgaggatgtgcagccctctgaaggtgagggcatgcagctctctgaggatgtgtggtcctctgaaggcgagggcgtgtag

SEQ ID NO: 50828 - DNA, 462 bp, Glycine max
  Peptide Sequence Number=SeqID_167606
atggaggacaatgtggttgtagttgctgctactagcattgttgctggggtggacccaactcccctatcaggcctcaatcaagtaaatcatccagcctcagatatggtagggcaaggaggcgaaacattaggaaggaggacacatgaagtaccccaccacaatctagctaacttcgagcctcgcctcggatacacccatgaggggcaaacaattggtggtgtacccctgccaaacactttggagggttctcagtattacctacaactaaaacccttgcattttgcggtgggaagtgtccctcctgctatgacggaaaagggaaagtttgatcatatagaggaaaggctcaaggccattgaaggaggcggagattatgccttcgttgacatcatagagtggtgcctagttcctgatgtcatcatcccttcaaaattcaaggtgcccaattttgataagtactag

SEQ ID NO: 50829 - DNA, 561 bp, Glycine max
  Peptide Sequence Number=SeqID_167607
atggaagctgaaaaagaacgcagcaaatcatcacatcctagtaaggagaaaggcagtaggaaggaagctgaaaggaagcgccaggaaaaaagaaaagagaaagataagggttctagtaagagcaactctgatgtagaagaactggatagaagagccagcaaggaaactgatcggaagcgtgactttgacaaaaagagtgaaactgaccgtagagagcatcagaaatctgggtttgaaagtggcaagggacagaatacagataatacacatagtaaaaatgttgctgcaaacagttacaaccgtggaagtactggaacaaggtaccttgatcgtatgcgtggtacaattttgtcttcttctaaagcttttggttttggaaagggtgctaatgctcctggcactgtggtgaaagaaaataaatttaatggttctgtagatcatattcattccacttctagcaggaaagatatatgtcctcctgatcgttcaactgctagatccaatttgaatggagacgataggaatataaatcactctctggcttggttgaagtgtgattga

SEQ ID NO: 50830 - DNA, 669 bp, Glycine max
  Peptide Sequence Number=SeqID_167608
gtacgacctttgtaacttcatggtatactcatggattggcaagttcttatttggaaggctgcaacttcttaaccgctgcagtctccactcctgctaatagtttagcacactctttgttgttactgtggggtcctgaagcacagggagattttacccgttggtgtcaattaggtggtctgtggacttttgttgctctccacggcgctttcgcattaataggtttcatgttacgtcaatttgaacttgctcgatctgttcaattgcggccttataatgcaatcgcattctctggtccaattgctgtttttgtttctgtattccttatttatccactgggtcagtctggttggttctttgctcctagttttggtgtagcagctatatttcgattcatcctctttttccaagggtttcataattggacattaaacccatttcatatgatgggagttgctggtgtattgggcgcggcactactatgcgctattcatggtgccaccgtagaaaatactttatttgaagatgtaactggtttatggatgagtgctcttggggtagtcggtttggccctgaacctacgtgcctatgacttcgtttctcaagaaatccgcgcagcggaagatcctgaatttgagactttctacaccaaaaatattctcttaaacgaag

SEQ ID NO: 50831 - DNA, 635 bp, Glycine max
  Peptide Sequence Number=SeqID_167609
gtctctttgtatgtgttgtctggaaagaggaggactcaatgattattcgttcaccggaaccagaagtgaaaattttggtagatagagatcccataaaaacttctttcgaggaatgggcaaaaccaggtcatttctcaagaacaatagctaagggacctgatactactacttggatctggaacctacatgctgacgctcatgattttgatagccatactaatgatttagaggagatttcccgaaaagtttttagtgcccatttcggccaactctctatcatctttctttggctgagtggcatgtattttcatggtgctcgtttttccaattatgaggcatggttaagtgatcctactcacattaggcctagtgctcaggtggtttggccaatagtgggccaagaaatattgaatggtgatgtagggggagggttccgaggaatacaaataacctccggtttttttcagatttggagagcatctggaataactagtgaattacaactctattgtaccgcaattggtgcattggtctttgcagccttaatgctttttgctggttggtttcattatcacaaagctgctccaaaattggcttggttccaagatgtagtatctatgttgatcaccatttga

SEQ ID NO: 50832 - DNA, 642 bp, Glycine max
  Peptide Sequence Number=SeqID_167610
atgggttctccacctgcctccagtcctcctcctcctcctcctcctcctcctcctcctcctcctcctcctcctgctccttctcctcctcctcctcctcctacttcagacacatcggcttcgacgtctaccgtgaagcggacactcaaagccttacgtctaagatcgttgtccactagaccacctggtgttgagagaccagtggtgaatgctgatcctactatagagaaggctgacggtccccacaaaaaaaaattaagaacatatttggggattgtggcacatgataaggtggacatcacctacgagaactggaaggaggcggaatttgatatcccagaggcttctgacagtaggacgaaaaggagagatggaggcagtttaaatcagacctcacgaggaaatgggcccttacagccgattaggacggtgtcgaggacactttctgtgaccaatacggcatcagatttgcgcatcaagacacaggccatccagaagcagaatactgccccccacgttttgtctcgtgggggttatgattatttgaagcagaagctcctggatgagaagaccaagaagaaactgcacagtcaggaagtgttgatggcgtcatcgacactctatccccagtcagacgccatgtga

SEQ ID NO: 50833 - DNA, 225 bp, Glycine max
  Peptide Sequence Number=SeqID_167611
ggaatagaagagaagactgccaagttgaaaggaagtgagaaggctctagttgcacggcatgaagctagtcatgctgtactaggtactgcagtaccaaaccttcttgctggacagccacatgttgaggtgtggactttggaatatcttattttagaattcatttatcttgtattatggtgggaaattaaagaaaagtataaatctgttatgtgtgatattcaatga

SEQ ID NO: 50834 - DNA, 342 bp, Glycine max
  Peptide Sequence Number=SeqID_167612
atgcctttctatgaagggtcgcaaagatatgccaatcctcaatcagaatcaagtttcaagaatcaagattcaagaataatcaagatcaagattcaagaatcaagagaagactcaatcaagataattgttgcaacctacccttcgtcgggagggcgacacgagactcaagggtgcatcttccaagaaaggaaaatacgcggagtcaccaccaacgtttattcgaggaaaacatcaaaaaactggaaaaggtgtggtctacgaactttaagtgtgaaaggttcgggagttgtttttatacacggggaaggtattagcaccccacgcatccgtcacaagggatga

SEQ ID NO: 50835 - DNA, 435 bp, Glycine max
  Peptide Sequence Number=SeqID_167613
atgttacctccacccaagcataagcttttgctaaagttgtggatgataccactatacgtagggtcattagtgatcttactaacactggtcaggacttgctccattgaactatgcaccctccactgttgtaaccatagatcaggtgcaagacatgattggtcaagccatgggatcatttgcaaaataataatgaaaggaaatgagcaattcaggttctctatgcaaaaccttatcactacccaattttctaaccttggtgttgttcttcttcaaaaccttcaacaagctcatatgtctatgctaagagttgttgttgaacctacacccatgcctatacctatacccctaatacttgagccaacaccatcttccattgaaccaacacctccacctccaactactcaacctccaccacctccaccaattcaagactga

SEQ ID NO: 50836 - DNA, 456 bp, Glycine max
  Peptide Sequence Number=SeqID_167614
atggagaggagtatgattaatgctaccagtggtggagctcttggtgatatgacccctattgaggctaggaatttgattgagaagatggcttccaacccccaacaattcagtgaaagaaatgatgttattgtccttagaggagtccatgaggtggtcacagattcatcttcatctactgaaaataaaaagcttgagggaaaaattgatgccttggtcaacctacaatctggagtcaatgagcaacctgaagcttatgctgcaaacattcataatagaccccctcagcagcaaaaccaacaaaataattatgatctttcaagcaatagatacaatccaggttggaggaatcatccaaatctgagatgggcaagccctccacaacaacaacaacagcctgtccctcctttccagaatgttgccggtccaagcaagccatatgttcctcctccaatgtag

SEQ ID NO: 50837 - DNA, 315 bp, Glycine max
  Peptide Sequence Number=SeqID_167615
atggggcgcccgttccccccagcaagttcatgtcgtcgtggcatagttctagggagtgcctgtcgcccccagcaaggtcatcaggtcccccctaccaatcgagctttcatcaagaagttctgcgtctccaggcaggcgcagggcgaaacaccacagcagcctggcgatggccggcagcgggcaacagacgcaccgccatcacctctagagttcacctctgctcatccacaaaaaggtttgagtattgcctacaccacatggccgaccaataggcgaccaagtccaaagccaaaggacgcacctagttgctcatga

SEQ ID NO: 50838 - DNA, 421 bp, Glycine max
  Peptide Sequence Number=SeqID_167616
tgaagaaatatgcccccaagaagaaggacaacctttattggttaagaagaagtgtaaggagacacttgttagcactcccacacctcttgggcttgaggttattattcaagtaaagaagttgatggatgagggtattgttatgcaccaaatccctaagataagtgatatgatgaatgtgttgagtgttgcaaccatcgtttgtaaaatcactcatgcacccaacatcttcataattcatgtacacagggactcattaggggttcccacggaccctaagagaataaaggtcattcctgattggcccactccaccaagggaagggatgatgcaatcctaccctcaaagggtattggatagaggattccaagaggattgggctagagctgctaaagaaggccctagggttctcatgaacctcagg

SEQ ID NO: 50839 - DNA, 159 bp, Glycine max
  Peptide Sequence Number=SeqID_167617
atggcctggaagaataggcatatcaggtgggtttatgtatcaactccaatgattctgaaactccacaagttagtgaagcaacaatacaggatagaagagaatttttatgttagtccattagcattcaaagctagccattacccttttgagagtttttag

SEQ ID NO: 50840 - DNA, 207 bp, Glycine max
  Peptide Sequence Number=SeqID_167618
atgacacatttgttgaagcatatgttccccaacagccggtggcagcaacgactatggacaaagcacttgcagatgcacatgctgatgcagagcagcctcaacatacagcggtcagaaaataatattgtagatccgtgtacaaaagggttgatgcgccaacaagtacttgagttatcgaagggaatgagactagagttcattatttag

SEQ ID NO: 50841 - DNA, 324 bp, Glycine max
  Peptide Sequence Number=SeqID_167619
atgggagatcgcttggaggatatgattcatgatcttggacaagagtctttcaacaagcacatgctcctttacactgagtttgaagaaatgcacaaatgccctaggtgtggggtatcacagtacaaagtgaaggatgatgatgagtgtagtagtgacgaaaacttaaagaaaggccccctagaaaaggtgttgtggtatctttcgatcattccaaggtttaggcgactgtttgctaaaggagacgatgcaaaagaccttacatggcatgcaaatgggagaaactatgatggaatgcttcgtcatccagctgattcctctaagtga

SEQ ID NO: 50842 - DNA, 381 bp, Glycine max
  Peptide Sequence Number=SeqID_167620
cttgggaggattgatggggacccggggttgagaaaaacgaggatatgggctacgtgggagtacgtgagctcagttggaggtgggcaacaggggatgagtggtaccaggagatatgtcgcgagggtcaggagaccttggggacgtcaggcgagctcctggcagtcaacagataaaaggaacaaacaccacaaagcaaggaggcttgtgtggtggctggccagctgtgaactttgtttgatatatgggatatgggctctggtaatcgattaccaaggtgtcgcaacctacccttcggcgggagggcgacgcgagactcgcgggatgcgtgttccacgaatggaatacgcgcggagtcgccaccaacgtttatttgaggaaaac

SEQ ID NO: 50843 - DNA, 252 bp, Glycine max
  Peptide Sequence Number=SeqID_167621
atggattatgcaatcgtcccctctttggcttctggaatgttacgaaactttacggattgcgcattaatgcttcctttcgactcccgacatgtcgtggaacttcacggattgcctaacgatgggtgtcaagtacctcgaagtggtcaagcaaaggtcgcatcccaccaaacagatggtccccggatgaaattagggtatgacacaaggatatactcaaggaggattttcaggctttcagcagggtccttataa

SEQ ID NO: 50844 - DNA, 444 bp, Glycine max
  Peptide Sequence Number=SeqID_167622
atgaagaacagtggaaaaccttcgcgaaatcgcccatggaaacgtcttggaagcgttacggaagcgcctcggcttggattttcttcgctgaaacaatttttctcactaattttaagtgattctcatataccaggagggttgaacattttgttctgccctccttcccctatttataggggaaaagagggaggtggttgccgcccagctcgcctaggcgagctgggttgcttccaccagaaggcaccgccttctgttggaagatcctggaaggcccaaatgtcgtaccggatgtcacgacatcacgcttcagaacatgcagattatatgtgtccgtatgaacagattaaacaagtaaataacacaagagaattgtttacccagttcggtgcaacctcacctacatctgggggctaccaagccagggaggaaatccactctcaatag

SEQ ID NO: 50845 - DNA, 213 bp, Glycine max
  Peptide Sequence Number=SeqID_167623
atggagaaaataattataatgtttgttttcaaggctcaggtaaccatcacgaagcttaatgaggagaggcgcaggaacactcaagaaaaagatttactactgcggcaggaggaactggacaatttgttgttcagaatttctcaaatttctccattgggtgttcattcatggcttttggaagatgcaataagcaataaatatttacttatctga

SEQ ID NO: 50846 - DNA, 225 bp, Glycine max
  Peptide Sequence Number=SeqID_167624
atgaatgctttgggtggtgcaacactcttttctaaaatcactcgtgcacccaacatcttcatgatttgtgtacatagggactcattaggtaggaataatcaacatgaaaatacagaaaaaggggttcccatgaaccctaagagaataaagttcattcctgagtggcccgctccaccaagtgtgttgaggaaaaaagcccagagtttcaagaacctcgggatttga

SEQ ID NO: 50847 - DNA, 273 bp, Glycine max
  Peptide Sequence Number=SeqID_167625
atgaagtcaatcaaagagggatatgttaactctaagtattatcacatggtggtgaattggaagagaagacggaatatgctactaggtgtagacgttgatggaacgtgggtaaaagaatcaagaagagcgaaagagttttttgaagaaagattcaaagaaatgcctttggagagacctggcttagaaggtgtagagctccaaaagattaacgaggaggacaacaatttttttatctcaaattatgaggaatatgaggttaaacaagtggtgtga

SEQ ID NO: 50848 - DNA, 178 bp, Glycine max
  Peptide Sequence Number=SeqID_167626
agctgttgctgatcagttggaaggcaatgaggaggaacatggaaagtaccgcagcatggtggtgaaacacatattggataaccgggagatgtttgaaccctttatcgaagatgaagtcccatttgatgaatattgccagtctatggaaaatgatggcagcttctcttgtaacgcgtag

SEQ ID NO: 50849 - DNA, 261 bp, Glycine max
  Peptide Sequence Number=SeqID_167627
atgaatggctctagaacagtggcctcagatgacgtatcctttatatgctgtggtacctgggctgtgggagcttcatcttccctgagctgcagatgtggaaagaagatcagctggcctcgccttcgccctcctagcccctccaataaaaactgtcagatcatcaagattccaatagttcttcctgatgtaggccaagttaatgactgggctcaggcgctcaaaagtgaggttgttagagacaacccctctagctcgacatag

SEQ ID NO: 50850 - DNA, 363 bp, Glycine max
  Peptide Sequence Number=SeqID_167628
atggcactgttctattcgagaatatcgccctcaaagactcccaggtttgcgcctccgtggtcggcgtcgtgctggagaaccaacgccgcgatcgaatcgccatctgggttggacaggtttgattccatttcatctgggtcgggcttctcttgcggagttttgaagggtagtgatcgggttcggtgttggggtgttgggtctatagccagaaaaatggagaaggaagtaacgactttggtcaaattgatgttcctaaaggaggtgctttggagttttctggtttggcacttggggttgagcacacttgatgttcccaggattggttcaaggccaaaaccatcgcgaggaggcccttaccaatga

SEQ ID NO: 50851 - DNA, 729 bp, Glycine max
  Peptide Sequence Number=SeqID_167629
atggggaaaattcttgctcgtgggcacagccgagttcccgtctattctggaaatccaaaaaacattattgggcttctactggtcaaaagtcttctcactgtacgacctgaaacagaaacacccgtcagtgctgtttccatccggagaatcccacgagttccatcagatatgcctctttatgatatactgaatgagttccaaaagggcagtagccatatggctgctgttgttagggctagggggaaaggaaaaacaattcctgaaacaactgatgaagagacatatgaagaaaacaaaggggttggtggggattcacaattgactgctccattactacagaagcagaatgagaagtcggaaagttttattgttgacattgacaagttttcaaggtctccaagcattaacaaatcaactggtttgcaacgtagtgattccacaagaaatggttccttttcagataatattgaagatggtgaagtgattggtattatcactttagaagatgtatttgaagaacttttacaagaggagatagtggacgagacagatgaatatgttgatgttcataagagaatacgtgtggctgcagctgcagctgcttcctctgtggctcgggctccatcaatccgaagattgactgcccaaaagggagcaggaggtcaaagcaagccagggctaactctgaagaaatctgcagaggatggatcgaatacaaggtcacagtga

SEQ ID NO: 50852 - DNA, 537 bp, Glycine max
  Peptide Sequence Number=SeqID_167630
atgtgcatatctgtaatatttacaagattcatagcaaaatttggggctggcttgtttttattgattcaagtgataattttacttgactttactcacacttggaatgatgcatgggttgagaaagatgaacaaaaatggtatattgctttacttgctgtatcagttggatgctacattgcagcatttacagggtcaggaatccttttcttttggttcaacccttccggatatgattgtagcctcaatatcttcttctttgtcatgaccatgattcttgcttttgtgtttgcaattattgccttacatcctcagttttggtcagggatattaccagcaggtgaatgggagcttgttgccttctgctgtgatttctctttactgtgcttatgtgtgctctacacggggctttctagtgaacctcgtgactatgagtgcaatggtctcaacaagtccagagcggtcagtacaagtacactcgttcttggcatgctaacaacagtgctatcggtgttgtattctgctcttcgggctggatag

SEQ ID NO: 50853 - DNA, 2022 bp, Glycine max
  Peptide Sequence Number=SeqID_167631
atggagtgtgtggcgaagatgacgaaggtggtgcagcagaaggatgtactccaatttgactccgcgggagagtctcttccctccctcgaactcgccgagttcttggtctcttacatttgctgggacaacaatgtccctattctatggaagtttctcgaaaaggcattgacgcttcagatcgttcctcctatgctcctcctcgctctcctttccgtcagggttattccatgtagacatgtccaacctgcagcgtataggctatatttggaactcgtcaaaagacatgcttttgaacttaaatctcagataaacaggccagattatcaaaaggtcatgaaatctattgatgctgttcttcatctttccaacatatttggcatgtcacaaagtgagcctggcattctggtggttgaatttattttttcaattgtctggcagttacttgatgcatcattggatgatgaaggtttactggaatttactcctgacaaaaagtctagatgggctacactatatcatgacatggaactggataggcatgataattatagtgaacaaaggactgaacatcatgagaaattgcaaaatgcaaatacacttatggctgttgagatgattgggcagtttttgcaggataaaatctcttcaaggcttctttacttggctcgccaaaatttgccggcacattggcttagttttactcagcggctgcagctgctgggtgaaaattcattagcattgagaaaatcaagaactctaagtcctgaggaacttttggaattgacttcagattcttgtatggtcttgtctcgggaatgcaaaacaaattcacagaaaaagttccaaacagttatgtcttttgaatatctttcttcttctgcctcactatgtcatggtgcaagtcattctgctctctggattcctcttgatctggtgctggaggattccatggatggctatcaagttagtgcaacaagttctattgaaacaattagtggtttgataaagaccctgcgagcaataaatggcacctcttggcatgacacttttttaggcctttggttagcaactcttcgtcttgttcagagggaaagagatcccattgatggcccaatgcctcatcttgatactcgcttatgcatgctcttgtgtatcatacctcttgttgttggtgatcttattgaggaggaggaggaaaggacaccagttgatgaaaaagacagtggacttacagattgctggaaagagaaaaaagttgctggaaaatgtcataatgatttagtctcgagtctccaggtattgggtgattatcaaagcttgctcactccacctcaatctgttcttgctgcttcaaatcaagctgctgcaaaagcaatgctatttgtttctggcatcacaatagggagtgcatattttgactgcctcaacatgacagagatgccagttgactgctctggaaacatgcgtcatctgatagttgaggcttgtattgcccgcaatctactggacacatctgcatacttatggccaggttatgtaaatggatgtatcaatcaaatacctcagtgtatgccagctcaagtacctggctggtcatcatttatgaagggagccccacttacttcagtgatggttaatgctttggtttcaagtcctgctacaagtttttctttttctttcctgaagccaggtatgtcagatgctcttttttgtaaatttaccaaaagcttagcagaactggagaaaatttttgaaattgcaattgggggatcagaagatgaaaagatatctgctgctgccattctttgcggggcatccctaattcgtggatggaatatacaggaacacactgtacatttcattctgaggttgttatctccaccagttcctgcagaaaacactgaaggaaacaactatttgattaattatgctccaatactgaatgtactctttgttggaattgcatctgttgattgtgttcaaatattttcgctccatggcttggacttagaatttatataa

SEQ ID NO: 50854 - DNA, 213 bp, Glycine max
  Peptide Sequence Number=SeqID_167632
atgaggtggaagtggggaggggaggcagtcaaggacgaggacgaaggcgacgtaagagaggaaggcgagagggatggagtgttcaaagttatggaggtgattggaggggatggtgaggtcagggtcaaaggctgccatgatgaggaagagtttaaggtacttgtctttggaggttgggaaccatggtggagcagtgtagaaggttggatttag

SEQ ID NO: 50855 - DNA, 972 bp, Glycine max
  Peptide Sequence Number=SeqID_167633
atgcaagaggagaaggtgacattgagcatgagcatgagcatgagcatgagcatgaacagagggatgatggttcactgcaacaacaataacaatgtcaacaacactaataatgtgtgcaactgcaagcactctccctccgccaccttagaccttctcatcctcctcctagtcctcttctccggcgcgttcctcctctcctcctacctctgctacatcttcaactccctctccctcctcctcccctcggtgccgctctcctacctcctccccttcctcctcttcttcgccctctccctcgccaccgccgacttctgctgcggcgcccgatcccgccgctgccagcgccagggctgcaagggcctcaagaaggccatggagttcgatttgcagattcagcgcttcggctcctccgtgccttcctccgccgaaatcgataagctcccctggaagggcggcactgaggccaaccccgattacgactgcctcaggtccgagctgaggaagatggctccccctaacggccgcgcgcttcttctcttccgggccccctgcggctgccccgtcgccaaactcgaggcctctggtcccaaaaaggccaaacgccataagagtaatggattcttcgagtgtttgattttccagtttgtggatatctgtttgccttattcaggattttatttaagtgaaagatctggctgggagactatctcccagtcccagggaagttttctctggttcggtcttccttctgttttttcagcctctgccgtcctcgacagttctgcgtggttattgggtgtcccaaatatcactcaggtggctgcttgttttgtccctcaccagtgtgagatccacgcactgcctaaccaaatcttgacagtttctgatattcagtttggtttggcagaggatcttattgattgtctaattagaattcctgctctagaggcaagactaggaactgattcatag

SEQ ID NO: 50856 - DNA, 348 bp, Glycine max
  Peptide Sequence Number=SeqID_167634
atggtgatgatgacgaggaagcgccggcgcatgacggcggtgacggcggcctgccggaggggtcagcaatccgctgcaattgaggtgcgtgtgcaagcggtggaaatccctagtggtggatccccaattcgtgaagaagcatttgcacacatcgctctcggacatcacggatctcgcgtccaatgccatggaggacatgaacgcgtttcaattgtagctcaattatgcccctgccttgacatgaacgagttggctcagttggataacattttggtggtggttcgatcgctgaaagggagcttggaaatgattaaggttgacgtgcaagcgatcaaggagagagagtga

SEQ ID NO: 50857 - DNA, 593 bp, Glycine max
  Peptide Sequence Number=SeqID_167635
gatatagttattgggattacattgacgcctggaccaatgtgttctggcatcaaaatagtaaattcaagcattcatggctaatttacttcaaaaataacaccgtgtataattttccaaattggttcctccaatggtggaactacttcagaccaattccacagatatttccacaagaagtccaacagggattccaacaattcagcaagctcttcaatagcaaggaatcaagaatttcggcagatttaaaacatgcctttgtaaaatggtggtcacaattcgatacctcaaaggctgctccagaacaagtcaagaactggtttcagagcaaccctgagtttctcaaacctgctgatccagagacatctttgtttctgaatcagaagtctcaacttgcagcattcttggcaagctcaaaatctaaagagagtcttgctcagaatcttaaggaagttctccaactacttcaacaggaagaagaagaagaaccccccaagaaggaagccgaatcatccgaaaataatgatgaccaagaagatgatccattctaccagaatgaggatgactgttttggcatatcgttagacgatgattag

SEQ ID NO: 50858 - DNA, 890 bp, Glycine max
  Peptide Sequence Number=SeqID_167636
ctattgagaaagaactggaaactgcgatattcatggccggtggtatgcgtgatagtaattttggggacttgaacaaagtgaaatggggccggagtagcagaactgataaaggagtgcattctctggcaacaataatagcttttaagatggaaatccctgagaatgcatggaaaggtgatgactatggcattgcacttgcgaaccgcattaactcttatcttcctaatactatcagaatttttagcatactgccttcaacgaagagatttgatcctagaagggagtgcaatttgcggaaatattcttatctcctccctgctgatataataggaatccagagtcattttagccaggatgaaattgattttcatattttggagttcaacagtatacttaatgtttttgagggagagcatcctttccataattatactgttcggtctaagtacaggaaaaaataccaagtaaggcaatcatctggaaatgatggcatgccagatagaataggatcatctagtttggcatcagcttgtgaatcagagagtgaagaaagtgatgatgatgatgatgatgattttgtgagtggcagaccaaccacattaagtgacaaagaagagagccacaagcctccagagtctagtgaatccaatggcttcagtagtcaaaactctactgtagtagttcgtgcaaaatggctatatgaaccagatgagacagatagattaaatgcttctcatttcagaaaggtgtttcgttgttcttgtgggaagttggaaacatctcttgggtatgactatgttgaggtccatgtatggggggactccttcatgttgcatcaatttgactatgataacagcaacctaggaggtcaaactcttaaagttatgtga

SEQ ID NO: 50859 - DNA, 408 bp, Glycine max
  Peptide Sequence Number=SeqID_167637
atggttgggactgctgtggctgtaaagcgcaacttaatcccaagagatgccattttgttgtcactctccaagttttcgcggattgtcttcccccttgcccccccagaagttctgattttgaggggaaatgctttcaaaatgagagcaagtgctggaaactttacgcggcaagaaatggtgtctatggttgaatcagaaccaattctcaaagcagctgacgagttctacacgtctgttgtgttgcctgaagtgtcaaagttcctagactcatcaagctctccttgggcaaaatgggttgagaatttggataagtactcaagcattccagatgttgagttggatgaagtcagaaaggcttggaagacttggaaggaaaatttcagggtaaagtcagaatcagaggcatag

SEQ ID NO: 50860 - DNA, 195 bp, Glycine max
  Peptide Sequence Number=SeqID_167638
atgggtttatggatgagattcttggagttggtttcagaaaaaggaagccaactgtggtcggagatagagctccaaggcagtgctagggaccaagtttcaacagtggagaagaggaagagagaacctgaacctgaatctgaatttgaatttgagggtgttgccgcttggaaacaagggattatttgcttgaagtga

SEQ ID NO: 50861 - DNA, 892 bp, Glycine max
  Peptide Sequence Number=SeqID_167639
atggctgcaactgcaaccgcaaaaaccaacaatgacaacaaccctgaaataacaagggaggaaatccaaactgccatagccaaagcagtggaattaagggcccttcatactgcattaacacaaggaagtagtccaggcacaaacaatgctagatttccgtcaccttccccggcttctcacttctctgcccaagactaccctgttttcacaccaagttatgaagatgaggcacaccagaacccaacaaggagcagaacaatatcagaaagctgggatgagaatggggtagaaggaaggaacagcatggccccctcagattacaaggagaaattaaattcaagaaaggaactaccttttggatttggcaaccttgacactcacatgtgtcctgctgatgatagcaaatctgtgactggttcttgtgcaaatcacattacttttctccaaacatcgccggcggcagtggcgaatgactacttcaaatccaggaggagaaacagtctgggggatttgaagcccttatcttcctgcaatagatgcaaccctgctgtcataactagtgaatatgagagcactaggaacaacaagagctccaacattgttgtccccctcacagactctcatgtctcttttcaaacccaaccaaaaagtaaaggggtgatttcatggctgttccctaggttcaagaagaagcataagaatgtgagttccccaagcagaacagaatctgaggaagtctcccaggttctcaaggacatggggatagtgtcagttgaggcactgaagagggaactgatggaggcaaatgagagtagagatactgccttgatggaagtttctgagatgagatcttcacttggagaactgaaacaaaagttggagtacttggaga

SEQ ID NO: 50862 - DNA, 1365 bp, Glycine max
  Peptide Sequence Number=SeqID_167640
atggacgacgaagctattgctaacgctaacggagctccgtcacctccatgtgtcgtttcggtgtctgcactctccggttcccgccgccgcctctcgacgagcttcctggagctgagccgccgccctgtctcgtcgtcggagaagctcaagcctatggcgtggatatctctccagggacggctcctcaacgccgacgaagccagctcggctcgaaccatctgcggcggcttcagcgccgaactagccctcgcttggaacctcttccctcccatccacaggttcctcgtagtcgcggtcattggcactgccgttgcacgctcccgaaaagaccttcaaatattccaactcaaaaactccgttcatctaagggaccaggtgctgttaaacatgcagcaaaagcttgatagtctttgcgagttggttaacaattctaaactacactcaaccaataagtcttgtgacaaggatggggaattgcaattaaatgagactcttggctctgggaaaattaactttgttgattgtggttgttggcattgtgagcaacactctgctttccttaatgaattaatggttgattctgttgcaagaacctctggtgccaatgaggtgcttcaatataagatgcccttctctaatgaagatcaagaggagcgaagaatgtctgacatgtcagattgggcttcaagtgtcacatcttctgctgatatccagttaaacaacttggctgtagaacaagatatttataatcttaggagggactgcgaagagaaggataccacaataaaggaactaaccaccctgttgaactctaatgaggttgctaagtgcaagaggattgctgaattagaagacattatacggaggaaaaatacaacaatttcaaaattaaagaaagacatgttggttttagaacaaaaggttgtgcaacttacaagacttcgtcgaccctctttctctactagtggctcaaatgacattcagctgccacatatcatgatagataaccttctttatgatatggagagcaccactagcccctcctcatcttctgattcggatagctcttctgtcatcaaagcacgggatcgtcctgctgatgttgtcctgaaccagaatttggcttccaaaattaatcagaaaccttcaccagcaaaagtatccagttcatcaggaagattttttgaatgccactcaaagtctcaatccgttagtcctcgtaaagaactttcaagtagccaaaaatctaatgcagcttcctcttcagcccaaaagctattgtcagctcgtggggacttaaaaaagaatagaagacgatctcttaatggagataagagtacgaccgaacataagagatgggtatag

SEQ ID NO: 50863 - DNA, 324 bp, Glycine max
  Peptide Sequence Number=SeqID_167641
atggagaaagcaattctcgagagattagaatggaatttcactgtccccaccccctatgtcttcttagttagattcatcagaacttttggtctcccaccagatcagcagaactttagccttgtgcactatgaaaccgcaaatttgtcccccccttcaatgactgccgcagcagctgtgtatgccgctcgttgcacactcaataggaaacacccatggaatgaaatcctaaaggacatggcaggctacaccacagcacaattaagagaattctgcactctagacaggggaaggaaggcattattatcgccaacgaaggatatataa

SEQ ID NO: 50864 - DNA, 839 bp, Glycine max
  Peptide Sequence Number=SeqID_167642
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatcacttgctgctattcgtgagaagatggcttacactgatgtacccaagcctctccaaggtctagggataaccttcatcacggtaggcttgatggcaatggcatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 50865 - DNA, 2127 bp, Glycine max
  Peptide Sequence Number=SeqID_167643
atggattcttctgctgtcgtgggtagcacaatttcagagcctcataatgatatggaatttgaatctcatgaagcggcatatgcattttacaaagaatatgctaagtctgcagggtttggcactgctaagttgagcagtcggcggtccagggcatcaaaagaatttattgatgccaaattttcatgtataagatatggtaataagcagcaatctgatgatgcaattaatccacgcccgtctccaaaaattggttgtaaagcaagcatgcatgtgaagagaaggctagatggtaaatggtatgtctatagctttgtgaaggagcataatcatgagcttttaccagctcaagctcattttttccggagtcacaggagttctgatccactaagtaatgatgttcgaatgcgaaggcggaagaactcaaatgcagtttctaaattatttactgcaaatcagaatgttgattgcttagagaactttgtgaaacatcaacatgataaaggacggagtttggttctagaagcaggacatgctcacttgcttcttgaactcttcatgcacatgcaggaagagaatccaaaattcttctatgcagttgatttgaatgaagaacatcgactaagaaatgtgttctgggttgatgctaaaggcttggaagattttacttatttttctgatgttgtttcttttgacacaacatattttacaagcaaatataaaataccattggtattgttcattggagtaaaccatcatattcaaccaacattgcttggttgtgcattgattgctgatgagacaatatatacttttgcctggttactgcaaacatggctcatagcaatgggagaacgaactccacaagtgtttctcactgaccaaaacgaggctattaaagcagctgttgctgcatttcttccaggaacacgtcattgtttttgtttgtggcatattttggaaaagataccaaaacaactggaatttctcggtgcgtggcatgatagctttttggaaaaatttaacaactgtatatacaaatcatgtacagaggagcaatttgataagagatggtgggagttggttgatgactttaaccttagagatgttgagtgggttcaatccttatatgatgaccgtacatgttgggtgccaacttttatgaaagatatttcctttgctggcttgtctactagttcacgctcagaaagtttaaattcattgtttgacaaatatatccaagttgatacttcattgagagattttatagaacagtatagagtgattcttgaagataggcatgaagaggaagccaaagcaaattttgatgcctggcatgaaacacctgacctgaagtctccttccccttttgaaaagcaaatgttgttagtttacacacatgaaatttttagaaagttccaggttgaggttttgggtgccgctgcttgccatcttaagaaagaaaatgattgcatgactactacttatactgtgaaagactttgaaaacaaccaaacttatatggtagaatggaacacatcaacctcaaatatatgttgttcatgtcatttgtttgaatataaaggttatctctgtagacatgctattgttgttctacaaatgtctggtgttttcagcattccaccaaagtatatattgcaaagatggacaaatgctgctatgagcaggcatcctattggtggaaaaatggaagaggttcaatcaaaggtgcggcgattcaatgatttgtgtagacgggccataatattaggtgaagaaggttctttgtcacaagaaagttactatatggctttaggtgccataagtgaggcactaaagcaatgtgcaaacttaaacagttctgttgagaatggtatgagacctgatgcctcaagtacccatgttgtttgtaatgttgaaaaagaatatcaatctattattacatctaataataagatccctgatccaaaactgaatacgggaaagaaagctgtgaggactggtatggctggtaggagtctaggaagtgttgaaaacagtgaaggaaataaaggaaaggtatctcaggtcgaagaaggtatggtgaaagatggttttcaacaaatggatatggtatccattaagcaatga

SEQ ID NO: 50866 - DNA, 2358 bp, Glycine max
  Peptide Sequence Number=SeqID_167644
atggcttttctgtttgcctttgttgctattgtggtgtggggttgtgctgcgggtaaagagtgcacaaacaatgatgcccaatcacatactttccggtaccagttatccacatccacgaatgaaacttggaacataatgtcacataatcatttgacgacaaaggatgaccatttattggctgatttgctaccaaggaagttgttgaaagaggaaaatcaacgtaatttggatatgttgaggaaaattgagaaagtgggtgtgttgaagcccccccagcaaccccaaggttttctcaaaccagtgtctctgcatgatgtgagattgaatcaaggttcaatccatgctcaggcacaacgaacaaacttagagtatctgttgatgttgaatgtggacaggttactctggagctttaggaagacagctggccttccaactcctggaacaccatatggagggtgggaagatccaaaaatggagcttcgggggcattttgttggtcactacttgagtgcatcagcattaatgtgggccagcacacataatgatagcctgaagaagaaaatgtctgctcttgttgccaatctctctatctgccaggagaaaattggcacaggatatctctctgcctttccatctgaattttttgatcgacttgaagctactaagtatgtttgggctccctattacaccactcacaagatcttggctggccttttggatcaacattctatagcagaaaatcctcaagctctaaaaatggtgacatggatggttgattacttttacaaccgagtgcagaatgttataacaaagtttagtataagtagacactatcaatcactgaatgaggaaactggaggcatgaatgatgtcctttacaaactatacagcataacgggagatcccaggcatctattgttagctcacctttttgacaagccatgctttctagggttgctcgcagtgaaggcgaatgatatagctcattttcatgctaatacacatatcccagtgattgttggatctcaaatgcggtatgaagtcactggtgatccactttataaggaaataggaacactctttatggatcttgttaactcttctcatacttatgcaactggagggacatcagtcaacgaattttggagtgatccaaagagaatggcagacaccctagaatccaccgacaatgaggaatcatgcacaacttacaatatgttgaagcttttacattgtcctctaagtacaagaaagaaaaacaattttccaggtttcacgccacttgtttacatggaccaaaaaagaacagaacctggagtgatgatatatatgcttccacaaggtcgtggggtttccaaggctaaaacttactttggttggggaaccaagtttgatagtttttggtgctgctatgggacaggaattgaatcattctcaaagctgggagattctatctattttgaagagcaaggggaaaatcctactctttacatcatccaatacatatcaagcttatttaattggaaatctgggcaaattatccttaatcagacagttgttccacctgcttcatgggatcctttcctacgagtgtcatttacattttctcctgctaagaaaactggtgctttgtctacgcttaacttcagactaccaactcggatgcacaagaatggtgaaaaaggcatattaaataatgagactttaactctgccagggccaggcaattttttgtcgatcacgcgaaaatggaatgctggtgacaagctaagccttcaattgccccttaccctcagagcagaggccataaaaggtatatttctaatggaaaaattaatcatgtacttcacaatactgatatggtgttttgaatcaaatacagatgataggactaaatatgcctctattcaagcaattctttatggtccctatcttcttgctggtcacaccactggtgattggaacattaaaactgcagcaaatgcttctatagcagactggattactccaattccagccagctacaacatccacttattctacttctcccaagcctttgcaaactcgacttttgttttgacaaactcaaaccaatcattagcagtgaaaaaagtacctgagcctggaactgattcagctcttggtgccacttttagagttatccaaggaaaatcttccacaaagtttaccacattgacagatgctattggtaaatcagtgatgttagaaccatttgatcatccgggaatgcaagtgattcaccaaggaatagaacttcctcttacagtcaaacggatgcattctcacagttggggaattccattcattttgaagaagggaaagatgcaactctattga

SEQ ID NO: 50867 - DNA, 282 bp, Glycine max
  Peptide Sequence Number=SeqID_167645
atggcggaggagctgaaggcagtgaaagtgttaggcaaaggaggcatgggcaccgtgttcctcgtccaactacacaactcatcccacgtcgcactgaaagtcgtagacaaatcaagtacgaagttggttaggaaaaagaccacttctcacttctcaggacctatatgtatacccttttgtcttctacctctgtctgactccatcaagtttttgttcactgaatgcactttcatgcataacccaaacacttattgggtttgcatgtgtttggatagcaattag

SEQ ID NO: 50868 - DNA, 531 bp, Glycine max
  Peptide Sequence Number=SeqID_167646
atgcaatgcaacaaaggtggagtttgtatagggaatgtggtttcacagtgggacttttggaccatatcgatagttccaaatattttacttatgcatatgtgggggcatggatctcaatatagaaaggggccagagtctctaaggggaactcaaccaacagcaatgcttaggctcccttgctattgctgcgcaccgggatgcaagaacaacattgatcatccaagagcaaagccactcaaagactttaggaccctccaaacccattacaagagaaagcatggaatcaagccattcatgtgtagaaaatgttgcaaagcatttgctgtgaggggtgattggaggactcacgagaagaactgtgggaagctatggtattgctcttgtgggtccgattttaagcacaaaagatctctcaaagatcatatcaaggcatttgggaatggacataaagcttatggaatcgactcgtgtcttgatcaagatgatgaagccggctctgaaattgagcaggaaaataatgaatctttttaa

SEQ ID NO: 50869 - DNA, 789 bp, Glycine max
  Peptide Sequence Number=SeqID_167647
atggattctcaggttgccgtagctcttgctctttcacttgttggtggtgtcagcacttctatcggtgcactttttgtaattgttaataaaacgcccagtttgaagatgcttgggctattacagggttttgctgctggtttgatgcttagcatatcgttctttgatttggcccacaatgctttgaactcactgggcttcttgaaaggaaacctttggttttttgccggggtaatattctttgctgttgttgccagttttatcccagagccaacacttactcccacttctgatgtgaagggcagaaagaaaaatggggatgaaggagacaaggatattatgaaaaagcatcgtcggcaagttttattcagtggaattgttacagctgtaggcataagtttgcacaattttccagaaggaatggcagtgttccttggatccttaaagggcctccgtgttggcctcaatttagcattagccattgctctgcacaatatcccagagggtgttgctgttgcacttcctgtttattttgcgacacaaagtaaatggcaggcattcaaattagcatcactttctggctttgctgaacccctgggagttataatcgtagcctatctattccctagcagcttaagtcctgagattctggaaggtttacttggatcagttggtggagttatggcttttctgacccttcatgaaatgctgccattggcttttgattatgcgggacagaagcaatctgttaaggctgtctttttggggatggctttcatgtctgcaaggtaa

SEQ ID NO: 50870 - DNA, 294 bp, Glycine max
  Peptide Sequence Number=SeqID_167648
atgagaaaccgaaccggaacaatagctcgcacaagcagagaaacaagccgcaaaggaacaaaacaaaactggttcagaacagaggcgagctcggacgcggcagagcggagctccggtcgcggtgggttgcgagacgttgaagatgcagtcacagaaaatggtgtttttctcagttatctcagtgttagggttagtgagcactgggcttttgggctttggtatacgggctttaagttggcagaagcccgagtaatattgagggagtattcgaagaatttttcaatacttgagtga

SEQ ID NO: 50871 - DNA, 429 bp, Glycine max
  Peptide Sequence Number=SeqID_167649
atggcaagtgcattgagtagcagagttgaatctgttcgaaactccccctttctaagattttcgctcaacttcatcagagcccttagctcttcttcgtcttcttcttctgccgtttcttctgctgagaaccttaagaaatcaaagcgaaggaagaagaagaatttgttcgaggtggctcagttcttacctaactggggaatcggctaccacatggccaagactcactggaatgaggatggaagacatggaaaagcatgggggattgcttttaaaaatggcttgccgttagcagatgctcccaaaaagattagtggagttcacaagcgctgttggaggtacataccaaatgtagtaaaagcattagaaagctcaacaaacttaacgagctcaacagacagtggcttaaaagttgaaactgaagcaagttga

SEQ ID NO: 50872 - DNA, 1344 bp, Glycine max
  Peptide Sequence Number=SeqID_167650
atgaacagttcgggtttgggtggtggttttttgtctggtcccagcggggagattttggacttggaatctccatttcatagacaccagcacacccaattgggtcatccatcaataactggtcaacagcacatgaatatgatgagtggtcttgaaagtgatcaccccattggcctaattgaagtgaaaagtttgaatgcggcattgaattttggtaaaggaaaggcggtcgctccttccaatagtaatgagttgagtgaagaagatgagcctagctatgcagaagaagggaattgtgagaacctggatggtgggaagagcaaaaaggggtcaccttggcagcgaatgaagtggacagacaatgtggttaggcttctgataacagtggtgagttgtgtgggtgatgatggcacaattggtggcatggattgtcataaaaggaaatctggggttttacaaaagaagggcaagtggaaaacggtctccaagataatgataggcaagggttgccatgtgtcgccgcagcagtgtgaggacaagttcaatgacttaaataagagatacaagaggttaaatgacatacttggaaggggaacttgttgtcaggtggttgagaatcctgtgctgatggattcaatgcctaacctgtcagctaagatgaaggatgacgttaggaagatattgagctcaaagcacttgttttataaggagatgtgtgcttaccataatgggcaaaggataccaaactctcatgaacttgatttacagggttattctctagagcatgggagggactccagagataataatggatctgaggatgaagatgaggataacaatgatagtgaggatgatgagtcagatgatgaaattaatattaatgcacatgaggatggggggaggatgcagcagctatgtgatagaaataagttaagtgaggaggatgtccattttggtccacaaacttctcggatggataaatttgaggttgaaatggcaagggtttttcaagaccccacaaagtcattgcatgaacaaagagagtggattaagatccagatgctacagcttcaagagcaaaatatcagctaccaagcccaagctcttgaacttgagaaacaacggcttaagtggttaagatattgcagcaagaaggacagggagctggagaagctgaggttggagaacaaaagaatgaaattagaaaatgagcgcaggatcttgaaactgaagcagaaagagcttgaggcagatttcagtacatctgagatgtctttagaccctgcctctcttggaatcaaccggccacaagggagggaacatatcagcttaggcagacaacaatag

SEQ ID NO: 50873 - DNA, 2199 bp, Glycine max
  Peptide Sequence Number=SeqID_167651
atgtttcgaaacgacgacgtttgcatagtttcctcttccatcaaaatccctcttccttacatttccaaacgccctacctgtcctctgcgaaccgcgcattctcacatcgccaacgccactaactcgattgcgcaactcgttaactccttcacctctcactccaccgagttgactcgctccgttctgcaaaaatcgtcgctcctgtgctcagcaacgctgtccttaaccggcgacctggagagaaaatgtccgattcggcgtttggcgtcgctgtctctggcggaggaagcacagcagaaggctcggcagaatgaggagagagtgctgataagcgaagtgttggttcgaaacaaagacggcgaggaattggagaggaaggacctcgaggcggaagcggcgcaagctctcaaggcttgtcgacctaactcggctctcacagtgcgcgaggtgcaagaggatgtgcatcgcatcatcaacagtggatatttttcgtcgtgcatgccggttgcggttgatacgcgcgacggtatccgattagtatttcaggtagaaccaaatcaagagttccaagggttggtatgcgaaggagctaatgttcttccggctaaatttttagaggactcgatgcgagatggatacggaaagattatcaatttgagacgattggatgaagcattatcttccattaataactggtacatggaacgtggtctttttgccatggtttcagctgttgagattctctctgggggtattctgagattacaagtttcagaggccgaggtcgataatatttccatacggtttcttgacaggaagacaggtgagactactatggggaagacaaagcctgaaacaatacttaggcaaattacaaccaagaaaggacaggtctacagcatgcttgagggaaaaagagacgtagaaactgtattaactatgggaatcatggaagatgttagcattattccccaaccagctggtaataattacaaggatggccttccctttctacaaaatggaatgctaacacactcagcagttcttgagagacttcacctcccaatacaaagattgagagcctatctgaagtgtaatctgtcagttacaactgtcataaagacagttgtgactgattttcaatcagttaacagtagtacatatacagggaaggttgatttggtgatgaatgtggtggaacgtcccagtggaggattttctgctggtggtgggatatcaagtgggattacaaatggtccactaagagggcttattggaagctttgcctattctcatagaaatgtttttggtaaaaaccagaagctcaatatttccttagagaggggccagattgactcagtctatcgcataaattacacagacccttggattcaaggagatgataaacgaacatctagaacaataatgattcagaattcaagaacacctggaaccattgttcatggtaatgcagatggtaatggtagcctgaccattggccgcatcacaggtggtatagagtttagtcgaccaatcaggccaaagtggagcggaacacatgccggagtacgtgatgagcaaggtattcctatcattaaggattgttacagcagtcctcttactgcaagtggcaatacccatgatgatacattgcttgctaaacttgagactgtttacactggttctggcgaccatggatcttctatgtttgtccttaacatggaaaagggacttcctcttttgcctgaatggttgtccttcactagggtgaatgcacgtgccaggaagggtgttgagataggtcctgctcgccttcatttaagtatctctggtggtcacgtggtgggaaatttctctccctatgaagcttttgccattggtggaacaaacagtgtgagaggctatgaagaaggtagtgtgggctctggtcgttccccctccttgttaggtcacaccacaggtttgtcgggtcagtacgggccagtagaaggtgttatattttctgactatggaactgatcttggatcaggcccaactgtacctggtgaccctgctggagcaaggaagaagcctggcagtggatacggctatgggtttggcatacgtgtggaatcacctttgggtcctttgcgtcttgaatatgcctttaacgacaagcaagacaagaggtttcactttggagttgggcatagaaactaa

SEQ ID NO: 50874 - DNA, 267 bp, Glycine max
  Peptide Sequence Number=SeqID_167652
atgggggagacgcatgagataccctaccataatttagccgatttcaagccttgtctcggatatgccacaaaagggaaagtagttagtggtatacccctgcaaaacactttggagggccctcaatttttcccccaaccacaacccttgcattccactgcgggtaaaagccctcctgctatggtagaaatggaaaagttggatcatctagaggaaaggctcagggccactgaaggaggcagagattatgcctttaagagttgttcctag

SEQ ID NO: 50875 - DNA, 132 bp, Glycine max
  Peptide Sequence Number=SeqID_167653
aagttgaagaagtcagagaccttaatatgggtggactttgtggagtgtcctaaggttgaagtagtttatggttcaagttggaaaagtggtgaccttaaaatggaggaccttgacatagacttgatggagtag

SEQ ID NO: 50876 - DNA, 426 bp, Glycine max
  Peptide Sequence Number=SeqID_167654
atggctcgtactcatgacgcgatcctgtattacaacgggaaatggaacatgtcaccgcagaacaaatttgttggatgcgcattcacaggaaaaaatcctaagaaatttcaaattccttcaacatgtaccatcgatgaactgaagaatttaatcaagcaagttgcacctaaagggattccccatcttggaattcatgaatcacaaacggtaagacgattgtttttctgccaaccagctcactttgagtattcagatacggttataaaatatgaaataaatgagctgatgaccaacaaagaactgctaaaggtgttagtacaatctaactactggaaaaaatatggaccaatagaaattttagctgtctttactaaatatgttgtgaaaatcgaagacgaggtctcttggacgtcgctaaacaactga

SEQ ID NO: 50877 - DNA, 1011 bp, Glycine max
  Peptide Sequence Number=SeqID_167655
cgacgtgggcattctcagcgaaccctacaatattctttccgatccgcaactggcgatgtgggggccggtgattgctaacgtctggtttggcatcccgttttttgccatcactctactggcggcactgcagtcgattcccaaagatttgtatgaagcggcagccatcgacggtgccagcggctggcagcagtttcgccgtgtcaccctgccgtttctcgccccgatgatcgccattaccgtgatgctgcgtaccatctggatcgctaactttgccgatttaattgtggtgatgaccgacggcggtccggccggttcaacctcgattctttccagttacatcttcaccaccgcttatcgcaaactggattttggttatgcctcggcgatggcgggcgtgacgctgttacctggcggtttcaccctgagccattttgcgaaggtattgaccgacagtgatttccccacgttttttattaacagtctcattgtctcctgcagcactgccgcgctcaccaccttgattgctgcgggtgccggctatgccttttcccgctttcagtttcgcggcaagatggtgatggcggccctgctgctgtttacgcagatgtttccgctggtgatgatcattgcgccgatttaccgggtgatggccccgctgggactgacgaatagtctgctggggctgattctgatttacagcgccttcaatgtcccgttcgccaccttcctgatgcagtcattttttgatgccatcccgaaagatctcgaagagtccgccatgctggaaggctgcacccgctttcaggcgctgtaccgcgtgctgatgccgctgacgctgcccggcatggcagcgacgctcggctttgttttcaccgccgcgtggagtgagttgctgttctcactgatgctgatcaacaaaaacgaagtcatgacctttccggtcgggctgctcagtttcgtctccaaattcgccgtttcgtggggcgaaatgatggctgccgccgtgctggc

SEQ ID NO: 50878 - DNA, 285 bp, Glycine max
  Peptide Sequence Number=SeqID_167656
atggctcatttcattccatgtaaaaaagttgatgatgcttcccatgtggctgatttgtttttcaaggagattgtgagactccatgatggagaatccgatttgaggacgaatcattctcaagagggagagaatgatgaggacatgaccaagagcaagggcaaggatccacttggaggacctatgacaagggttagagcaaggaaagccaaggaagctcttcaacaagtgttgcccatattatttgaatacaagcccaagtttcaaggagaaagtccaaggttgtga

SEQ ID NO: 50879 - DNA, 140 bp, Glycine max
  Peptide Sequence Number=SeqID_167657
atgaataggtggatgactatgaagaacctcatgctagaggacacgggaacacaacgctctgataggatgtatgctttaaatcagattactgctgaatacgagcatgtacattatgctgggaagaatccttctcgttgtgg

SEQ ID NO: 50880 - DNA, 227 bp, Glycine max
  Peptide Sequence Number=SeqID_167658
gtcggctaggtttattcgttcgagctcaaccaaagttgtgttggggccgacaccggcttgttttcatttgcttggcaaggaaaacattagccaacctcgatgatgaggacataaccaaggaccatgaagcacttgaaggtcccatgaccagaggtagacttaaacaagcccaacacgtcatagagacaaggctggtcatttgtatagctgtcattgatgatgattga

SEQ ID NO: 50881 - DNA, 123 bp, Glycine max
  Peptide Sequence Number=SeqID_167659
atgtctactgctcctatcaggaatccaaagagatatgggatactcaaatacactgtcgaggacgtggtcaaaaaaagattcttgtcgcaccgttggaccatgaacaaagaaaaagacatcaag

SEQ ID NO: 50882 - DNA, 358 bp, Glycine max
  Peptide Sequence Number=SeqID_167660
ggattgtgcccgcaagacacccagtggacccgaagaaggccaacaaggacttggagttgccagctctaattacgggcctctgtcagttctacgggctttcatcaagaagtactgcgccccaaggcaggcgcagggcgcaacaccccagcagcttagggatggccgacagcgggcaatagacgcactgccgccacctccaaagaacctcagctcatccacaaaaaagttagtgcgttgcctacgacccatggccgaccagcaggcgaccaagtacaaagccaaagataagaaaagtactaggtctgtgaccgacaagtcatcaagcgtccaactcaagacgttaaagaagcgctactag

SEQ ID NO: 50883 - DNA, 495 bp, Glycine max
  Peptide Sequence Number=SeqID_167661
atgaccggacgccttcttgccggttcattggcttttgaaagccgcatcctacattattctaattgtgcggattttgcttccactattcttccaatcttgcccaagtttctgaggaaagatcttgttatcatgtgggcctttcataccggccgtcaacttgactgggcacatcttagatcttttttaattggtgctgctgtgattgcttcttttggttaccgcaaagaccatgatggctcttgggtcaaaaagggcgctcaacccgctgatgaagaaggcaacctaccagttgaagataattctactcttcttcgaaggcttatggacaagtttgatggacttcagacttttgttggtgacaagtttgatgccatggaattgcaagtcgacatacggttcgatgccatggaatcaaggatcaccaaagttgaagaagatgtctccttcatccgtacttgctttgatccaccaccaccgcctccatcatcgtcttag

SEQ ID NO: 50884 - DNA, 126 bp, Glycine max
  Peptide Sequence Number=SeqID_167662
atggataccttagagccttacattggggcaatgaggggcaccgtgcatgaacctcaagtcatgacgaaagataacaattggtacctcaaagccttacactggggcaatgaggggcatcgtgcatga

SEQ ID NO: 50885 - DNA, 1454 bp, Glycine max
  Peptide Sequence Number=SeqID_167663
tcgagcgtgtcttccttgaggcgattgccggcattgtccagcgtgtagtgaatcgtgttgcccgcgttgtcctcgatatcggtcaagcgcagcgccgcatcgtagacataggaaacgctgctgccgtcgggctcggtgatctgttgcacctggccggtcggccagtagctgatctgggtgacccgattctcggcagtggtcgcgccacgtacggtgaccgaggttggccagccgcgagcatggtaggtgtagtcggtgaccacgccgttggcatccttgaccgacaacggccgtccgaaagcgtcgtaggccagagtctcgaccgtctggcccagcgcattggtcacgctgcgcaggtcgcccttgcgataggtgcaggcacctcccgtcgcgcaccctgcatcatccgccgagtaataggcataggtaacggcatcggccacatccgtgcgcgggccatccacactcttcagcagcccctccaccgggcagctgcctgccgctgccacatcagcggcttcgcagtacgtgtagttggtgatgcgcgtctgaccggaagcggtgtcggtcacggtgttggccgtcggctggcgtcgggaattgaaggccgtgcgggtttcgcggctaccgatccgggtggtcagtaccgcattggtttcgacgtcgcgcgccgtggtcaccacacgctgctcgggaaagccgaccgcttcggtcacggtatggatgctgacggcacgaccgctcaccggatcggtgccctgcgcataggtgtgcttggtctggatgccgcggcgatcggtgtaggtatccagacgccggcggaagtcgacactctggtcgtagtaggttcggctgaccgttccctgcgaatccgtcaggccggtcaccttgcgcgacggagcgctatcgcctccgggcgtcagggtgtagtcggtctgccgccccagcgcgtccgtcacgatcgcaccgccgttggggctgtaggccagcgtcacgccatcggcaccgccggcgtgctgactggaaatgacacgaccgtcggaatcataggtaaaagtgctgtagcgacgcccgtcctccgccgtgatgccggtcagatgctgggggaagtcctggttctcgtagtgatacgtgcgcacaccaccacccgcataggtcaccgtggcgacctggttctgcgatgtgtaggtgtaggtggcgagcgcaatgccctcgaccagcaccgaactgatcagcgcctcatagtcgttggactgatagacgaactccagcgtgcggccactgctgtgggtgacggctgcaaggcggtcgctgtcgtcatagatgtaggtcagcgacgtgccatccgcgaagcgcttggcggcaagacgcccgtccgcgccgaaggtagagatggaatcggccgtgtacagtgtccagttgccgttctggaccagacgatcgccactgtcgtc

SEQ ID NO: 50886 - DNA, 648 bp, Glycine max
  Peptide Sequence Number=SeqID_167664
atggctcggcttgcccccgatgtccgagctccaggccgagccggccgagcatccggcgcaggttcgcctcgcccccggcgcggaagtagccgtcgaggacgggcgcgagttcggggcgggtcgcgtaggaatcgaggcggcggtccggccggtcgtcgccgggcaggagcacgaggccgatgccgttggcgcgggcgacctcggaggcccgctcgatcccgtagcgccagtagtcgagcccgccgagacagcggatcacgacgagccgcgccatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 50887 - DNA, 357 bp, Glycine max
  Peptide Sequence Number=SeqID_167665
atgggtggagtgacaaaagcttcacatcacttcttcaagtggtgcaggatatgcttccagaggaaaacacattgccaaaaatttactattaggcgaagaaaatactatgtccgatgggtatggagtaccggaagattcaagcatgccctaatgattgcacacttgaaggatgatggcgagtgtagtagtgatcaaagcaccaagaaaggccccctagcgaaggtgttttggtatcttctgatcattccaaggtttaagcgtctatttgccaatgcagatgatgcaaaagaccttacatggcatgtagatgggagaaattacgatggaatgctctgtcatctgattgattcctcttaa

SEQ ID NO: 50888 - DNA, 517 bp, Glycine max
  Peptide Sequence Number=SeqID_167666
atgggaagagggcctcctgctttggtggaaagggaaaaatttgatcatatagaggaaagggtgagggtcattgaaggaggcggaaattatgcatttgctgacatggtagagttgtgcctagtgctcgacatggtcattcctctgaagttcaaggtgtcagatttcaataagtacaaggggaatacttgccaaaagaatcacttgaagatgtactgcaggaaaattggggcatacgcgaaggatgaaaaactcttgatgcattttttcaagagagtctggcagtatcaatacaattctgatatagcctcggatagaatgcagctgcagaacatgtgtaaaagggagcaggaatctttcaaagagtacgctcaatggtggagagatctggcagctcaagtagcacccttaatgatggagagggagatgataacaatgaaagtggacacattactggtgttctattatgagaagatggtgagttacatgccttcaagctttgcagatttagtgtttgctg

SEQ ID NO: 50889 - DNA, 237 bp, Glycine max
  Peptide Sequence Number=SeqID_167667
atgacaaaaatcattcagcttatagaaggatcaaaagatacagttatcattcaaggcgtggaagggtcagctgcctgctgcagagaagtggtatctgccactggtgccgaaggctctggagtagcttcaagagacttttcagaggtggttgcagcttcctgggttacaactaccctcctcttcctgatcaagggctcaggagtggaagactctgatgactcatcctctggtgatggg

SEQ ID NO: 50890 - DNA, 186 bp, Glycine max
  Peptide Sequence Number=SeqID_167668
atgaagactgaatacaacgatggatattctccaaataggtacatctctaagaaggtggcgacacccctcctcataactccagctaccaccgtgaactcgagcaaaagcaagggttacctcatcagcaaagggaagcttgatcttgtggggatcgaggaaccacacgaggttcttgttgacatgtga

SEQ ID NO: 50891 - DNA, 259 bp, Glycine max
  Peptide Sequence Number=SeqID_167669
atgggctcaaaaatctaccctaaggttcatgagaaccctagggccttctttagtagctctagcccaagcctcttggagtcttctatcaaatacccttggggggtaggattgcatcaactggcgctaagctcaaatccacttactcgcgctaagtgcgagggagaagatttgcatagaattccagagcacaccacagtgcctatttcggagaaagagctctggaggcagcaagaggagcagcttttgaagagatacctag

SEQ ID NO: 50892 - DNA, 825 bp, Glycine max
  Peptide Sequence Number=SeqID_167670
gtccgcgttgccgcgcatgtagcagccggcgcccaggctcggcagtgcattcgggcagccattgccacgggtgtaatacagatagtccggattcgactggtacaggttcggtgccttgaatgcacgggcgataccccccttcaccacccagtcgctgttgatgcggaactgcgcattgaggctggggctggtgttgttgccgaactggctgtggtgatcgaagcgcaggcccggggtgacgatccagcgctcacccaggtagatgttgtcttcgacgaatacggcggtggtctgcgcatcggacttgccgcgcgcgcgatcggccgacagccccggaatgccgccgccgctgctgctggactggctcatcgagtacgggtcggtcaggcggctgtccaggtattcaaagcccagcgtccagatgttctcggcgccgcccagcgtggtcgggaagctcacttcgccgtccagttggtagttgcgcaggcgcgaggtcgaccagtcggtgccgttgaagctgccctccgggccaccggccaggccttcgttgatgcgcgagttgttcaccgcctccactgccgccgttacccgcgaggtcacatcaccccagcggccgcgatgggtgatcgcgccggtgttgcggtacatgcggttggtctcggcctgctgctcggccaaggcccccagatcgatcggtgtcgaggtgccggtggtgctgaccgcgcggtcacctgcatagatgttgccctggcggctggtgccggcttcgaactcgaccacctggttggcggtcacgtcccagcgcagcagcgcgttgatgtcgcg

SEQ ID NO: 50893 - DNA, 261 bp, Glycine max
  Peptide Sequence Number=SeqID_167671
atgccaccatcatcaacaaagatttgcgatcttaaagttacacgaggcagtgttggtagcttggaaggtcccgtgtgtggatatggttgtaggggggaatggatgaaggtggcggtggtgcatgccaacgacggagcagtgcattcactagtgatggtgttgtggtgtcatgtgcgctacattcaggttgtcaggggtgtgcgtgaaagtggatctgagagggcacgcaaatctaggtttgtgtttgggatctgggtttga

SEQ ID NO: 50894 - DNA, 273 bp, Glycine max
  Peptide Sequence Number=SeqID_167672
atgcttagattctctaaccacgctagttacccacgtctgggccatccgacaagaacgtggccaaaagctattgccaaagaccctggaaggtcagtgcaagatgccccccacgatcatacacaacatccaacgtatgaacgtggccaaaaggtagtgccaaagaccctggaaggtcagtgcacagtgccccccacgaacatacacaacatgcacatgccaatgcatttccaacatcaatcaacaaatcgtatttccatgtcattcacaacataa

SEQ ID NO: 50895 - DNA, 3671 bp, Glycine max
  Peptide Sequence Number=SeqID_167673
atgattccacagtcaggatgggataaactgtttatctctttcatccccgctgactctgtgaaggctacatcaaagacaaccaaagcaaatgtgagaaatggaacctgcaagtgggcagatccaatctacgaaactacaagactcctccaagacattaaaactagacaatatgaggaaaagttttataaatttgttgtggggatgggttcgtcaagatctagcatccttggcgaggccaacatcaatctagctgattttgttgatgccttgaagccaacagctgttgctttgcctcttaatggaagtgagcctggagtcacactacatgtcacagtgcagcttctgacttccaaaactggtttcagagaatttgagcagcagagggaactcagagagaggggtctacagacaacctctgacaaaggaactcatgatgaatctgctgacagcaaagagtcatctcctgaccagaatgtcaataatcatataaataaggttcattcaagagtgaaattgaaaagagaatctaaagatctcccccgcatttcttcacttgaagaagaatcaggggtaaatgaagattatgctgactctgctgctggctttgatggctcgtctagtacttctgaaagcatatatacagagaagcatgatatctccagtacacatgaagtggacagtcttaaaagtgcagtctcttgtgatttaggtggcctatccctcagtcaaagttctcagccagagaaaggagaggcacctgataatcagtttcctgcacagggtagtgatcgggttcatggttggagcatagactattcagctgccaataatttggctgctgcttctgaagataggaacagtagcagacttatgggaaatttggaagcagttaagtcgtctatttttgatctaaaactgaaggtaagttctttgcaaaatcatgctgatgaaataggtgttgaaacgcataagttttctgagcaacttgctgctgagatttcatcaggagaagagttagtaaaggaggttgcagtactcaaatcagagtgttcgaaattcagagatgagtttgagcagcttaaaagttctaacttgagcttagcattccctcagaaagaacctactggtacagatccggatagattatttcaaaatttacagcttaaatggcttaaggggcttttgctcatggaagggaagataagagatattcagaaggtgtctatgggatttccagaaagggattgtaggttccttaacttggagttagaagcactggctgagattttgcagaatctcaaacaagaatctggagagccaatttcaggggccaaagttgtcaatgaaagagagaacaagaaaatggatttacataaaagtgaacaatttttaacagatattgggtctgatgcaggtttatttcaacctgaaagcatgactcattatcttaccatacctggccctgtgtctcacgagtctgattctgttgatcctacccttcctatgaaagaaaaagtttttgcacttctaagagagctagatgagtccaaaaccgaaagggaaagccttgtacggaaaatggaccagatggagtgctactatgaagctcttattcaggaacttgagcagaatcaaaggcagatgatggctgagttgcagaacctcaggaatgaacattctacttgtctgtacacaatttctgctggtaagactgagatggagagaatgcaccaaaatatgaatgagcagataatgaagttttctgaagacaagcgcattttggaatctctgaacagtgagtttgaaagaagggctgtttcagctgaagcagcccttaaaagggccagattgaactattctattgctgttggtcaattgcaaaaagatcttgaactgctttcttgccaggttctttctatgcatgaaacaaatgagaatctcataaaacagaccctttctgattcttcacttccaaatactgatggtagcccagagccagtgacatatcctaaactttcagaaggtcatacttccaatcgattgctatgccgaaatcacagttcttccttacaaaaacaacatttgggtgaagacattttactcagcgatttgaaaagatctcttcagttgcaagaggggttgtacagacaggttgaagaagaaatcagccaaatgcattttgcaaatatatactcagatgtgttttctaaggctctgcaagaaacattgcttgaagcaagtcttgacattcaactcatgaaagagaaaattgttcaactctctcagcagctggagcttacaaatgaatccaatgagctactagtgttgaggttgcagaatgctatgaatgatatcctctcgctaaatgagtacaaggagatttgcactgcaaatagcaatgatattgctctccagaaccaaattttagaggcaaatttaaaagatcttgctcatgaaaacaatctccttaccgagaaaattaacgagctggaagttcttctaacacagtatagaagttatgagggcaagtacatggcatgcagtacagaaaactcagagttgaagagtttattgaaaaaagagagcctagaaaagaataatcttcatgatgaactatccattttgcaggaagagttaaaatctatcagagctaaatatgacgagcaagtttcgatgaaggataatctgcagaataatgtcatctttttgtctaataagttacagaaattgcttacatcatatgaagaaagacacagtgaactttctctttgtagtagatctgcttgtttggattcagaatgtgaagacttagaaggcctcttattgcaactagaagagctgcaacaaagtgcatttcgtagaatcctgctactcattgaagagaaggagaatctagtgcatgaaaaacttatggctcaagtatctttaaataccacagaatcagatgttctagtcatgaaacagaagtttgagcatgatttgcaagagatgttacataagataactgtgtcaggtgcccttttgcagaaacttcagttagattttgaggtgatcattagcaggattaatgctggttttgaagctgaagaattcttttctcagcatcacaaagaatttttgtctggtctggatcatttggaagctgagctacaacaacttaattccagaaatcaggaccttgctcaagaaattataaagctagatacttcatctagtgaccttgaaatgtataagctgaccttagcaacaatcaaagagcaaaagaatgatttggacttgtctttacgggaaaaaacagaagaatctgccaagatttcatctgagcttgatttcttgaagaagaacttggattctctgcataatgagttgcatgctgagaaaactgccagagaaaagttggagaaaacagtttccaatcttaccacagaattgaatgagaagcaaagccagctgcaggaaaagaaagatttgaagtcatctttacaggaaaaaacagaagaatctgctaagatttcatctgagcttgattttttgaagaagaacttggattctctgcataatgaattgcatgctgtgaaaactgtcagagaaaacttggagaaaacagtttccaatcttaccacagaattgaatgagaagcaaagccagctacagggaaagaaagatttgga

SEQ ID NO: 50896 - DNA, 1431 bp, Glycine max
  Peptide Sequence Number=SeqID_167674
atgggcgcattttttagtgtggcgagtacaaaacctgaccaaagggaatgtagtgaaatctctccaaatgaagcatgtaagaggcaaagaatgtcacctactgttgatgaagagaatccaaggctaattcctaatctccctgatgagttatcacttcagattattgctaggcttcctagaatttgttacttcaatgtaaggctggtatcaaagaagtggaagtcaactatcatgagttctgaattgtataaattaagaaaagaacttgggacaactgaagagtggctatatctgttggttaaggttggagaaaataatcttctgtggtatgctctagatcctcgttctaagatatggcagagaatgcctaatatgcccaattttgttaacaaagaagaatctaaaaaaggttcttctaggctttggatgtggaacatggtggaaggtataagaattgctgaagttattagaggctttcttggacagaaggatgcatttgatgaaatgcctttttgcggttgtgcgattggagctgttgatggatgtgtttatgttcttggtggattctctaaggcttcaactatgagatgtgtctggcggtttgatccaatacaaaatacgtggagcaaggtgacttctatgtcagcgggtcgggcatactgtaagacaggcatcttaaataacaagctttatgttgttggaggggttagtcaaggtcaagctggattggttcctctccaatctgctgaagtttttgacccctctacagatacatggtcacatgtacctagtatgccattctctagagctcaagtattgcccagtgcttttttggctgacatgttaaagcctattgccacagggttgacctcatacatgggaagattatgtgttcctcagagtctgtattcatggcccttttttgttgatgttgggggagaaatctatgatcctgaaactaactcgtggatagaaatgcctgctggaatgggtgacggatggcctgcgcggcaggcaggtaccaaattgagtgttgtagtggatggtgaattatatgcttttgacccttctaattctatggatagtggaagaatcaaggtatatgatcaaggtgaagacgcttggaaagtagttattggaaaagtccccatatatgattctgctgattcagagtctccatatctacttgctggtttccatggaaagcttcatgtcattaccaaagatgccaatcatgatattgcggttctgcaggctggcctgcgcgataatttggattcttcaccatcactctcaactctgtcacaaagtacattgcaagaatctccagaactggctgccgaatcagatgcagcagttgtttggagggtagttgctagcagggattttgggcaggctgaactagtcagttgccaagttattgatatctag

SEQ ID NO: 50897 - DNA, 264 bp, Glycine max
  Peptide Sequence Number=SeqID_167675
atggaacatcaaacaccttccaaggacttcaaaggcaatacaaacttcccttttgaaaaagaattaaaaaggaaaaactccatcatgactccttcactcatcaaaatgaagaaaacaatagacaacttgttagtttttaccaataaaactaataaaatcttccacacaagtagccatcagaagcagaagatgcagatccaacagaaagaaacacccaaggctaaacaatttttcagaacttcaccttcccaggatacacaataa

SEQ ID NO: 50898 - DNA, 2629 bp, Glycine max
  Peptide Sequence Number=SeqID_167676
aaagaaagatttggagtcgtctttacatgaaaaagcagaagaagctgccaagatttcatctgagcttgattttttgaagaagagcttgcattctctgcataatgagttgtatgctgagaaaaatgtcagagaaaagttagaaaaaacaatttcagatcttaccacagaattgaatgagaagcaaagtcagctgcagggaaagaaagaattggagttgtctttagaggaaaaagcagaagaatctgccaagatttcatctgaactcaattttttggagaagagcttgcattctctgcataacgagttgcatgctgagaaaactgtcagagaaaagttggagaaaacagtttcagatcttaccacagaattgaatgagaagcaaagtcagctgcagggaaagaaagaattggagttgtctttagaggaaaaagcagaagaatctgccaagatttcatctgaacttaattttttggagaagagcttgcattctctgcataacgagttgcatgctgagaaaactgtcagagaaaagttggagaaaacagtttcagatcttaccacagaattgaatgagaagcaatgccagctgcaggattctgatctaaacagacaagaacttgtccatctaaagcaaatggtgacagacctagaatttgaaaaatcaagaatctcagatctgctagagaaatctgagaaacatcttacagatgctttaaaagaatcttcttcaattagttgtctggaaactcggttatctgaaatgcatgaattttccatagctacagatgttgttatgacttttaccggtgctcagtttgaggatcatatggaggagctagctgagaaacttcattccacttgcaggcaacttgatgtgctccacaagaagaatcttgatgtagaatctgaattggatggctgtctttcaagagaacggatttgcattgaagaaaacacaagattgttggcgagtcttgacttcttgaaatatgagttagaggacttgactgctcagaatagagcactaattgatcaaaacagtgaactgaagtcagagcttaaggagcataagagtaggaaagagaaggtcagcgatacttcttatgtgtgtgaaagacagagtgtcctcgaggttgcaaggctggagcaattgctggcaagttgttgtagagatgctgaagaactctttttgtccaaggaggaaactgaactcgagtgtatagttctccggggcaaattggatgaactggaaagtgcattcacttcattaaaacaatcagatgatgagctgctaaggctgcagaaccaatgtaatgaacttaccaagaggcttgctgaacaggttttgaagacagaggagtttaagaatttgtctattcatttgaaggaactgaaagacaaagctgaggctgagtgtgttaatgcccatgacagaagaggacatgaaggaccaccggttgctatgcaggagtccttgagaattgcatttatcaaggaacaatatgaatcaaagttacaagaactaagacaacagctgtctttgtcaaaaaagcatagtgaggaaatgctgtggaaactacaagatgcagttgatgaaactgagaatagaaaaaagtctgaagcttctcaaataaaaattaatgaagagctgggaatgaagatcttggaattggaggctgaattgcaggctgtactttctgataaacgcaatttgttaaatgcttatgacctcctacaggctgaaaaggagtgttcagcgataagccttgactgttgtaagcaagaaaagcaagaacttgaagcttctcttgtaaaatgcaatgaggagaagtccaaaattgaagtagagcttacattggcaaaggaattggttgagacttcccgatctcatgtgaattctctgaatgagggcaatggtgcattctcttcatttaatcctcaagaaaattctacttgtgctgcttgcagtcatgagccagagagtgcaagcatcaatatgcaatccgaggatcctcttgcatttagtgttatgaatggatgccaaactcttggaactgaaaaggacttgcaactagaagaagtaatgaagcatgtggcatcaactgaaagtttgaaatctagcatcgatcacttgaataaggagttggaaaggatgaaaaatgagaatatgcttccttcagtagatggtcaaagccacgagtcaagttttccaggtctgcaaagagaactgatgcaattacacgaggccaatcaagagttaggaaacatattccctgtttttgataaattctctatcagcggtaatgcattagaaagggtgctcgctttggagattgagcttgctgaagcattgcggaccaagaagtcctcaaacatccaatttcagagttctttcttgaaacaacacagtgatgaagaagcagtattcagaagcttcagggacatcaatgagctaattaaagacatgttggaactaaagacaagacattctgctgtagagacagaactgaaagagatgcatgaccgttactctcagttaagccttcaatttgcagaggttgaaggtgaaagacaaaaactcatgatgactattaagaatacaagagcatctaagaaggcttcaaattaa

SEQ ID NO: 50899 - DNA, 192 bp, Glycine max
  Peptide Sequence Number=SeqID_167677
atggatgtgcacataataacaaggaggacccctaaggcaaagggtcactttggggtagttgcagcttgcccaggcgagctgaaacttaaccctgaagcagtgagctcgccgaggcgaactggtttcttcaccatgaagctatttggtggcccaagcgagccagaggctagcctggatcaaaactccgaatga

SEQ ID NO: 50900 - DNA, 246 bp, Glycine max
  Peptide Sequence Number=SeqID_167678
atgaagaacgatgaagaacggtggaaaatcttcacgaaatcacccatggaaacgtctcagaagcgggaaaagagggaggtggttgcttgcccagcttgcccaggcgagctgggttgcttccaccagaaggcaccgccttctgttggaacattctggaaggcccagaatgttacggaactttacggattgcggattaacgcttcctttcgactcccgacatgtcgcggaacttcacggatcgcctaa

SEQ ID NO: 50901 - DNA, 456 bp, Glycine max
  Peptide Sequence Number=SeqID_167679
gcaatcaatttgcggggttccagactcgatggtggtggacacatgaacagcgctaggcaatcaattcatgggtctccgaataagattgagaatggagaattggcgaacagcgctaggcaatcaattcgcggggctccagactcgatggcaatcaatttgcggggttccagactcgatggtggtggacacatgaacagcgctaggcaatcaattcatgggtctccgaataagattgagaatggagaattggcgagcagcgctaggcaatcaattcgtgacgctccagacacgatggcaatcaattcgcggggctccagactcgatggtggaggacgcatgaatagcgctagacaatcaattcatgggtctccgaataagtttgagaatggagaattggcgaacagcgctaggcaatcaattcgcggggctccagactcgatggtggtggacacatga

SEQ ID NO: 50902 - DNA, 633 bp, Glycine max
  Peptide Sequence Number=SeqID_167680
atgcgtcacgccttcaccgccaacaagcactctgcacttgacgatgcctacgccatggagtccatcagcgacgatcccctggcggtgtctagcggccaagtcatcgtcggtgtcgagagtcgttatcgcatcgtgtatcgtctcatgaatgacatttacgtgctcagcatcaccgtcatcgaccaagacaactcagtgaacgtattcgagtgcatccacatcgtcaaccaggtcgtgagcgttgtggtgacgacgtgccgcgacgtcgaccgtcacgcaagagaagatcagtcgcaacggcgagggaaggagacagtggtgaggcgtggtcacgagtattccatcaagatgggagactcacgaatcacgatgaggttggcctcggaagaagaatgtggttaccccgatgaagagttggccaaggaagcttccaacgagactgagcgatgtggggatttagatttacgtgagtgcgttacttatgatgggcctgggcctgggccttgggaggtgtttcagcttcaccattcggattcggaccccttcttaaaaggcactggatttggagatcttaatacctacttgggccggcctgcttctgcacctctaaggcccatgactcctgtcatgtga

SEQ ID NO: 50903 - DNA, 813 bp, Glycine max
  Peptide Sequence Number=SeqID_167681
atgtcgtcgtcgtcgaattcgccatgtgcggcgtgcaagattcaacgtcggaagtgcacgcaggagtgtgttttcgcgccgtattttccgccggacaacccgcagcggttcgcttacgtgcataaggtgttcggggcaagtaacgtggccaagcttctcaacgagcttaacgcggcgcaacgcgaagacgcggttaagtcattagcatacgaggcagaagcgcgtttgcgggacccagtgtatggctgcgtgggcctcatctccatactccagcacaggctcaaacagcttcagaatgaactccaccacgccaagaaagaacttgcttctcacatcggatcccacaccatgctgcctcctgcaccttccctactaccgccggagcagcagccacgcactttttcgctttttcctttcaaacccgcgtccactcatcagcatgatcttttcggcttccacgacgacggtggcgcatcttccgcttcccacgccggcggattcaacagccacctcgccgccgtattctcgccttcccctgccgttgatcacgccttttctcacgcgccgatgcagtctcttactcttccgcatcaccaacacctaatgcgctccccgatgcaacccaagcctcaaaccgacccagagtgcttttccttattcaattttcctttttttggacttgctgtgatggttttgctgcaccgaatcaaggaagggttgcttagttcttctcaattggaggcaaatgggtgtaaaggaggaagggagagacaaacttgcagaaagaggatgaaaggtgggggagacagataa

SEQ ID NO: 50904 - DNA, 408 bp, Glycine max
  Peptide Sequence Number=SeqID_167682
atggagaggagtatgattgatgctgccagtggtggagctcttggtgatatgacccctgctgaagctaggaatttaattgagaagatggcttccaactcccaacaattcagtgcaagaaatgatgttattgttcttagaggagtccatgaggtggccacggattcatcttcatctactgaaaataaaaagcttgaagaaaaacttgatgccttgctcaacctagtaacccagcttgccatgaatcagaaatctacacctgttgcaagagactgtggttggaggaatcatccaaatctgagatggacaagtcctccacaacaacaacagcttgtccctccttttcagaatgctactggtccaagcaagccatatgttcctcctccaatgcaacaacaacaacaacagtag

SEQ ID NO: 50905 - DNA, 504 bp, Glycine max
  Peptide Sequence Number=SeqID_167683
atgaccggtagattgttgaccggatcattaacctttgattgtcgcatcatgcactatattatcgttagaattttgcttccccattcttctaatttggctcaagcctctgaggaggacttgattttgatgtgggctttccttaccggtcgtcagatcgactgggctcacttggttaggtaccgaatgcataaggcattacgggccaatgcgcctctcccttatcctcaattggtcactctgtttctccgtcattttcaaattcctcttgatgatgaaccttttgttcaagtcaagcattcctttactataggtgttggtgttgtaacttcatttggttaccgtaaagatcatgatgagttacgaggcctccacacatatgttggtgaacgattcgattccttggacggtcgctttgaaggcatggatacccgtatcacccagcttgaagaagatgtgacttatcttcatcggtgcttcgatcttccaccaccttctaagtcttag

SEQ ID NO: 50906 - DNA, 248 bp, Glycine max
  Peptide Sequence Number=SeqID_167684
gtaatccttgtggcgtctaccttgacttatcttccttcactggaagtggcgtctacccggacttatcttccttcaccggaagtggcgtctaccctgacttatcttccttcaccggaagtggcgtcatccaaatatccgtagcctgtatcaagcgatccgccccgaggaacatatggcttgcttggaccagcgacattctgaaaaggagggacaagctattgttgttttggaggacttgcccatcttag

SEQ ID NO: 50907 - DNA, 351 bp, Glycine max
  Peptide Sequence Number=SeqID_167685
atgtctcgtactcatgacgcgatcctgtattacaacgggaaatcaaacatgccaccacagaacaaatttgttggatgcgcgttcacaggaaaaaatcctaagaaatttcaaattccttcaacatgtaccatcgatgaactgaagaatttaatcaagcaagttgcacctaaagggattccccctcttggaattcatgaatcacaaacgctgatcaccaacgaagaactgttgaaggtgttagtacaatctaactactggaaaaaatatggaccaatagaaattttagctgtctttactaaatatgttgtgaaaatcgaagacgatgtcactgggacgtcgctaaacaactga

SEQ ID NO: 50908 - DNA, 414 bp, Glycine max
  Peptide Sequence Number=SeqID_167686
atggcaaagccatcctcttccaagcactcctgcggcatgtcgttcatgaaatggaccatggcggacgcaatccatgtggcgacgcaccattggatgtcatgcttgttcgcattagggcttctcttcttcatggccatggagtacacgctcctcatggtgccgcccttcgacctgggcttcatcgccacgatccccctccacacgctcctcgagtcgtcgctaaatctcaacacgctcttcgccgggctcaatgcgagtacgaaacacagggatttagcaaatctctcaatgtgttatggttcacaaagaggcctttctacaggtgaattgcatttgagttttttgacaaaagagacgattttctccgtgaggcatcttcatccaaggccaaaagggagtgcaactgcaggatag

SEQ ID NO: 50909 - DNA, 501 bp, Glycine max
  Peptide Sequence Number=SeqID_167687
atgtggtcattctgcacccttttgtcatccagaggcggcgggcccgatgacacgtggagacaaaatttggtcattccgcacccctttgccattcagacacagtcgtgtccgatggcacgcagagacaaaatttggtcattctgcacccttttgtcatccagaggcggcggccccgatgacatgcggagacaaaatttggtcattccgcacccctttgccattcagacacagtcgtgtccgatggcacgcagagacaaaatttggtcattctgcacccttttgtcatccagaggcggcgggcccgatgacatgcggagacaaaatttggtcattccgcacccctttgccattcagacacagtcgtgtccgatggcgcgcagagacaaaatttggtcattctgcacccttttgtcatccagaggcggcgggcccgatgacatgcggagacaaaatttggtcattccgcacccctttgccattcagagtcggcgagcccgatga

SEQ ID NO: 50910 - DNA, 380 bp, Glycine max
  Peptide Sequence Number=SeqID_167688
ccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtggtgtccg

SEQ ID NO: 50911 - DNA, 517 bp, Glycine max
  Peptide Sequence Number=SeqID_167689
atggaactactcctcttgagagctgggcttagggaggaggaaagaacaagtattgctaggttccttagtgggcttaatttggaagtgagggacaaggttgaggtccttccatatagggacctagatgacctagtccaacttttcataagggtagagaaacaacttaaaaggaagcctacttcaaaatcttatggatctcactcttatcccaagaaagaccaaggtcaaggcattttagaggctgcaccttctaagcccatagatgataaggggaagacaatagaaaagcaaccactatctaccattaaaaggtcccattcttattggggcaaaagattagtctctaagttgagccttgctatcacttcccatctaaagccttacaaacctcaatggctcaatgaacaaggggagatgatagtcaatcaacgagtaaaagtgcccttcttcattggaacatacaaggatgaagggatttgtgatgtagttccaatggaggcacgacaccttctcttag

SEQ ID NO: 50912 - DNA, 459 bp, Glycine max
  Peptide Sequence Number=SeqID_167690
atgggtgccaagcacctcacaaggaccaaagaatggtcgcatgtcatcaaggaccgtaaggtatctccgcgtatcataatgaccaaacttggtctctgcgtgccaacggacacgactgtgtctaaatggcaaaggggtgcggataaccgtaaggtatctccgcgtatcatgggtatctccgcgtatcatgtgtgcagaatgaccaaacttggtctctgcgtgccaacggacacgactgtgtctgaatggcaaaggggtgcggataaccgtaaggtatctccgcgtatcataatgaccaaacttggtctctgcgtgccaacggacacgactgtgtctgaatggcaaaggggtgcggataaccgtaaggtatctccgcgtatcataatgaccaaacttggtctctgcgtgccaacggacacgactttgtctgaatggcaaaggggtgcggataaccgtaag

SEQ ID NO: 50913 - DNA, 473 bp, Glycine max
  Peptide Sequence Number=SeqID_167691
gggaggagcttgctacccagctcgcccaggcgagccaggttgcttcctccagaagcaaccgccttctggaggaacatcctggaaggcccaagtgggccgggttacgggaccttacgggtcacgcaattactcattttttggctttcggaatgttacaaaatctcacggattgcgtaacaatgcttccttttgatttccggcatggtgcccagtacctcgaagcggtcaaacaaaggttgcatgccatcaaacaatggtacccggatgaaattagggaaccgatcgggaaaataacaaaaaaaccacatttcccagtcaccggaggctccgcacttgataatggaggacacatgaacagcgctaggcaatcaattcacgggtctccgaacaagatttcgagggtggaggataggcgaacagcgctaggcaaatcaattcgtggggctccagactcgttggtggaggatgcatga

SEQ ID NO: 50914 - DNA, 453 bp, Glycine max
  Peptide Sequence Number=SeqID_167692
atgaacccatcaaaccctgaagtgactatccgcagaatcaatggcgacgacaaagcacagtggctggcgctgtggcagggctatctcgatttttaccgcgccgacgtggcgccgcaggtgaccgatcgcaccttcgaacgcctggggcaggatgaacaggtgtacgggctggtggcgcaggatgccgacggccaactgctggggctgatgaacctggtgttccatccgtccacttggagcgcggtcggctattgttatatcgaggatctctatgtgtcgccgcaggcgcgcggccacaaggtgtcggaaaagctgttcgaacaggcgtatcgactggcggaggcgcgcggcagcgatcgggtctactggatgacccaggagtacaacgcgccggcgcgctcgctgtacgacaaaatcggcagaagaagctcgtttatcgtttatacccgttaa

SEQ ID NO: 50915 - DNA, 1295 bp, Glycine max
  Peptide Sequence Number=SeqID_167693
atggcgggtatcagccagtcggcgcgtttggttcagcagttggcccatgaagggcaatgcaaccgcgaagcctttcagacctcgctgaaaagcctgctgcagatggacccgccctccacgctggcggtgttcggcggtgaagaacgcaatttgatggtcggcctcgaaaccctgatgggcgtgcttaacgccaacaacaaagggccgggcgcggaactgacccgctacaccatcagcctgatggtgctggagcgcaagctcaacgccaacaaacaggcgatgaacacgctcggtgaacgcctcagccagctcgaacgccagctggcgcacttcgatcttgagtcggacaccatcatcagcgcgctggccggcatttacgtcgacgtggtcagcccgctcgggccgcgcatccaggtgaccggctcgccggctatcttgcagaacccgcaggtgcaggccaaggttcgcgccacgctgctggccggcattcgcgccgccgtgttgtggcaacaggagttgctaccgatggaattatcctcactgaccgccgtttcccccgttgatggacgctacggtgataaagtcagcgcactgcgccccattttcagcgaatacggtctgctgaaattccgcgtacaggttgaagtacgttggctgcaaaaactggcggcctgcgcagaaatcaaggaagttcccgcttttgacgccgacgcaaacgctttcctcgacaaaatcgtcgcggaattcaatgaagaagacgcccagcgcatcaaaaccatcgagcgcaccaccaaccacgacgtgaaagcggtcgagtatttcctgaaggaaaaagtggcggcggtgcctgcgctgcacgcggtgtccgagttcatccacttcgcctgcacctccgaagacatcaacaacctgtcgcatgcgctgatgctgcaaagcgcccgtcaggacgtggtgctgccttactggcgcaagatcatcgatgcgctgaaagggctggcgctggaataccgcgatattccgctgctgtcgcgcacccacggccagccggcgaccccgtcgaccgtcggcaaagagttcgccaacgtggcttaccgcatggagcgccagtaccgccagctggagcgcgtggagatcatgggtaaaatcaacggcgcggtcggcaactacaacgcccacatcgtcgcttacccggaagtggactggcatcagttcagcgaagcgttcgtgacctcgctcggcatcacctggaacccgtacaccacccagatcgagccgcatgactacatcgccgagct

SEQ ID NO: 50916 - DNA, 1239 bp, Glycine max
  Peptide Sequence Number=SeqID_167694
atgacaacgaatgccgcggatcatgccacaaaatcgaggctaaacccagcgtctaatacgcccgagacgaggcggaggcgccgtacggcgcagaactgcgcagacaggcggcgaaaatcgccggcgcggcggcgcgaacttattgttgcggcggcaaataaagtgcggcggctgcatctatactgccaacgtgagccctcaaataaagatcttcatatgcacgtaaaaaacaagcagccgctgccggcggtaacgctggcggccatcggcgtggtgtacggcgatatcggcaccagcccgctgtataccctgcgcgaatgcctgacggcggaggagggcatcaccatgacgccggcctcaatctacggctttttgtcgctgattttctggctgctgacgctggtggtgtccattaaatacatttgtttcgtgatgcgcgccgacaacgacggcgagggcgggatcctgacgctgatgtcgctggcgatccgcaggctggatgcgcgctgggtgccggcggcggtgctgatcgggctggtgggcggcagcttcttttacggcgacggggtgatcaccccggccatttcggtgctttcggccatcgaggggctgcagattatcgcccccgaactggacagctttatcgtgccgctgtcgctgctggtgctgaccgcgttgttcgcgatacaaaagcgcggcaccggcagcgtcggcaaactgttcgccccggcgatggttatctggttcctgacgctcgcgctgctgggcatcggcggcattctgcagcaccctggcgtgctgcgggcgctgaacccttactggacggtgaatttcttcctcgaatacaagacggtgtcgttttttgcgctgggcatggtggtgctgtcggtcaccggcgccgaagcgctgtacgccgatatgggccacttcggtaaaaagccgatccgtctggcgtggtttacgctggtggcgccggcgctggtgctgaactacttcggccagggggcgctgctgctgaccaatccggcggcgatcaacaacccgttcttcctgctggcgccgacctgggcgctgatcccgctgctggtgatcgccacgctggcgacagtgatcgcctcgcaggcggtaatctccggcgtattctcgctgacgcggcaggcggtgcggctgggctacctgccgccgatgcgcatcatctatacctccgatcaggagtccgggcagatctacattccggtg

SEQ ID NO: 50917 - DNA, 879 bp, Glycine max
  Peptide Sequence Number=SeqID_167695
atgaacgagacctcgttctttatgtcgcgcgatacgctggtgctgggcaagcggccctggtatttgcgcgtgcgcggcaaggtgttccagctgttgcagcgcaatgcgctgcgcgcgccggatctgttcgaaatcccgccgaaccgggtgatcgaactgggggcgcagttacgccaggcgctgttcgatgatgccgccgccgaggcagatttcgccctggtagaacactgccgactggccgggggtgacggcggagaccggttcgtcgaaacgcacttcgatgcgttcgctgtcgagcggggtcacggtgcaagggatatcctgctggcgatagcgggtcttcaccgtgcagcggaacgggccgctcagcggcaggcgatccacccagtgcagctgctgcgcgataaggccggtagacatcaggcgcgggtgatcgtgcccctgggcgaccaccagcacgttgttggccacgtctttatccaccacgtaccaaggatcttcgctgctgtctttcaggccgccgatgcccagccctttgcgctggcccagggtgtgatacatcaggccctggtgttcgccgacggtctggccgtcaacgctgacgatcgggcccggctgcgccggcaggtagcggccgaggaagtcgcggaacttgcgctcgccgataaagcagatgccggtagaatctttcttcttggcggtgaccagctccaactgctcggcgatgcggcgcacctccggcttctccagctcgccgaccgggaacaggctttgcgccacctgctcgtggctcagggtgtagaggaagtagctctgatccttgttgccgtcgacgccgcgcagcaggcggctcttgccgtctacgtcctggcggcgcac

SEQ ID NO: 50918 - DNA, 228 bp, Glycine max
  Peptide Sequence Number=SeqID_167696
atgtccaactttaccacacttatgagatttgcctgctatggcacttcacatggtggtacttcacacatcaaagccaacctctctcctagtatggtgtggtttaaggacgaactaggtgaaagtggtggatatgtaacaccccggatgaatcaccctagaaaaaagagggatgcagaggctatgtgtggcgtccccaaactaatgactggtttaatagtaatgatttaa

SEQ ID NO: 50919 - DNA, 309 bp, Glycine max
  Peptide Sequence Number=SeqID_167697
atgccaatctccccctgcaaaagtatcagttgggatcgcacccacaagacacccagtggacccggaaaagtccaacagggccctggggtttccagctctggttacgggcctctatcagtcctacagggtgcccggatcgcacctgcaagacacccagtggacccgaagaagtccaacaggttctacagagtacctataacctccagcaagggcatcaggccccctactgatcgagctttcatcaagaagtactgcgtccctaggcaggcgcagggcgaaacaccacagcagcattgggatggccggtag

SEQ ID NO: 50920 - DNA, 372 bp, Glycine max
  Peptide Sequence Number=SeqID_167698
atgacttatcctcttttgattaatcgtattttgtatgttgttgtatgttattgtataaaagatcatgggttctccacctgcctcccctcctcctcctcctcctcctcctgctccttcggacgcatcggcttcgccgtctaccgtgaagcggacatgcaagcctcacgtctacgatcgttgtctactagaccacctggtgctgacccaccagtggtccatgttgatcctgctactggcaaggccaacggtccccacaggaagaaattaagaatatatttggggattgtggtgcgtgataaagtggatgtcacctatgagaacaggaaggaggtccctactgctcagaaggacctgatttgggaggatattaag

SEQ ID NO: 50921 - DNA, 1389 bp, Glycine max
  Peptide Sequence Number=SeqID_167699
gtattggttttgcttaatggtaaaagaagacatacctcttcgctggttaatgtaaatggttctcccggaagaggttctgtgggaaccgatctgaatgcattgcctgcatttgctatagaacgtctggaagtcctgagagatggagcttctgcacaatatggttccgatgctattgcgggggtgattaatgttatcatgaagaagaatactaatgcatttacttcggcaattacagcagggggatttaattccaaagggtccaatgaccacagcggaggctgggatggaggtaaatatcaattagaccttaattatggtacagctattggaaagaatggattcatcaattttacggcaagtttaatgaagcgggaagagacacgaagagccaatgctgctaccgggcagatttttaatgcctataatgctatcgaacaaagggcgctggagaacggtgtcaatatttcctcccttttcggaaatatcgggaacactcccaattcccaacagattattgattatattcatctatatgctcaaaatgtaaattattttagtcccgcttttcaaactgagattcagaatgccaatagtatttctcagcttcaaacacttttaaaaactgatgtttcagaaaatgaaatggcatatagagggcttgcgagaaatgattttaatatgagagtagggcagtccaggttgacatcggggcagtttttcatgaattctgaatttgatcttgcttcttccgtaaaaggatatgcttttggggggatttcctatagaagtggcaatgcgggaggttttttccgcaggccttatgagagtagggcttctacttctatttatcccaatggtttcctgcctgaaatcgcttctgatgttatagatctttccctggcaacaggttttaaaggtaaaatagggaatattaattatgatataagcaacacatacggtaggaatactttcgattataccataaaaaatacggcgaatgcttctatgctttatccgagtaaaacagaatttaaagctggaggactcaatttttcacagaataccgttaatgcggattttgatacaaaagttgactggcttcaggggtttaatattgcatttggtggagaggccagatttgagaggtataaaattcaaagtggagaacaggattcctgggcactctatgatattaatggcaatgttcaggatgtttcaacacctgctaatcttaaaccgactgatttttttggtgcggtgagacccggtggagctcaggtatttccgggatttagaccagccaatagcttaaataagggaagaagttccgtcgcgggctatatagataccgagcttgatgttacggataaatggctgataagcggtgcc

SEQ ID NO: 50922 - DNA, 210 bp, Glycine max
  Peptide Sequence Number=SeqID_167700
atggggtcgagtcaggcgccttcgcttaaaaagaggttctatcaagtcaaggtcaagagcctaggagtcactagtctgaaagagttagggcagttgatgggtcagctccagcgacaagcctttcgcaaagcttacgaactacataggtctgatttcctcttcaatggaggatacgtagaagcaaaagccccgcttttgtcgacctcgtga

SEQ ID NO: 50923 - DNA, 806 bp, Glycine max
  Peptide Sequence Number=SeqID_167701
ggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgggccactggcttttcaaccaagcgcgatgaccaattgtgcgaatcaacggaaagagccgacatccgaaggatcaaaaaagcaacgtcgctatgaacgcttggctgccacaagccagttatcccttgtgggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggatagtagacagggacagtgggaatctc

SEQ ID NO: 50924 - DNA, 2085 bp, Glycine max
  Peptide Sequence Number=SeqID_167702
atgaaaggtggggtgagaaggggagtggacggtgggagaggggattcttggcggtgggagaatggaggtggtgcttttcacacaaaggtgcaatctgatgatgggtggaatcttgtgcaatatcgtaagaggtgggatggtgggagaggctctggttataccaaaccagatatttatcaatccagggaccaaaggagtaaggagcaactccaatcaacaacgatttacattaccaattttgcggaggagatgaatgcaaagcacttgttcaacagtctcaggagctatggtgacttgcaagaggtggtgattccggcaaggagaaataggttgggtaaaaggttcggttttgctcgtttttgccggattcaagagccggaacgattcaccatgaagctggacaatattttcattggaggggataagatttttgcaaatcttcctcgatatcaaagagatcaagcgaagaagatgcctggaggtccaatatctaaggagagtgtgtcggtggtatggaagtcaactcaggtgtggaaaccgaaagtcattggccaagctagtaaaattacaaacggatccatgcatgtccaaatgggtggcgagctgaagtatgaggcaaaggtggaggatatgaagcgtctaagtaaagctatggtcggagttgtgatacatccgggccaatcttatcttatacaagaacattttgctatgcaaggggtgtttacaattttagttactcccttaggagctaacatggttctcttagaaggtagtgtaggtgtcgaggacttccaaggctacatagaggaagcgaaagggtggctacaacaatggttcaaagaaatcaagccgtggaatgcgtcgatcgtagacgaggaaagattggtttgggtgagatgttacagggttccaagccacgtatgggactccgatttcttctcttttttaacgaaggatattggcgtttttgtaaactctgatgacaacaccatgaagagaaagacaatggatgtagctcgattaatggtgcgcacagtcaaaaaagaggaaattcatatgatccgcaaggtgtgcatcaatggcgtctctttttccattaagatggtggaggattggtttggtccaatacaatggagtagtttacaggatcaaagtaagcgcgagttatataatgatgaaaattcttccagtgacgatgaagtgtggccggagagttcgccagaagatgatttggtgaaggaggatgatgaagctggcagttatggaaataattcagcattaaatgaggcattaattggaatatcaatttcaaattcaaatgaaggcaataatgagttggtaagtaaaagtggtaatcaagaattagaagaggattacatggaggagataaaagaccactcaaaggataatttattgtgttggaactctgctggagattttatgaaacaattagagagtcaacaagtgggggaatattcagcaaattcgcatgtgagtgcaacacgtggatcaggggggtgtaaagagggtttttgtgaagaaagcccaggaaattcattaagttcgtttggcccaattgtgtctcagaatcatttgggtccagtttttaataataactcaggcccattagtggaaagactctcttcaatccaaagaaacaatctctcttctcagatcccacgcatgaaacagagaaaactttccaaacgtggctttctatcaaaaccgggtcgggcatcacgttccaacaggttcaatcacgatttgaaatcaatttctcagcaatcctccatgaacgaagctcctgtaaagtcgcgcacagcaacagagcaagccgcaacgcatttctctggtggctcggtcttgtgcggtgggtcattgtcaagcgctgatatgcgtttatgtaacaacaagttttgggttttacagagcaaatcagtggtgcagagggtttgggaagaggcacgtcacattggggtggaaggcacggagaaggacgaggtgtacattcagcagattaatttatgtgagagcagagatgcagttgcaaagcagcagagggtgaacaacaatggtgtctcatga

SEQ ID NO: 50925 - DNA, 201 bp, Glycine max
  Peptide Sequence Number=SeqID_167703
atgagaaaggaggtcgctatcacaaagggtggtatgcctctatggcaccaccggtgcaggggccgacgtccaatccacatgaacctcgtcgacgatcaaggtgccctcggtgagatagaacaaaatgaagcagcagatcgcaaaaaagaaaagaaaggagaaagaatggggagaggaaaacgtgagaaagtgagaaaataa

SEQ ID NO: 50926 - DNA, 447 bp, Glycine max
  Peptide Sequence Number=SeqID_167704
atgggtcgtggggtcagtgctggtggtggtcagagttccttaggttatctctttggcagtggggtgcctgccagcagtgcaaacagtcagcctgcaaatggtgctcgcactcaaaatgctagtgctccttcaccaccagtcgataagcaaagtccagcaccagcaccagcaccagcacctgcatcatcaccaattgataagcaaattccagctggaattcctggaagtcttaaaaacaattaccatcgtgctgatgggcaaaactgtggcaactttcttactggtgagccttggtgcaatggtaaggttgctgccttgggaccgataggtctttgcttccaagggcaagtgaagccagcagaggatcggccatctaccaaggttcatgctgccccaggtggcggatcttccttgaattacctctttggtggtcctccagggaactaa

SEQ ID NO: 50927 - DNA, 1332 bp, Glycine max
  Peptide Sequence Number=SeqID_167705
atgtcacatgcccctcaatgctccgggcaagccctcgccttaggggagaaattcgtgtggtatgcgcctcacagcgggttcagcaaccagctttcggagttcaagaatgctgttctgatggcggggatactgaatcggactttggtggttcctcccattctggatcaccatgctgttgccctaggtagctgtccgaagtttcgcgtagtggatcccaaggatgttcgaatttctgtttgggatcatgtgattgagcttgtccagagtcgaaggtatatctccattgctgaaattatagatgtctcatcattagtttctccctctcttgttcgagtgattgatcttagggattttgtgtcaatatggtgtggcatcagcttagatttggcttgcgtaaaagatacaaagttgcagtcctctgtttctgaaagcctaaaacaatgtggatctctgctagctgggctccatggtagtattgaaaagtgtatatatgccgtcaatgaagattgcagaactacaatatggactttccatacagatggccatgaagacggaaagttagattcattccaagcggatgaacaactgaagcaaaaaaagaaaatatcatatgttcggagacggaaagatgtatttaagactcttggacctggttctgaagttgaatcagcctcactgctagcatttggaagcctgttctctgccgcatacaaaggttctgaactatatgttgatattcatgaatctcatcaggatcagaggtttcgatcattgatggacaagattaaacatcttccatttgtcccagaaattatgattgctggaaagcagttcgttaaagaaaccataaaggctccatttctttgtgcacaacttagactgttggacgggcagtttaagaatcatcaaaaggctacctttcacggattaaggcaaaaaatcgaatctttgaggaaggaaggccctctacccgttcatatttttataatgactgatcttcctggagataattggactggtacttatttaagtgatttaattagtgacaaacataactataaggtacatttcttgaaagagaatgataagttggttaggcgagcagccataaaactcatggcagcgggtcatggacagaggttcatttcaaattcagatagtacaattagtaaaaggtattgttccagtcagagactaccagatctacttctttatgttgagcagactgtatgtagctgtgcatctcttggttttattggaactcctggatcaacaattgctgaaaatatagaactaatgagaaaatttggctcaagctcccagcaatgttga

SEQ ID NO: 50928 - DNA, 255 bp, Glycine max
  Peptide Sequence Number=SeqID_167706
atgcattcagctgttttgggtgaaaaaaatattttccgtgaagaaaatccaagtcgagatgcttccgtaacgcttccgagacatttccgtgagcaaatccgtgaaggttttccatcgttcttcaccgttcttcgttcttcaacgggtttgatttcctcatcgcaattgaggatacgtaggagcaaaagccccagttttgtcgaccaccccaagagatcgttaatggtccaacgccaaaacatttctctactttaa

SEQ ID NO: 50929 - DNA, 1716 bp, Glycine max
  Peptide Sequence Number=SeqID_167707
atggagtttggaagtggttctcctggtgatcgccatcatcaccatgatggttcttctgattcccagcgaaggaagaagcgttaccaccgtcacacagctaaccagattcaaaggcttgaatcgatgttcaaggagtgtccgcacccagatgagaagcagagattgcagttgagtagggagttaggcttggcgcctagacagatcaaattttggttccagaacaggaggacccagatgaaggctcagcatgagagagctgataattgtgcactccgggcagagaatgataagatacgttgtgagaacatagccataagggaagccttgaaaaatgttatctgcccctcttgtggtggtcctcctatgaatgatgattgttattttgatgaacagaagttgagattggagaatgcccaactcaaagaggagcttgatagagtatctagcattgcagctaagtacattggaaggccaatttctcaactcccacctgttcagcctatccacatatcttctctggacttgtcaatggggacttttgcaagccaagggttgggtggcccttcccttgatcttgatcttctcccagggagttcttcatcatccatgccgaatgtgcctcctttccaacccccttgtctttcggacatggataagtccctcatgtcagacattgcctcaaatgccatggaggaaatgatcaggctattgcaaacaaatgagcccttgtggatgaaaggtgctgatgggagggatgtgcttgatcttgattcctatgaaaggatgttccccaaggctaatagtcacttgaagaaccccaatgttcacgttgaagcttctagagattcaggagttgttattatgaatggcttaactttggttgacatgtttatggacccgaacaagtggatggagctattttccaccattgtcacaatggctagaacaattgaggttatatcttctggaatgatgggtggccatggtggttctttgcaattgatgtatgaggagttgcaagtgctttctccacttgtttctactagagaattctatttcctgcgttactgtcaacaaattgaacaaggcttatgggcaatagtagatgtttcatatgattttactcaagataaccaatttgctcctcaatttcgatctcaccgtcttccttctggtgtctttatccaagacatgcctaatggatattccaaggttacttggattgaacatgtagagatcgaagacaaaaccccagtccataggctctatagaaacattatttacagtggcattgcatttggagcacaaagatggctaactacacttcagaggatgtgtgaaaggattgcttgtctattggtgacaggaaattcaacccgtgatcttggaggagtgattccttctcctgagggcaagaggagcatgatgaaacttgcacaaagaatggtcaccaatttttgtgcaagcattagttcatcagctggccacagatggaccacactctctgggagtggcatgaatgaggttggagtcagagtcactgtgcacaagagctcagaccctggccaacctaatggtgtggttctaagtgcagctaccaccatttggctccccatccctccacaaactgtgttcaatttctttaaggatgaaaagaaaaggcctcaggttgtgacatgtttaactcaattgtcttatctgatgttgtcaccttag

SEQ ID NO: 50930 - DNA, 222 bp, Glycine max
  Peptide Sequence Number=SeqID_167708
atgttacttccttcgggcccggaagaggagtcagtatcactatcatggggacagatgtcgtacaggatgtcacgacatcacgcttcagaacatgcagattatatgtgtccgtatgaacagattaaacaagtcaataacacaagagaattgtttacccagttcggtgctacctcacctacatctgggggctaccaagccagggaggaaatccactctcaatag

SEQ ID NO: 50931 - DNA, 216 bp, Glycine max
  Peptide Sequence Number=SeqID_167709
atggttggagcattctcgcaaaacatcgtgaccctgactggtcttcctatgatcttacttagtgagagtgacctgacaaacccattgtgtggtgtgtcttgttatgtactcctaagcgccccagggtggtttttcactgacatgatgaataggtggatgactatgaagaacctcatgctagaggacacgggaacaccacactctgataggatgtga

SEQ ID NO: 50932 - DNA, 203 bp, Glycine max
  Peptide Sequence Number=SeqID_167710
atgacatgtagcaaagtcctcgatcctgtcaagtttgatcacctggaaaatgaagccgcaataatattgtgtgagttggagatagaaatcaaatgtcgtggtcctgtttatttgaggtggatgtacccggttgagcgatacatgaagatcttaaaagagtatacgaagaatctacatcacccggaagaatctattgttgaaag

SEQ ID NO: 50933 - DNA, 312 bp, Glycine max
  Peptide Sequence Number=SeqID_167711
atgcatgctttgttagggtcattcaacagtgggaactggtctgattctaaagtccttggtagtacgggactaaattgtagtgctatcacgggggatcggggtactttagttcctttggacttagaaatagatgctacactaagaaggaacagggttgagaggagaaggaaactgttgcaagacagaacagttgcgtccattcttgaggaggagactcatttttatgattcattatcacctgattcaccatcatcaggggaatccgctaatcaacattttgaaactactaccatggcagatgagcatgattag

SEQ ID NO: 50934 - DNA, 183 bp, Glycine max
  Peptide Sequence Number=SeqID_167712
atggtggttgagagtgatgttggtaacgatgatggtcaaaagattctaagtgattgcagaacatcacgaactgacgaaggcatagcgacaatgggagaaactctcaatcccatccatgattatgacagtttcttctgggtccatcttcctcttaatttcaatttttccagaaccatagactaa

SEQ ID NO: 50935 - DNA, 540 bp, Glycine max
  Peptide Sequence Number=SeqID_167713
atgagaagtaggcttccacggaaatacattgacagagatcgtgaagaagggcaattagaaagatttttcaatgactatgtctccaacaatgcgatatacatagatgaacaatttcaacaaagatttagaatgtgcagggatgttttccttcgcattgtgcaagcccttggcaatcaagattcgtattttcagcaacaagttgatgcaacgggaaggatgggcctttctccattacaaaaatgcacagttgttattcgcatactggcatatggatcaccagttgatagtatcgatgattatgttcaaatgggagaaaccatgactttactatgctttgataagtttgtaaggggtgtatatgatgtttttgaagctaagtacttaagaagacccaacaataatgacatccaatacttattgcaaataagtgagcactatggttttccaagttcagacaacgacatcaatgtgttcaacaaatttcctatgtttaaagatgttatggaaggagaagtccctagtaaaatttgtagtaaatga

SEQ ID NO: 50936 - DNA, 1620 bp, Glycine max
  Peptide Sequence Number=SeqID_167714
atggagggtcaatatcaattgagggaagctagagtgtgtaagagacatggaagacaaaaggtgtgcaaggttgcaagcgattgtggaagggatcgtcacgagagagttgaatgtgagaactgcgcatgcaaaataaattgggccgatttggacacacaccccgtcatcttcttcttgttctgtgccgcactctcgctcgcagttacagaaaccatgacgacggtggtgcccacctccgaagaagacgctgctctctctgttgtccgattcgcctctgaactcgcctgggccgatgccggtcccgagccgacctctcctggtggcataaggcctttgttttttgtcctaagggataaggttgctgagcctcaagttagtagactctgcatggaggctgaagagtttatcgttatgggaaaatggttggaactagcatcattgatgattacctctgctgaattggttttctcaaaggtttctgaaacagatatagagtccatcttcactatcatctgcaatcttgtgacaaagactgagaatccagatgaagtgatggagattgtaaaagttataactgcaaaaataattcagcagccaaacgaaaagcctgctgtgcgattgaagactttgatcaatctgtacaatcttttggagactccatactgccagttttatgtctacatgaaggcattgaatttagctgttaatgggaaagtcacagaatacattataccttcattcaaaaagatagatagcttcttgaaagagtggaaaattgggatacctgaacagagagagctctttctcactatctctaatattttgaaggaaaataaaagcatgtcaaaggatgcttttaagttcctgagcaattatctgtcgaccttttcgggagaagatgcacatgttttgagtgaagccaaggaggaggccgcacgtgcaattgtggaatttgtcagagctcctgacatatatcagtgtgatttgcttgacttgcctgctgttgggcaactggagaaggatgccaaatatgctctgttatatcagcttcttaagatttttcttacccagaggctagatgcatacttagaatatcaagctgcaaattccaccttgttgaaaaactatggccttgtgcctgaagaatgcatttccaaaatgaggctgatgtcattgatggatcttacctctgatggttctggccaaattccatatgaacttattagggacacacttcagatcaatgatgatgaagtggaactatgggtggttagagcaataactgccaagttaattgactgtaagatggaccaaatgcatcaatcagtagttgttagtcatcctactgatcgtgtgtttggtcagcaccaatggcaagcactgagaacaaagctagcgacatggagaggaaacattgcaaatgttatcagtaccattcaggccaacaaaataacggaggatgggtctcaggcagcccaagagaaggaaaaaattttactccccaactttgtgacagaaccattttgttttaagcttttccattttgatgttatgtttgaccagcctcacgatagcgttgagtatattatacctgtggactgttgtccaagtagctcctag

SEQ ID NO: 50937 - DNA, 306 bp, Glycine max
  Peptide Sequence Number=SeqID_167715
atgaagggtcttctccttgtgttgatgatcattctgatccactacaaagttgtaaatgccaactacaataaggagtgtgccacagaaaattgccttattggcaacgatttggaatcagaattctcctttggttcccgtgtggccagaatgctctatgatgtgagtcaatctgtgagtggcaaaacaggcaatagcaacaacaaagctgttaattgcacgcaaaccaaagattaccgtagctgcttgccacccaaaaacggaggtggccctaaccaacgttgtggtgattacaccaggaattgctaa

SEQ ID NO: 50938 - DNA, 243 bp, Glycine max
  Peptide Sequence Number=SeqID_167716
atgaagggtctcattgtgttgctcttcattctgatccactacaaagttgtggtcaacggcaactacaacaacgttgtcatcggcaatgagttggaaacagagttctcatttggctcccatgtggccagaatgctctatgatattcaaaaacagaaaatagcatctatcaagagctattcagcaaagatgtatattgattccatgtctatctggtctaactatgaacgatcgtgtaatcagtga

SEQ ID NO: 50939 - DNA, 852 bp, Glycine max
  Peptide Sequence Number=SeqID_167717
atgccctcaccttcagaggattgcacgtcctcgccttctgatggcttcacgtccacgccttcagagggctacacgccctcgccttcagtgggcttcatgtcctcgcttttagaggactgcatgtcctcgacttcagcggagtgcatgttctctccttcagagtactacatgtcctcgccttcagcggagtgcacgtcttcgcctttagaggaccgcacaggccttcacgtcctcgccttcggaggactacacatcctctcctttagagggcaacatgccctcgcctttagaggactgcgcatcctctcctttagagggcttcacatcctaaccgtcagaggcctacacgtcctcgccttcatagggctacacgccctcaccttcagaggattgcacgtcctcatctttagcagagtgcaagtcctcacctttagcagagtgcacgtcctagtcttcagagggctgcacgccctcaccttcagagggctacatgccctcacattcagaggacagcatgccctcgcctttagatggcttcatgtcctcagcttcagaggactacacgtcatcgccttcagagggctacacaccctcgccttcagaggactgcacgtccacacctttagagggctacacgccctcgccttaagaggactgcacgttctcgccttcagcggagtaaacgtcctcgcctttagagggctgcacgtcatcgccttcagggggctacacgccctcaccttgagagggctacacgctctcaccttcagagggctgcacgtccttgccttcagaggactgcacgtcctcgactttaaagggatacatgacctcaccttcagaggattgcac

SEQ ID NO: 50940 - DNA, 297 bp, Glycine max
  Peptide Sequence Number=SeqID_167718
atggtggtgactgcacgcgcggatctgggtcttggagtgacaacgcgcgcaagaggggttgtcgggaatgcaagtgcacaccctcactcactcacatgtaggtccgccacttatcgaatgcaccaagatatggagaggacatcgggatgcgcaatgatagatccagaaatttgtatcagtagaaacaaaaaacatgtgggggcaattagccctagttatgcaagtgcatccgccactgggcgtgcgacagttgtcaaagttggagctggtgcgaggcgtttgtgcgcgcggaggtaa

SEQ ID NO: 50941 - DNA, 942 bp, Glycine max
  Peptide Sequence Number=SeqID_167719
atgaagctttggtcagcccaaaagacctcaaatttgactgctgagtttgataacctcttgctggactccaatttcaggggagggggcattgcaataaaaaactcactaagaatcaacatagacaattgttacattacacatttctccaccactggaattttagtccaaagtggccatgaaacctacatcaggaacaccttcctaggtcagcacatcactgctgggggagacaaacatgaaagggacttctcaggcactggaataagccttcagggaaatgacaatgcagtcacagatgttgtgattttctctgctgacataggaatattggtcactggtcaagccaacactctttctggagtgcattgctacaataaggcctcgggctttggaggcacagggatttatttgaaacttcctggcttgacacaaactaggattgtgaattcttacatggattacaccaatattgtcgccgaagacccggttcagctccacatctctagcagtttcttccttggtgatgccggtattgtgttaaaatcagtcaaaggggttgtaagtggtctcaatattgttgacaacatgttctctggcttaaataaaggggttgatatagtcaagttggaccaatcaaatagtcattttaatcaaattgatcaagtttttgtggcaagaaatgttgtgaggggtatgaacttaaaggccacagctgcaaagatgtctttgcttggtaatggaacctcatggactgctgattttaacaaagttttgcttttccctaatcttatcaagcatgttgtgtattctttaagtgccagtggcaacaccttcccgaatcatgctctcagaaacgtttctcagaatcgcgttgtgatcgaaacggatgaggctgtgaatgcaaatgtttttgtcacagtggatcaaggtaatgcaagttga

SEQ ID NO: 50942 - DNA, 738 bp, Glycine max
  Peptide Sequence Number=SeqID_167720
atggcaaattcaaacttaactggatccattccctgtgatcgagcaccacctctctatattgcgacctcgcgatcatcaacaaggttgactctgtacacaacaccaaagcttcccgcaccaatcttgttgtgccgtgagaaattgtcgatggctgctttcaactcagccggggtgaataatcgtccaccaacatgtccagtcacattcgacaccctttgtgacaatcatgcagaaacaatccttgtgtcctctacggaagcaaaaccatgggcaagagatgcttcaaaatttgaggcagtcctattacttcttattgtgttgtccatcgccaaagaaaaaccatggacaaggaatgttttaaaagttgatgcagtcccgctccttatcacgctgcccactactgaagcaaaaccatggacagggaaagttccaaaatttgatgtagtcccagtactattgcttatggcattgtccactatgaaagaaattctttggataagcgatgctccgaaatttggtggagtcctactccttatcggtacatctacatggattgttgtaactgagaacaagagagggtacatctcttgtggatcaggtcaagtggagggtacatccacttggttgttcaaagagaacaagggagggtacatcccttgtggatctttgcttgtaaaggcttttacaaggttgaaaagaaatctcaaggaccgcaggtcgcttagggactggatgtag

SEQ ID NO: 50943 - DNA, 471 bp, Glycine max
  Peptide Sequence Number=SeqID_167721
atggcaacaatatctcgaatgtggttcatatttcttggaataacttgtttctatgttacttattcttatggtgagaacatgcctcaaaggactctttctagaggcactcatcaagaagcattgcttggacttaaggcattgaaggcctctattactcggcgtgactccattgcttcaacaccaccttcattctcaccctctcctactccttctcctcttccaccacaggaaatcaagaaaccacatgtgtaccttgtgacatcttatggtgcagatccaacaggcaattcagacagcactgaagctcttcttgcagccatagcagatgcagccaaaggtccaagtgaagggttcttaatgaaggacatcaaagatcttggaggtgctcagattaatcttgagggtggaaagtacataattagccaaccactgaagttgcctctggccagggctggaaacctcatggtatga

SEQ ID NO: 50944 - DNA, 615 bp, Glycine max
  Peptide Sequence Number=SeqID_167722
atggagacacctgtggtactagctgagggtgaaaccttacccacatattccagatactactggttgcccactgatattagagaaattgaggctgccttatgtatcccaggtcgggggtttgttttgaatgctgaaggccaccctgggaagattctcaggaaagatttaacaactcttgctcagatggacatgaatttgggagccctcatctctggtcagattacatctatggcccagtctaactcttctagacttgggttccttgctcttatcatcgctttatgtaagtccagaggggttacttctgacagtctggtcttcgaacgcctgagctcggtcattaacttggcctatatcaagaaaaattgttggaaccctgatgatcggaccgttactatcagaggggccagtagagcgaggacaaggccagctgaggccccttccacatctacagctcctcctccagcacgtaccccagcagctccttctgccacagctcctgcagattttcagcgtcttgaagccatgcttcaaagcatccatcaggggcaaattatcttattacaaagtttacagatggtggcacctccaaactctattccttcaatagagtag

SEQ ID NO: 50945 - DNA, 614 bp, Glycine max
  Peptide Sequence Number=SeqID_167723
gtcccgagtcgatcgggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattgggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggcaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgtatgtaaatgttgtgtcgtgacgactcccgcgggacaccgtctccgggcccccgggagtcgcacttaa

SEQ ID NO: 50946 - DNA, 219 bp, Glycine max
  Peptide Sequence Number=SeqID_167724
atggattataaaagagatagatacctggcagagaatgtgaaccgcagaattgtagcaacggataacgaattggtggaaataataataaagaagggtgagggttacttacgtagacaaagtgagtgctccaagaaagagagaagaatggactgcgacggaggtgcagcggaggacggaggtgacgacaagcagacaactaaagatgtgaggctgcaatga

SEQ ID NO: 50947 - DNA, 351 bp, Glycine max
  Peptide Sequence Number=SeqID_167725
ccctttgtcaaagtcaagagatccttctctataggtgcaaatgtagttacctccttcggtaaccgcaaagagagggatggctcttgggtgaagaaggatgctccggtacaagccactgaagactgctctccatcaccacattctcagagagatgactcttcatctcttttgcacaacattcttgaaaggtttgatggacttcaaacctatgttggtgagaggtttgatgctttggaacgacaagtggacacgcgattcgatgcaatggactcaaggatcacaaaggttgaagaagatgtcaccattattcgtgactatcttgatttacctcctccaccaccattagtttag

SEQ ID NO: 50948 - DNA, 336 bp, Glycine max
  Peptide Sequence Number=SeqID_167726
atgctgaggataactcaaaaagcaatttttttattaaccctaaccctaaggtatttggaagggcagtctcgaaaaccgcaaacttcaaatgttatcgtgaagcagccgccgtgggtgaaggtgcttgaagagtcagtgttgatcctaggaacatggacgaggcttatgttttcaagtgtaacaagcaaaaaagccaaaaaaattgaagaaaagaagaaaatttggagtaggcccagcccaatacgtgcgcttagcgcgcgtcacgtgctaagtgaggcattaagctcgagagttgtcatgtgtgttgagcgcgcaataggcgctaagtgcgcataa

SEQ ID NO: 50949 - DNA, 470 bp, Glycine max
  Peptide Sequence Number=SeqID_167727
gttttaatgcatacattgaatttgaaagcagtgataatgatgactttaagccatctaatatggatgaggataatatgcagacaagtttggattttgagactgagtttgacgatgttgttgatgcctctatagaagcacatgtcattggcatagatgaagaattgtttgttgatttgtcgaacatagttgatttagatgaggactgcttgactaaagaattacaaagtgacaatgatggagagagaagtgtcgccaacaaaccaatgatttatagattcagacaagaggacatttgtaaagacttccaatggacactaggaatggaatttaacacactagcagaattcaaagatgtcgtgttgcagtattcaattttaattagtaaagaagtgaagacattgcattttaagcacacattaagcagggtcttctggaataaaaatgcaaagtcaaagtgggttgcgaagtag

SEQ ID NO: 50950 - DNA, 3084 bp, Glycine max
  Peptide Sequence Number=SeqID_167728
atgtctaaaaaggttttgacatcaatgaaggatgaaaatccagatttgcagaagcaaattgggtgcatcagtgggtttcttcagctgtttgaccgccacagtttcctcacaggtcaaagcaatagcagccacaatcagaacataccaaataataaaggtggaatcagcaaccatatcaaagaggtgaataatacaactcaaaaggcaacggcaaataatgtgaaggttgcaagagagaatcaacaattctccactgaatcatcaggaacttcaatgacttcatcgtctcgctcatctagcatgtcgtccctcgagtttaatagaacaattcagatagagccaccaccaatcaatcaaatgaaaattccagaaaactctaactcaggagcagcaatgaagcaaggcagccaaggccatcaacctcttgatttctatgatattgtcaaagagtcaatgcatagagatgttcatggattgtcagtaaaaactgtagctaaagaggaaaagaagggtcgtatcttgaaatacattgactctcctaggcctttggagccctccaaatttgtcaatacaggagttatggttgcttgggattcaccaagactctcttatgatgggagggacacacaagatacattcaaatccgctacaaagccaaaggaactcccaaggctttccttggacagcagacaaggatctatcaaaagtttcaatgaaggaacaaaatctcgtagccttttgaagggtccccagaaagggtatggtagctccagtacaatgcagctgcaggaaccagaaacttctagaagaccatccagtgttgtagcaaagttaatgggacttgaagccttcccagactgcacagaaacttgtgatactccgccgcgaatctctagctgcgccaccaacaaaaatgagacaaccgcaggacctagcacaaatgatgagtacaagcaacaccaaagtgcagcatcatcccagagaacaatcaaggggtctaccttgcttcagtttaggagggatgcttcaatcatgaacatgacgccatattcacggttttcccttgaaccaattccgtggaggcaacctgaagcaagccaaggttctcaattacagaattctaagagaagcgaatcttcagcaaaagcatcaaaactgtccctctctgtatatggggaaattgaaaagaggatagcagatctagagttcaaaaattctggaaaagatctcagggcccttaaacagattcttgatgcaatgcagagatataaagaatcattggatattccaagagatcaggtgtctaattctctatctgacaatagaagtaatagcagtctcagtgaaagctcaatagtaaaaagcccaagactacggcagaaggacccaacatccaccactgttgagatgtcaaattcaacccagggtagtaagtcgccgattttcatcatgaaaccagcaaaagctgcaagaaaaaccaatagtccagcttccacagaaatgtcatttcagggtaaatcaggccccagcaagtttagccctgctaaccgcacaaatggaataatgggtgacaagcttgacaggcaaacagcaaagggtattggtccagcaatcacacatgccacagatcccatcagccaaccctttcactcagtgaataagagtaataagaagagaacttcaaaattgatgcaatcctcaaaagttcgtcaagtaatcaatggagaaaatgccaccaactccagcaatacagcagaagccaagagcccaagactacaaaagaagtttggtttggagaggcgttctccgccaactagcccatcatcagatttgagcagtaacagaagacaacagaataggcaatcggtggaattgtcttccccaagtacaacacccagacaaaaattcagtgagattagcaatcaaaggagggattttaagcatgaagttgacctagaagtcattcacattgatcattctgataggatcaatggcaacaccatccagctaaagggcattaaccaaaataatgctgcagaagagttgagcaaggaaagctttatggctgagaaaacaattacagcagaacagccaagccctgtgtctgttctagatgcttctttctacagagaagaaccaccttctccagttaaaaagaaatcagacatctcaaaagatttagatgatgctctgaacacttatgatagtagtgaggagaactcagaagatcttccactttcatccaacactacaaaagccaacttcagcagtgatactgacttgagaactcaaaatttggtcgaaattctccaacaaattgacaacagtgatgagagattcaccaatttcagagacaataaagatcctgatcatagatatatatcagaaatactgttagcatcggggctgctcagcagtccaagctctagccaggtttttcattcatcaagttacccaataaacccaaagttgttccttgcactggagcaaatcaagacaaacaagatgtgcttcaacattgaacataatgccaagaatattactgggctgaatagtcctgagcaaatgcaaagaaagctaatatttgatgttgttaatgacattctagctcagaaaataatattggaaagttctactctgtggcgccaaccaaatcagcaagcaggtagaaaactaagtggacagctgcttttggatgagctttgcacagaaattgataagttgcaacataaaaatacaaatgtcaacctggctgatgagaatgagaatttgacaagtctcctgtgggaagagttgatgcactgtcccacaatttacacaaacagttacagtgaaataccaaatgtcgtgttggatattgaacggttaatcttcaaagatttgataactgaagttgtgagaagtgaactagctaaccattctggctcagctcctccagaggtgcttaatgcctcaatcgttgatttattgcttccttcgattcaatacttttgtattttgcctatgcttgtccatggaaatggaagtaacagtggaagcaggaacgagttcatggcaaaccttgacttctcaatacaggaataa

SEQ ID NO: 50951 - DNA, 267 bp, Glycine max
  Peptide Sequence Number=SeqID_167729
atggacatagtggagtggattcatggttctgatattcctaagaaacacatggagggccctgagcataaggtgttcagagattggatgcgatgggcttgccatgaaaccaacaggttcaatgctaagtggtttatgtacaattatcctgatccaccttctgggtgtagtcacaacctttggaatgatatactattgcacttcatttgtggaagaatcaggagaagtggattcagactttcacctatttcaaccacaccgatgctttga

SEQ ID NO: 50952 - DNA, 879 bp, Glycine max
  Peptide Sequence Number=SeqID_167730
atggattctgagtcaactatagcaggcaaaaggaaaaatgataaagtgttgaattcttatactgatgaaatgaagatggtatctgctgcttctatcataaatgaagattttagttcagaaatttctaaattttctttggatggaactcaagttcgtagtttaaagaaaagactaattgttcttgatataaatgggttgttagcggatgtagtttctcctcctccaaaggatcacaaagcagatgcaaccattgcgaggagagcaatattcaagaggccctcgtatctcaagtttctggagttttgcttcgataaatttgaagttggcatatggtcttcaagaatgaagaaaaatgttgatggagtcattgattatttgatgggagacatgaaaaacaggttgcttttctgttgggatctttctcattgcactgaaacaagcttcaaaactcttgaaaataagcataagagtgtgacttttaaggatttgaggaaactctgggataaacatgatcttaatcttccatggaagaaaggacatttcaataaaacaaatacattattgttggatgattctccttataaagcattgcttaatcctccaaacacatcggtcttccctcgtacgttcacttataaggatggaagcgacaactccttagctgaaggaggggagctgagagtatacctagatggtttgacaaatgctgaagatatgcataagtatgttgaggaacacccatttggccaagaaggcattagtgaaacaagtgaatgttgggacttctatcgccaggttattgatagtctttctgcagatattctagaagctaataaaagaggtgcaagaagtaacttggaggtccaggaaacaacctag

SEQ ID NO: 50953 - DNA, 4731 bp, Glycine max
  Peptide Sequence Number=SeqID_167731
atgagggggtacaacaatcaacacagctcacagaacaaaggcccaaaaggaaagtatccaagccaacataccttagagattatatctgaggaatcttttccttatctcaattccttctcggaggccactggtcctcgaaaccaggagttcttttcttccagcttgtatcaatttggtgctctcgttgctcctcctatggccaattccccttccgcggataaaattgaggagctcctcattcgcttgaccacccaacagctttccctttccacaaagattgatgatttcatctcccatataacccctctcgtttcccctccggcctccatcccttcgtcatttccacgtttgttccctgctcctgcaccacaacatcgaatcaaattagacgtcccgaggtttgatggtacagatgcccttggttggatctttaagatcaaccaattttttgagtaccacggtacacctgaatatgaccggttgacgatcgcttcgttttatatggaggggagggcattggcctggtttcagtggatgaccagcaatggtcaattcacttcctggcctacctttctccaagcattacaggctcgttttgccccttcacaatacgaggacccaacaggggccctctgcaagctcatgcaaaaaggttcagtcactgcgtacctctccgagttcgaggatttggccaatcgagtggtggggatacctccggccttcctcctcagctgtttcatctcaggactgctgccggagattcgccgggaagtccaggcgcaccagcccctcacgctttcccaagctgccggcctcgcgcgtttacaagaagaaaaactcagcgatcttcgtcacccagcacctccaattcggccgcgacccccctccctttcctctccgtccctgtcccgacctccatctctgtcccctcttctcccatcaccaccgcctcgacctaccaacccttctccacccttcaagcgtttgacttccgaggagattgcaagccgccgcgagcgcggcctttgctttagctgtgatgagaaataccacagaggtcaccgttgtgcctctagggtatttctcttcatcacagatggagacgaaccaagtgacccatcccttttaacctcccctgacccaactctggaacccgaaccggacccacccgatacccaagatccatacccggcccaactcagtttaaactctatggctggccacttagcccccgaaacgctgcgttttgtggctactgttgctcacattgacatcgtgctcctggttgatagcgggagcactcacaacttcatccaacaccagttggtggccaagctcggtctgcaacccacctccacagcccctctacgcgtcatggtcggcaacggacagcaattggactgcagctccatgtgtgaggctgtccctatctctattcagaatatccgattcacagttgacctgtatgttcttccgatatcgggtgctaatgtcgtgctgggggtccaatggttgaagtcattgggacccgtcctcactgattacaacacgctctcaatgcaattcttgtcggagggtcgtgtcatcaaacttcagggtgacctcgatgctaagttaaatgccctcactccgacccagctccgccggcttagtagaacccagggtgaagcccgattctatcacattaccttatttccgaatctgtcttccccagcaacacatgcattcccagccccaattcaacaattgctgcttcgttacaaggccctgtttgaccctccctccaccttacctccttcacgcgccaccgatcaccatatacacctgcttccccaggcctctccggtcaacgtgcgaccctatcggtaccctcactaccagaagcatgaaatagagcaacaggttgatgcaatgttgcagaaaggcttgatacagcccagtacgagtccattttcttcccccgtcctcctagtcaagaaacacgacggctcctggcggttttgtgtcgactaccgggccttgaatgctctaacggtgcgtgatagatttccaattcccaccatcgacgaattgttggatgagttgggcggtgcttcctatttctctaagctggacttactccaaggctatcatcagattcgcatgaatcctgatgacattccgaagaccgcttttcgaacccaccatggccattacgagttcaaggtcatgccattcaggttgtgtaatgccccctcatcatttcaagccaccatgaattccatatttcaaccttatttgaggcgcttcatcatcgtcttcttcgacgacatattaatttacagtgcctccatggatgaacaccttctccatctggaaactgccttccaggtattattaacccatcagttcgctttaaagctttctaagtgcttctttgcgcaacagcaggttgaatatttggggcatctggtgtcgactaagggcgttgaacccttagcagagaaagtcgctgccgtgcgtcaatggccacgacctcgcaccgccaaggctctgcgcagcttccttggactcgccggcttctatcggcgttttatcaaaggctacgccaccattgctgcgcccctcgtcaaaaccaccacgctcgacccttttcactggtctgatgaagctcaggctgcttttgaacggttgaagcttgctctgtcgtcggcccctgtattggcccttcctgatttccacagccccttcatgattgagacggacgcgtcgggagtgggccctggtgctgtcctatcacaaaagggccacccaattgcctattttagcaagccttttagccccaaactactccgatcatcgacgtacgtccgggagttatttgccattacggcggccgttaaacggtggcgacagtatttgttgggccaccgttttgtcatcatcacggaccatcgaagcttaaaggagcttctgacccaggtcgtgcagactccggaacagcacatgtaccttgcgaggttgatgggatacgattatgagattcattatcgttctggcgccgcaaatcaagcggcagatgctctttcccgcgttcctgaacatgattcttccctggtgatgttgctctctgttcccaatctgtcctttatggatgagcttcacactcagctccaacaacaccccgagttcaatcgccgccgtctcgaggtcatcaaccaccccgctactcatcccggtttctcagttgtcaacaacctcatcctctatcgtcaccgcatttggctacctcgggatattccgatcatctccacactcctccatgagtatcatgctactcccatagggggccactctggcattgcaaagacccttgctagaatttccgagaacttctattggactggcctccgtgctgacgtcactgctttcgtgtccaattgccttgattgccaaacgaccaaatacgaagctaggcgctcgacaggcctcctctgtcctcttccagtaccgcaccggccttgggaagacctctccttggattttatccttggactgccggaatataagggtcacacggttatcttggttgttgttgaccggttttccaaaggcgttcatctagggatgcttcccactgcacatacaacttttatggtggccaccttgttcctcgatatggttgttaaaatccacggcgtgcctcgaagcttggtctccgaccgcgaccccctgttcttgagcaagttctggcaggagcttttccggcgaagtggcacccatctccgcatgagttcggcctatcacccccagagtgatggccaaactgaggttctcaaccgcgttatcgaacagtacttgcgttcttttgtacatcggcgacctcggacttggggcaagcttctgctatgggctgaatggtcccataacacctcatggacctccgctactgggaccactccttatgaactcactttcggcaggaagccctttaatttcccagattatcttgccggtgcttccgctaatgatgccattgacaccttatgcagtgattgcgaagccacttttcagctgattcgtaagaaattgattaaagctcaggaagctatgaagcgaaaggcggatgctcaccgtcgcgacgtcactttctcaccaggccagtgggtcctgctccggcttcgtccatcacgtcaggtctcggtcaggaaccatcctcacatcaccggcaaattagccaagcgtttttacgggccctttcaggttacggaagctattggtaaagttgcttacaggttgcaattgcctcccggggccaagatccaccccgttttccattgttcccagcttaagcagtttcatggtgaccctactcaacccgacataccccctttaccccctcaattttgcaatgaccagcctctgattcagcccgcggctattttggcttctaggcaaacttcggatgccacctgggaggtcctcgtccaatggcacggcctttctcccgatgagacctcctgggaagactggtccaccttgcgtcaggactatcaccttgaggacaaggtgatttcccaagggcccgggagtgatacgagggagcagataacagagatgagcaacaatatagaacaacacatagcagaagtgagtaaggaacatgagggggtacaacaatcaacacagctcacagaacaaaggcccaaaaggaaagtatccaagccaacataccttagagattatatctga

SEQ ID NO: 50954 - DNA, 408 bp, Glycine max
  Peptide Sequence Number=SeqID_167732
atggaagagtctttacaagatgaaagagttcgttaccttcatcacctcgccacaggcaacatgccgccaccggagttcgtgattgttgacgactatatctcaaaagctcagccctcgtgttgcgtggagctcggcttcttcaaactgggtgggtctctcacgaagcatgacgtgagattcacagagtttgttcatggaggcagagggaagtggaaccaatgttcgtgggcaacaatgttcggctatgacttaatcgtcccttttaacatgaggtgcaagttgtcgcacccgtcatgcaatttggacatcgagaagttgcggtgtttggttttattgacctcctgtatccctgctcatcaattgatggagttgattttgaggaggttgatcgtgagctgcccaagttga

SEQ ID NO: 50955 - DNA, 1524 bp, Glycine max
  Peptide Sequence Number=SeqID_167733
atgaaaggtagggtgggtaccatgctgagtgtttcaagttttcggccgccggctgtgtatcctacgttgttgcattgtccgagactccaccatgttaatgtttccttattctgctccctttcaaatggtgcctcttcttcatgtagatccctcggtatactacgtgccatctaccgtgaatccgaagtgccggctcaacagttgcaccacgtccagaaccagaagctaaagattggcatcataggcttcggcaaatttgggcagttcctggcccgaaccttggttcgacagggccacaccgtcttggcccattcccgctccgactacactcacgtcgcactcgaactcggcgtaacattcttcgaaaacccccacgacctctgcgacgaacgccccgaagtcattttgctctgttgctccatcctttccgccaggcacgtgctcctcactcttcctctgcagcgtttggagcctggcacattgttcgtcgacgtcctttctgtcaaggagtttcccaaaaagctcttgctcgacgtgcttccctccaatctcgacattctctgttcgcaccccatgttcggccccgatagcgccagctgcggctggagtggccgtcgctttatgttcgacaaggttcgaattcggaacgaggagcggtgcaacaagttcctggacgtgttcaagagagaaagatgcgaaatggtggagatgagttgtgaagatcatgataagctttcggcaaagacgcagttcataacacacactatcggtagggttttggggatgttggacttggagaagactcgtatttatactaaggggtatgagtctctgttgaatttaaaggaaaacactgctaaggacagttttgatctctattatggtttgtttattcttaataagaattccccggacatgttgggaaggttgtgttttgctttccaggagttgaggaaacaactcttgaaaggtgtgcatgttgttgtcagagaacacttgtttgagaatcccgtaaccgcaaaggtgcaaaatttacaagatactgcatcatttcatagtgatgtcagcgaatacaagtcgagcctttcaagtgattattcttataacaacttgaagttgaagattgcaatagttggtttcggcaactttggtcagtttctcgcaaaaactattgtgcgtcaaggtcatcaagtgttggcatactctaggtcagactactctactgtagctaaggaattgggtgttacttattttcgtaatgctgatgatctatgtgcacaacatcccgaagtaattttactttgcacatcaatcctttccacagagggtgttcttaaatcattcccttggcagaaattggagagaagtaccttgtttgttgatgtactttctgtcaaggaatttcatagaaacttgtttcttcaacatttgccacttgattttgatgtgctctgtactcatcccatgtttgggccacaaagtgcaaaagatggatggagtggttttctttttgtttttgataag

SEQ ID NO: 50956 - DNA, 3768 bp, Glycine max
  Peptide Sequence Number=SeqID_167734
atgctcgtcgccaacctcattcaacccagccactctcctttctcttcacctatactcttggtcaagaagaaagatggatcgtggagatgttgcgtggattatcgggcgcttaacgtagtcaccattaaagatagatttcccatgccgacaattgatgaattgttggatgatctgggacaagctgcgtggttttcgaagttggatttgcgtcaaggatttcaccaaatccgtatggcggaggaggatatacacaagacagcttttcgaacgcatcagggacactacgagttcaaggtcatgccgtttggcctctgcaacgcgccgtcgacgtttcaggcggccatgaacgacacccttaagcccttcttgaggaaacatgtggcggtgttcttcgatgacattttggtctatagtgttgacttggccacacatgtctctcacctcgactccgttctggatacactatcagctcgacaattccttctccggcgtactaagtgtctctttgcccaaaatcagcttaactatttgggccacgttatttcctctgattgcattgctcctgacccagaaaagatctctgtgatgctggcctggcctgtacccacatctccgacagctcttcgtggattcttgggtctcaccggtttctaccggaaatttattaagagctacaccgcaatcgcctctcccctcacgtcattattgcggaaggaacaattctcgtggtccgcggaagccttgcaagcttttcaggcacttcagcaagctatggtacaagcccccgtcctcgccaacccgaatttttctcgaccattcaccattgaaacggacgcctccgcttcagccatgggtgcggttttactccaagacgatctccctattgctcatcacagcaaggtactatgtccacgattgcagcgagcctcgacgtatatccgcgagctccacgccatcacctccgccgttaggaaatggcgtcactatttgctgggaacgtccttcacgatcctcacagaccatagaagtctgaaggatcttatgtctcagatgctctcgcgcatcgttccagcagaggccacgtgttttaccctggtcatgccacatttcaccttcttggagcagctgcgtaagtctctaatggtggatccacaatatctcaacctgctaaaggatatccagtctaagccggaagcccactcggacctgtcccttcaccaggaccttatcatccgcaatagacgtatctggatcccattcccttgcccgttcactgaaaggctattagaggagtttcactcatctccgatcgggggccacaccggcgctgctaagactcttcatcggctgcgtcagaacttcgattggcccaccatccagaaggatgtgcgtcactttgtcggccagtgctcgatctgtcagcagaccaaatacgagaccaagaagcccgcgggtctattacaaccccttccgattccggccaccgcatgggaagatttgaccgttgactttatcacgggccttccttgctctcatggcttcaccgtcatcatggttgtggtcgaccgttattcaaagggggcccatttcggtgcccttccgacgcactattccgccttcaaggttgcagttttgttcctggactgtgtctgcaaacttcacgggtttccccatagtattgtttccgaccgcgaccccgtttttgtaagccatttatggcgtgagttatttaaactcagtggcacgaagctccgcatgagcaccgcataccacccgcagacggacggccaaacggaggtcctcaatcggactctcgaacaatacttgcgtgcctacgttcataatcatccttcccactggtttcgtttcctgtctctcacggaatggtcctataataccgcaacgcacgtgggtacggggatgtcaccctttgagggatctacggtggctgctgttgaccatctactcagttcccgggagaccatccacgccaccctccagcgtcgtcttcgcaaaatgcaagaggcaatgaaggctaccgcggacaggcaccgccgggacctctctttccgcgtcggtgattgggtttatgtacgtttacggccttaccggcaaacctcggtagctccggcgtatagcaaactggccaagcgtttctacggccccttcgaagtggtcgaatgcattggggcagtagcctacaggttgcagttgccaccatcgtcaaggatccaccctgtgttccacgtttctcttcttaagcttcataaggggcaagctcctgaaaactcctcgtgggaacgctgggacgagttgtgtcgcgtccacaaccttgaggacaaggctgttttcggggaagggagtgttgatagaaacactggccagggggatacagtgcttctttggctcttggtattcccaccaccaccaccaccaccaccaaaacctttgagttcaacgtacaaagagagagtgagagtaacaatggcttcttccagtgattgtttggctcttggtattcccaccaccaaacccttgatttcaacgtacaaagactctttccttcggttctctgcaacctttccgacccgcacacggttttcaaacggagcattttctgtttcttgctgcaagaacatggagccggttgtttacttgaaccatgacaagcagcagctgatggtgaatgatcgtcccattttgaagggaatgacagagaacttcacactgagctcagtgacggaaggtcatgggcatttccttgaggtgaacaactctgcgcatgttgtctccctcgaagtgctcagctgcctctctttcacggcatcattccggagggatagatggtatatggcgcgggagaccggagactggggggatttgaagtgggatggagtgtggattcaaagcaatgtcgagaataaggataagcttgagctacatctacatcccgaggccaaagggtttactcgtgtgatctttctcagtgctggcagcgacccatttaagttagtgcacgacgccttctgcttcatggaagagtctttacaagatgaaagagttcattaccttcaacccctcgccacaggcaacatgccgccatcggagttcgtgatcatcgacgactatgtctcccaacatctcagccgtcgtagcccgtcgccaaaagatgttagcctgttgaagatttggagggggaacaaatatggtggggtgatgggaatgtttcactgtcaaggtgttgcgtggagctcggcttcttccaaactgggtgggtctctaacggagcttgacgtgagattcacagagtttgttcatggagacagagggaagtggaaccaccaatttgccttctacgctcactgtgaagagcgagtgttcgtgggcaacaatgttcgactgtggcttaatcgcccctttcaacatgaggtgctagttgtcgcacccatcatgaaatttggagatagagtagttgcggtgtttggttttattgacctcttgtatccctgctcatcaattgagggaattgattttgaggaggttgatcatgagctgcccaaggtgaaagagtatcttgtaaacgtgaaactcaagggtaatggaaaatttgctgtatattcctcctttaaaccagctttttgcttgattcttgggaagatggttgaatttaattacaattatgaagatcatttggtgactatcaatgttgacccacgatcagatggcaatccatctcaggatgttagccttgtgtggcttacttattag

SEQ ID NO: 50957 - DNA, 366 bp, Glycine max
  Peptide Sequence Number=SeqID_167735
atgtgtaagagttctattttgctatggtggtgggtttgctatggaaatatatcggtattctgtacttcatggaaagccattcaatggaatgctagcaatttttctgatatgtcaagctggtcatatttgattaagcaggcagtgtttttaaaattatggatgggctgctgttatttttgtgaagcggttgatgatgaatggcagcagaatggagaaaggaagagagagaggagacgccacttcaaggagaagatgagtctagaagaagctcaccaccataggaggccatggataagagcttggaggaagaaggagatgaatgaagggagagggagagaagagcacgaaattttgtgctctaaatga

SEQ ID NO: 50958 - DNA, 207 bp, Glycine max
  Peptide Sequence Number=SeqID_167736
atgtctactgagactaagattgtatttgaccagctaactgaggatgctatgaagctgatggagaatgatgtttatcatgaaatgcaagaggtttttgatcgtgaagcagataagcaggatctagaagctgtctactgccataattcttcagatgaattccttgagaagtactatcacacggttccccctgactccttttctgcataa

SEQ ID NO: 50959 - DNA, 294 bp, Glycine max
  Peptide Sequence Number=SeqID_167737
atggatagcaaacccttctccactgtcgcaacctacccttcggcgggagggcaacgcgggactcacgggtgcgtcttccaagtgaggaaggcgcacggagtcgccaccaacgtttattggaggaaaacattgaaaactcggaacgtgtggtctacgaactttaaccgtgaaaaggttcgggagttatttttacgcacgaggaagggtgtttccctcgctcctacgtatcctcaatttgtgatgaggaactcagacctatgtagttcttgcaaaagcggtgaagttacgtgttga

SEQ ID NO: 50960 - DNA, 234 bp, Glycine max
  Peptide Sequence Number=SeqID_167738
atggcgacgttagtatctgcatgctaccggacccttgagtctgacggtagaaacgagactttttcgcggtctcgaccggaagacgcttatatctccgggaagggtgcaggtgtctccgcgtgccatcggactctcgggtcacaggatagcaaaaagtgtgcgcggataaccatcaggtgtctccgcgtgccatcggactcacaggtcacgatagcaaaaagtgtgcacggataa

SEQ ID NO: 50961 - DNA, 926 bp, Glycine max
  Peptide Sequence Number=SeqID_167739
gactacacgtcctcaccttcagagagctgcacgtcctcaccttcacaggattgcacgtcctcgcctttagaagactacacgtcttcaccttcagagggctacacgccctcgccttcagaggactacacgccctcgccttcagaggagtacacgtcctcaccttcagaggactacacgtcatcaccttcagagggctacatgtcctcgccttcagagggctacacgtcctcgccttcagagggctagacgcctcgccttcagaggactacatgtcctcacctttagagggctgcatgccctcgccttcaatgggtgacacgtcctcgacttcagaggattgcatgccctcgcctttcaaggttcttgggtcaccccttgatcctggaggagggccaactgtgagagcacaaccagaagaggaggctatcacgcagctactatgcatactggggcaagatttcactcgagccgttgcaaaaagggatcgcgcccacaagacacccagtgaacccgaagaagtccaacagggccctggggttctagctcggattacgggcctctggatcactcctacaagacactcagtgggcccagagaagtctaacagggtcctggggtttccagctctgattacaagcctccgtcagttctacggattgcccgccgcccccagtaaggcccgtggccgacaagtcatcacgcgtttggctcaagacgttaaaaaagcgctactaggaggaaacctagaattgactacgaagaagctccccgcgaagtggtccaggaagggcaccattgaagagggttctagtgtggccccaaaagccgacacaggctttgataaacaccgattccagagcgtggaacatcagtaccattttgaggccatcaagggatggtcattcctcagacagagacaagggtag

SEQ ID NO: 50962 - DNA, 168 bp, Glycine max
  Peptide Sequence Number=SeqID_167740
atggacattgagaacgataggggatacaactgtaatggcagcaacaacactagggaggaagagattcaaaaggaagatgaaagcgaggtggaggttcactggggtgacgacgagacggcggtgacgggtcgtaagatgcagtgtcgcggaggagggagatggcagtga

SEQ ID NO: 50963 - DNA, 99 bp, Glycine max
  Peptide Sequence Number=SeqID_167741
atggggtggtattgccgtgctatggaggaacccattggtgtttcacataatagattacttgttgaacttcttagaataatcagaactttggcaaaagag

SEQ ID NO: 50964 - DNA, 270 bp, Glycine max
  Peptide Sequence Number=SeqID_167742
atggctccaaagaagcttcttactaaaagggctaggaaggccaccgcagaggagggatctagtgcagccttgcaagtggagattgagtttgacggacaccattttcgaagtgaggagcatcagcatcgtttcgaagcaatcaagggatggtctttcctcaaagaaagacgggtccaactaagagaaaaggagtacacagagttgcaggtggagattgccaggaggcggtggaccgaactgacagagcccatggctaagtatgacccttag

SEQ ID NO: 50965 - DNA, 522 bp, Glycine max
  Peptide Sequence Number=SeqID_167743
atgtctccgtcttcctcagctccgtcttcatctcctgaggcctcggccacgggtaagggttggggtcctagcgctactggtgcagtgtatactggtagaagctatcgttcaactgcacctagtctctatggtttgtcatctactggtcagccaaatgctgcatgtagagctccatcctctacatgtgagctgagatggacttcagagatggtggctgatgtagaggtgtcggtggtacatctgcaaccggttgctgctgctggtcctgcctcgactattgtgcctgccttggcatgcaatattctcaatgaaagacctgttaatgggaggccggatgagctttgtgggtgtaatcgataccccatagagctgacaaagaccaactgttatatggcatccgagataagctgggtatctcgaaggtgcgatgcctataaactggtagatggcatccgagataagctgggctacatgaacactaatttgggtcaggatagcgtagaccaactggaatttaggtaa

SEQ ID NO: 50966 - DNA, 246 bp, Glycine max
  Peptide Sequence Number=SeqID_167744
atgtcaccggggttcaatgaaggtaggattggaggcttcgttgtctatcgaatcctcgagataagttttgaagattccgctccgattaaactgttcttcttcgtgtgggggtcctacggtaagcaaagacggctcgtggcggtcaccgggggtgagtggtggtggaggaggagcttgaggggcgttggggagggtttaggggaatggaaggaggaagaagtggctgttttccactgctgcacgtaa

SEQ ID NO: 50967 - DNA, 207 bp, Glycine max
  Peptide Sequence Number=SeqID_167745
atgggtcatacgcaacacactaacttttttgtggatgagctaaggggctttggaggtggcggcggtgtgcctgttgcccgctgtcagccatccccaggctgctgtggtgtttcgccctgcgcctgcttgggggcgcagtacttcttgatgaaagcccggttaatgggaggcctaatgaccttgttgggggcgacaggcgcttcatag

SEQ ID NO: 50968 - DNA, 921 bp, Glycine max
  Peptide Sequence Number=SeqID_167746
atgggtctaaatgaactaaatcaagcacatttgtatatattgaataacacccaagaggttgtcccgtacatagctgctcacaaagaatttctgaaggataatcaccctaaaatgtccaagaaacaacttttgcaaaaacataataaaagtttcttaaaatggtttacaaatacaatatttggtgataacaatgcatatgaaatgttgagaaacttagcaaatgggccaaatcaaaatgtgagaacttggaagggatatgatatcaataactactcattctacacaaagtcgcaagatgacaagagtaaagtgcaaaatagtggggttagccttgacgttgaatctaaacatttttgtagtgcatcaaacaacaacccaaaactggtgtccatgccttactttggagtgattgaagaaatttggaagcttgattatagtagatttagagtgcctatttttaagtgtaagtgggttaatgacaattctactgtgcaaatcgctgatatgggatttaccctggttgaccctaataaggttgcttataaggacaagcctttcatcatggcaaagcaagctaaaaaaattatttttatgtcaaacatccctctagcccaagatggtcaatggttctacaagactccttgtttctccaaacttatgcctaccatcattgaagaacatgaagtggacgatgtatatgcaaattgcaatgatcatatggcagaacattctgacctaactgtgttatatataaggcatatggctacaccaccaagctccaatcccccctcgccatcaattgcttcacagtctacgtctaaaaggagtagacaatccacacgactaagaaaattgtttgttagacacttggatgagcagaagctactagttcatgtggatcttgacactggaaagctttag

SEQ ID NO: 50969 - DNA, 651 bp, Glycine max
  Peptide Sequence Number=SeqID_167747
atgtgcgaccccaaatgggtgaatacaatggaagaggagctaaattttgttgagaagaatcaaacatgggaacttgtcaaccttcctcatgacaagaaacccataacattaaagtgggtttataaagtaaaggtgaaaccaaatggtgaggtgattaaacataaggcaatactggtagggaatggatttctacaaaaacttagagttgactatacaaatataaaaggttggtctatgcacgaattatatgtgaagtcagctttcttgaattggccattggacaaagaggtttatgtcatccaaccgctagattttgagatcttggatcaagaagagaaggttctcagattgaggaaagccttgtatggctttaagccagctccatatgacttactagcgattggaagcaatgaaatggagattggagagttcaagaagaaaatgatgaaggagtttgagataagtgatctggggcttttgttctactttcttgggattaaattgaaaacaataaagaatggtactatgatgcaccaaaccaagtatgcaactgacttgttgaagaaatttaacatgttcaagtgcaatttagttgtgaaaccattgaagctagattggtacttgagaaggaagggactaaggaacttataa

SEQ ID NO: 50970 - DNA, 243 bp, Glycine max
  Peptide Sequence Number=SeqID_167748
atgacgaatgaagaacaccgaatgaagaacgatgtagaggttgattatagtcgcgattccgtagtgcctctgcttcgttttctcttctttcttctccttcacccttatttctctcaaaatctctcaatgctgaatgctagaaccctttactcaacctccctcacgcctatttatagcaaaaaatggccttcaggaccatggcagatcgcccaggcaagccagaggctagcctgggtgagctag

SEQ ID NO: 50971 - DNA, 603 bp, Glycine max
  Peptide Sequence Number=SeqID_167749
atggaagaaaggatcagtggagcagtactcagcagtgccatacctagccacattgatgaattgcatgggtgtgtcattgagatcatctatgtcaccctcttcttgctctactccgaccgtaccaagaggctcaaggtcttcctttggctcttcttagaactcgtcttcatcgccgttctaaccttcgtcacattcactctcatccattccgtcaagaagcgctctgccgtcgtcggaaccatttgcatgctcttcaatgttgccatgtatgcttcacccttgtcagtcatgaaactagtcatcacgaccaaaagtgttgaatacatgccgtttttcctctctctagcatcctttgggaatggcgtgtcttggactacttatgctctcatcccttttgatccattcattgctataccaaacgggattgggacaacattttctgtggctcaactaattctgtatgcaacctattacaagtctacgaagaagcaaatagcagcaaggaatgcaaaacaggtgaatctctcagaggtggttgttggtaacagtactgtccaagatcccaacaataacaagatcagtgctgctcccaatggtctttaa

SEQ ID NO: 50972 - DNA, 326 bp, Glycine max
  Peptide Sequence Number=SeqID_167750
atggcatctgaaaagggtgggtgtatgcacactgaatttgaggctagactatctcaagctaggtcttatgctacatcaagtgttggtaagtcacaactcactcctttaaaccctgccgaagaacaaagacttaggacccagtattgggttgtagctgcaggaccaaagcgtaaaggacgcctttacgatactagagaccttgttcatacttataaatgtggagatgacaacttcatgcatcatatgcaaggttcttctagtcactctcaagatgccacaaagattcaccaactgggggaggagttttgtcaatcaaaggaggagat

SEQ ID NO: 50973 - DNA, 356 bp, Glycine max
  Peptide Sequence Number=SeqID_167751
ttaacttcagaggggcaaggaagccaagagttcgaccagctgatgttccttcttcttctactctaccagctccttccacttctgctactcctacaccagctcctccagactcatctactcaagactctcagcactttgagttcatgcttcagagtcttcataaaggacaaattttgttaatgcagagcttgcaggttgtagctcctctaggatccattctgacaatggagcagtttttagagagggtatcctggccaggaaccctgccttctcttgagagaaaaggtgggggtctcagtgctcagctacctcagcaggtaaggcataagactgctactccagagagatcaccatag

SEQ ID NO: 50974 - DNA, 802 bp, Glycine max
  Peptide Sequence Number=SeqID_167752
cagatggtacaaagagagaatcacatagtttcaaggaagaagattactatataagttcaacacctgaaaatcaaattatcccctttgacactccaagtgcttccaacaccgattcaaatctgagtattgaagtgttagaagaaacagacttgacatacaatcaagtagacaaatgttctactccaatcatgttagatgaagctcgtgctcctgaggagaatgacaatctgcatcaagaaccagattgggatccaattgctgagcttgagaacatgttatgtgatagttataagagttttcctatgtcaactctctcaacttctatttcaggtccaaatgtggcagctatccttgaaaaattagagacccttttggagacctcccttgaaaatatctcttgtgatgatgaagtcaagcaacaattccatcaagtgttggatcaactcgtgcaatttgaagaccaagttcctgttaagcttcgccctgtaattaacaagttaaaaactttcattgaaggtgtcgatgccagatatgttactgcccaagaaattatccaagattataataagcttctccaatcaaggtctcctctatcaaagcatttggaaagtgccagagcccgacaataccaaattaattctaaagtctctgaagctaaaatacaagttgaaaagatcaattttgagattgttaaactagaacaaaagataagggttttaattgagactagaaacaagctaaagagagacttggacaattgtgatgttgagaataacaagctaaagactaaggctgcacaatg

SEQ ID NO: 50975 - DNA, 2409 bp, Glycine max
  Peptide Sequence Number=SeqID_167753
atgcagagctacattgtctacactggcaatagcatgaatgatgaggcttctgcgttgactctttattcaagcatgctacaagaagttgcagacagcattagcactctgtctcacttattgactgctattaatggaactgataggctacaatgtaactgcattacaccatcctcagtgggcaagcctattttttgcttgcaaagctttgttagcaatgctgagcccaagttagtacaacaccacttcaagcgtagtttcagtggctttgttgctatgctaacggaggaggaggccgatagaatggctagacatgatagagttgtagctgtctttcctaataaaaagaagcaactccatacaacaagatcatgggattttattggctttccactacaagcaaatagagcaccagctgaaagtgatgtcatcattgcagtacttgactctggaatttggcccgaatctgagagcttcaatgacaaaggattcggtccaccacctagtaaatggaagggcacctgccaaacttctaaaaatttcacatgcaataataaaatcattggggctaagatttacaaagctgatggattttttagcgatgatgatccaaaatctgtgagggatatagatggtcatggcactcatgtagcatcaacagcagctgggaacccagttagcacagctagcatgttaggccttggtcagggaacagcaagaggtggcgcgacaaaagcacgcattgctgtgtataaagtgtgttggtttgatggttgttctgatgcagacatacttgctgcatttgatgatgcaattgcagatggggttgacataataacagtttctcttggagggttcagtgatgaaagctactttagagatgtaatagccattggagcatttcatgctgtgagaaatggagcattaacagtaacttcagcaggaaacggtggtccaagaccttcctccctatccaacttttcgccttggtcaattactgtggctgctagtaccatagacaggaagtttgttaccaaggttgaattaggtaacaaaatcacctatgagggtacctcaataaatacatttgatctcaagggagaattgtatcctataatttatggtggagatgcaccaaacaaaggcgtaggcatagatggatcgtcatcaaggttttgcttcagcggttcgttggacaaaaagttagttcatggtaaaattgttctctgtgatagcagaagccaagtgtcaggcccttttgatgctggtgctgttggggcattggtacaaggtcaaggttttagagatattcctctctcttttccattgcctggatcttaccttgccttgcaggatggtgtctctgtatatgactacataaactctacaaggactccaactgcaaccatatttaagactgatgagacaaaagatacaatagctcctgttgtggcctctttctcttcaaggggcccaaacattgttacacctgaaattctcaagcttatggagaagctattgtatagtcccataccaccacgtatctatggtcctcaacaatctccaaatgtggctcccggagtttcgattctagctagttggtctccagtttcccctccttctgacattgaaggtgacaacagaacattgaatttcaatataatctcaggaacttcaatggcttgtccacatgtttctggagccgcagcgtatgttaaatcatttcatccaacatggtctcctgctgctattcgttcagctctaatgacaacagctaaacaacttagtccaaagactaaccttcaggcagaatttgcatacggctcaggccaaattgatccttccaaggctgtgtaccctggtttagtatatgatgctggtgaaatagactatgtaaggtttttatgtggacaaggctatagtacaaggactttacaactcatcacaggagataacagtagctgccctgaaacaaagaatggttcagcaagggatctaaactacgcttcatttgcactctttgtcccaccctccaactccaatagtataagtggcagttttaacaggactgttataaatgttgggtcaccaacgtccacatataaagctactgtcacttctcctgagggactgaaaattaaggtgaaccccagtgttctaccattcacttctcttaaccaaaagcaaacatttgtgctcacaattgagggacaactaaaaggacctatagtgtcaggctctttggtttggggtgatgatatcgactatcccattaacatatgtgtgactgaaaaaaggctaaaacttcctgcatttcccattgcattgcggaatgcaattttgccttccgaaatggactttctgaaatgtaatggaaagtggcaagccatcaacggcatatttcgcacttaa

SEQ ID NO: 50976 - DNA, 404 bp, Glycine max
  Peptide Sequence Number=SeqID_167754
gtccccctgcggctgcggagggcccccctcacaatgaggtctcgttgttcttggaggagggccctcctcctttcttccagaccgcgaatgcggtccaggatccgttgcatggctgcagccacaagcgctggatcgatgggaggcaggtgctcccaaaaggcagccagggtttgctgccgttgggccttctcgcaatcctcactcgacagctcgaaagcggatcagtacaaacccacgtgatccgtattcgcttacgtaccaggcgtgcttcgtcgtaccctgacaactcctctttcactggcttctacttgtcttttactggcttatttgtacccagcttcatgatggactcccctcggccaatcgtcactcgacagcagctccgtcctagcgtaggcgattga

SEQ ID NO: 50977 - DNA, 816 bp, Glycine max
  Peptide Sequence Number=SeqID_167755
atgcagatatggtcgtcgaccctccattcccctattgcgagacatgagaagtggaaaaaggctaggacaaacaaatttgggcaaatgacatctacagcagctcaagaaattgcagacaaaattgatgaattacaagaacaagctaaacaaggagctttagtcccacatggtcgtcaagacatcctgaacactgccattggccgtccagagcatcctggacgtgttcgtgttggtggacatggtgtgaccataaccagctactttggacatgcttcctgtgcgtcccacagttcttcgcctgcgatcaccgccgaaagattggttgaaatcatacaaactattaagcaagaagtgaagaaagaggtagaagatgagaacaaagactgtatggacaagatgaaaatggagttggatgcgatcaagactgaattatcccaaattcatacgcaacagtcagctcccccaagaccgtctaaccctgacatatttgttgcacgtgttagcacgaaagagagttgtgctgaagctgctaataatgttgttggtaacgagcggtctacatttgatacatgtagtatgggcttatacattgtttgtggtgacagtacacagctggtggcagggggaaaggtctttggagtaggtggcacgatacacactgttgcttatggagatgatgtactaagggtgtgtgttgacactgtatacgatggtgaagccattgtcccgttacctacttcagagattcagtatgtcagggacgtcgtgaactcattcattggatggcctagacatctagtgaaacctttatcttat

SEQ ID NO: 50978 - DNA, 559 bp, Glycine max
  Peptide Sequence Number=SeqID_167756
agcttctattctgaatttcgagcgtctcgatatattacgggacacaatcggacatccgaataaaagagcttctattctgaatttcgagcgtctcgatatattacgggacagaatcggacatccgagtaaaagagcttctattctgaatttcgagcgtctcgatatattacgggacacaatcggacatccgagtaaaagagcttccgttatcaattatgaacatctcgatatattacgggattcattcatacatccgactgaaaaggccctgggtttgccagcattgatcacgggtctctgccagtcgttcagggttcccgtcacacctagtaaggccccagacgcatcgccgccacctcatcaggctgatccagctgggtcatttgacacggagcggtatttacggcatttggtttgccagcaggcggccaaccacagggggcagatcagttcagggcagaggtcgcatggcccggagattggcctaaggcccaggcaagggaggcgcccgcagaggctcctggcgatggagaggaggcccgcatggatgaggagatga

SEQ ID NO: 50979 - DNA, 1168 bp, Glycine max
  Peptide Sequence Number=SeqID_167757
agggctacacgccctcgtctttagaaggctacacgtcctcgccttcagcggactacacatcctcgccttcagaggactacacgtcctcgcctacagaggactaaacatcgtcaccttaagtggacttcacgccctcactttcagaggactacacgtcctcctcttcagagggctacacgtccttgccttcagaggagtacacgccctcgccttcagaggactacacgtcctcgccttaagaggactacacgtcctccccttcagaggactgcacgtcctcgccttcagaggattgcacgtcctcgccttcagaggactacacgtcctcgccatgccttcagaggacttgacgtcatcgccttcagaggactacacgccctcaccttcagtggactacacgactacatgtcctcgccttcagagggctgcacgtcctcgctttcagagggctccacatctgcgccttcagaggagtcaaggggccagtagtttccatttatcagttgcttggccaccccctgatctcagaggagggccaactgtgcgagcacaaccagagagggaggctatcgtgcaactactatgcatatcggggatagatttcgcccagaccgccacagggagacgattacggatcatgcgaaccaccacaactctgatcttcccctgccgaagtggatcacgcccacaagacacccagtggacccggggaagtccaacagggtcctgcggtttccagctctggttatgggcctctgtcagtcttacaggggattgcgcctgcaagacacccagtggacccgcagaagttcaacagggtcctagggttctagctctgattacgagcctctatcggttctatggagtgtccgtcgcccccaacaaggcaggcgcagggcgaggcaccacgacaacctggggacggccaacagatgcaccaccaccaccttcagaattcacctcagctcatctacaagggctagatacatggtcgaccagcaggcacccaaccaccgggacaggtacgagcaggtactgggcccgtgatcaacaaattaccatccggtgtccggctcaagacataaaagaagtgctactaggaggcaacctagaattggctacgaataagctccccgcgaagcggtccaggaaggacaccattgaatag

SEQ ID NO: 50980 - DNA, 243 bp, Glycine max
  Peptide Sequence Number=SeqID_167758
atgtcacacagtcctaccagatgcccgttccccccccccccaacaagggatcagcccacaagacacccagtggaccaggaggagtacaacagggtcctggggtttcgagctcttattacgggcctttgtcagttctatggagagctcgtcgccccaaacaaggtcatcaggccccctattaactgggctttcatcaagaagtactgcacccctaggcaggcgcagggcgaggcatcacagtag

SEQ ID NO: 50981 - DNA, 669 bp, Glycine max
  Peptide Sequence Number=SeqID_167759
atggcgggaaagccccttcgtcgcgtgccagacggtagaaggcgatatttcgccggacgccagatgcggcgaaagcaaagaggtggcgtcctttgccggaaagtcgcggccttcttcataacccttcaaagcgccatcgatgaaatcgtcgagtttctcccgcgccccgacttcgccgggagaccagatgtcgctgaaacccttcggcgcatccgccggcgcatgtggctcctcgccgccctccagcgcccgccagaagggcgtatagacccgatggccggaaaagctgcggaccgtcaggccgtcatcccgaagcgtctgtttcagcgccttgtccgtcgccatgccggcaggatcgtatcggcggttccagaataccgcctccgcaccggtttcggatatcagatggcgcaatgtctcgccggcgtcgccgctgagaagcacgaggcggctgccgattttttccagtgcagcggtaagggacgtgagggagtgacggggatgacggggccgccatgctccacggcggcaagcaaagcgaggttgtccgaaaggcgcaggtccttgcggaaccagacgatggcgggggaggctgttgtcggcatgaaaggacccggttcacttccgcttgaacgagtgttgaaacgctttgttccgcaaatcggctag

SEQ ID NO: 50982 - DNA, 285 bp, Glycine max
  Peptide Sequence Number=SeqID_167760
atggagaatggagaattggcgaacagcgctagggaatcaattcgcggggctccagactcgatggcaatcaatttgcggggttccagactcgatggtggtggacacatgaacagcgctaggcaatcaattcatgggtctccgaataagattgagaatggagaattggcgagcagcgctaggcaatcaattcatgcgtctcccaataagattggagaatgggaattggcgaatagcgctaggcaatcaattcgcggggctccagacttgatggtggaggatgcatga

SEQ ID NO: 50983 - DNA, 636 bp, Glycine max
  Peptide Sequence Number=SeqID_167761
atggggcgaatctgtggaggagatatcaactcaatgccactttctcggtctccttttaactcaaccatcttactgccatggatgaatttcatgggaaggaatgaccctgtatctgcaccacaacatcattacagagctggtgacattccagttcgtcaccattttcaactggataggttttcaattggttcaagtggaacaaggtttagggtcacgagggaggtttctagagactcttcattctcatccgcgactaacaagaacaatctggaagaacacttatggccacgtgtgaatttctcattacaattgaaacatacttctttttctcgccgcatagcaagttcattagctgaaaggcgtttgaagggaatggaaggggaagggtgtttggtggggttgggaagcaggggtgtcggagaaacaagtggtggaggatgtgggcctagtggtcttgttcaagccagaaaagctgcttggatcaatgatagcagttgcaaggcttgcacctcacagtggatcttcgggctgagccctgagacaaaacaacttagcagaaacggtgcaggaaggccgataatccgatttgcgagggactcgaactccgataagtgctcattaacagaggctcgttga

SEQ ID NO: 50984 - DNA, 264 bp, Glycine max
  Peptide Sequence Number=SeqID_167762
atgacccctactcatgatgccctactatattacagcgggaggtggaacatgccacaccaacatgactttgtcggttactcgtccataggaaaaaatccaaaaaaatttgatattccttccggatgtaccatctatgaactgaaggatttgatcaagcaagttgcacttcatgggattctcccttatggtattcatgaatcacaaacggtaatggaaatggaagatgatgtgtcttggtcgcaacatgattcaatgcaaaattag

SEQ ID NO: 50985 - DNA, 1008 bp, Glycine max
  Peptide Sequence Number=SeqID_167763
cgtccttgccttcaagggctacacgccctcgccttcggtgggcttcatgtcctcgcttttagaggactgcatgtcctcaccatcagcggagtacatgtcctctccttcagagtactacatgcccttgccttcagaggagtgcacgtctacaccttcagaggaccgcacgtccttgccttcagagggctacacgccctcgcattcagtgggcttcatgtcctcgcttttagaggactgcatgtcctcaccttcagcggagtgcatgtcctctcctttagagtactacatgtccttgccttcagaggagtgcacgtctacgccttcagaggaccgcacatcctcacctttagagggctacatgccctcaccttcagaggatatcacgtcctctccttcagagggcttcacgtcctcgccttaagaggactacacatccttgcctttagagggctacacgccctcgccattagaggactgcaaatcctctcctttagagggctacacgtcctcgccgtcatagggctacacgccctcaccttcagaggattgcacatcctcgtctttagtagagtgcacgtcctcaccattaacagagtgcacgccctcaccttcagaggattgcatgtccttgcctttagagggcttcatgtcctcgtcttcagaggactacatgtcgtcgccttcagagggctacacgccctcgccttcagaggactacacgttcacacctttagagggctacacgcctttgccttaagaggactgcacgtcctcgccttcaaaggactacacctcctcaccttcagagggctacacgccctcacctttagaggagtgcacgtcctcgccatcagaaggcttcacgtcctcacttttagagtactgcacgtcctcaccttcagaggaatcctcatcctcgcctttaaagggcttcacgtcctcgccttcagaggattgcatgtcctcaccttcaacggagtgcacgtcctcgccttcagagcgctgcac

SEQ ID NO: 50986 - DNA, 102 bp, Glycine max
  Peptide Sequence Number=SeqID_167764
atgtctacgaatattgaaatgaagggttcaggagttgtttatgtatcgggaagggttgacaaaggtgttgcccttgctcctatgtatcctcgggtgcgataa

SEQ ID NO: 50987 - DNA, 231 bp, Glycine max
  Peptide Sequence Number=SeqID_167765
atgcagctgtcttctcaagaggaggctataaaacagaaggatgtcctggctacagaagtttcctctcttagaggagagttgcaacaagaaaaatgttctttgaaagataatcagataaaggcattggaagagcaactagcaactacagagaagaaactgcaggtgtctaatatatctgcatacgagacaaggacagagtacaaaggacaacaaaaatttgtgaatgagtag

SEQ ID NO: 50988 - DNA, 276 bp, Glycine max
  Peptide Sequence Number=SeqID_167766
atggcgattagtgcattgttgtctggaaaaagtcagacaccgagaatagtgcctgatttctctcaagtcactgtcattgaccttttcaccactatcccagtgtttgtcatgggttccgattccatgccaatgatgttcaagattgaatcaagaacacttcaaggttcaagaggaaatttgatttcaagaatcaaaaatcaagattcaagcttcaagcttccaagaatcaagatcaagattcaagactcaagattcaagaatcaagagaagacttaa

SEQ ID NO: 50989 - DNA, 225 bp, Glycine max
  Peptide Sequence Number=SeqID_167767
atggagcagtcaatggtagtcctggccctgtgggggtgtgggggcatgtttagagatcacaggggctttaatgtcagaagctttgccatctatattgattcggagttggtcaccaaggctttcaagaagccaaatattgttccatggaggttgcgtaactggtggaaaaattgtctctctattcttagaaagtttaatttcaaggtcactcacatatacagataa

SEQ ID NO: 50990 - DNA, 144 bp, Glycine max
  Peptide Sequence Number=SeqID_167768
atgacttcttaccttgacgaacagttgcaggaggcgacaccactcaaaggggtacgactttggcaacgtgagctgttggtaaagaggcacaatgtgagggtggttggtagttcaacgacggtgtctactaagccaccgtcttag

SEQ ID NO: 50991 - DNA, 351 bp, Glycine max
  Peptide Sequence Number=SeqID_167769
atggcctctgtctttggatcccaaaggtgtccacaccattccattgtgtggatgcttcatctatttgatgcctctattggacaaacatatttgaccactgctggtgttgttggaaacccggctgagcacacaattctaaattggtttaagattcagaagtatgaggatgcttataagttggtctatattgtcctagtgtgtgcccctcttgccaccatctgtgcaaggatattggaatgtttgtggataccaataggagaatgcatgtggctctcagtgatgatcccttcaaaattaagttcaaagaaccctgagatcaaagctctttcaaatgatggcaaaattaaatga

SEQ ID NO: 50992 - DNA, 2296 bp, Glycine max
  Peptide Sequence Number=SeqID_167770
tttagagggcttcaatgtcctcgccttcagaggactacacgtcatcgccatcagagggctacacgcccttgcctttagaggactacacgtccacacctttagagggctacacgcccttgccttaagtagactgcacgtccttgccttcagtggactacacgtcatcgcctttagagggctgcacgtcattgcttttagggggctacacggcctcaccttgagagggctacacgctcttaccttcagagggcttcacgtccttgccttcagaggattgcacgtcctcgactttaaagggatacatgccctcaccttcagaggattgcacgtcctagccttcagatggcttcacgtccttgccttcaaagggctacacgccctcgccttcggtgggcttcatgtcctcgcttttagaggactgcatgtcctcaccatcagcggagtacatgtcctctccttcagagtactacatgcccttgccttcagaggagtgcacgtctacaccttcagaggaccgcacgtccttgccttcagagggctacacgccctcgcattcagtgggcttcatgtcctcgcttttagaggactgcatgtcctcaccttcagcggagtgcatgtcctctcctttagagtactacatgtccttgccttcagaggagtgcacgtctacgccttcagaggaccgcacgtcctcacctttagagggctacatgccctcaccttcagaggatatcacgtcctctccttcagagggcttcacgtcctcgccttaagaggactacacatccttgcctttagagggctacacgccctcgccattagaggactgcaaatcctctcctttagagggctacacgtcctcgccttcatagggctacacgccctcaccttcagaggattgcacatcctcgtctttagtagagtgcacgtcctcacctttaacagagtgcacgccctcaacttcagaggactgcatgtccttgcctttagagggcttcatgtcctcgccttcagaggactacacgtcatcgccatcagagggctacacgcccttgcctttagaggactacacgtccacacctttagagggctacacgcccttgccttaagtagactgcacgtccttgccttcagtggactacacgtcatcgcctttagagggctgcacgtcattgcttttagggggctacacggcctcaccttgagagggctacacgctctcaccttcagagggcttcacgtccttgccttcagaggattgcacgtcctcgactttaaagggatacatgccctcaccttcagaggattgcacgtcctagccttcagatggcttcacgtccttgccttcaaagggctacacgccctcgccttcggtgggcttcatgtcctcgcttttagaggactgcatgtcctcaccatcagcggagtacatgtcctctccttcagagtactacatgcccttgccttcagaggagtgcacgtctacaccttcagaggaccgcacgtccttgccttcagagggctacacgccctcgcattcagtgggcttcatgtcctcgcttttagaggactgcatgtcctcaccttcagcggagtgcatgtcctctcctttagagtactacatgtccttgccttcagaggagtgcacgtctacgccttcagaggaccgcacgtcctcacctttagagggctacatgccctcaccttcagaggatatcacgtcctctccttcagagggcttcacgtcctcgccttaagaggactacacatccttgcctttagagggctacacgccctcgccattagaggactgcaaatcctctcctttagagggctacacgtcctcgccttcatagggctacacgccctcaccttcagaggattgcacatcctcgtctttagtagagtgcacgtcctcacctttaacagagtgcacgccctcaccttcagaggactgcatgtccttgcctttagagggcttcatgtcctcgccttcagaggactacacgtcatcgccatcagagggctacacgcccttgcctttagaggactacacgtccacacctttagagggctacacgcccttgccttaagtagactgcacgtccttgccttcagtggactacacgtcatcgcctttagagggctgcacgtcatcgcttttagggggctacacggcctcaccttgagagggctacacgctctcaccttcagagggcttcacgtccttgccttcagaggattgcacgtcctcgactttaaagggatacatgccctcaacttcataggagtgcac

SEQ ID NO: 50993 - DNA, 447 bp, Glycine max
  Peptide Sequence Number=SeqID_167771
atgattcaactaaagtatgtcattttggtgtggcttagaagtgaaggctttacgtttcatgagctgattgagtatcacgggttgaagaagctggtggagaagaaggacacctactacactaacctgttgggtcttaaggatgctggatttgctttcaataaggttgacaagtacaagtctatgatgaagactccttctacctatgctgatgttgttacaaaatcaaagggaaaggaacattttggtattagatcgttgatgcttgagcatgggcttttggcctatatggttgcttggataattactccaagagggagcagtcatgctcaattgaatgaggaggatcttctccttatcaatcttatggaagggaggttaaagatcaaatgggtcaacattattgttgatatcatgttgaagatgttggatcaagtggcctcggaataa

SEQ ID NO: 50994 - DNA, 216 bp, Glycine max
  Peptide Sequence Number=SeqID_167772
atgaggacgtgcaatcctctgaaggtgagggctggtagccctatgaaggcgaggacgtgtaggcctctgacgtcctccgaaggcgaggacgtgaaggcctctgaaggagaagacgtgctatcctctgacggagagaacatgcactccgctgaagtcgaggacatgcagtcctctaaaagcgaggacatgaagcccactgaaggcgagggcgtgtag

SEQ ID NO: 50995 - DNA, 465 bp, Glycine max
  Peptide Sequence Number=SeqID_167773
atgtcaaaggtttctaggtctggaaaagctttaaaaaggaaaggagaggcatcttttccgttgctgaaaatgtttaaagcgcctagtaattatctgcctaacgctttcagagggattcacgtcctcgccttcagaggattgcacgtcctagccttcagtggagtgcacgtcctcacctttggagaaaactgcacgtccacgactttagagggatatatgccctcaccttcagaggattgcacgtcctcgccttctgatggcttcacgtccacgccttcagagggctacacgccctcgccttcagtgggcttcatgtcctcgcttttagaggactgcatgtcctcgacttcagcggagtgcatgttctctccttcagagtactacatgtcctcgccttcagcggagtgcacgtcttcgcctttagaggaccgcacgtcctcacctttagagggctacacgccctaa

SEQ ID NO: 50996 - DNA, 321 bp, Glycine max
  Peptide Sequence Number=SeqID_167774
atgaaaaggattggctctttcagatgtccttatgcagttctgatctccagaattctttgctattttggtgttgatacccaagaggaagttgttggttttgttgaggtagagtttgaagtgaagaccaaagttttgagccagatggttagaaaagatcaaacagaacaagaagaagcagaaaaaaagcccctaagcctctttgagcagatgatgttagcaaagatggatgagctcatgaggatacatgaagaagactatgctaagcttaaggagtgctttgagtatattgtagaagcaagcttcatgatgaatcaagattga

SEQ ID NO: 50997 - DNA, 401 bp, Glycine max
  Peptide Sequence Number=SeqID_167775
atggagtcaggtgacatgtgggggtatcgtatggttacccgcacctttcgtcaaccaagggcaaacgagcctgttgacgcgcagagactaacatcgtcttctgtaccttttgtcatccagggacagcgagtcaagtggcagacggagataccttatggtttttactctcgtcgtccagagacattcaagcccgacgacgcactagattcttctctgctgggcggggacgatcaagttcgatggcgtttcgctggtcgagatattaaccggccggatgatgattcataccctaatttcgtccggggaacattgtttggtggcatgcaaccttcgcttcaccgcctcgagggggttccaacagaaggcgttgccttctggtggaagcaacccagctcgcctgg

SEQ ID NO: 50998 - DNA, 161 bp, Glycine max
  Peptide Sequence Number=SeqID_167776
atggagagagaaaaaggaatcacacgaagacagtacatatggaggcttcaatgtcttctccgtctctctgacgtttgggaactctatcggagcagttggaggaaaaactggaggaatctcagggaaccactagagatgccgctatcgctgtcggaagacac

SEQ ID NO: 50999 - DNA, 748 bp, Glycine max
  Peptide Sequence Number=SeqID_167777
atgaataaattcagtggaaatccatttgcaagtcttcgatcactctctaaattgttatctcttcatattgacggcaatctttttcacggagttgtcaaggaagatgatcttgcaaatcttacaagcttgacggagattcatgcatcggggaacaatttcactttaaaagtgggtcccaattggattcctaattttcaacttacctatttggatgtgacatcatggcagttaggtggtcccagctttccattgtggattcagtcacaaaaccaacttcaatatgttggactatctaacacggggattttcgattctattcccacacagatgtgggaagcactttctcaggttttgtatttaaacctctctcgtaatcatatccatggtgagattgggactacattaaagaatccaatatctatcccaactattgatctaagctcaaatcacttgtgtggtaaattaccctatctttcaagtgatgtgtttcagttagatctttcaagcaattcattctctgaatccatgaatgactttttatgtaacgatcaggacaagccaatgctattagaatttctgaatcttgcatcaaataatttgtcaggagagatacctgattgctggatgaattggacatctcttgtggatgtaaatttacaaagcaaccattttgttgggaacttaccccaatccatgggttccttggcagacctgcagtctttacaaattcgtaacaacacactctcag

SEQ ID NO: 51000 - DNA, 234 bp, Glycine max
  Peptide Sequence Number=SeqID_167778
atgaagaacttcgtgactattatgaaggaaggcataggtcacatcttagaccttacccccatgggagagaaaaggaaagaaagcctcaagaggctaacgttaacctcccatacttccaagggaaggattgttgattttcaccctctcactaagccaatctgctggcttagcgagctatccgctgagcgcaacaatccttggctaagtgcgaggaagaatttggaagaaggatga

SEQ ID NO: 51001 - DNA, 928 bp, Glycine max
  Peptide Sequence Number=SeqID_167779
tcaatctgccaatggagacattccatatgaaaacttaagctatggccaattaatttcctatgtccaaaaggtagccttaaaaatctgccaggatgacaaaattcagaggcaattagccaaagaaaaagctcaaacaaagaaggatttagaaacttcagaggaagaaactgaaactgaaacttcatcctccgtattttccgacgaaaatctaaacttaattcaacaagatgaccaattatcatcaacggatgatgatgataagcaaattaatactctaacaagagaacaagatctcttgtttgaagcaattaattccatccctgacccccaagaaaagaaggtttttctggaaaaactcaagaagaccttagaggtaaaacctagacaaaaagattttattgcaaacaacaagtttgatgtaagtaacatactcaagagattagaaaattcttcaaccaaaccaatgactatccaagatctccaaacagagataaacaatctaaaaagagaagtaaaagaacttcgtcaacaacaagaaattcatcagatcattctttctcagcttgaggtagaaagtgattctgaaaataccaacagtgaggaaaatcaaccagaaaatctagaagacgatatgtttatgggattaatcaacaagattaaaatccaaaatttttacataaacataaaaataattattaatgattttgttctagaaacaatggccctattcgacacaggggctgactcaaactgtattttagaaggattaattcctacaaaattctttgagaaaacctcggagaaacttagtacaacaaacggctcaaaattaaaaattaattttaaattctcaaatgcaattattgaaatccaaggtcttaggattaacacaaactttcttctggtaaaaaccctcaaaacgaagtaa

SEQ ID NO: 51002 - DNA, 322 bp, Glycine max
  Peptide Sequence Number=SeqID_167780
atggcataccatgctagctcaaaagccaatcaagattcaatgaaaaatcatgaaattcattttggcaagagctactcaatagaaaactttcaggggggaccagagttacaaccttactatcaaaatgaagcagaaagagaaatccaggttggtgagctggcagaagaagtgactcaatttatgtccagacaagaaaaatactttgtaaaggttgaagctcaagaggaaagccctgtaaaagagcatgagtcaagagaaaaagatgaggaacaagcacaacaacaatgggagaagtactcaacagtagaaaacaatcaagaaa

SEQ ID NO: 51003 - DNA, 336 bp, Glycine max
  Peptide Sequence Number=SeqID_167781
atgacatcaagaaggtacatgccaaatgaaagtgaacccaccaataagaacccgatgaaaaactctcaaagggatccttctacactcatagatgctaacccacaagtgaagatctatcttgatgctcatcatctgaacctaaaaatatcggtcaagcaaaactcacaacatcctatgggcccaacactaccactaagcctcccaggctgtcatggtcttatgcaacatttggacgacaatcaggaggacacatcacatgctggtacaggacatggtgctctcactaaccatggatacaactctgctctagttaggaatgccaagtatggcttgtga

SEQ ID NO: 51004 - DNA, 183 bp, Glycine max
  Peptide Sequence Number=SeqID_167782
atggtggacgaagtggagaacggggtagtcaacactgtactcattgcaattattgcaaccactatgggcaagttgaagtcgaatgtctcaccaagatcgacgtatcagacaatgatgggagtaggacatgagtctagaggattataccaactatcaaggtattatcgccagtggcctatgtga

SEQ ID NO: 51005 - DNA, 573 bp, Glycine max
  Peptide Sequence Number=SeqID_167783
atggatgactttcttatagagttcttcccctcaatatatagacaaaaaaagcatgcacatgaaaacaactactgcaaatatgacaaccaaggccttgcagcatttacctcttctctgtacattgttggtttagttgcatccctgatggcatctcccgtgacaagaaaatatggacgacgagcaagtatcataggtggcggcatcagttttcttattggatcagctctgaatgcttcagctattaacctgataatgctgatcttaggtcaggtcatgcttggtgttggcattggatttggaaatcaagctattccgctttatttgtcaaagatggcaccaacacaccttcgaggaggcctgaacatgatgttccaagttgcaaccacttttggaattttcacagctaacatgatcaattttggaacacaaaagatcaagccttggtgttggaggttgtccctaggcttggctgcagtaccggttcttttgatgactatgggagggatatttcttcctaacactccaaatagcttaatagaacgaggattgatggaaaagggaggaagctgctag

SEQ ID NO: 51006 - DNA, 573 bp, Glycine max
  Peptide Sequence Number=SeqID_167784
atgcagatagtgttgctcactcaaatcaaccgaaacaagcatcaagctgtttcttttgtatgtctctggaaattggaatacacaattcgatatcatattcttgtcttcaacagcgacctaaaccctccctcaggggaccaaaagttgaaccctgatccacacaagctgctttcccctttcgctttcaaagatctcaacagccgctcctcctcacgtgactctcacgtgcgtgcgatcaacaccgaaatccaacagcataatcaatcaaccaattcatcatcaccgcctcaacgcgaggaacccagggaccggaacggagctcggatcggggcccaaccggttcgtggatcccaatacaaaatcgaaaccaccgtcgtcgtcgtcgaaagaattggcgcggcgggggttctcggggctgagcgtctcgcctctcttgaggatcttgacttggcccatgacaaggttcgcgcaggggcctttcaccaccatgccggagcggtcgccgtcgtggagcttccgccggcgagtctggtaagggttggggctagggtttgggttagggtttctttgtga

SEQ ID NO: 51007 - DNA, 1012 bp, Glycine max
  Peptide Sequence Number=SeqID_167785
tacacgtcctcgccatcagagagctgcacgccctcaccttcagaggactacacgttctcaccttcagaggactacacgtcctcgccatcagagggctgcacgccctcaacttcagaggaatacacgtcctcgccatcaaagggctgcacaccctcaccttcagaggactacatgtcctcgcctttagaggactgcacgtcctcctcatcagagggccgcacgccctcaccttaagaggactacacttcctcaccatcagagggcggcacaccctcacctcaagaggactacacgtccttgccatcagagggctgcacgtcctcgtcttcagagggctgcacaccctcaccttcagaggtcttcacgccctcaccttcagagggctacacgccctcgccttcagaggactacacgtcctcaccttcagagggctaaacgtcctcaccttcagagggctaaacgccctcgcctttagaggacaacacatcctcgtgttcaaagggctgctcatcctcacttccagaggactgcacgtcctcaccttcagagggctacacgtcctcgccttcagagggctgcacgccctcaccttcagagggctacgcgcccccaccttcagagggctgcacgccctctcctttagaggactagatgtccttgccttcagagggctacacgtcctcaccttcagggggctacacattatcaccttcagaggactagacgtcctcgccttcagagggctacacgccctcgcctttagaggactacacgtccttgccttcggagggctacgcgcccccctttttgagggctgcacgtgcccatctttagaggactgcatgtcctcaccttcagaggactgcacgtgctcacatttagaggactgcacgtcctcacctttagagggctacacggcctcgccttcagaggactactcgtcctcgccatcagaggactacacgtcctcgcctttagaggactgcacgtcctcgccttcagaggactacac

SEQ ID NO: 51008 - DNA, 579 bp, Glycine max
  Peptide Sequence Number=SeqID_167786
atttcactcattgctcagtccaactcctcgcggcttggatttacagctttgattactgccttgtgcaaggcccgaggagtcacctcagattctcttaccttcgagtcacttaacctagccattaatttggcctatattaagaagaattgttggaacttggatgaaccttcagtcacttttccagggacccaaaaatccaaggctagaagatctgaggccccatctacatcagctgcctctactccccctacatcagctccatctacttctgctcttccttcaccaccagcagctccagttcttccaggtcccttcgctcagagcttagaacttttcatgtctatgctgcagagcctgcatcagggccagctcctgatcatacagagtttgcaggatgtggtccaacagcggccagttatgagcttggaggagtttgttcagaagatggcctggccaggagtccagccttctcctttgggagggggtgaggcctctgcagcccaggagcctcagccggaccaggaggatgacattctagaggcctcaaagtccactccacttgagcctttcattttttag

SEQ ID NO: 51009 - DNA, 222 bp, Glycine max
  Peptide Sequence Number=SeqID_167787
atgtctttgaggatgggtgtttgtggtgatggtggtggtggtggtgggaatctgaggggtcttccatggagggttggagtgagagtgaagagcaatggacggagggaggcccgaaaaaacgagaagcgaatggacggaggagacatagggactaagggtttggaaattttggttttccctaaaacgagaagcgcaatggacggagggaggcccgaaaaataa

SEQ ID NO: 51010 - DNA, 429 bp, Glycine max
  Peptide Sequence Number=SeqID_167788
atggctgcaccagacaataatgatccaagaaacatggtttccatttcaaggattatgtttgtgcatgcaaagcttgtgcaacctcagagggttttaaccgtttcaaatttggataggaagctttacaactacatgactccttatgtgtccaagttcctaatgaaggcatatgtgaactatagagatttggatttgggaatgaacaagaagaacaacacaaagcattccaccactcctagtttcaagtatgaggccaaaagacaagaagtgcaagacctgggaatgaggcactatgttgctggagccattgggtataattgtgtcattgttgaactagctggggttcgaggacatgagacattatgttctgtacataaccttggaggtagaagcaacaattgcatcagtaaaggaggagattacagatag

SEQ ID NO: 51011 - DNA, 1044 bp, Glycine max
  Peptide Sequence Number=SeqID_167789
atgaagaagaaatcatgtgacgggggggattcttatttgtacaaatggtacttcgaacttggaacgagtatgaagaaattaacgatacttctttaccttttgagttgttctgccggatcggtcgctcaagacctttggtctctacccggacctgatgaaaaaaatgggatcacatcttatggactcgttgagaataattctgatctagttcatggcctattagaagtagaaggcgctctggtgggatcctcacgtacagaaaaagattgcagtcagtttttttttggttcgagtgacattgcttcttcgagatttctctatgaaaaatatgaatcggagtttgaagaaggggggggagtcctcgacccacaacagatagaggaggattttttcaatcacatcgtttgggctcctagaatatggagcccttggggctttctattttattgtattgaaaggcccaatgaattgggatttccctattgggccaggtcatttcgggacaagcggatcatttatgatgaagaggatgagcttcaagagaatgattcagagttcttgcagggtggaaccatgcagtaccagacacgagatagatcttccaaagaacagggcttttttcgaataagccaattcatttgggaccccgcggatccactctttttcctattcaaagatcagccttttgtctctgtgttttcacatcgacaattctttacagatgaagagatgtcaagggaacttcttacttcccaaacagatcttcctacatctatatataaacactggtttatcaagaatacgcaagaaaagcattttgaattgttgattcattgccagagatggcttagaatcaatagttcattatctaatggatttttccgttctaatactctatctgagagttatcaatatttatcaaatctgttcctatctaacgaagcgctattggatcaaatgacaaagacattgttgagaaaaagatggcttttcccagatgagatggttgttgctatctgctccaataacgaatcattggtttaa

SEQ ID NO: 51012 - DNA, 351 bp, Glycine max
  Peptide Sequence Number=SeqID_167790
atgcggattccgttgttcctcatctgggtgttcgatttcaagctcaattcgagatgggtgtccaaggattcctttgtggcggctccggtcaacaaatctggggaaccggagctacggccctctgatctgccagatacggcgtcgttgaaggccgtggatgtttgtgacgcggtgttgcccgataagtctccttctgaaggcgaggctttggtgcctccacggtgtgcaggtgaaactgcggagaaatcgaaggtggctggtcttcccccaaggagcgtgaagaaacgtgctgcgaaatcgtgccccaagactgcgtggggaaagctcctctctcagtgttctaaggaatga

SEQ ID NO: 51013 - DNA, 396 bp, Glycine max
  Peptide Sequence Number=SeqID_167791
attttcaggaaagtgatagatctcatccagcatcaagtagttgcagcccagaaacgcacattgctatataaacacgagggctgcacgagttctgtaccaagtccgggattgaagagttattttgtgagtttgggacttgagtgttttgtgagccaccttgatgctaccctaacatcaagtgttggacctgagtgtgtagagttgatctctatcaaacacaatctgcagcgtgatgtcgtgacatcctgtacgacatctgtccccagtatcagaatttcagagacacccccttttttgacaataatgcctaatatcaacgactcacacgatgttgacggtgtacacacaaatcgtaatgatcacgatgaaggactatgggagaacattgctacataa

SEQ ID NO: 51014 - DNA, 162 bp, Glycine max
  Peptide Sequence Number=SeqID_167792
atggtggctgtgggaaggtggggtccggtctctgttgttgtgcgtgcgaagagagatgaagaggatgattggtcaagagtgtgtgaaaggaaacgacaagcagccaaccatgcagatgcagtgattcagcggcggttgaagatggagtctagtagtcaatag

SEQ ID NO: 51015 - DNA, 237 bp, Glycine max
  Peptide Sequence Number=SeqID_167793
atgatcgttaatgagtttgagaatgaaagagagaaaaatggctcgtgggggagtaaggtcgccaaacttgtagtcgtagctcgtggaggaggaggagaaggggtggcggctcgtggaggaggaggaggaaaagaaaatgaaatgcaaattgggtttggattggctaatgggaaattgggaatggacaaatggtttccttgggcttggctcaccttcaagttgagcgaatatgaataa

SEQ ID NO: 51016 - DNA, 1710 bp, Glycine max
  Peptide Sequence Number=SeqID_167794
atggatggaaagaagttagagtacaaaggtgaggaagcactgaaggagatagagaggttgacaatgaaggctgctgaagttcaagaaggccttttgaaacagatcttaactcagaatagggaaactgagtatttgaataagtatatgaggggagaaaaaaatacaacggacatagcagagtttaagagttcagggacatcatctggagagcctaaaatgatgccatcaattgcggaagatctagaacgccgtacttttgtgtacaatcttatcacgccaatcataaaccagtacgttcctgatcttgacgagggcaaggcaatgtatctgtactttgtaaaagcagaaatgtgcactccttgcggcttaccagccagaacagtgttaacaagctactacaagagcaagcacttcaagtgccgcacgcacgacccttggaacgattacacaagccccgaccaaagcattctatgcaatgacagcaaccaaagcatgcattgccagctcctagcaggtttggttcaccgccgccacgtcctaaggctcggcgccgtctttgcctccgcacttctgagagccatttccttcctcgaacgaaactggaggcacctgtgtgaggacatttgcagtggccaactcagttccttcataacagacccttcatgccgctcccgcatgtccacattcctctcttcccctaaccctcgtcttgctgatgagatcacaagaatctgcagccagaagtcttggaagggaattctgtgccagctttggcctaaggccaagttcatagaggctgtggttactggctccatggctcagtatgttcctgctcttaagcactacagtgaagggaaattgcctttggtttgtaccatgtatgcttcttctgagtgctactttggggttaatctgaagcctctttgtgatcctagtgatgttgcttttaccctcttgcctaacatgggctactttgagttccttcctcttagacacaacgggacgctgttgatggattttgatgaaggagagcaggttcccaatgataagctcgtggatttggtgcatgtcaagcttggttgcttttatgagcctgtggtcactacttttgctgggctgtaccgataccgcgttggtgacgtgcttcaggtggtgggattttacaacaacgccccacaagtccgtttcatctgcaggagaaacgttgtgatcagcgtcgacaccgaaaagaccaacgaggaggacttgcacaggggcgtgacaatggcaaaaaaattgttggagccatacgattctctcttagtggagtacacaagctaccccgacacttcttcagtaccaggacattacgtattgtactgggaaattcttcattgtgggataaagacagaatcatcaccacaacttcaacttgacgcaaacgtgcttgaggaatgttgcattgcggtggaagagcaattggactacgtatatagacgatgccgtagctatgacaagtctgtggggccacttgagatacgtgtggtggagccaggaacgtttgacgcgttgatggacttgtttatttgccaaggagcttccatcaatcagtacaagactccaaggtgcatcaagtctaagaaagcactcaagttactcaagtctaaagttacagcttctttcttcagccctagagatcccaaatgggcccctaagatgtgttcaagttga

SEQ ID NO: 51017 - DNA, 230 bp, Glycine max
  Peptide Sequence Number=SeqID_167795
gccccagctcgcccaggccagcatttggcttgcctgggccaccaaataacttcaaggctaagggactagctcgcctgggcaagctgcaaccgccccaaggtggccttttgcctataaataggcatcctaggggtgttttaaagggtttcaaggttcaaaagttgagggaattgagagaagagagaaacaagaggaaacgaggccgaggcgctaccaaatcgcgaccgtga

SEQ ID NO: 51018 - DNA, 444 bp, Glycine max
  Peptide Sequence Number=SeqID_167796
atggagatgtacatcgagtccattcaatatcgaatttggcttatcatcacaaatggtgatattcctattcccataccagaagcaaaaaggacaaatgttggtctaaccattatgaagataaatacaaaaaccagatacactttaacatgtatggaagatgttagactaaaaaaagctatcactttgaccagccattacgagagtttctccacaaaggaaggagaatctatggaggatatgtttgagaggctacaagttctcctaaacaacctagaagctttgggtctaacctacaccaaggcccaaataaacttgaaagtggtaaacaactttcccaaggtgtgggaacctaagaaaatagccatccaagaggctagggactttaaaaatcttgcctgggatgagctattggggattcttagagttcatgaagttcatctttag

SEQ ID NO: 51019 - DNA, 474 bp, Glycine max
  Peptide Sequence Number=SeqID_167797
atgtattcagagttggaatcaagagcaataactcagtacatcgttcacgagtatgctgataaggggactcaactgataagcaaggagtccaagaagatggcaaaattgaggttgtggttggaagtagagagccaacactacgatcaaccagcttcaaaacttgtatgggagctcatggtaaagcctatgtatggtctccctacggatccagcagctgtggaagagaatgaagggaagctaggcactgttcttgatttctacgagaaaacattgtctcagtccaaatacgtggcgggtgagtgtttcaccttggcggatctgcatcacctcccaacgattcattacttgatgaaaacacagagcaagaagttgtttgaatcacgaccccatgttggtgcatgggtggctgatattacagcaagaacagcttggtctaaggtccttgccatgcagcctttgctaagtagtaaatag

SEQ ID NO: 51020 - DNA, 199 bp, Glycine max
  Peptide Sequence Number=SeqID_167798
atggcaacaataagacttcatggaaaccccttctcaacagccaccatgcgagctgctgcttccctacacgagaagcagcttgaatttgagtttgttctcattgacatgaaaaatggtgaacacaaaaaggaacccttcatttcccttaatcctttcggtcaagttccagcctttgaagatggagatttgaagctctttg

SEQ ID NO: 51021 - DNA, 195 bp, Glycine max
  Peptide Sequence Number=SeqID_167799
atggcacatcataatcttgtaagaaacacaatcaactttcttgaccgttcacgagaattaaatccaatcacaattcatttggagatcaatcaatgcgtttactttggcacatctgaaccagcaattcctagccgggttcgtggagcttttagactggccaaacagatgcagacagaatatgatgtcaacaaataa

SEQ ID NO: 51022 - DNA, 345 bp, Glycine max
  Peptide Sequence Number=SeqID_167800
atgccttctgaagtaatggtggagagtatggaaagcaatggaggaaacgttgaaaatacagagcagcaccatcatttgccagtttctgatcctcatgggctcatggggaagaagctttcatggcaaaagtttcctagaaatgattctctcgacatggaatcccgcagcttccctacatcctctcatgcctctataatgccagtgattatgcatctagcgtttcaaagcctcggaattgtatatggtgacatgggaacatcaccgttatatgtgtatgcaagcaccttcgtggatggcataaagcacaacgatgacattttgggtgttctttcgttgatcttctaa

SEQ ID NO: 51023 - DNA, 531 bp, Glycine max
  Peptide Sequence Number=SeqID_167801
atggttcaaagattcggaactgataaagtgggttacagttttgctcctattatttattattttagaaggaacaagaaagatgcttggatttctcttggtggtgtagtgttatccataacaggaactgaagcactatttgctgatgttggacatttcacagtccggtccatgcagataagcatgtgctctgtaacataccctgctctcttacttgcctacactggacaagcctcctttcttcgccaaaacaatgatcttgtttcagacactttctacaaatctttatattggccaatgtttgttgttgctgttatggcatccatcattgcttctcaagccatgatctctgggactttctctatcatccaacaatccctcgctcttggatgctttccttgtgtgaagatagtgcatacatccgccaagtatgaaggacaagtttacatacccgaaatcaatttcattctcttgattgcatgtgttgcagtcactgctggatttaaaactaccacaaaaattggcaatgcttag

SEQ ID NO: 51024 - DNA, 393 bp, Glycine max
  Peptide Sequence Number=SeqID_167802
atggttgagcatggaactcgaaaacccaccactgacagactcgaagaaacgttagctcgcctccccgtccaccatgagtccctcgtggctcaacactttgacctcgcctccaaagttgccatctcctcgactgtgccctgtttcgacggccacaacccactaggatggatcttcaagatctctcagttttttgaatatcaggcaacccctaaggaagaatgcatcacactagcgtcattttacctcaacggacctgccctcagctggttcgagtggtcctatcgaaaagcttttatcactacctggccaggattcttgcaggtgctggagtcaagatttgcaccgatgtactgcgatgaccccaaaggtgctctgtttaaattgacgcaatga

SEQ ID NO: 51025 - DNA, 1503 bp, Glycine max
  Peptide Sequence Number=SeqID_167803
atgtcaaatatttcaggtgatgaaggaagcttctccacagcaaacactggtgaagaagttcatcaagaaaacaagctacaacaaccactaaaccacccccatggctcaagttctggtgttcgcaacagcaatagctccactaatcaacagcaacaacaagcaaacaagaagaatagaaacctacctggaaccccagagtctgtgggggatgatatggatgaaattcatgtaacagatccgaatgctgaagttattgctttatcaccaaccacattaatggcaacaaatagattcgtctgtgagatctgcaacaaagggtttcagagggaccaaaaccttcagttgcaccgcagaggtcacaatcttccatggaaactgaggcagagaggaagcaatgaagtgaagaaaagggtttacgtgtgccctgagccatcatgcatccaccataacccagctcgtgcattaggagacctcactggcatcaaaaaacattacagcagaaaacatggtgaaaagaaatggaaatgtgacaagtgctctaaaagatatgcagtccagtctgattggaaggcccaccagaaaacatgtggcaccagggaatacaaatgtgactgtggaactatattttccagtggcatggcaccaacaacaaccctggaaaatgaattgccggatcttattgccactacaatgcctctaagcgctagttccaacaacagtactgtatccgaattcaacaacaactacgacactaagagcccactccaagagcatattgtcccaatgccattcaagtccactagcatgggtggtggcatgttctccaacaccactttttcagctggtacactctttggtggtccaaaaaacatgtctcatccctcttcttccactcttcaactcagctccaacaactccactgctttcaattacttccaagacagcaaaaacgcttctgcctcatctcacatgtctgccacagctttattgcagaaagcaacacaaatgggtgccactgcaagcaataacaatagcattattaactctccaaccatgatgcagaaaagctttattagtgccatgactggtcctgaccacaaccatatttcttcctatgaccacttccatcatccaaaccctgatgatcaatctcacaatatggctgggattagtaacgccggagccttcaccaacctgttttttcacaagggacaacaagaaatgtcactgatatttgattccaacactagtgatatgggaatgttcggcccaatactgatgaagaacgtggagcaagagattggtactggttcgagtttggttcatgacttcttgggcgttggggatgcaacttcaagggtgtatgaaccacagaaacaacaacagcaaagattggagttagaagcattaacccaccagaggttgcagattatgaatcactttcaccaccaccttccacatggggattctgctactatggagaaatccatttgggacatttga

SEQ ID NO: 51026 - DNA, 1257 bp, Glycine max
  Peptide Sequence Number=SeqID_167804
atgggtatacagaagacgcttcatcgtctccaagagagcttcacttgggactccattagaaccgatacactagctttcgtcaccagttgcttgacatgtcaatataccaagtatgacaacaggaaacccgctggattgctgtgtcctctaccggtaccggtgcaaccatgggaggatttatccatggattttattgttgggttacctgcatacaagggaaacacttgcatcctggtgattttagataggttttcgaagggactgggccttggtatgttacccacacatcataatgcacgaacggtgactgagttattcatggaaatagtaggaagattacacggaatgccgagaagcatcgtgtccgatcgtgatccactatttgtaagccgattctggaaagaactcttctctctcagtgggacgaagcttcgcctcagctccgcttaccatccgcaatcaaacgggcaaacggaggtggctaaccgcattgtggaacagtatttacgagcattcgttcatcagaaaccttcacggtgggggcgtttcttgttatgggccgaatggtcctataacacttcatgtcactcagccaccggagtgactccatttaaggttacctttggtaggaagcctccaagttttccccactacatattggggaccgcgaaggtagacgcagtaaagctgagtaaagctcaagcacgaatgaagatgatggcggataaacataggcgtgaggaggaattgaaagtggcgtaccagttgcagttgccggagcaatcatgcatccacaacgtgttccacgtttcgctccttaaacccttcgtgtccactgacccaccacaggattcagttgctcttccccccacggctatggataacgaccccatcatcgttcccttagccatcgtagcaacaaagacaattttgtcagaagaaggcccaaaacgcatggtgctcgttcaatggaaggatcttccactcgaagaagcttcgtgggaagaatggacaccctttaaaaagcttcatcaccttgaggacaaggtgttctttgaagggcaagggagtgttacacctattgaggatagggtgcaagtagcaggtggggtggtcaaggaagaacaagggctgcgactagtaagggaacagcaacatgggggaaggcccatcagaaagatgaagataccagcacgtttggatgactacaaggttctagaagtagttaagcttgtaactgattctgttagggtttag

SEQ ID NO: 51027 - DNA, 722 bp, Glycine max
  Peptide Sequence Number=SeqID_167805
atgggaacaaatcaaaccggcaagaggttctaccaagtcaaggttaaaagcctagataccacaagcatcaaggaattagggcggctgatgaaacctctccaaatgcaagccttccgcaagacttacggaaagatcttagagttgaccatagcagaggtgtccatagaagccattgcatcactcacccaatactacgaccagcctttgagggaaattctaggatgtcctctcggggggaagaaaaccatatctttcatccgggtgtctcccctctttgagcagaaattgcacaaggattcagcaagaggagattgggtcccatttatggatgtgttagctttgctaatttttggggtcgtcctctttccaaacgtggatggtttggtggacctagcagcaatcgacgctttccttgcataccaccatagcaaggaaagtcctgtggtagctgtcttggtagatttaattgacacatttgaccgaaggtgcgaaaagagtagcgcacagatcatctgttgcttgcccgccctctgtgtttggttggtttcgcacttgttccagcaagacacaaggcatccatgtccgctcctgagccatcgctcgtgtactgaaaagaggagaatagattgggaccagcttttggccgggataggaggtagaacaatcaattggttcccccgatggaaggaaggaaaggagggagtccttttctcatgtggagg

SEQ ID NO: 51028 - DNA, 246 bp, Glycine max
  Peptide Sequence Number=SeqID_167806
atggagaatcttggacttaatcttggattatctgaccgttgggatttcaaaaataataacttttggctccggctaagtgagaatggtgcgctaagcgcaattccaaccgaggggaattgcgccaagtggcccaaagctgcactaagcctaattccaaccgaggggaattgcactgagcagcccaaaggtgcgctaagtgagccctatttcagaggaggctgcgctaagactaaattcttgcgctaa

SEQ ID NO: 51029 - DNA, 201 bp, Glycine max
  Peptide Sequence Number=SeqID_167807
atgcctcgccacctccttggacaacgagtacatggtcctccaaatgagttggtcattaataaggtggcacatgatgaacaaaactcaaaaatcttcacatttggtgtcgctctaaggatcttcaagcttgatgactatggtgtgttgtgggacttctccaccaagagcttggatgattcgtatgccttgagtcaaagttga

SEQ ID NO: 51030 - DNA, 245 bp, Glycine max
  Peptide Sequence Number=SeqID_167808
gtggcgaaggagaagaagcacagacttctgatgatgctcgagtgcgacgaacacgatgctcaaccttagacaaaacgatggtcagatggagaacatacaacttcaaggagaagaagcagagacttgtgacgatgctcgagtgtgacgaatacgatgctggagtgcgacgaacacgatgctcagatgcagacagggaccttgaaggtagacggagattagaagaagaagagagcgtgaaagcttag

SEQ ID NO: 51031 - DNA, 390 bp, Glycine max
  Peptide Sequence Number=SeqID_167809
atgtttctcttaaccaatgctttcaagggattcaacaatattcaaggaagtaaatccaagtcttgtgctaaatggattctagttaaatgtaataagcaaagaggaaacactgagtgtggctattatgtgatgcattggatgtcaatgatagtcctaggaggtttcaaggatatttgggaaatgattttcaggatagcatcagaggatagagagtatcagaatgacaaacctacaacaaagtttagagagacaaggttggcattgggacctatgcagttgatccagagatgcaaaagttggagctggaaaagcttaatcttcttaagctctagaaggaaggtttctcagggattggccctttctcctatcaatcttgggacaccttactag

SEQ ID NO: 51032 - DNA, 1893 bp, Glycine max
  Peptide Sequence Number=SeqID_167810
atgggagttgtcactgttggagaattgaagcctagcatctcagggaagaggacctttcgtccaagctcaagcataaggcatgccactgaatggccaatatctgatgtctctagtgatctcaccatcgaagtaggagcttcaagctttgcacttcacaagtttcctcttgtttctaggagtggaaggattcggaaaatgttgttagaaacaaaagattcaaaagtttcacgcataagtctcccaaacttgccaggtggtgcagaggcatttgagctggctgccaaattctgttatggaatcaatgtggagttcagtctctccaatgttgccatgctaaaatgtgtagctcattttctaaaaatgacagaagagtttgcagacaaaaacttggagacgcgagccgaagcatatctaaaggagacagtgctcccaaatatatcaaacacaatatctgttcttcaccgttgtgaatctcttgttcccatttcagaagagattagccttgtcagcagactaatcaatgcaattgcaaacaatgcatgcaaagaacagctcaccactggtttgcaaaaactggaccacagcttcccttctaaaaccacctcaaacatggaacctgaaacaccctcagaatggtgggggaaatctctcaatgttcttagtcttgatttctttcaaagagttttgtctgcagtgaagtcaaagggattaaaacaagacatgatcagcaaaattttgataaactatgcacataattcccttcaagggattgttagggaccaccaagcagtgaaaggatgttttcccgacttggaattacaaaagaaacaaagagtcattgttgaagccattgctggcttactaccaactcaatcaaggaaaagcctggttcctatggcatttctctcaagtttgttgaaagctgcaatatctgcatcagcatccacttcatgcagatctgatttggagagaaggattggtctacaacttgaccaggctattcttgaagacatcctaatcccaacaaattcacatcaaaacacacatgggactatttatgacacggattcaattttgaggattttttccaattttctgaacttggatgaggaggatgaagatgataatagtcacctgagagatgaaagtgaaatggtttatgactttgacagccccggatctccaaaacaaagctcaattctgaaggtatccaaattaatggacaactatctagctgaagtagcactagacccaaacttgttgccatcaaagttcatatcccttgctgaactacttccagatcatgcacgtattgtgagtgatggactctatagagccattgatatattccttaaggttcatccaaacataaaggactcagaacggtaccggctatgcaaaaccattgattgccagaaaatgtctcaagaggcatgcagccatgcagcacaaaatgaaaggttaccagtgcagatggcagttcaggttctatactttgagcaaataaggctccgcaatgccatgagtggagggcacagccatgtcttctttggaggaggagcaggacttaatggtcaattccctcaacgctcagggagtggtgcaggaagtggagccatttcccctagagacaactatgcatcagtgagaagggagaaccgtgagctgaagctagaagttgcaagaatgagaatgaggctcactgacttggagaaagatcatgttaacatgaagcaggagctagtaaagtcccaccctgccaacaagctattcaaatcattcaccaaaaaactaagcaagctcaatgctatgtttcggattaacagtatcaagccaaatggttctgagagtcgctttccttttcctaagagaaggcgtcactcagtttcatga

SEQ ID NO: 51033 - DNA, 1467 bp, Glycine max
  Peptide Sequence Number=SeqID_167811
atggacttgtacggtcggagccctgccagaaatggacccaacccggtgaaccaacccgaatggagctcaccgggcaccgacactgctctcgaagaatcgatgtggcatttgacgctgggtggtggcgaatcttacccggagcgatccggcgtgccgaattgtgtgtattacatgcgaactggtgtgtgtggatatggtggcaggtgtcgttacaatcaccctcgtgatcgtgctgcggttgctgcagcagtaagagctacaggggactacccagaacgggtgggggaacctccgtgtcagtattatttaaaaactggaacctgtaaatttggtgcatcctgtaaattccaccatccaaaaaatggaggtggatatttaagccaagctccactaaatgtttacggatacccgttacggccgggtgagaaagaatgctcctactatttgaaaacggggcagtgcaaatttggtatatcttgtaaattccatcatcctcaaccggctggcacatcattgccagcatctgcacctcaattttatcaacaggtgcagtctcctactgttcctctgcctgaacagtatggaggagcttcctccagcttgagagtggccaggcctcctatattgcctggttcatatgtgcaaggggcttatggtcctgtacttctttccccaggggttgtccaatttccgggatggagtcattattcggcacctgtaagtcctgtgccatctcctggcgctcaacctgctgttggggctacttctttatatggagtgacccagttgtcatcaccaacatcagcttttgctagaccatacacaccgctgccctctaccactgacccttcaagaagcaacccgaaggaacaattatatcccgaaagaccgggtgaacccgaatgccaatactatctgagaacaggggactgtaaatttggattagcttgtcgatatcatcatcctcgcgatcatattgtggcacggccacttcttagccctgtgggacttcctttacgtccggtagccctgcatggatttcagatgcaacaccgtatccagttgtgcacacttgggttacaaccttgtgcattttatttgcaaaatgggcattgcaaattcggctccacttgcaaatttgaccatcctttgggatctatgcgatacagtccatcggcatcttctctcatcgatgtgccagtcactccatacccagttgggtctttgctgtctcagttggctccttcaacaacgtcttcagaccttcggcctgaactgatgtcagggtccaaaaaggaatccttttcagccagaataccttcttctggaaatagttctggtacttctgtcggtctaattttctcacaaggtgggtctgtctcgctatctgatgtgcaactctcaagtcagagtaatgcccctccaaacagtagcagaagcaccagacaaagcggtgaaatacgttga

SEQ ID NO: 51034 - DNA, 1122 bp, Glycine max
  Peptide Sequence Number=SeqID_167812
atggacttgtacggtcgggcccccgccagaaatggatccaacccgctgaaccagcccgaatggggcaccgacactgctctcgaagaatcgatgtggcatttgacgctgggtggtgtcgaatcttacccggagcgacccggcgtgccgaattgtgtgtattacatgcggactggtgtgtgtggatatggtgacaggtgtcgtttcaatcaccctcgcgatcgtgctgcggttgctgcggcagtaagagctacaggggactacccagaaagggtgggggaacctccgtgtcagtattatttaaagaccggaacctgtaaatttggtgcatcttgtaaattccaccatccaaaaaatggaggtggatatttaagccaagctccactaaatatttatggatacccgttacggctgggtgagaaagagtgctcctactatttgaaaacggggcagtgcaaatttggtatatcttgtaaattccatcatcctcaacctgctggcacatcattgccaacttctgcacctcaattttatcaacaggtgcagtctcctacagttcctcttcctgaacagtatggaggagcttccacaagcttgagagtggccaggcctcctgtattgcctggttcatatgtacaaggggcgtatggtcctgtacttctttctccaggggttgtccaatttcctggatggagtcattattcggcacctgtaagtcctgtgctatctcctggcactcaacctgctgttggggccacttctttatacggagtgacccagttgtcatcgccaacatcagcttttgctagaccatatactcctctgtcctctactaccggcccttcaggaagcagcctgaaggatcgattttttcctgaaagacccggtgaacccgaatgccaatactatctgagaacaggggactgtaaatttggattagcttgtcgatatcatcatcctcgggaccatattgtggcaccgcttcttagccccgttggacttcctttacgtccgtctggcttcaggtgcactaggatcaacatggacagcaatcaatctggagtaagggacaatattcagcttttgcttttcacaattgcagagttggctcttgacagcacatga

SEQ ID NO: 51035 - DNA, 180 bp, Glycine max
  Peptide Sequence Number=SeqID_167813
atggtgacgattggtgagagtggttataacggtgatgattatggtggtggctataacaatcatggtggctataactttgacaactatatcactattcttgatcacggtggtggtggtggtgatagtagtagcggtgatagtgacaataataacaatcatgttggttgtgacaacggttga

SEQ ID NO: 51036 - DNA, 309 bp, Glycine max
  Peptide Sequence Number=SeqID_167814
atggacctaatcaccagcatggtagctgaaaggcccgtggtgatcttcagcaagagcacatgttgcttgagccactccatgaccacactgatacgtagctttggtgcaaaccctactatttatgagcttgatgaaatgacaaatgggcaacagattgaaagtgcactgcttcaaatggggtgccagccaagtgtacctgctgtctttataggacaacaattcattggtggatctaagagagttatgagcctgcaccttaggaatgagttagtaccaaagctcataaatgctagagcaatatggatttga

SEQ ID NO: 51037 - DNA, 531 bp, Glycine max
  Peptide Sequence Number=SeqID_167815
atggacatgaacattggagcccttacctcaggtcagatttcttccattgctcagagtaactcctctaggctcggatttccaaccttgatcactgccctctacagagctataggagttacctctgacagtctgacctataagagcctgatcccgaccattaacttggcctacattaagaagagttgttggaatgtggatgatctgacaactaactttagaggggcaaggaaggcaagggctcgaccagctgatgttccctcttcttctgctccaccagctccttccactttcgctactcctacaccagctcctccaggcccatctgcccaggaatctcagcgctttgaagccatgcttcatagtcttcatcaaggacaaattttgttaatgcagagcttgcaggtggtagctcctccaggatccattatgttagtggaacagttcatggagaaggtatcctggcccgaaatcctgccttctattgtgagagaaggtgggggtcccagtgctcaggtggaggatcgcagatga

SEQ ID NO: 51038 - DNA, 507 bp, Glycine max
  Peptide Sequence Number=SeqID_167816
atggcacaaccactcataactctacaacctccgatgatgcccaacacagtcctctgtataggtaatggtgcgcggaagatgctaagcaaccatgtcagcttcagtgcggctcccttacgtgcattatctggagggactttgcctagtaactcgtcatataactcattccaatgtaggaagctaggccttcatcgttcaaccaatgcagtgataaatgcaaaatcaattctgcactgtttggttagggcaatatgttggaacctggtagacgataataatggtacaatttgtcgttctgattcagtttttagaagtgacaagacaaaatcgatatcgttgaatccaacaatgacgctgccaaatataatcaccacaatacagtcatcaattaaagatgacgatgttacgcctataattactgcactttggtatcattgtcctatataccaattcaatgctcatgttgagtatagggcgattcaaattattgacgaagaaggtgtttga

SEQ ID NO: 51039 - DNA, 174 bp, Glycine max
  Peptide Sequence Number=SeqID_167817
atgaacaagatatatctagggcaatttgcattgagccgcaatctcctgtaccctcatgagcaccttggtatatgggtgtcgcaacctacccttcggctggagggcgacgcggggctcaagggtgtgtcttccaagaaaggaaaatgcgcggagttgccaccaatgtttatttga

SEQ ID NO: 51040 - DNA, 297 bp, Glycine max
  Peptide Sequence Number=SeqID_167818
atggtaaaattagtaacattggcaaaagggaacacaacatggcaaaagggaagatttggtgaaaatacaatcatcagtaacattgatacaggttttgtgggtaatgttgggtcctgcacaaagattaataggcccgtggacattatcacagttgtggggggtcaaggatactcattacatgcagatatacagtatcttgatgctagatgggaagttcttgttgtgcttcctctgcgtgattgttttgcccaagatatcaacatgctatgccaccttgatgggtttgtagtcctctag

SEQ ID NO: 51041 - DNA, 369 bp, Glycine max
  Peptide Sequence Number=SeqID_167819
atgtttcacacacctgacaactctgccaaaccgagtgaagcagtaaaatatgcatcatttcaagcacttcatgaatctcgaagtcatgtagacgacaagaaagtcacctcaatgttgtcaccatcaccatcacgactgatgttgcgacccaggtcatctcgggtgacacttgacctcttgtccatcatggaggagcctgtgacaacaatccgaattttgggtattgagattcaaccttacctcccaccaccacctgggtctgtccgaattttgggtgtagagcttcgaccttaccttccaccacctaggccattgttggaaatcgacgctcctgtatccaacgcaaacatgaagccacaaccctcataa

SEQ ID NO: 51042 - DNA, 891 bp, Glycine max
  Peptide Sequence Number=SeqID_167820
atgccactgccattggcagaatgcagtggtgtcgccagtgccattagcgatttggccatgcaagggttccagccaacggtgtcaatggatatagcaagtggtgttggcgagatcatgcaatatggatatagccattgggtatatgaagagaatgatggtgtaatatttgaaggcagtaaaaaagcgattcagattaaactttctggaaaatatgttgctttgcaaatttgtgatgacgaagatgttgaaaccatactcgaaagttttcaacaacaagatcaaatgtcagatctggaattatacatagaaaaggatgtggctggtggttctatgtttcattctgcaaattctcttacatcatgtggaaataatttatctaataatgaggcgcaaccgccaagaaatgtgagcaatttacatggtgatgaagatgatgatgatgattatcttgtgtctaactcatacgttgaagagtctttagacaaagatgatagtgttgacggtatatctgatacagatgatgaagtcaccgacatgattcaaccagtaagaattgttcacccagcagaagcacctaataagtcacctatatcagctattgctctgggtacattccattgcgtacctaatggggcgttaggtgttggaattggggcatcatgttgctgtgaaggggatactaatacatctgtgttggatactaagaaaatgttggtggtgtgtaatacattccatggccacgctccgctatttgttgggaatattcttccgcttcaacaaccacccttcgcctgcctatcccttgagtttcaacacttgactggagaatgtgaaactcttgtgctggaaattgatgctctgatgctggaccatgtgacacaggctcagtga

SEQ ID NO: 51043 - DNA, 267 bp, Glycine max
  Peptide Sequence Number=SeqID_167821
atgaccttggacctcctgttcgtcatggacaggcctgtcacatgcaacattctagatcagggtgttgagcctcaatataacctgttgcatgttgatggatgggctgttggacaggagggtgaagccccactgcctaggtcattgttgacacttggcttgcatgtatctgatgccgaagtagaactcactactcttatactcggaccaccgggttcggagaaggaagcaatcgagaaggcaaagctggatttgcatttgaaaatctag

SEQ ID NO: 51044 - DNA, 243 bp, Glycine max
  Peptide Sequence Number=SeqID_167822
atggatacaaaggagttcaattttcctagaatcagtcatacttgtgcacacaacattgattcacttcctctatggaacctgtcaccagcaacatctcctaatccctactatgaaggaaacaaaagaggagaaaatgagtgttttggagcaaaactagtagcacctgaggctcacaggaagagtttttcatatgcatcacaggaaaagtgcgatgaggaatacccttatcatcatattttgtaa

SEQ ID NO: 51045 - DNA, 354 bp, Glycine max
  Peptide Sequence Number=SeqID_167823
atggatgctgctgataaaggtactaaagcatctaaaactagagcttatccctttggtacagcattagttgaatttttagtgagtcgtggtctattgcgcttagtaacatataatgttgatttattaaatttctctgatgatagtggtccaaagactgttgtaaaaaatgttgtcaaaaagggccataattactataggagctctttagtatatgccgaatgcttgtttaaccccgcattacttcctataaagttaaacctacctatggtatttccacctaaagattgggagccccacaaacctgaacagaaaccaaccctacgggccaaatctacagcactcaacggagtatga

SEQ ID NO: 51046 - DNA, 135 bp, Glycine max
  Peptide Sequence Number=SeqID_167824
atgatcaacactcacgctctaaaggtagcgactgtgccacactgccattttcaattctgttccttgtacttcttcgttattgtcaagtgggacgaatctgttgttgatgtagagaaggaaatactaccaggctag

SEQ ID NO: 51047 - DNA, 927 bp, Glycine max
  Peptide Sequence Number=SeqID_167825
atggcaacgtccccgctaccggtaccgcccatggatccgatcgccccgtcgctggcccgcttgcagcaggtgcaggtgcgctaccgcgaccataccgccctgcatggcatcgacctgcaggtccgcgctggccaggtgctggcattgctgggccgcaacggtgccggcaagagtaccgcgatcagcgtgctgttgggccagcgtcgcgccgatgccggcctggtcgagctgctcggtggcgacccgcagcagcgggccagccgattgggcctgggcgtgatgctgcagagcacgaacctgccgccgatgctgcaggtggacgagctggtggcccaggccagtgcctgttaccccgacccgatgccgttgccggaggtactgcagcgcgccggactgcaggcgctggcgcgccgccgctacggccagctgtccggcggccagcagcgcgccgtgcagttcgccatcgcgctgtgcggccgcccgcgggtgctgtttctggacgagcccaccaccgggctggacatccaggcgcggcaggcgatgtggcaggcggtgcggcagttggtggccgaaggctgcggcgtgctgcttacgacacactatctggaagaggccgaggcgctggcgcagcgcgtcgtggtgctggaaggcggccgggtactggccgacgcacccttggccgagctgcgcctggccgaccggccgcgccgcatccgctgccgcagcgtgctgactgttgaagacgtacagcaatggccgggtgtgcagcaggtgcagcgtgacggcgagcatctgcagctgctggccagcccggccgagccggtggtggcgcgcctgctggccgccgatgcgcagctgcgtgagctggaagtacagggcgcggcgctggctgacgccttcctcgacatgacccgggaggccgcatga

SEQ ID NO: 51048 - DNA, 1056 bp, Glycine max
  Peptide Sequence Number=SeqID_167826
gcaaccgaaagggaagtgggagctgggaacaatacagtaaacttcaggagaggaagcctctgtttcactctcaaatggaaacgtgaatttctaagccttttctgtttttcgaaggttatcaaagtagccatatcagagctgttaccggccaatcctgatattttagagggtgttgaagatcttatacaactcagttatttgaatgagccctcagttctgcataatcttcagtctatatattctcatgatatgatttacagtaaatcagggccaactttaattgcactcaatccttttaaagatgttcaaatttatggagatgattatatttcagcttataggcagaaacttatggataggcctcatgtttatgctatggcagatgcagcatataatgagatgatgagagatgaagcgaatcagtccattatcataagtggtgagagtggatctgggaaaacagagacagcaaaaattgttatgcaatacttagctgctcttggtggtggctgttctggaatagaaaatgaagttctcttgacaaactttatactagaagcttttgggaatgcaaaaacatctaagaatgacaactctagcagatttgggaagttgattgaaattcatttcagcacaatggggaaaatttgtggggcaaaaattcaaacttctgtaacaaatgctgctttggtaatgggttgcagttcccatgagctaatggaagcattatctacccataaaatccaagctggcaaggataccattaccaagacattgaccttgtggcaggcaattgatgcaagacatgcattagcaaaatttatctatgcaagcttgtttgattggcttatagaacaagttaataagtcacttgaagtgggtaaacgccgcactgggagatccataagtatccttgatatttatgggtttgagtcattccagaataacaactttgaacaattttgtataaactatgccaatgagaggcttcaacaaaatttcaattggcatctgtttaaacttgagcaggaggtcatcaactatgttaagctttaa

SEQ ID NO: 51049 - DNA, 123 bp, Glycine max
  Peptide Sequence Number=SeqID_167827
atggggaaggcaaagggtccctttggggtagttgtagctcgcccaggcgagatggagctcactcaggcgagttggtttcttcaccatgaagctatatggtggcctaggcgagcccgaggctag

SEQ ID NO: 51050 - DNA, 150 bp, Glycine max
  Peptide Sequence Number=SeqID_167828
atggttgttcaaagaatcgtcttagaagggtactcttctaagatggttttagctaacaaccgtcttagaagacggttcttagctaagaatcgtcttagaaaggatccgcgaaaggaaagagtttgcgacagtgttactgtgtggcactag

SEQ ID NO: 51051 - DNA, 172 bp, Glycine max
  Peptide Sequence Number=SeqID_167829
tgatcaaggggttcccacggaacctaagagaataaagatctttccagattggcctactccaccatgtgtagagggaaggagcccaaagtatgaagaacctcgggatttgaggtcaaatcatttccaagatggaggggatgatgcaatcctagccctcaagggtattggatag

SEQ ID NO: 51052 - DNA, 531 bp, Glycine max
  Peptide Sequence Number=SeqID_167830
atggatatgaatcttggttccttcatttctagtcagattacactcagagcccagcatgactcgtcgaggcttggctttcctaccttaatcactgctttatgcaaagcccggggagtccgctctgacttcctgaccttggagagcttgagtcctgccattaatttagcatacattaagaagaactgttggaatcttgatgatccaatagtaactttcagaggacctaggaaggccaggggtaagagatctgaggccccttccacagcaccatcagaggcactagcaccttcttcttctacacttcctccctcttcctccatagagatcccagtgattcctccagcacctacacagattccacttcctactcctatctctacaggtccagcaaattctcttttcactcctcagatgcttcactccatgctccagagcatccatagggggcagtccatcgtcatgcagagccttcagggcttgggcttgccctccattatgagcatggaggagtttgattctcaggtggcctag

SEQ ID NO: 51053 - DNA, 663 bp, Glycine max
  Peptide Sequence Number=SeqID_167831
atgcagaaccccaaccccaaagatgatgatgatttgctcactttctctctctcatgcaatcgtccaaagagagagacacactctttcccaacaaaccctcctcccctaaccatgcaaactccattcattaaccccatgttgtaccctcttcgtcacgttctcgccgccgcgccgcgcgaaaccatccctccgccctttccttgggccacgaaccaccgcgccacggtgcacacccgaaagtaccttttggagaacaagatcgtgaaaatcaaggggagcgtggagtgcaagaggtgcaagaacaagttcgagatggttcttgatctggagggcaagttttccgaattgtggagcttcattcagaagaagaaagatagcatgcatgatagggaacccaaggtttggatgcaaccggtgctgccaaaatgccaacactgcggacaagaaaacagcgtccaaccctcccttgcaggaaccaagaaaaaggccattaattggttgttcttgttgctaggtcaaatgctcggttgctgcacgcttaaacagctcaaatatttcctcaagcatactaacattcatcgagctggcgccaaggatcgaaatctttattctacctacatgggcctctgcaagcagctagttcctgagtggttcggttcttga

SEQ ID NO: 51054 - DNA, 171 bp, Glycine max
  Peptide Sequence Number=SeqID_167832
atggaaaatataaattcaaaattgagaggcatgcgagaccacaaggacatttcactagcacacccgcaagtggctgctgctgcacatgaatccttggcggtggcctgcaaaaagttaggcaggacttacaagacagattatgatgcagatatatacatacttgaatactaa

SEQ ID NO: 51055 - DNA, 618 bp, Glycine max
  Peptide Sequence Number=SeqID_167833
atggtgagggttagtgtgttgaatgatgctcttaagagcatgtacaatgctgagaaacgggggaagcgccaggtcatgattaggccatcctcaaaagtgattataaaattccttttggtgatgcaaaagcatgggtacattggagagtttgagtacgttgatgatcacagagctggaaaaattgttgttgaattgaatggtagactgaacaaatgtggggttattagtccgcgttttgatgttggtgtcaaagagattgaaggttggactgctaggctgctcccctcaagacagtttgggtatattgtgttgactacctcagctggcatcatggatcatgaagaagctaggagaaagaatgttggtgggaaagtgctggatccaacgcaaatctcggatcttgacgttctcctgatggtggaactcaacagcggcgttgacgaagatctcgtaaaagatcctgaagatttaagaaaaatatatgatcattcttgttttaccaaagcccaaccgtggcttctctgtggatccatcaccattgcttcaacctcgagaaactcgtcggcgatcaatttgtacgatgggaaaggtctattccgatggccaaagatgggatag

SEQ ID NO: 51056 - DNA, 585 bp, Glycine max
  Peptide Sequence Number=SeqID_167834
atggggcgtggaactgttgtgactggtcgtgttgaacaaggcaccatcaaagtaggtgaggaggttgaagtattgggactaacacaggtagacatggaagtcaaatatgtattatcatgtcatgttaatgagtgttttgctttatgtggacctttgaagactactgtaactggtgtggaaatgttcaagaaaattttggatcgaggggaagctggtgataatgtgggacttcttctacgtggtctgaagcgcgatgatgtacagcgaggaatggtcgtgaccaagcctggtgcatttaaaacatataagaagttcgaagcagagatttatgtcctctcaaaagatgaaggtggccgtcatactgctttttcctctaactataagccacagttttacttgaggactgcagatgttaccggaaaggtggaattaccagaaagtgttaagatggttatgcctggtgataatgtgactgcaacttttgagctgatatcacctgttcctcttgaaataggacaaagatttgctttgagagagggaggcagaacagtaggtgcaggagttgtctccaaagtgatggcttag

SEQ ID NO: 51057 - DNA, 858 bp, Glycine max
  Peptide Sequence Number=SeqID_167835
atggcttccactgctttcagaaacctaaattctaagcgcctcagctccttttctctttgcatttcacaagtgcttaccagtcactctctcgtggaatttgcaccaccatatcccaaaacttgcatctacagagatcattggccactttcgctcgaacgtaaagaccctccttttctagggacaacattgctctttctttctccttttccctctcttttttatgtgctagctgaagaaagtaaagccaaggcggcctttgaggacatagacaaggctcctgaggagaagaagagaggaattactgttgcgactgctcatgtagaatatgagacagcaaagaggcactatgcccatgttgattgcccagggcatgcagactatgttaagaacatgataactggagctgaacaaatggatggtggaattcttgtggtttctgctccagatgggccaatgcctcaaacaaaggaacacatactgcttgctcgccaggctaatagctctttttgtcaatgtgttggtgtgccatcattgttctgctttctaaataaggttgatgctgttgatgatccagagctgcttgaacttgtagaaatggagcttcgcgaactgcttaatttctacaaatttcctggggatgagattccaattgtacgaggttctgccctgtctgcatcgcagggaactaatgaagaacttggaaagaaggctatcttaaaactaatggatgctttggatgaatacatttcggatcctgtgcggcaacttgataagcctttcttaatgccagtagatgatgttttctcaattctggtaagcacaaagatcataactgatgtatatcaaaacaattcttag

SEQ ID NO: 51058 - DNA, 2550 bp, Glycine max
  Peptide Sequence Number=SeqID_167836
atggatcataggctttctgtgaaaaaagaaggagagggaatcgttcacatacaagttgctgaactccacaggctaagcgagacaagcaaaaccagcaccatgtttgagcctcgtggactcagcagtattgagaagagagacagtgatgcagataactctttctctgcagcaacagctagagcaccagaaaagaagctgaccctctttgcgcttcgtcttgcggtgcttgaaaaagcagccactagccttggaactcttggtttcatatgggcaaccgttgtccttcttggcggtttcgccatcactttggacataaccgatttctggttcatcaccatcatactgttgattgaagggacaaggattttcagcagaagccatgagcttgagtggcagcaccaagccacatggtctataactgatgctggaatcaacagtttcaggatgctaaggtcctccccaaacttgcttcttcaaagtatcgagagccttttcaggccaattgtaaccaagaagcaaaggagagacatgatggagtctaatgttacccccaggtatagggataataccaccattagcatatggacaccaactcgcatgtggattagttcagatgttccacttcttccatatgctagatggtttttcctttcaaggcatatcagcaagcttctgtattggcttcagcttttttcggcgacggcttgtgttgttctttcgtcgatgaaactcgtcaagcataattatggggaggttgacaagggagacactgacaagaggaaccgggagtctgctttgaatatattttatgccttggctttggctgaggctttgcttttcttgatggaaaaggcttactgggaatggaagatcagctactgcaaactgttggatgaggttagcaaggagtgtgggttgggaccatcagggatggtgtcaattagaaggttcttttatgatgcctattctaggtgtgtcaatgggagcatatttgatgggttgaaaatggacattgtctgttttgctatggatctcttggcctcaaactctcctgatgagcagctcattggaggaagaattcttcgccaattcgctgtgagtgaacggttttctgatgatacccttcagaagcttggaatttccatatctgtggtggagaggctagttgagatgttgaattggacagaccacaaggaggaagagattaggctctcagctgcagagattttatctgcactagctggcaagaagcagaactctctgcgtatagctgggataccgggcgctatggagtcgatatcatctcttctccaaactaacaggaattgcatacatgcagctgatgaaattggagaaaagaaactcatatttgatcatcccaattatggctactggacatttaaccatttgggactcctcattctgaagaaacttgcccgtgatcatgacaactgtggaaagattggaaacacaagaggcctgctcccaaagatcatagactttgcacatgctgaagagaggttgctgaagaatgagaatgctacaccatctcaaattctgacagtgaagagatctctgcagctggtgaagatgctggctagcacaacaggcacctacgggaaacatcttcgaagggagatttcggagatagttttcacaatcagcaacatcagagatattctaaggcatggagagaaacaccccttgttacagaaactgagtatagaaattttaaccagtcttgcattggaagaggaggcaacagaaaggattggaggcacaggtggagtacttaaagaattgttcaacatatttttcaaagattacattgctgaaaatcggaaagatgtaaccactgttgctggggaggccctagcaatgctggtattggaaagcaagagcaactgtcataggattttgaagttgaaagtattggaaaggctgatagaggcattgaaagttccgccacttcatatcaatgctgctagaattctaagaaatttatgcacctacagtggatcagaatgcttcaaacagttatggggggttacagctgcagcacccacagtacttcaggcaatcatgtcacaagaaaacaagctacaggaagtgatgattggactagcggcaagtgttttctcattcatgacttcctctgaatcaagcactgtatttgaagaatctgggatcaccgaggctgaactggcaaataaactaatccatattctcaagaaacaccgatatcctccaactaaggtccccaggataaggagatttgtgatagagctggcaatttggatgatgaaagaaagagaagaaaacattcatactttcaaggatttgggaatggaggaggtgctggagggtgtcttagagaccacttcagagcttgaaagctttaatgttttctctggtactgtgggactgaaccggcacaatctaacaattcactcactggttgaaacagcattgaagtttctggaagatagtaattatagtaaattctttaggaaggttgccatgtttgctggggctggaaagatagcttga

SEQ ID NO: 51059 - DNA, 1494 bp, Glycine max
  Peptide Sequence Number=SeqID_167837
atgagaactggagaagtaactaacaagacgttttatcaaattggatgcagggttgatgccagtgaagctgctctaattttacttccttcaaatattacagtttttactctggatttctcgggatcgggaatctctggaggagagcatgtcactctaggttggaatgaaaaggatgatctgagagcagtggtcaactatctaagggcagatggaaatgtttctctgattggcttatggggacgctcaatgggtgctgtgactagtctcccgctaggagtagtggatccttcaattgcaggaatggttttggacagtcccttctctgatttggttgatttaatgatggaacttgtagataagtacagagtccgtctgccaaaatttgcagtaaagtttgcaattcaatacatgcgaaaaacaatccagaagaaggcaaaatttgacataatgaacttgaacactgttaaggtagcaaaatcttgttttgttcctgctctactagggcatgccattgatgatgattttattcgtcctcatcactcagattttatacttgaggcttacatgggagacaaaaacataattaaatttgagggagatcacaactcttcacgtcctcagtattattttgattccgtaaacatctttttgcacaatgttttacaacctccagaagatgagcttggggaatcattttttgacattatgaatgattactttgaaccatcaacaagcagtactgtggaggacattaagcaagtctgcttaaaaagaccaatgagtatgagggaggcacagaaatgtgatggtctttcctcatcatcttctactattattagttttgaattatcaaatggtcgtctctatagtcccctcattccaaccgatctagatgatgaccactatgtggaatttcaacttgatgactttacaggctgtccatctagtgcaaagaaagaacaaaaaatgttcatggaagcagtggtggattcattgaaagaccgagaaatacgaattccagaggtagaacaaccacctgttagcagtgctagtaccatgtctatagagccatcggatgaggatgattcacatgcttcttcacacaagatttccaaacctatggagacagaaccttctttactcaaccagagtgttaaaacgatttccactgcatctgatgcattggagcccttgaaaactgaaccaaattccatttcagtgattccaagtccagtaccaagtctttcatcaagcaaaataccactaccacaaccaccaccactggacacttcatccgtcgcggattctagcaataccgaaagtactactgcttgtaatgataattctgctagcttacaaagttcatcagacactgacatatcacataatacaaaagccacattaactgttattaagaatccagcaggccatgtcttgaactgcttactgggacgttgggatttcaactttttcagaaacagtcacaatcgataa

SEQ ID NO: 51060 - DNA, 324 bp, Glycine max
  Peptide Sequence Number=SeqID_167838
atgctaaaatcaataagaagcataagcaaacacccagatgagaatgtgaagaaaaaaagaactttgactgaaaaagttgatcccagcacagagagagagcgaggaaaaaggagagaagatggtgtgcctggcaaactaacatataaaacatttgaattttgcaatgaaaagaaagaaaaaggtgttgaaggaaggagagagaggaacttggttagacaagacaactgtgagacaaagaagaattctcgtcgtcacgttgctgatgttgctggccgaatgaactcaaaaattagtgtcatccgccacagcacagtgcaacaataa

SEQ ID NO: 51061 - DNA, 549 bp, Glycine max
  Peptide Sequence Number=SeqID_167839
atggcttttagctctggttgttctaccggcaaggtcacacataattatgagatttgcattagtagtgtacctgactttgctttcaatttgggctctaccaagaaatgcctggacggactgggttcagatggtgcgcctgcacttgttcaattgagaacaccaccacctgcaatgatggggcttcctaatcttccagtatctttaacaggttatgcatatacaatcatgaagttaggtccattaacctttaccaggaaaggcctatctgtagcaagcactattgcatgtttgacttttacagtgtttcaaagtgcaagtctctgtctcacaactacaagccctgaacaactagcatttgcattgcgatggtttatgctcccactgaaatacataggtgtttctgtgtcagaaattgtgcttacacttttactgtcattgaggtttatcagtcttgtttttgatgaggttcggaacattgctttggggattgtatctcgtaggctaaattggaagcagctgactgttatggagacaattgatagtaagtaa

SEQ ID NO: 51062 - DNA, 474 bp, Glycine max
  Peptide Sequence Number=SeqID_167840
atggaggagactttgactcattttatgcagaatcccaaggaggaatggaaagctgtgatgacaaggagtaagaggtttgtggaggcggaggatgaggatagtgtcgtgtccaagaagaaagctgctgaaaagaaaggtattgatgaaaggaaaaatgagaatgaagagaggagtagaagtggacaagctagagagaagaaaagagaaaaagctgtgattgaaggtccagaagtaccatatcctgtggtaccttccaagaagaagaaggaccaccatttggcgagattcttagatattttcaggaaactggaaataaccatgccctttggacagatgccactctactccaagttcttaaaggatatgttgaaaaggaaacataagtatattcaccaagaaaacattgttgtggaaggaaattgtagtgttgtgattcaaaagatccttccacctaagcataaagaccctgggagt

SEQ ID NO: 51063 - DNA, 252 bp, Glycine max
  Peptide Sequence Number=SeqID_167841
atggggtgtgtgttaggacaacatgacgagttcgagaaaagggaacgggttgtctattacttgagcaagaagttcacggcatgtgagatgaactactatttgctagaaagaacgtgttgtgccttggtgtgggcggctcaccatttgagacagaacatgttgaattacaccacttggttggtgtccaaaatggatccagtcaagtacatttttgaaaatcccgctctcactggacggatcgctcggtggtag

SEQ ID NO: 51064 - DNA, 216 bp, Glycine max
  Peptide Sequence Number=SeqID_167842
atgagatttcttacatctcatgtccaatcttttgaatttggaatgaccgaacctttcaatgagtcaatctcttgctttctcaacggggtggacccttgggtactagtaccctcaccttcagatgactacatgtcctcaccgttagaggactacacgtcctcgccatcagaggactacacgtcctcgccttcagagggctgcacaccctccccttga

SEQ ID NO: 51065 - DNA, 180 bp, Glycine max
  Peptide Sequence Number=SeqID_167843
atgatacaatcacagtctaagtcaagctttcctgagccaagtgcatttcgtcgcgacatctattgggctaagcgagccccgctcgctaagctcccatacttagtgtatttcgtgaactgtatggtgccgctaagctcaacctatgaggagctgagcgcatatccttgcgacatatgttag

SEQ ID NO: 51066 - DNA, 444 bp, Glycine max
  Peptide Sequence Number=SeqID_167844
atgtcctgcctagtgatcataactccgaccttcctctgccgaagtgtcagctggtgtatgccacccaccaggcaccctctagacccggataagtctaacagggccctgggatttccagcattgatcacgggcctctgccaatcattcggggttcccgtcacacctagtaaggtgatccgactgccgatcacccgagccttcattgagaagtattgcacgcctaggcaggtgcagggtgatgcaccgcaggctgcagacgcaccgccacctcatcaggctgatcccactgggtcattaggcatggagcggtatctacagcacttggttcgccaacaggcggccaaccaccgggggcagggccagggtttcgctcctattgcgtgccctactccagatcagtttagggttgaggtcgtatggcccggagattggcccgaggcctag

SEQ ID NO: 51067 - DNA, 729 bp, Glycine max
  Peptide Sequence Number=SeqID_167845
agggctacacgtcctcgccatcagagggctgcacgccctaaccttcagagggttgcacaccctcgccttcatagggctacatgccctcaccttcatagggctacatgccctcaccttcagaggactgcatgccctcaccttcagaggactgcacgtcctcaccttcggaggactacacgtcctcgccttgagagggctacacgtcctcgccatcagagggctgcacgccctaaccttcagagggttgcacaccctcgccttcatagggctacatgccctcaccttcatagggctacatgccctcaccttcagaggaatgcatgccctcaccttcagaggactgcacgtcctcaccttcggaggactacacgtcctcgccttaagagggctacacgtccttgccatcagagggctgcacgccctaaccttcagagggttgcacatcctcgccatcagagggttacatccccaaacttcagaggactacacgtcctcgccttcatagggctgcatgccctcaccttcagaggacttcacgtcctcgccttcatagggctacatgccctaaccttcagaggacttcacgtcctcgccttcatagggctacatgccctcaccttcaagaacgtgacacgtcctcaccttcaaaggactgcacgtcctcaccttcggaggactacgcgtcctcaccttgagagggctacatatcctcaccttaagataatttaa

SEQ ID NO: 51068 - DNA, 267 bp, Glycine max
  Peptide Sequence Number=SeqID_167846
atgtcgggacggcacagaccaattgatacttccgcaggaggagatcggcattacgtggtcatgttggtgcgcatgatccacactcatctctttgcagcggcacgggtgaaatcttgccccggtatgcatagtagctgcgtgatggcctccctctctggttgtgctcgcatagttggccctcctccaatatcagggggtggcccaggaaaaagaactgataaagggaaactgctggcccctgaaggcgggagtgcaactctcggttaa

SEQ ID NO: 51069 - DNA, 273 bp, Glycine max
  misc_feature (244)..(244): n is a, c, g, or t
  Peptide Sequence Number=SeqID_167847
atgcgcataacaaagatacctaaggaagtgatccacaactctggtcatgccaagtatccactgcctccaactgcattcaatctcgagacggagcatcgactcctcgcccgccatctgatcttaaataaaaacataagggtggtcttacccactttggttttggatgattgttgggagtacacatttttaccacggtacaatggaaggctctcaccaactgaaaattgctcgtacttagtcaggntggacatggtggccaagttggcccaatga

SEQ ID NO: 51070 - DNA, 384 bp, Glycine max
  Peptide Sequence Number=SeqID_167848
atgggttctccacctgcctccactactcctcctcctcctcctcctcctccttcacctccttctcctcctcctcctcctcttacttcggacacatcggcttcgacgtctgtcgtgaagcggacacggaaggccgacggtccccacaagaagaaattaagaacatatttggggattgtggcacgtgataaggtggacatcacctacaagaactggaaggaggtccctactgctcagaaggacctgatttgggaggatattcaggatgtgcgcatgaaggcacaggccatccagaagcagaatactgccccccacattttatctcgtggaggttatgattatttggagcataagctcctggctgagaagaccaagaaaaagatgtag

SEQ ID NO: 51071 - DNA, 261 bp, Glycine max
  misc_feature (17)..(17): n is a, c, g, or t
  Peptide Sequence Number=SeqID_167849
atggctgttaaacattntgaggtggtcaagcgaaagtcgcatgccaacaaaaaatggtcctcggacaaaattaggtgttgtaattacttttcgttaaatataggcaagtttggtggaagtgctgattttgagccggtcgctaagccaattctctggcttagcgacgtagtagttcatggcttagcgtatagaagatcctggaagtggatgagttgtcatgatgcgctcagcgagaatcaattagctaagtgcaccgcttga

SEQ ID NO: 51072 - DNA, 1083 bp, Glycine max
  Peptide Sequence Number=SeqID_167850
gggcttgagctgaaggccttcgccgaggcacagccgggctggcagttgctcgggcgtggatccggccgcaccgatgctggccctggccgaacagacactgggtccgctgaagtcgcgcgtgcagctgctggaaggctacatcgacgatgcacccgatctgcgcttcgacggtgccacctgcctgttgaccctgcacttcctcgacgccgcgcagcgcctgcacacgttgcgcgagctgcaccggcgcctgcagcccggcgcgccgctggtggtggcgcaccacagcgtgccgcaggatccggccggcaagctgcgctggttgcagcgttacgcggcgttcgccgaagcctcgggggttgcccgcgccgatgcgcagcgcgcgatcgaggccattgccgagcggctgccgctgctggcgcccgagcaggaggtcgccctgctgcaggaggccggcttcgacgacgtggagctgttctatgccggcttcagcttcaagggctgggtggcgtacgccagcgccacctgctgcacgtccagcgtggcgccgcgcaagttggtcctgcgcaggtccagctcgcccagctcggagttggtcagatcgcagtcggtgaagttggcgctgttccagtcgatgccctcgaactggccgccggacaggtccgagccggcgaagctggcgccactcacgttcgcaccgtcccaacggttttcccaaagctcgcacttctccagcgtcacccgcgagaagttcgcgtagcgcaggttcgacttcttgatgaaggcactgcagaaccagctccgcgtggtgatctggttcatgaagctggcgttgctgaaatccgcgccctgcgcgcggcactcgctgatctccaggcccagtgccttgatgaagttgaagtggcacatgctgatgtcgcagctgcggaagctggcttccttcagcgtggcgccgttgaagcgacagccggcacggctgtcggcatcgtagaaactgcagttgatgaactcggtgccggtcatgtccgcgccggagaaatcgcacttgtggaactgctggtcgaccaccttctggccggtgtactg

SEQ ID NO: 51073 - DNA, 147 bp, Glycine max
  Peptide Sequence Number=SeqID_167851
atgacagctcgcccaggcgagctgatgcttcatcctgaagtatctttggcattcttgatcaaaacattgaatgatcatctgtttcgcattgtaactgacgttcaacaccatcagtcaattagcaaggatcaaaagatcagcaaatga

SEQ ID NO: 51074 - DNA, 510 bp, Glycine max
  Peptide Sequence Number=SeqID_167852
ccttatggtgaagttagtaggtcattcgttgtaagatggaaggatgaactagagcctacttggcatttgctacactctagtggcaacatgcactttgtcacatatagccaagatctggtgagctcaactctacttgttggatggacagaactcagagagttctatgggctcactggaaatcatcagcttaccctaaataacactccttgtaccaccaagttcctaactcagccacttaaagtcctactgactgagtacaaagtgacttgcaacagtttggatgtgctgagtaccatgtactcattgatgaaagctacaagattcacccatctgaagttggaagggactacagagtgtaggatagtttataatcatcataggaagattgcaaaaaatggaaatagatggaggaatttttcacaaccacaaaatttgcttcctggaactcaaattatatttgttttcgcagatgcaacttctaactttgttttattttggctttgtttgtaa

SEQ ID NO: 51075 - DNA, 312 bp, Glycine max
  Peptide Sequence Number=SeqID_167853
atgggggtgagattagctattatagggggtgtggagctaagctctagcttctcatctcaaggagcaccttctccaagcttcttatccaaggcactctgttggtggcaaaactccttctttcatggcttattccctagtggatggcgcctcctctcacctcttctcctttgtcttccgctgcatctccatggtggaaaatcaccattgaaggacctcattgaaactcaaagatccagcctccatagaagctcgacaagcaagcttccatcaagtggtattatagcacaagagcttcaagtaggtgctccttaa

SEQ ID NO: 51076 - DNA, 393 bp, Glycine max
  Peptide Sequence Number=SeqID_167854
atggggaccaccacggttgaagatcgaagaaaacgaagaatgaatgctaaatatcgaagaacagttgaaaatcttcgcataattacccacgaaaacattacggaagcacctcggcttggtttttcttcacggaaacaattttccttagcaattttaagagaatacgaagtgccaagaaggctagcccctttcctcttcactcctcctatttatagcaaaataggggaggagcttgccacccagctcgcccaggcgagcaaggttgcttcctccagaagcaaccgccttctgaggaagaaactggaaggcccaagtgggcctgatggctattcacaccccccctttttactaaatgcaccccctgtactttttttggtgattctttttccataa

SEQ ID NO: 51077 - DNA, 156 bp, Glycine max
  Peptide Sequence Number=SeqID_167855
atggtcatcccacgcacctttgaagaaggagactttgtcttgcgcaaagctggcacctcgggaaatgggttcctaaactggggtaaaatcttacaaagtcctacttgttcagctacatgtaagcacatcgggaaacgggttcccaaaccggggtaa

SEQ ID NO: 51078 - DNA, 369 bp, Glycine max
  Peptide Sequence Number=SeqID_167856
atgagtgacaactacaattcaggagacaccaattcttcaaggtccttcaagaccaacattgacattggaagctccaatgaacctttattcaacattagtttccagggttttgataaacccatcaaccattacatcattaggagttcccaaattgtcaatctcctaagaaataaaatcttgatttatagtaccaggggccctaggatgagtcagacgaagctcaccattatcccacatgtagaattctctatcaacaatttcacaaaggggactgcaaaaagacttcttgatactgaccattggatggagctacttaacttgcctcaaagtgttgttaaaagagtctctcgcgacaagcgaatcacatag

SEQ ID NO: 51079 - DNA, 366 bp, Glycine max
  Peptide Sequence Number=SeqID_167857
atggtgattttggttactttcattaccaaccatcatgcctgcacgctcacaagtaggaagaaggaaaccaagcgtgagagacgcatgaaagacagaaagaaaacattaaaacaaagggagttgctatgtgcacctagcacccagcaattatgtgataggacaaaactgtccttgcttaaaaaccacaattttgaactacgaaagaactttcttacgtgtcatcttgcggaagaacttctttcgcagaaaaccacgaaagaagattctttcgcagttgaaaataacaatagcggaagaaccttcttccgtggattcctgcggaagaacttctttcgccagataacacggaagaaggttcttccgtga

SEQ ID NO: 51080 - DNA, 273 bp, Glycine max
  Peptide Sequence Number=SeqID_167858
atggcttacacccacattccgggacacctaacaacagctttcaaaattgccccatgtgtggcatctcttgccaatgtcgggatttacacgcaattctcctcaaatttcagccagcccgcatcaattagaccttgcaccttacgcctgagggtcatacagtgctcaatggaatgccccagggctcccccacgatatgcacatgttgcgttcgagtcatatcctcagaaaagtgggggtttgagggaacctagcaggggttatggctaccattga

SEQ ID NO: 51081 - DNA, 243 bp, Glycine max
  Peptide Sequence Number=SeqID_167859
atgaccaaacttggtctctgcttgtcatcgggcccgccgcctctggatgacaaaagggtgtggataaccgtaaggtatctccgcgtatcatcgggcccgccgcctctggatgatacaaaggtgtctccgcgggctaccagctcttgggtcatggcaacaaaaggcggtgtggtcgacaaaagcgaggctcttgctcctacgtatcctccaatgaggaactcagacctacgtagttctggataa

SEQ ID NO: 51082 - DNA, 259 bp, Glycine max
  Peptide Sequence Number=SeqID_167860
atgcatgccaaagctagagtgatgagtgaaatagaggaggtgcaagagcagatgaaggccgacatggaggccatgaaagagaaaatgaccacaatgatggaagccatgatgagtatgagaaaaatgatggaggccagtacgactacagtcactgctgcaagtaccactactgaggttgacccggctcacccatctagcctcaatcaagtaaatagtccagtctcagatatggtaggccagggaggcataacattgggat

SEQ ID NO: 51083 - DNA, 447 bp, Glycine max
  Peptide Sequence Number=SeqID_167861
atgtacgacagtctgtacaaaacgccgcccaaggatgtcgcgttcctggaaactaaatcaacccatatagaactccccgctcccaagggaggtggcccgctctatgtgaccgtaatgccgttcgataagcatggcgaatcggtggggagacggtggcagaaacgggtaacgctacttccctatgcaaaagctggaaaagatctcgcccaacaaatcatcgctggtgaacttcccggtgatgctcgacaggctgtcatgcgccagccgcagttcctcggcgaacaggtccagcacgcggacgtcctgttccacgtgatccacgttcagcgccaggtgatcggtggcatcctgcagcgcgtgcaggtgccgttcgcgcgccatccagggcgactcggcgccgggattccagccggtgatgcgtatcatctcggcgcgcagagcgaacag

SEQ ID NO: 51084 - DNA, 246 bp, Glycine max
  Peptide Sequence Number=SeqID_167862
atgcatgaagaatcaagactaaaagttgttcacagggatttaaagacctctaatgtgttgcttgatgaagacctaaacccaaagatatctgattttggtttggccaggcttcgtgagggagacaatactcacataagcaccagaattgcagggacttggggatatatggctcctgagtatgcaatgcatggttatctgaccgaaaaggcagatgtttatagttttggggttattaccatagaaatt

SEQ ID NO: 51085 - DNA, 849 bp, Glycine max
  Peptide Sequence Number=SeqID_167863
atggatgcatttgaagtcgttgcctgtggtcgccagcagcttgatttaacagaacctgaacagatcaggcatgtggcgcgtactgttcaacctgatttgattattaatccggccgcttataccgccgtagataaagccgaggctgaacgtgaactggcttatgcggtcaatgcgacggcagttcaggtgttagccgaagaggcggccagactcaatacaggcttgattcatttttcgaccgattatgtttacgatggtacaaaatcttcatggtatgttgaaacggatgcggttaatcccgtcagtgtttatggtgccagcaaattggcgggcgaggaggccattcgtaaggcaggtgtgccccatttgattttgcgtaccagctgggtatatggcagctatggtaaaaatttcatgaagacgattatccgcctggcccaggagcgtgagttactacgtattgtggctgatcaacacggggcacctacatcggatatttccatagcacaagccgtcttgcaattgctcagtcactggcagcctgatgactcggcacaaagtggagtttatcatctggtcaatgccggggaggcgacatggtacgggtttgctaaagcgattgaagcccaatatagggccctggcaggccaggccggttggcctgcgctggcattaaaagagatgcagccgattaccacggacgaatacccaacaccagccaaacgtcccgccaactcaagactttcaacagaaaaactggctcagcagtttggggtaactttgccggagtggccgcaggctttgaatcaagtgatggccgagctggatttcaggtcggctaacacttag

SEQ ID NO: 51086 - DNA, 279 bp, Glycine max
  Peptide Sequence Number=SeqID_167864
atggactccttgaagcaaagttggcacattgatagcggtttctccaaacatatggcgggagatgcatcaaagtttattcatatttttcccaaagatagtgaatatgtgatctatggagacaacaaacaaagctttaaggttttgatgatgctagagagaatttacttgataatgattgtcatcatcaaaaagtttttcaaaatggttttgatgatgctgaaaagaattcacttggtaatgattgtcatcatcaaaaagggggagaatgtgaatgtataa

SEQ ID NO: 51087 - DNA, 504 bp, Glycine max
  Peptide Sequence Number=SeqID_167865
atgggatctgcttctcgtcattcctcgtcgccattttcagctttagcagaggatctgaagaagactagccaccttcttcaaatcattggtttgtttgtcaattcgatatcgacattgtcgtcgatgcatgttcatcgcggcggaggaattttagggttcctctctgttagcctgaaagtagttgctggaggctttgaggtaggcacgacggtcgtcgttgatgattgcagaaaaaggatcagaaagggacgttatttggggactccaatttgtgcccttttgagagatccgcaagcttggaggctaaatcggaaaatgaaggaaagatttaggttggacaaagaagatgagggttgggcagagatgatcatggccatgcacaaaagggtggggcagagacaacggctggcaaaggtgaatcggccgcagagaggaaggtgggggcagagaggagtgtcaggtttgagggagaggcaaaagaaatcacacttgaggcatggttga

SEQ ID NO: 51088 - DNA, 750 bp, Glycine max
  Peptide Sequence Number=SeqID_167866
atggatgttgcgcatttcattttcgggatatttgggaatgtttctggtttgttcctcttcttggccccaatagtgacattctggaggatcattaagaacaaatccacagagaaattttcgggggttccttaccctatgacccttctcaactgtctcctttctgcttggtatggtttgccatttgtgtccccaaacaacatacttgtgacaataatcaatggcacaggagcagggattgaaatcatatacgtcttcatcttcatctacttcgcaccaaagaaagagaaggccaagattcttggccttttctccttcgtggtggcagtgttctctgttgttgttctggtgtcactgtttgctttgcatggcaatgcccgaaaactcttctgtggcttcgctgctgccatattttccatcatcatgtatggttcaccactctcaattatgaggctagtgatcaaaaccaagagcgtggagttcatgcccttcttcctctcactctttgtgttcctctgtggtacttcttggttcatctacgggctactaggccgtgacccatttgtggctgtacctaatggggttggttctgcgttgggaacagcacaactaatattgtattttatctaccgtgacaaaaaaggggatcaaaagaagaagccgagaacagaagaagaagaagctatggaaatgggcaccgctaataaaaatcccatatccaactcgaagggagcacaagagggacacgtctag

SEQ ID NO: 51089 - DNA, 724 bp, Glycine max
  Peptide Sequence Number=SeqID_167867
atgatgctttacgcaattggtggtgacaaaaagttcaacagccgagatgataagggtgttacaacgttcccacgacgaataaatgggatcagtggtaactgggacaactggggtgatggaaacagaggctgggttgtcactaggatgaatataataaggactagatgggtcaagacaaggattagaggtgccattaagactccgacgaacaacctggccttccgtgatcatcaccctccgcggttctcccttggaccctcttcagggccccaacaatgccaccgccaagcgacgcacctcctagcgacgcacctcctttgtgaagtgcgtgttcttcgtgtccgccacggtggcgccaaaggtgtccatcccgcagcagtagaaggacccaaagaagcgcgtgattatcacgggatgaggctcgcgtcagtgtttgggaatgacatggagggatactatgagaagcttctcgccggcgagagcggcatcaccgctcatgcacacaggcaccgtgagagcgtggtcctctgcaacaaccttaattcacatgctcttcagcttcacctcaacacttcattttctgctttctatcatgactatgatggctactatgaattcgatgaggaagcttataggagatggagctttggtggagcgataagtccttgtttggctgatttaaagcatttgaattacttggacttgagcggcaatgattttgaag

SEQ ID NO: 51090 - DNA, 897 bp, Glycine max
  Peptide Sequence Number=SeqID_167868
atgaagtccttgaagatgattcatttggctaaattgaagcatggattataccacttgcagatcaacaaggatgtgaaccaagccattcctaaaatctgggacattgtccagacgccgccacatgtgagaccaattggttgtaagtgggtgtataagattaagcatggtccggatgggtcagttgagcgctacaagcaacttgatgttagtaatgctttcctatatggggatctcaacgaggatgtgtatatgaccattcctcagggtgtctctggctatcaaccatttcaatgttgcaaactgaaatggtcactctatggcttaaaacaagccaactgccaatggtttgccaagctatccaatatgttgaagcattatggattcacgcatactatcactgtcttgatcatttatgttgacgatatcattctgactggcctcttaaactccaagccatgttccacaacaatggacacctctcttcgcctgcaccatgattttagtgaagctcttactgatcccttatcatacaagcgcttagttggacgtttgatatacctaaccaatacccatctggacatcgctactcctgggaagggttattcttccgcaaaaatacttctttccaactatctggttttagtgatacagactgggccacctgtgttgacaatcgtcgatctgtcactagatattgtttcttcattgaggcttaatatagagcccttgcctcagccacttgtgaactgcaatggttattttacttacatagagactcacgggttctttattcaaaacgtgttgcattatactgtgatagccaaagcgtactctacattgcagcaaatccagtgtttcatgaacggactaaacacttggaaattaactgccatctag

SEQ ID NO: 51091 - DNA, 600 bp, Glycine max
  Peptide Sequence Number=SeqID_167869
atggaaaccgcaacacaacctttcgaatccatctgtgggaagtttgccatgaatccaaggccagaaaaggaaggatttaggagtcacaaacaaaagccaaatgaatttggcccacgcactagggccggcccaagggcctaccaatgtgttgggccagccttgccaagaacaaataggtttaggaggatgaggaaattgaaaagcatctttaaaagacaacaatccattcaaagaatgtttccaaatcaaggtatccgagagaggatcaataggcaacactgcaaccttgatttgagagaccaaagcaagattaacatgaagatgcacgtctggaatcttttaatgggagtattgaataaagtccttcaccggggcaatgagatcagtgtgaatagcaggagcgatgaaagattaattttgaccaaatatgaatggcagcggaatggagaaagggaaagagagaggagacgccacttcaaggagaagatgagtctagaagaagctcaccaccataggaggccatggataagagcttggaggaagaaggagatgaatgaagggagagggagagaagagcacgaaattttgtgctctaaatga

SEQ ID NO: 51092 - DNA, 315 bp, Glycine max
  Peptide Sequence Number=SeqID_167870
atggcgacaccggtgccagctgtcgcgtcgacgacgaaatcgtcattccctcctgcgatttgcatgattagggttagaaccagagaattatgtcagactttaggtagagttttaggaagaaccttagggagacagcatcgaaggctgacaacatttgcacgtaggcaacgggcaactgcaactattgctgaggatgttgatcatatggatcatgcagctgacaaggttcatgagcagcctcaagagccagttacggatcatgtcggtgctgatacaaaggattttccaagggaccccatgatacatcagtgttga

SEQ ID NO: 51093 - DNA, 372 bp, Glycine max
  Peptide Sequence Number=SeqID_167871
atgagggagaggatcttcaaaagttcaacaccatcatcatcaatttcaacatcaaaccgcgtggggcaagacgcgtacggtcaggacgaagtcagcctcggagtcaaagtgggcgtggacttggaggtggaagaggcgggagaggaagaaggagcggccgaggtggttgacgagttttctgatctggtcggtgcagacgaagatgaggcgcttgttgtcgccgtgttggccatcttcttgctcgaacttgatgctccgaagtcgggaaagtggttgcggagcctcacttgctcgctcagtgttttgacaatactgttcattttcgctaaaattgggatgaaagaaattggtgaaaatcgatggcaattataa

SEQ ID NO: 51094 - DNA, 234 bp, Glycine max
  Peptide Sequence Number=SeqID_167872
atgacaccacacacttcttcgaacacggaaacattcccggtggagcaagaagatctacacaagaagtggaagttggttgcttatctagtggactctgtaggcatcacgcaattctcttcaagtgattggctggtagttggcagtttccacgttgatggccgaatcatgcacaagcgcacctttggttctaaactcgtcttttatgacctgcacagtggtggcttcaaggtctag

SEQ ID NO: 51095 - DNA, 384 bp, Glycine max
  Peptide Sequence Number=SeqID_167873
atgtcattttgtgttgtagcattacaatgtaattggacaatttaccagggagatggtaacttcatcaagtctaagtccaagtctcccacttggtttaaggattcgaaaagcgagcagtccaagagtgtgttacaaagaaggctgaagaggagtcattgcagcagtgaggaagaggttgaaacccctgaggagagtgaggaggtgcaagccttgaaggcggaacttgaaagggtgcaagcagtcaaggaaaaattcaagacaacagctatcaaggtccgaaaagaatgtgacgaactaagagacgtcaatgtggccatcgcagaagcattggaatgggaaacaaagagggcccaaaaggaagaatggggtcgaaacaagttctga

SEQ ID NO: 51096 - DNA, 339 bp, Glycine max
  Peptide Sequence Number=SeqID_167874
atggaagagaacatgtgggccatcattgaccaatacaaagagaagttaagtctagctgcaacccatgaacaaaggttagaggatgagtacgcgaaggtatcggtcttgcaaacggaaagggaagcaagagagagagtgattgattcattacacagagaagcaatgatgtggatggataggttcactttcactctaaatgggagtcaagagcttccaagactgctagccaaagccaaggcgatggcggatgtgtactcggctcccgaggaagttcatgggctcctcgattattgtcagcacatgattgatttgatggaccacataattaggaaccgctag

SEQ ID NO: 51097 - DNA, 201 bp, Glycine max
  Peptide Sequence Number=SeqID_167875
atgaagatggagcccttgacaaatagcactgtggctcatgactatattattcttttttgcattgatgcaaattcctttgacagtcgagaaaagattaggccagaaaaggagctacaaagagcaaggaagattctgcctctagatggatctatctaccatgaacatggttatttcgaattttgcgttttctcacttctatga

SEQ ID NO: 51098 - DNA, 318 bp, Glycine max
  Peptide Sequence Number=SeqID_167876
atggcaaactgggcccgaactggggtgtcggtctggccttgggtggagaatggtggttgtttgattgtagtggaggcgatggtgaagttgtcgaaccagagcgcgaggtccaggctctggtaccttatggagtacgccaggttagggttttcaagaatgccctcaacgttgaaagtcgccgttaactcctctgcccatgcggcaaaagaagagctcgtaatcagggggaattctgaagaagggaattatgctgcgaagtggaggctggggagtgaggaatttggtcctttgagcggaaaagagtgtggggctcactaa

SEQ ID NO: 51099 - DNA, 780 bp, Glycine max
  Peptide Sequence Number=SeqID_167877
atgacttttattagggctccttcgaatgctctgttgaagggccttggttatggacatgcactttctgaacatatactattagatgctggcctaatctccagtacaaaagttccaaaagatagaatgtgggatgatgttactattcagccgctggtccaagctattgtgagggattatacaaagtttgagacatttgatgctgcattggatgagttctatggcaaaattgagagccaaagatctgaacaacagcagaaagccaaagaaaactcagcttttcagaaacttaataagattcgccaggatcaggatgaccttgctcgaatggtgaaggaagaaaagaaagctggaaacccagtaactagtctcattgataagcttcatctcgacaggaactgcatgactttactgttaagcaacaatcttgatgaaatgaatgatgatgagaagacactccctgtggataaggttgaagttgatttagctctcttagcacatgccaatgctcggaggtggtatgagcagaagaaaaagaaagagagcaaacaggaaaaaactataattgcccatgaaaaggcttttaaagctgcggagagaaagactcgcctacagcttaatcagaaaaaaactgttgcctcaatttcacatatgcgtaaagtctactggtttgagaaatttatttggatcattagcagtgagaactatttggttatcagtggacgtgatgcacaacaaaatgagatgatagtgaagcgttatatgtcaaaaggagatctgtga

SEQ ID NO: 51100 - DNA, 663 bp, Glycine max
  Peptide Sequence Number=SeqID_167878
atggcaacgttgttcaccatggtcgtcatgacatactcaatactgtcattggatgaccagagcacccaggtcgtgttcatgagagaagtagaagaggaaaacaaacggagtctggagacactgaaacaagagttgaaaaaggccatcaaaattgagttatcccaaatggcatcacaacactcacccccggttgaggcagatatacaactattagctgcatttgtgagcacgaaggggaattgtgctaaaacaacaaccaatccatcaagggaagaacatgctactaatgtggtgcctttaatggggttgtacattcagtgtcatcattctacatgcctagtgacgttgggaaaagtttacgacaaggcgtctaccatacacaatgtagatgatgtggattcacaaattcctccaaagaaactcattgaacctgttcaaaggtcaaatacccttggtggagatgatcccttgagtgacttgattaagaacctgtttatggatgagtggagtgcaaggttgggtcatggttcggtctatggattccttgagcctcagtccatacacaatgcaaaggatagatgtgctgaatgtcagcaatacattgaaacatgggagaaggaatcacaaagagaggtctacctaggagcttacttgaataaataa

SEQ ID NO: 51101 - DNA, 654 bp, Glycine max
  Peptide Sequence Number=SeqID_167879
atgcctaggttaaacacagacgtcaacatcctcttctatcctaccatcgccgctgcatgcagcgccttcttttttctgatcctcttccttgttctgtgggttatcttttcaactaccacctcctctttcacggtaacgtccgtcatcgtgtccaagttcaacatcatcaccacacactcgaccaagtcggagttaacggcgactttcaacgtcgagggcattctccaaaaccataacatcgcgtactccataagatacgagagcctcgacctagtgctctggttcgacaactttaccatcgcctccgctccgatcagacagccacctttctcgacccaagcccagaccatcaccccggtccaggcccagttcgccatggcccgcaggccgttacctagcggtttggccagcgagatcaccgcggaacgaaattatcatggttccgtggattttggagccacgttggtagctgggtttaggtacaagtttggtgtgttacattccaagaaattggggaaaatcaaagaccaacggtgtacgaagcacccccaaccccccagttgtcattgggagagtaaacaactagcaaagggtaactctcaaccgtcaaaggagaaccctggttcacactatgatacaccaccagaaaagtaa

SEQ ID NO: 51102 - DNA, 345 bp, Glycine max
  Peptide Sequence Number=SeqID_167880
atgttggaatatttgaaggagatttgtgaagaaggcgttacgctgaggagtggatatgggagagtatggaaatttgctactttaagcggaaatgagtgtggggttgacagacagtcatctattgttagagagcagaagctggagcatttgaccaatagagtcaataaattggaaagtgcaaagaagaagttgttagagagcatgaaggctgttgtggaagcttgtgatgagatcgaagcttcttacaacatcttgagggctaagtatatggaattcaccaatgaattgcacgtgctgaagatggttgatgaaaagttgtctgatgaaattttagatcttaattaa

SEQ ID NO: 51103 - DNA, 150 bp, Glycine max
  Peptide Sequence Number=SeqID_167881
atggttgtggatcgtggtagtggtgactgtcatttgaaggttggagatgaggtcatctttttctacaacattgaccaacatttatgggaggtcctccataggaagcaagttaaatgggatgacaaagaggatgaagctgactctccttga

SEQ ID NO: 51104 - DNA, 189 bp, Glycine max
  Peptide Sequence Number=SeqID_167882
atggtaaaaacatggtcccacaacgtccacactgaaagtagtatttttgtcccatccaacgaaacgcatgacaacactttcatgaatgtcatgggttctcctaagttccttcagttcatcgccaaaaaagaatcggttaccatatttatgaagctttataaagtgtttgtttccttcgtagtcgaatag

SEQ ID NO: 51105 - DNA, 732 bp, Glycine max
  Peptide Sequence Number=SeqID_167883
atggcttcccgtaagagaaaagccacaactacattgtcccaggccagttatgactcatccagatttgtttcaagggatgcttgggaccgttatgcagataacatcctcggccggaacattctttcggagaggaatgtgaagctatacattaatgagtttgatgacttcagaagagaagtcgagaggaggaattggcacagggagctcactattttttctgaaggaagcattgatgtggtaattgttaaagaattctatgcaaacctatatgtccctgaggacaaagaaccaaaccaagttagggttcgagggtacctaattaagttcaatgcgaactccctcaacaccttcttgaagactccagtggtcttagagcaaggggatagcttaccttcttactctaggttttgcaggttgaggccagatcctcaagagctggtagcctggctgtgtatccttggaagggaatttgttcttaacaccgagggcttgccgtggaagctcttgaggaaggatctttcaactttggtgcagacctggagtgttttatcttattctaacctagccccgacttcacatacctctgatcttaatcttgacagggctaggagcacttatattcagacagatctcgctcattgctcagtccaactcctcgaggcttggatttctagccctcatcactgccttgtgcaaggcccgaggattcaccttagattctctcacttatga

SEQ ID NO: 51106 - DNA, 447 bp, Glycine max
  Peptide Sequence Number=SeqID_167884
atggcatatcatgctagctcaacaactaatcaaaattcaatgaaaaatcatgaaattcattttgaaatccaggttggtgagctggcagaagcagtaactcaatttatgtccagacaagaaaaatcctttgtagaggctgaagttcaagagaaaagccttgagaaagatgaggaacaagcacaacaacaatgggagaagtactcaacagtagaaaaccaacaagaaaatattctccaaagcaataaccttccccatcaactgattgacaagaaaggaaggcaaggagagcatgaggaaaccttaagtggcgttctttctttaataactaacacctttcttgaaatgatttggaatgtccttccagattatatgaagtttatggaatttctagctagaaggcgaaacttcaaggaagatgtgttctttgtgactttcaagccaccttga

SEQ ID NO: 51107 - DNA, 819 bp, Glycine max
  Peptide Sequence Number=SeqID_167885
atgcctagggaaaaccgtgaccccgactactccctccgtctcatcgctgccacatccagcatcctcctcttccttttgacacttatggttatatggatggtgttttctccacacacccctgccgttaaagtaacctacctcactgtcaacaaattcaacatcacaccccgggaggaattaacggccgtgtttaacgtcgaaggtattctcagaaaccctaacatcgcactatccctcacgtacgagaggctaaccctagcgctctggttcggcaactttaccatttcctcggtggttgttgaaccgccaccgttctcgatccgaggtcatacccatgccccgatccgagcccggttcgaggtggtgggcatgcagatacctaactgggtggctagtgaaatcgcggtgcagcaacgttttcatggtgggatggattttggagccatgttggatgctaggtttaggtacaagtttggtatggagagctccaaggttttcagtatcacgcttcagtgttacccgctgcgcgttgaactccctctcaacgacaccatgaacaacggaagacttcatgacagacagaagggaacacaactagcaaaggctaatactcaaccatcaaaggtgaaccctggtccgcatgatattacatcaccaaaacgtaaccctgagagccggacttataccatgaggataagcgttggtgtaatggtggggttattgtcttgtgatctgaaattcatggatatagtaagcagtaacagattctctgcttgtgggggtaaggctgcgaagtatatactcccaagaatccattag

SEQ ID NO: 51108 - DNA, 405 bp, Glycine max
  Peptide Sequence Number=SeqID_167886
atgaggaaccaacgaaggtggttcgtagcaaaacggtgcagcggggttgttgttgctgcagcggcgggcgctcgtccttctgcgacggcagaggggctgatgagaccactagggacagaaacgggatcgcgacgtttcactcgagaacggggcgtgactctacaggcacaactgggctgccggcgagagggttgggttctgtgggattcagccatgtgcggcggagacaagtggaatgtagcttttgtgcaacacattacaacacccaaaagccaaaggataagatacaaatccttacctgtatgtgggcccgcagaggacgttgtggccgtgacggaggcttggccgcaacagagacgtcagcgtgatgacggagtgaatgacagactgagaaggagtgactaa

SEQ ID NO: 51109 - DNA, 768 bp, Glycine max
  Peptide Sequence Number=SeqID_167887
atgcctagggaaaactgtgaccccgactactccctccgtctcatcgctgccacatccaacatcctcctcttccttttgacacttatggttatatggatggtgttttctccacacacccctgccgttaaagtaacctacctcactgtcaacaaattcaacatcacaccccgggaggaattaacggccgtgtttaacgtcgaaggtattctcagaaaccctaacatcgcactatccctcacgtacgagaggctaaccctagcgctctggttcggcaactttaccatttcctcggtggttgttgaaccgccgccgttctcgatccgaggtcatacccatgccccgatccgagcccggttcgaggtggcgggcatgcagatacctaactgggtggccagtgaaatcgcggtgcagcaacgttttcatggtgggatggattttggagccatgttggatgctaggtttaggtacaagtttggtatggagagctccaaggttttcagtatcacgcttcagtgttacccactgcgcgttgaactccctctaaacgacatcatgaacaacggaagacttcatgacagacagaagaaagcacaccctgctgcatactgcatagcagttagaaggagaaggagcaaccagtgcaaccttccgggaacacaactagcaaaggctaatactcaaccatcaaaggtgaaccctggtccgcatgatattacatcaccaaaacgtaaccctgagagccggacttataccatggttatcctatga

SEQ ID NO: 51110 - DNA, 202 bp, Glycine max
  Peptide Sequence Number=SeqID_167888
gagaatgttcaagaaaaagacgacgttgaagatgaagaagaaaaggaagatgaagcggaagagaaagagaaagagaaggggttgacctctggtttggaacttggtctaaggcttaatggagctgaagagatcaaggcagagctcaagagattgaagaggatgaaggaacatgagaaagtggtagcgcattttctacccttcg

SEQ ID NO: 51111 - DNA, 171 bp, Glycine max
  Peptide Sequence Number=SeqID_167889
atggaaaatgggtcctctctaattacaagagcacttcctacgccttcctcaaagtggatcctctctgataatgaaaagaaaaatgacgagggtgagggcaagtgggttctcaaggttgatgtggatggggaagaagagaagagggatcatgaacgttttcgattcaattga

SEQ ID NO: 51112 - DNA, 177 bp, Glycine max
  Peptide Sequence Number=SeqID_167890
atgacgtgggtctgtgcagtctgtgccgtcggaggtgatgacgccgccattgcggggaactggcttgtggtacttatagcgacggtggtgtttgagggtggggaagggtatttggggattgggattgatggtcgtggagtggtggagacggtggaggcgggatctaggggtggtggc

SEQ ID NO: 51113 - DNA, 314 bp, Glycine max
  Peptide Sequence Number=SeqID_167891
atgaattgtgttttcgttcatgtgtccgccaccttcgagtttggagctatgcatagtgattgcttagtgaaattctccattctcaacctttttcggaaccacaagaaattcgttttcgttcatgtgtcctccaccttcgagtttggagctatgcgtagtgattgcttagtgcaattctccgttctcaacctcttttggagccccatgaattgcgttttcgttcatgtgtcctccaccttcgagtttggagctatgcgtagtgattgcttagtgccattctccattctcaacctttttcggagccccatgaattg

SEQ ID NO: 51114 - DNA, 390 bp, Glycine max
  Peptide Sequence Number=SeqID_167892
atggatgcttcaccagttaaagccctacccctcccgcaagtagatgatcctgatagagtgtcttggaaattcaccacatcagacgttctatccactgaccatttacaagccgaaggaaattggaagagcatttggaatctaaaagtgcctccaaaactaaagcactttctttggcgggtaacccgaggatgtcttccaacaagaaccaatctgcgtagaagaggcatagactgtactactggatgcgttttctgtcaagaacacttcgaatcagaatggcatgtttttgtggcttgcagcaaagcacgtgaaatgtggacagcagcaggtatccattacttgctggaacagaaatttaatgaagctgaaggtatcaaagagctcatgtaa

SEQ ID NO: 51115 - DNA, 297 bp, Glycine max
  Peptide Sequence Number=SeqID_167893
atgagattggagaaatgctggttttgctcttcaaccatataccctggacatggaatccagtttgttcgtaatgatgcaaagatttttcggttttgtagatctaaatgccacaagaactttaaaatgaagagaaatcctcgtaaggactcaacttttgagtttgagagaaagagaaataggcctgaaagatatgacaggaatcttgcggagaatgtcctcaaggccattcctaagattgataagatcagagtctcgagggaggagagacaccataagaacaagtcttttttgacttaa

SEQ ID NO: 51116 - DNA, 222 bp, Glycine max
  Peptide Sequence Number=SeqID_167894
atgctggatgaatacaacgtgcatgcaaaaactttcaggatggcgagagatagattgcaagatgcacaagtggataatatcaagttgaaattgattgctaatcgtgaaaaagatggtcgtacatataatgtacctactgttcctgaagttgtagcactaatagtaggcgattttgatgcaaattcaaaaagagatattattattgaaactcagcatggataa

SEQ ID NO: 51117 - DNA, 270 bp, Glycine max
  Peptide Sequence Number=SeqID_167895
atggaggataatgtgctagaggtgtatgacaataagaagagattggttctaaaggctcatttgtcaaagaacaaaatctttaaagtaggaattgatgttatggaacatgaatgtctaactacagcagtgaacaaaagaataatatggtgcatggcttaccacacattcaaatgccaagtgaagtatacgaggaatgcttggagtgaaagcaaactagaaacaccttcaagcaactggtttcaaccaggtcaagtgacaagcttgaggtaa

SEQ ID NO: 51118 - DNA, 1026 bp, Glycine max
  Peptide Sequence Number=SeqID_167896
atgcagcagtcaacttcaatatacttagttaaaattccaaaaggttgcttggaggcagaaacttgtaacgaagagtcacaacaggaatgctcagtcttactggtattcaagtgcagtgaggaattgctgctgagcaataggtgcagtggtaagggttttgttggaaaagataggttaaaactagggctgatcataaaacggaagcccaatcagaacctgctgtacctggttttagtgaaaagtttttcagatgctacactttctagcttctatgaaaaaccttcattgacaagttccgttataatgcgaagagggcatcacttgttcaatctagaatcaagctacaaatttgacttccccactccagaagatagacctggtgcaccgataataagtttcagtgatgcatcatttggttatcctggggggcccattctttttaagaatttgaactttgggattgatctcgacagtcgaattgcaatggttggacccaatggtattggcaagtcaactatacttaagttaattgctggggatcttcagcccagttctgggactgtcttccgttctgctaaggttcgtatagcagtgttcagtcagcaccatgttgatggactggacttatcctcaaaccctcttctgtatatgatgcgctgctatcctggagttccagaacagaagcttcgagctcacttaggttcttttggtgtaaccggaaatcttgcactgcagccaatgtatactttgtcaggtggtcagaaaagcagggttgcctttgcaaagataactttcaagaagccacacataatattgcttgatgaaccatccaatcatctggatttggatgctgttgaggcgcttattcaaggtcttgtgctgttccaaggaggcattctcatggtgagtcacgatgagcatctcatctctggaagcgtggaggaactatgggttgtatccgacggaagagtggcaccattccatggcacattccaagattataagaagatactccaatcatcttag

SEQ ID NO: 51119 - DNA, 171 bp, Glycine max
  Peptide Sequence Number=SeqID_167897
atggctgagtggtcgatagccctggaccctggtcttgaaaaccggaaaggaggtagcagagcagaatcacagaatacagagaagaaaagagatggatctagccagaaaagccaccagggccggccggagatgggtggctctgctggagatgagtcgcagaacagagactag

SEQ ID NO: 51120 - DNA, 324 bp, Glycine max
  Peptide Sequence Number=SeqID_167898
atggggacaaatcaaaacgacaaaaggttttatcaagtcaaggttaaaagtctagatgtcaccagcctcaaggaattgggacgattgatgggacctctccaaaggcaagcctttcgcaaagtgtacggaaagattctagatttgaccgcggcggaggtatttacggaagctgtcgtatccctcgcccaatactatgaccagccgttgaggtgcttcacgtttggggacttccaaatggtaccgactattgaagagtttgaggagatactaggatgccctcttggggggtggtcggggattcggcaagagagttggatcgcatga

SEQ ID NO: 51121 - DNA, 270 bp, Glycine max
  Peptide Sequence Number=SeqID_167899
atggtaggttacacaccttcaagctttgcggatttagttttcgccggcgaaaggatcgaagttggtctgaaaagaggcaaatttgattatcctgctttgatgaatgagaaagctggggcaaatgaagagaatgagaaggagggaggaacccatgttgtgactgcaaaaccccttaggattcctttgaatccaatggtggcctttacctcgagatcagcccgtgtcatcaagtttcagcgggatcgacaaacccttggcatcactctataa

SEQ ID NO: 51122 - DNA, 324 bp, Glycine max
  Peptide Sequence Number=SeqID_167900
atgaatagatcatcaagactaatgaacaaggagttactcaacaatgtaagagaaagacatacgtcgtcatcgataccgacaccaagaaacgacaactttcctttcgtaaactcgtcactattgcggagagaggtcaccgagagtgagaacacaaccgacagcgagtgcgagtgggatgcgagctttagacgactaagtgcgagtgcgagtgcgagtgcaagtgcaagtgcgagtgtgggtgagaagaaggaggagtcagagcgtcatggaagtgagatctttagaccgagactgggagtgagagtgggcgcgagaagagggtaa

SEQ ID NO: 51123 - DNA, 867 bp, Glycine max
  Peptide Sequence Number=SeqID_167901
atgacagtaattaaccaaccaacctgccgcctgtttaccgaagtcggccaaaccacccagctcgccgcctattatgaggaaggccgacacaccatgtggatgatgctgcgcgctcagccgcgccccagtttcaaccacgaattaattgaggagatcatgaacctgagctacgccgcccagcgttccggtctgccaattgatttctgggtgaccggatcgctggtgccgcagatgtttaacgccgggggcgatttgcgtttctttgtcgaatgcattcgcaacaaccgccgtgaagcactgcgcgcctacgcccgcgcctgtgttgactgcatccattcagcggcccgcgggtttgacactggcgcagtgacgctggcgatgattgagggcagtgccttaggcggcggttttgaagcagcgctggcgcaccacttcattctggcgcagaacagtgcgcgtatgggcttcccggaaattgccttcaacctgttccccggcatgggcggctactcactggtggcccgccgctccgggatgaagctggccgaagagctgatctgtgaaggggagtcgcacagcgcagagtggtatgaaacccgtggtctggtcgacaaagtgttccagcccggtgacagctaccgcaccacgcgcaccttcatcgatacgctgcggccaaaactgaatggagtccgtgccatgctgaaagcgcgacagcgcgtgctgcagctgtcacgggcagaactgatggatattactgaggattgggtcgactatgctttcacgctggaaccgaaagatattgcctacatggaacgtctggtacagctgcaaaatcgtcacagcgcatcactgcgcaaagccggttag

SEQ ID NO: 51124 - DNA, 177 bp, Glycine max
  Peptide Sequence Number=SeqID_167902
atgtcagaacatatccttatcaacgaaggagggaaaatccaagaatttcagcatcctttggcgatctatggggcaaaccgatatcgaaaagacactttcaataccatcgggttagatgccaatggcatattgaggttgctcgtagagatccacccaagtagttttatcctgttgtaa

SEQ ID NO: 51125 - DNA, 201 bp, Glycine max
  Peptide Sequence Number=SeqID_167903
atgttgagggaagggcttaagggttcagaagttggaaaaagaaagggaaagagagacataagagaaaaaaggaagaaaagcgaagtcgaggtgctaccgaatcacgaccatgattattccctacatcgttctcttgttctatgtccctcgtgcaacaatctacattggtctgaattcttcatcgcacctgaggatacgtag

SEQ ID NO: 51126 - DNA, 180 bp, Glycine max
  Peptide Sequence Number=SeqID_167904
atgagctcggccaggcgagctggttgcttaggcacgaagccatttcatggcccaggtgacccagatgctagccaggccgagcaagggtctagaaaaatccaaaaaagacccttttgcccccttccttggtttcaggcattgtattcctgggtcagggtccactttttcagatatggttaa

SEQ ID NO: 51127 - DNA, 162 bp, Glycine max
  Peptide Sequence Number=SeqID_167905
atgaggaggtgcatactagctagaggccaaaagattatgactgattacgcttgtcctgtttctgggttagctgaattaattggatgtgcttggcgaatatcatacagtttgtcaaatgaggagcatcgtgagtcgtcttcacattcacacgatgctgcatga

SEQ ID NO: 51128 - DNA, 309 bp, Glycine max
  Peptide Sequence Number=SeqID_167906
atgaatcaagggaaaaaaggagaaaccataggtcacgatacttggaagattatatggcaaaatgacttgagtaagcagcaagcctggtcaccatcgtctagaagcaatcctccaagatcctggaccggtactgctatcccctgtgagcaatacaagcaatttctgccaatttcctctttggcagacaagccaaattctgaacattacctgaatgcggcctcagtgttgtctgtcgccactgtagacgaaagaagaaccaacgccagagacgaagttagcgacagggactgtgtcggagacgatgcttaa

SEQ ID NO: 51129 - DNA, 249 bp, Glycine max
  Peptide Sequence Number=SeqID_167907
atggatgaagtgctcttggtgtttcaaaaccagtactgccagctgcacacaacaagatcatggaacttcattgggttacctacaattgctaagagaagattgaaatcaaatagtgacataattgttgctcttttcgatacagggttcacgcctgagtctaaaagcttcaaggatgatgggtttggtcctccaccagcaagatggaaaggatcttgtgaccactatggccttttcctcaggctacaataa

SEQ ID NO: 51130 - DNA, 399 bp, Glycine max
  Peptide Sequence Number=SeqID_167908
atgtcgagactttgtatggggtcatacgacaagttcgaggaaggatttggtaaactcaatcaataccgtgcttaccaatctagaattggtgagaatgtcccagtttgttttcttgtttatgagagtggtggatgggatctagaatgcatgaattttgatcttcctatgaatgtgatacaacatattcaaagtattaaacctccttgtggttcaagttgtagtgattatgttgaatgggatgatgtaaaggaagacaaatttactactaaagatgcctatcttaccttgtcccttgcttgtgatcttgatattgtacaagagtatttggaggtgggatggtcccaaaagaatcaagtatcacctatggaagattgggcagggtgtgcttcctacagatga

SEQ ID NO: 51131 - DNA, 303 bp, Glycine max
  Peptide Sequence Number=SeqID_167909
atggacatacttgctgcatttgatgctgctatacatgatggtgtggatgtaatatctatttccataggtggagggaatcctagttatgttgaagactctatatcaattggtgcattccatgccatgaggaaaggtataatcacagtggcctcagctggaaattcttgtccaagcccgggaactgtaaccaatattgcaccatggattggggtaggtgtgaattgtttcgatccaaaaggaaaacagtaccctcttatcaatggggttgatgctgccaaagaccagtggttcattgatggatga

SEQ ID NO: 51132 - DNA, 237 bp, Glycine max
  Peptide Sequence Number=SeqID_167910
atgtcaagtggcatagtggctagttcagagcttggtagcaaaagagttggatcagttaaagctactgttaacttctatgatgataagaagccctcttcaagaacaaaggaactccacagggcaagaagggatattggaagggagattgaggaggccaatgaggagcaagtacttggtgaagtggccaggattgaggctttgaaagaattgacagatattgagaccatgagaaaatag

SEQ ID NO: 51133 - DNA, 252 bp, Glycine max
  Peptide Sequence Number=SeqID_167911
atgggagggactggatgtaggcactggttgttgccgaaccaaagagaagattttgaaatgctgctaaaggacttacttagcgagccaaatttgctaagcgaggctcatccgcttagtgaggaagcatgctcactaagagagaacaaaaccctaaagaatgttgaaccagagagcagaacgattagtgcgcagccagcccacctagcaaggacgttgtttcttctcgctcttagcgcgtccaagcccgcttag

SEQ ID NO: 51134 - DNA, 303 bp, Glycine max
  Peptide Sequence Number=SeqID_167912
atggatatcgacaatctaatgaactactcaggtgaaaatgaagcatgttcggaggttcagagtttagaagatatagtgggtactatcattaagaacaatgcagaggatgaccacaaagatgatatggtgtctttggagcctgttacgcgaaaggaaacacttatggcgtcgaacactcttcacaactttatgatacaatacaaaaatacaacacctgaactattggatgcaataagaaaagttagagatgagctccaaatagacttgaactttaaagaaaaacagacaactattaaatcatag

SEQ ID NO: 51135 - DNA, 273 bp, Glycine max
  Peptide Sequence Number=SeqID_167913
atgtctattgttggcaaatttactgtaggagggtcttttatttatgtgggtgccgccattgttactggtgtgaagcttgtaacgtcgctggcaatggcgggagcgtggatgccgccattgacagcagcggaacagggatgccaacgtgcgcagtcccgccattgggtcctgcggcacaccttagaagagttgttggaggacgatgcgagaaggagaatgtggtggatcttgttattgtgctgtgaatggaagatgcacaagagagagttgtag

SEQ ID NO: 51136 - DNA, 1947 bp, Glycine max
  Peptide Sequence Number=SeqID_167914
atggtttctggatggagaaggacgtttcgcacatctaataccattccccaaaacacacacgaacctgaaatttgtgattattacaacaacatcaattcaagtcccaaaatcacttccaatttctcatttttctccaccccatcattgattcccacccgaaccaattcaccactttccaaacaccaatgcaattacaacaataatgcaagaactccctctcccaccaaacgctacagccccacatcgtttcatcaatccactccttcttccccaaactctccctcagccttctctcttctcaaatccaccttacgcttatccaaaagctcatgcaaaatctgcacgcggagtgtgaaaaccggcgaaggaaaagccattttcactgcggagtgttctcacgtctttcacttcccatgcatagcagctcacgtgaaaaaacaacgactggtcacgtgccccgtgtgcaacgctaactggaaacaactgcttcaaaacgcagacgaaaacaaaccgcacgcagaactcaaaacgacgaagtcgttcaagccccacaactacaacgacgacgagcctctcatgtcgcccacttcagtctcgcgtttcaaccccattcccgaatccaacgagaacgaagaagaagaagacgaagaagaacaaaacgatgaacaaataaagttcaatctctcatcatcattggtcaagaccagaaacatcgaagcattcttctcaccggaggctgcgattgtggcgtccaattggagctccgagacgtacgttacggtgttgaatgtgaaagttcagccgcgtaacgcggcggcgaatcggccgccggtggatctcgtcatggtgatcgacgtccgaggtagtgtcaccggtgaagagctttggatgctgaaacgttcgatgcaggttgttatctcgtcgctcggctccgccgaccgtctctccgtcgtcgcattctcaggcggatcgaagcggctatttccgctgcggaggatgacccgctgcggccagacagcggcgcggcgagtcgtcgacgcgctggcctccgttgagctccgccgagaaggaactccggcgaggaacgacgcgctgaagaaagccgcgaaggttctggaggatcggcggcagaagaacactgtcgcgaaaatcattctcctcacaaacagccacgaggatcatcgattaaccaccacgcgcttcacagttcattcattgatattctctcacgatgacaacgagttcgcgaagcgcgtgggaaatttgctgagcgtggcggcacaagacttcaaacttgagttaaaactagcgtcacgttcggctcaggcggagatcactgccgtgtattctctggccaagggtttcaccgacgctctctcgccggattccgtcgcgctcggtgatctctgcgcggcggaggagagggaactgctggtggagttcaaagtgccagctggcacagcttcgcgtgggtcccaccatcgttttatatctgtacgatgctcccaccgtgacccctttactcaagagcttgttaattccaaggagcgtgagttaattgttccaggaccccacactgttcgatcgtgtgatctcaggatcgaacagttgaggcgacgccacgtcagtgcacgcgccgtagccgagtcgagaaagtgtgtggctcgcaacgatgtgtctggcgcgcttcagttgctatcatcggctcgagcctctgtgagccgcgaacagggtgatgagtgcttgcgctggctcgaagccaaacaagccgagctgaggaaccaaaagttgagaagtagtaataataattgcttggaggaaaagggggagccgcttacgccgatgtcggcttggagagtagctgagagactggctaaagtggctattatgagaaagtctatgaacagagtcagcgatttacatggcttcgaggatgccagattttaa

SEQ ID NO: 51137 - DNA, 168 bp, Glycine max
  Peptide Sequence Number=SeqID_167915
gtttcacatggtgaacttgaggatgaggttgtagccaagaatgttggtggtgcaattgaattgtgtgagtatcacattggtgacatggaacttgaaagagcgaggttggattatgttgtcacagagtttggaatgccacttccagagaaggaagataagttaggataa

SEQ ID NO: 51138 - DNA, 447 bp, Glycine max
  Peptide Sequence Number=SeqID_167916
atgatgaagctcatgaatgacaagttgaagaaccccaaaggctacaccttcaacaaaaagcaaacctacgagattctacacattcaacttaccattaccatgtgccacaagattgtttacatgaagtccaatcaagaagatgaagagagaatgattggtccaaggtgtaattctatctgggcttctacgcatttagatcatatagataaccacatgaaaaacttaacaaatgaagctggttttggttgtgttataactattggacagattgatattaaccaacatctgttcatagcattggttgaacgttggaggcctgaaactcatatacttcattttccacattggaaggcaaccataactttagaagatgtggccttgcagctcggcctcaagattaacaaattgtctataactggtgtcgttcctggtgttgtttcttgttag

SEQ ID NO: 51139 - DNA, 111 bp, Glycine max
  Peptide Sequence Number=SeqID_167917
atggggacggtaacatatatgggtatggggatgggaatgaaaaacagtacatctaaaaatctcaagatacatgtacggttaggtacggataaggagatgatggtgcagtag

SEQ ID NO: 51140 - DNA, 912 bp, Glycine max
  Peptide Sequence Number=SeqID_167918
atgggaggactttcccttagacttcatcacaggcctacctccgattcgcggaaatactgccatattggttgtagtagatcgattttcaaaaggcatacacctaggcatgctgccaactcagcactcagcttactcaatcgtcatcctgttcatggacatcgtcagaaagcttcatggcatgccacgcagcttggtctccgacagagacccattattcataagcaattttctggcaagacctgctcgtcgaaagtggagacagtggatgagttcttatcagatagagaatctatttttgctgaactaaagaagaagcttcagaaggcccaactggcaatgaaacacacacctgacaggaagtgtagggatgtccattttgacataggagatttggtcatggtgcgacttcagcctcagagacagtcctctattataggccaacaaaggggatcctttaagcttaacaagaaatattatgggccctttaaggtactagatcaaattgggccagctacttataagcttcaattacccgtaggtacccgcatccatctagtgtttcattattctatgcttaaaccatttcatcagccacccctgcccgataataatccagccctctcattgccatcggttgtaatcaataatcaaccattagtgtcaccactagccattgtggaaactagatataacttagaatccagcaagcccagactgcaagtccttatgcaatgggatggttttcttccgggagataccacttgggaagattgggagcaactacaagctagttaccaccttgaggacaaggtgattcttgaaggcccaggggatgatagcaaacaagattatgcagtaaccaaacccaagagaaggagcaatgcacctgcatacctaaaggactacatataa

SEQ ID NO: 51141 - DNA, 129 bp, Glycine max
  Peptide Sequence Number=SeqID_167919
atggcctattattgcacgcgtagggggaggcaaatcggtggatttgcactacaacaagccacatggtccaagctcatgcacaccagacatctatctcttgctagccactttgaacgcctaaaatcataa

SEQ ID NO: 51142 - DNA, 924 bp, Glycine max
  Peptide Sequence Number=SeqID_167920
atggacttgaaagaaaattgtacttatgtcatgcacaattttaaagttctaaaatacaggtttgctggatttgcggatgttgtggctggccagtttgaacctggactattggttgatgttattggtgttgtggaggaggttgtctttcgccaagtttcaggaaaaggtagaagggtagtccttaaactaaaggacttgagccagcaatcgctatcttgcactttgtgggatgattattgcttgcagtttttgaagttcttagatgattatgaaggtgatggcccaattatagttctattgagccattgtaggatcaaggaagcgcagggcttgcagagttgggcattgaggcccggtcaggttttaaatcccatggtgaagggagtacacagctttcaggaaattgtttgtgtcactgttggcacaattactaggattgttctggacaatcattcatggtgttatacagcttgcattcagtgccataaaaaaagtgatgcagagatggtgccctttacatgtgcatgcggcaaatacaataaggaagttgtgcttaggtataggcttgaggacggtgatgttgatttgaatgcttcaccccaagcacttgataagctgctgggttatgaacttgctttcaagataaaggtgcaacccaagttcaggaattctgttgttttgaagtgttcagatgactcgagcttaataaatgctgtgatggatatgctagctgatgctgaggtaatgttcaatgcaagttatttgacattaaatattgtgaaaaaccatgatccactgcttggactccccttgacgcctacaaagcagcaggcatttcaagattgtgatgatgaagcagggacctctcaaatttcacctgtacagctttcatccaacaaattaaaaaaacatggcgcaatttag

SEQ ID NO: 51143 - DNA, 387 bp, Glycine max
  Peptide Sequence Number=SeqID_167921
atggatgaagcatctaaaggactaaggactcaaggtcaaacagtgactaaggtggatggatcagaagatttctggagcagcagcacctttaagttagaccatagtgcagctcattcccagagaagcatctcgtcaatcggaatgccaaataatccttctgatcctcaaagtagtggaggcagtcaaactggtcctcctgaatttgtcaaccatggcaaagagagagagaggagaaaatatccctctctcctagggtgcagcactgcagtattgctggagggttcacggatgaaaaggcttcttctttggaaccacataaggcaacaatggattggaaacaaaaggtctgagagtatcacagaaattcaagaaccaagaataaggtaa

SEQ ID NO: 51144 - DNA, 459 bp, Glycine max
  Peptide Sequence Number=SeqID_167922
atgtgttacgaggttcaaaacaaagccaagaaagtctactcaaatgatgtttgccgtctctacaacgtgataaccactaaacttgagaatatgaatatgcacatgtatcttggtaagcttgattgtttggttaatgattataacaatttgatgccttcccctcatgatgtagagacttttcactggcaacataatcagtactttatgacctctgcactgtccccgcttttgtctctgacgcaacctccctatgaagttggaattgacgcctcacctaacaacaacaaccgtctcatcatcgacggtagttgcaatgtgttaacgaaggtgaagaataagaccgacaactcccgattgtggataagatgctggatggatatcctctacttgtttggtccaatcgtgggcgacaatagaggtcttgctcgcaaacttcaccaagagccacattgtaattaa

SEQ ID NO: 51145 - DNA, 243 bp, Glycine max
  Peptide Sequence Number=SeqID_167923
atggacatccttgtccctcatcctctcacaaacgcatgtttgcttattcaactttcaccggaatgtgggtgcaagccattggtctatttgctcaagcgacctgcgctcctgagtgttgacttccaagactgttcaatcagagattactcgtcttgcacgttggtgggggtgccaaagtttgtcttcttagagaagcgagttgtcaagaataggatgttggacaaatggcctcagttaccttaa

SEQ ID NO: 51146 - DNA, 534 bp, Glycine max
  Peptide Sequence Number=SeqID_167924
tatgatggggaaacctacgaaattcaagtcagacaacacaaaggaaaactttactttgctgatggcctaacaagattgaggacagaactacagatttatgaatctgtgacgataaatttcctggcctgcgaccacccctcaaaatttgacttccacttcactccaccattagaccaacagaaatgcaaaaggcaccgtgcaacaggaaaacacatctggacatatgaaatcacccaatcaatgctaggcacaccttatccactgcaacttccagcctctgtcacacaatgcctaatccactgtggtgatcatatgacaattctcagaagattcggacctccattgcaatggaatgtagttgtgctcgacaaaggcattggtgataagtatgtcactctcccttggtataaattccttcaagaaggtgattttagccatggagacgagctctcattctactataggtgtgctgagaagatctgggaagttgtcatcaggcgtgcaattgattgggatgatagtgatatagattag

SEQ ID NO: 51147 - DNA, 252 bp, Glycine max
  Peptide Sequence Number=SeqID_167925
atgtctgtgcaccggcgccgaacaaccataagatatacaccgttttcggaatcgacctcaacgacacgtgccgtcgggaatcagcaactttgtggaaaaggtctcttcgttgctacgaccgaaaagaagaaacaagagtatgagaaaactattttggcttacaataagaaattggaggggaagaatctagaggaatacgagtctgacaagttaaagtctgaagtcaatggtgatgaggtagatggatattaa

SEQ ID NO: 51148 - DNA, 216 bp, Glycine max
  Peptide Sequence Number=SeqID_167926
atgaggaagccgcagtggggaacctttgatgctgctagtgacgtcaaggaggcggtgaaagcccttggggatgaaggcgtcgacgtagacagagagctcgctctgggcggcgaagaacacgacgtcagcggggaacaatcgagggagcgcgatgagaaggaggcaaaggagggcggagagttgggagagcaaggcggagacggagaggcattctag

SEQ ID NO: 51149 - DNA, 453 bp, Glycine max
  Peptide Sequence Number=SeqID_167927
atgaataaaaaaattagggtaaacagaggattgggcattgtgtataccttggtggcgaaaacaaggttgcattcggtcttgcagatgcagcaaaggcgatcgtcgcagatgaaacgtagacgagcaacgcacgtggaacacacctcccggtgcaagcagggcccgtacacaacccattccaaaggctcaacacaaatgacacaacagtcgtccatctcttctcctctctctttctctctcctttcgattcttgattatggatcacagaaagtgcaaaccctaattccagtgcctggatcacgacacgaggttagagatggtggggccgaaggacaaggttttggtgagagggtggaagataaggggccaggggagggccagggagaggttgtgggtggtggcggcgaggaggatgaggcggttggaggaggagatggactgtgtgagggttaa

SEQ ID NO: 51150 - DNA, 312 bp, Glycine max
  Peptide Sequence Number=SeqID_167928
atgagaatcctaaaactggccaaatacaggctaaaggcccaagtggagaaggacgaaggcccaagtggagaaggacaaagcctccgagtggagaaggatgatggcccaagttccttgttgaaccaatctcagacttatcaaggtaatccttgtggcgtctactctgacttatcttccttcaccggaagtggcatctaccctgacttatcttccttcactggaagtggcgtcatccaaaaaactctacagcctatatcaaacgttccgtcccgtaaggttcacatcatctggtatcagagcttcggctcttga

SEQ ID NO: 51151 - DNA, 414 bp, Glycine max
  Peptide Sequence Number=SeqID_167929
atgcagtcattagaagataaagaacatgaaattaggattatgactgaaaatgctagtcagcttgtcataatgattgtgaaggaatgcattaatcgtaacccggtgagaagtgtgatcttaattgtgagagaaacgaccaacattggccacttagccaaaaagcttaccttgtgtataaatgaattaatcccttgcacccagtttgagctgaaacctgaaatatcagaagaaaaagagaatttggagggtgaatttttagagagaataatcaccacagagagctttggagtgtggactgcaaagaacgaagaagcagagcaaggagccaagttctcaacttttaaagagattagggagtttttgagtgattatgaggtgccaagaggtagaggaggcatccctcctcttctataa

SEQ ID NO: 51152 - DNA, 813 bp, Glycine max
  Peptide Sequence Number=SeqID_167930
atgatggacaatgaaccactccaacaactccaagcccgcatcgtagagatagaaagatgccataaggaagaacatagaaaaatgaagaccgatcatgatgaattgaaagctcacattagacgtccccaagaagacgagcactgcgctcacatgattaacaaatacacccaggcggatgactcatcgacatcctttcatagaccgaatcatggaggtcgacccacctctaggttggaaaccgctcaacctgatgggaaattggcaagattcaagggttggacaatggttaatttcttgggccttaataaggtggatcttggcataaaagggatgaatgagatggtaaaaacagcttcctttgctttccttgctctagcccttgtcataggtcctccaagtccttcaagtggatccttgcccttgctcttggtcatgtcctcatcaaccgacttggacgagcacttagatgcattcctcaccaaggccaacctctacactaatggcgacatgatcttatatcaattcttccctatgtccctcaagagagctgcattgacatggtatggagggatccttccccgtgctaaagttgatgtctcgctaagcgagctcaatgcgcttagcgagtgtcatccgctaagcgagacatcaacgcgcttagcggatatgaggaatctggaagggaatctatcatacaggcatgcgctcattgcgtcatcagcttgctcagcgagtcgtttgtctccttccaggcttagtgcgagtttggtgctgagtgaaaattcacttactcacgctaagcgtgacatcgag

SEQ ID NO: 51153 - DNA, 345 bp, Glycine max
  Peptide Sequence Number=SeqID_167931
atgacacatcaagtgcaaactatggatcttccaccagtggcaatagataatcaaccagttccgattccattagctatcctggctcacaagaccattccgtcagatacaggtccgagacaactcgtgttggtgcaatggaggggtcttcatcctgacgaaacatcttgggaggagtggacgacccttaaaaatattcatcaccttgaggacaaggtgttgtttgaagcgcgtgggaatgatacgagtaacaacgaagagctacaagtagcaaagcccaatgtgagtaatagcaaggagttgcaaacagcaaggcccaaaggcaaagccacactcccagtcatttga

SEQ ID NO: 51154 - DNA, 2589 bp, Glycine max
  Peptide Sequence Number=SeqID_167932
atgtatgtcattgctgaggacagagtaatattccctgctataaaagcagagctgcattttctccaagaccacacagatgaagaactccaatttgacaagcttaggtgtctgatagatagtatccaaagtgctggagctgactcatcatctgctgaattttattttaagttgagctcccataccgaacaaatcacagatactatattgaagcactttgaagacgaggaagctcaggttcttccactggcacgaaaattatttagtccccaaaggcaacgagaattactttatgaaagcttgtgctcaatgcccttgaaattgattgagtgcgtgttaccatggctggttggatcacttaatcaaactgaagttagatcatttcttcagaatatgtatatggcagccccagctacggatcatgcattggttacccttttctctggttgggcatgcaatggatattctaggaacagttgcttctattcaagcacaacaggtttatgtcctgataggagattgatggaaataccattttgcatgtgtgaaccttcattcggtctcaatgaaaaatcttcagccattcaacaagaagatgaaaatggctgtattggaccagtcaagcatggaaagcctgaatcaaagcaagacaatgatgttgctaacctgatggtaactggaaaaaccctcagctcatctcttaatcagtcttgctgtgtccctgaattaagggtgaatgcaagtaatctagggcttggttctttggccttaacaaagtctctgcgagaactatctgattacccatctgcaccttccctcaattccagtctttttatgtgggaaaccaatttagtctcggctgacaatcaatgcattgcacggcctattgataacatatttaaatttcacaaagccatacggaaagacttggagtatttagatgttgaatctgtaaaactcaatgattgtgatgaaattttcattcagcaattcactggtagattttgcttgttgtggggtttgtatagagctcatagtaacgctgaggatgatatagtatttccagcattagaatcaaaagataatcttcacaatgtgagccattcttacactttggatcaccagcaggaagagaagttgtttttagatatctcttctggactcactcagcttactcaattacatgaattgctatataaaaagaattggtctgatcatataactaattgtttctctaattatgctggttgctatgatattgatactgtacaaaattacaacgagctctctacaaagattcagggcatgtgcaaatctatcagagtgacactagatcaacatattctcagggaggaacttgagttatggccattgtttgatagacacttttctctggaagaacaggataaaattgttggtcatataattggtactacaggggcagaggttctccagtcaatgctgccatgggtaacttctgctctcgcacaagacgagcaaaacaaaatgatagatacattgaaacaggctaccaaaaacactatgttctgtgagtggcttaatgaatggtggaaaggacctgcttcatctttaaatatcactacaccaggagattactcactaggtactgatgcatatgaagattcagagcatagctttcttgcattccgacctggatggaaagatatattcaggatgaaccagaatgaacttgaatcagaaataagaaaagtttctcaagattcaactcttgatccaagaagaaaagcatatcttattcaaaatctaatgaccagtcgctggatagcttctcagcagaagtcgtctcaatcattgggagttgaatcttcaaaaggagatatattggaaacttcactttcgtttcatgatccagagaaaaaaatatttggatgtgagcattacaaaagaaattgtaaactccgtgctgcttgctgtggaaaactattcacgtgtcagttctgtcacgacaaagttagtgaccatttgatggataggaaggctacaactgagatgatgtgcatgcagtgccagaaaatacagcctgctggaccagtttgtgcaacaccttcctgtggcagtctcttgatggcaaagtactactgtagtatttgcaaactttttgatgatgaaaggactgtttatcattgccctttctgcaatctatgccgtctgggaaagggacttggtgttgacttctttcactgcatgcagtgtaattgttgcatgtcaaagaaattggttgatcacatatgccgggaaaagggtttagaaacaaactgccccatctgctgtgattttttgttcacatccagtgaatctgtcagagctctcccttgtggacatttcatgcattctgcttgttttcaggcatacacatgtagccactacatctgtccaatttgtagcaaatctatgggagatatgtcggtttactttggcatgcttgatgctctactggcttctgaggaactcccagaagaatatcggaatcaatgtcaggtgaaaaatatttacagtagtactactagtacagctcttgaagctgaaagtaaattactcaaacctttttaa

SEQ ID NO: 51155 - DNA, 327 bp, Glycine max
  Peptide Sequence Number=SeqID_167933
atggcgacggctggtggtggcggtggtggtggctgcgtggccgtaatggcaggcagttgtactgtctccactccgtcgtcgagttacggaggcggcgcgtgttcttccaattccaaagacactctcatcgaatcgccgattttgatattctgtttattccacaaagctattagctcggagctccagtccctccacgcaaccgccttcgatttcgtttccaaccgccgccattcacaaccacactctcccctcaaaatcatgtccttctcccatcgctgccacttccttcgcactctctacaagcaccactgcaatgctgaggaccag

SEQ ID NO: 51156 - DNA, 285 bp, Glycine max
  Peptide Sequence Number=SeqID_167934
atgttgcagctgaagcaaggttggaacgaaggattcaagtatgtttcagcttcaagctctgatgaagatgaaccatctaacattgaagaagatggataccaacatgatgttcttcacagggctgaacgttgcttcaatgttagcaataggaataaattgacaatcataggaaggctttgtttcagaatccagtcaagagaaaatgaagcacaaacattttttagatcaaggagactattccaacaattttcaattgatggttacaccatggttgagtcagagtga

SEQ ID NO: 51157 - DNA, 132 bp, Glycine max
  Peptide Sequence Number=SeqID_167935
atggacatcatctatatcatcataatcttcgtaaaggacggtgttggcctagaagatggaaatgcaatctctcaaccgcgggctttctcccatggattggaaaaagcaaaagattctccaagcgcttcatag

SEQ ID NO: 51158 - DNA, 483 bp, Glycine max
  Peptide Sequence Number=SeqID_167936
atggggatttggttgagctctccatgtttgggtgaaccatcaaatgttagtcagcccctcagtataaggcaatactctcagggttctgacttttcggagcttgattgctttttgtacaagtccaaggttctcaatattttagaaatttgtgatgctcttgatggtactaatttatgtatgattgggactactaccaagttgatagttgggaagggtcgatggttttattattcctgtggcaggtgcaagtatcaatgcaaattcaattcctcttctatgatgaagatgtcaaatgatgttgatattattaaaaatatcacaaagcaaatatatgctcaacagggtgtagctgatattaccgagccatcatgttataaaactcaggcaagtaagctagagttatcccaaattgaagacttcgggcagtttgataaaagtttacctcacatgaggccaaattttacctacatatatcaggtttaa

SEQ ID NO: 51159 - DNA, 408 bp, Glycine max
  Peptide Sequence Number=SeqID_167937
atgttaccactgtgtgacaccaagattgcaagtgaaatggcagaaccaaggcaacaaaaaacaacaagccacatgcaagaaaaccaagatgagtatctagaacacagaaaacagcagcagccccgccaaacacaaacatgcacaacagtccaccttgaactgcagaagcaacgaaacaagaagaaaacagccaagcgaataaaacccggaatgaccaacccaaaagcacaacctcacaccaaaaacaaaatcagcagagcacgtggcaatagcaaagaaatataccatggacgtgtcaaaaaaattgcaaccgggaaaattggaactgcaatatcagaaccaacacaacataaagcagcaatccacgtgccagaaaaccaagcccaaagctggaggggtataaaatga

SEQ ID NO: 51160 - DNA, 708 bp, Glycine max
  Peptide Sequence Number=SeqID_167938
atgggtgaagtagaggaggtgcaagagcagatgaaggccggcatggaggccatgaaagagcaaatggccacaatgatggaggccatcatgagcatgaagaagataatggaagccaatgcggttgcagttgtcgttaccagcgctgttgctaaggtgaacctgatgcccccatctagcctcaaccaaatgaatcatccaacctcatctatggtaggcaaagatttgggaagtacgagcggcccctattatgtgaaaattcaaaacaagcacgctttcccaccatatggcttgcctcccaactatacaccacccaatgtggtatacactcccaatgaggatgtcaataactctgctcccatactcattgaaagccgacaacctcaaactgatcatgcacatgtctctcaacccatgggggagacacatgaaatgccccaccacaatctagtggacttcgagccttgcctcggatatgccactgaagggcaagtagttgggccctcaattttcgcccctaaccacaacccttgcatttcacagcaggtaaaatccctcctattatggatggaatggaaaaagttggatcatctagaggaaaggctcagggccattgaaggaggtgaagattatgcctttgctaacctagaagagtttgttcctagtacccaatatcatcacccctcccaagttcaaggtgccggactttga

SEQ ID NO: 51161 - DNA, 255 bp, Glycine max
  Peptide Sequence Number=SeqID_167939
atggaggctttggaggaagactatggagatggaaatgggaaaaatgaatcaaggcaatatattgagggtctaaagctactctgtcatcatggacctcatgtatcaaaagcaaatacaaatggtaatgatgctgatgttgcacctaaattttctcctttgaaaattgttcaatttggaaatccttctcaagacactgttgacccaagagatggagactttggaggaagactatggagatggaaatgggaaaaatga

SEQ ID NO: 51162 - DNA, 444 bp, Glycine max
  Peptide Sequence Number=SeqID_167940
atgtgccgtgccagcgttgttggtgcccaaaaaggatggtacgtggagaatgtgtacagattgcaggtgatgagaatcctgaaattggccaaatataggctaaaggcccaagtggagaagggcgaaggtccaatggagaaggacaaagcccccgagtggagaaggatgaaggcccagagacttattaatgtaatccttgtggcgtctaccctgacttatcttccttcaccggaagtggcgtctaccctgacttatcttccttcatcggaagtggcgtcattcaaaatctccgtagcctgtatcaagcgatctgctcctagtcagacttatcaaggtaatccttgtggcgtctaccctgacttatcttccttcactggaagtggcgtctaccttgactttcccagtcaggatcacatcatctggtatcagagcttcagctcttga

SEQ ID NO: 51163 - DNA, 240 bp, Glycine max
  Peptide Sequence Number=SeqID_167941
atggttagggatacctatttcaccttcttgtttttcctccaaagaaaaccaacctttactgaggttgctggtaacaaactgagaaatcgcaaaattttgctatgcaaagcaaagcaaagcaacctttacctagcgttgggggagggaattggaaatgtcgctctaaccccacacccaatcggtcacaggagcgcattggaaatacaaccttcttggaaacaaaaatgcatcagtaactga

SEQ ID NO: 51164 - DNA, 771 bp, Glycine max
  Peptide Sequence Number=SeqID_167942
atggaggccaacaaaggggaaagggtgaagattttgaagcgaccaaatggggattacttgcctaaagatatttctggaaagaaaactggtaatgagtctgagcgagttcatcccttctatttggtggagccaatgcaatacctatttgtcaaaatcagggaggcgcatgggctcactcctcctagcgaaggcccaatcataagggttgggatgtcgagtcaattcaggagatccaagcccaccagctacaggcccataatggaaccagacattctccctggaattcccttggtggcgttagcttcgacctttctgacgttccggtacgagatccttcgaacaatcccttggcgccgtaatggtattgcctcgaaggaggcaccgccgatcagaattgcgagagtttactacgacattcaactttctatgaggatcgggacgcaattcaacaacacattcccggaagcgtggatctcatatgcaccgtacgtgacacacactcagtccaaggtttaccaatctccaaagctttggtacctgtgcgtgacagtggtggatgcacaagacctaaatattgctcccattcaacctccgttaacagagccagaagtgagggtgaaggtgagattagggttccaattgcagcaaatgagaagaggatccacgaaccaccgtagcttatcattccactggagtgagggtaaaaaaaggttaccatacttgattaaaatgtcgcacctatatatagacgaaccaaaatgtgacacgtga

SEQ ID NO: 51165 - DNA, 333 bp, Glycine max
  Peptide Sequence Number=SeqID_167943
atgcataaaacttcataccccattgtacagaggctcttcgctatgcgaaggtatgggggagggatatattgtacgcagccttacccttgcatatacaaagaggttgtttccggattcgaacccatgaccaacaagtcaccaaggcacaactttaccgctgcaccagggatcgccctcaaaaaaaaacagctaatgacaccgatgccgacgctgacgagctgggggtctctcctcaaccagtggctgatcatccaagtcctcagcattatgagggtgcatttgactagtacctatttagctgcccctagacctgcggtccaacaccatctgtaa

SEQ ID NO: 51166 - DNA, 924 bp, Glycine max
  Peptide Sequence Number=SeqID_167944
atggcggaatggcttgggaatatcacccatactccgccagtgcagcccatctctcctataggcattcgggcagaggatcctcacaatgatgaggaagttgacaatatagacgaccatataaggaaggatgatatccctgaagtggaggtaaagtatgacgatgctgggagggttataatagaacctttaggtataggttggacccctaatcgtcatgctgttaaggcacttggccttgcaattaggtcacattttgagggcccctaccatcattatgaggctgtccctgaggatgtgcagacaagagttacttggacagctcaggatgagtggcaaattaaaaaagtgtatgaaacaaaagttaaaaaacgcctttctgatatgctcaccaaagctagggataagaggaagagacctcattggataggtgaacaggcgtgggttgatcttttaatatattgggtgactgataagaagttcaaggatcagtgtgctcaaaataaaattaaccggacttctagtcgtggtggagcagtgcacactacaggacgcaagtctcaccttgacattgcagtaggcctagagcgtaaatatggcaaacctgtggatccagacgtgttgtttctggccactcacaaaaacaaggacggtcgttgggttgacgatcgtgctcgtgatacatatgaaaaatatcatgagcgtttgcgggtggctcaatcacagaatgctaaagggtccactgatgatactggggctatgaagcttcagtgttggaaggatgctgctggaggcaagactaggggtcggtgttatggcaccgaggacttggcttccaacatccgtcgtgtcatgcacaccaacattcagctgaggccaaggcattgcgccaacaggttcagcaagcaattgagcgagctgatgtag

SEQ ID NO: 51167 - DNA, 414 bp, Glycine max
  Peptide Sequence Number=SeqID_167945
atgacttctcttcacttttctttgcccttgccagcaaatctcctttcccgcacaaccccatctcgttcctcaactcacattatgatgaatgtgagacccttgatgcccaattgcaacctcttcttctcaccacgcgacgccagtttggtagagaccgtttgtggtggtcgaacaagctatgatggtcgatgttacaaggaggctctatgttggccacatttcccacacgtgacaataatgataaccttgacaacgagtttcagacccaaatgttttgtgccgacgaggttcactgtgtcgcctgcagtggttgtcttgatgatggtggcggcggagtggggaggtgatggcaagctccgtgagcactgttgttgttctagccaaaaagatcttgtcgaggtgatgcagttttga

SEQ ID NO: 51168 - DNA, 1830 bp, Glycine max
  Peptide Sequence Number=SeqID_167946
atggaggtgagggaagatttcatggtttcagcaactggtgacagtgaaccaacttcgagaagtgcttattttctgaaaccccttgcaaattcccttgatggaccagtttctgaggtaatttcatcttctatggctatgccactgccacctgtgtttgatccaaagcagtggcctatggtggttcgttacaatggatggcaccacccaaaaccgaagtgggttgaatgggtggatacccttcaagttagatatcaatcactgtggaagaaagttggcatctttgatgccattatgagcaccaagtgcagcatagcgaaaaaccaaaacttgtgtgttgggattgctgagaggtggtgtcctgacacaaacaccttcttgtttccatggggtgaggcaacaatcaccttggaggatgtaatggtgttggggggttttcctgttgttggtgatcctgtcttcaccacacttcaaagccaggaaatgagaaaggtggaggaaaaattgagtcttgcaagaatggaaccttggagggagaaaaaacataaggttactacatcagcatggatggatgcttttgtcaacagtgggacgcggagcgaaatagagcatgaagcattcctttcaacttggttgacaatggttggcttttctcacaatggcttggtgaatgagtgtgttttccctattgccattcttcttgctagagggtatcccattgctttgggaccagcagtgttggctagcatataccatgatttgactttgttgaagaaaacaatagttcgtttggcggaaaaatcagtacttgatgataaattggaattggtgacaactcttcagtctcccttttacttaattcaaatttgggtgtgggaaaggttcaaaaatttgcagccacagcccaaactgatcaaccatgaggaccctgtgttgtttagatggcacaaagttaaggccttggaaattgataatgtaagattagcagtggaatcggctatggatcattttcgatggcgcccttatgtgcaatatgctggcaccggcaagttcaaggtgtattatccagaaaatgaaactttggtaatacttgatacagatttggataaagaacctacaggaatactagcctcttttgttgcatgcttgaaagtttctctgcttgttggaattcagtctaatatagagctgtatctgccgcatagagttgctatgcaatttggaatggatcaagatgttccaagttgcgtgcctatattccgcgggactaaagaaaatgcttggaaaaattactgtcggccaatatctgatacacatttgtattttcctgctaggctttttgaaggagacgtaacaacacgctatgcaacgtggtggaagcagttagtaccgagttgtcatcgtgattttgtgaagaatattgtgaggcgaaagagaagtctgatgtctcatgtatcaaaagcaaacaaaaattctggtaatgatgctgatgttccacctggtttttctccttccaaaactcttccttctggaaattctggtcaagatgatttgcaagctaatgaaaatattgatgctgacattccaacaaggtttaagagtttgtcgaacccaatttcttcagcttctactgcagattatgaaaaggctaagaggatatcatcactgacaaaaccagctgcagaagatacccctgaaccattgatgagtggtttggatgagcagtttgaagatgcaaatggaagaaaagaatcaaggcctagtgaaagctgtagttgtgcatctagagaaaatttaatggatctagaagagagaattaacaggctggaggaa

SEQ ID NO: 51169 - DNA, 174 bp, Glycine max
  Peptide Sequence Number=SeqID_167947
atggtggttctcaaatttgctttcggaacgattcgaaccaagtattcatggcttgaattgcatcatagttgtttgttggaagaggggtggctagaattagacctttccaatgcagctaggaaatttgctccatctatcatattcattgagggacttgatgttgttagaggctag

SEQ ID NO: 51170 - DNA, 255 bp, Glycine max
  Peptide Sequence Number=SeqID_167948
atgtcattggcctccaacggattttttggagaggtattgataatatgggaatgggctggaacctatgaagcacggacactccagtcccttgccgtgtccggtgtccgatacacgtccgtgtcggtgtcggtgcttcataggctagaactcgttggccccaagcattgttgggatcatactcttgtatttggtgtgccaaatgaaataaaatcttcttcttcttccaacaaagtggtatcagagcttgagttctag

SEQ ID NO: 51171 - DNA, 174 bp, Glycine max
  Peptide Sequence Number=SeqID_167949
atgcctcagaggacattgattaaacaccttgcttgggtgaacaaatatggtaaaggggaggatgatggtggtgcggtggtggtaggcggcgaggatgttggcaaagttgcaaggtacgatgacattgacaatgctttggtggatgatcggtgttgggaaatagcaaggcaatag

SEQ ID NO: 51172 - DNA, 273 bp, Glycine max
  Peptide Sequence Number=SeqID_167950
atggggaaatggctgacgacggagtcttccggaagacccgttaggggttcttccggaagttccggaagaactaaccaaacgtcttccggaagaacacttcttccggaagacttccggaaaacgtcttccgggaactttccggaagaagtggttcatccggaagaattccggaagacgcccacttccggaagaagtttcaaacttccggaagacctttccggaagaacccttcttccggagtgtttccggaagaaccacttcttccggaagtga

SEQ ID NO: 51173 - DNA, 150 bp, Glycine max
  Peptide Sequence Number=SeqID_167951
atggcgtccaaccgaagcagcagctgggctcgcggtgaaggagaaggctcgcggaagagtttcaataaattgctgggtgcaccagcaatattgctgggtgcacctagcatatccctaaatgaaggtgtcgatgttggttctgggctttga

SEQ ID NO: 51174 - DNA, 291 bp, Glycine max
  Peptide Sequence Number=SeqID_167952
atggtgggtcaagccggaccaattttccaagactcaattgtaagtgggtcgaggtgggccgaccgacctgttttgatttctactttatccagcttagtcatgagtttgttacatcagagaagtgattcttctactggcctcaatacattgttgcatggtatcttacttttgatgcaatcctactccgcaagggcattggatagaagactccaagtagattgggctagagatccaagggaaggccctagggttctcatgagccttagaatagatttcgagcccatgggctaa

SEQ ID NO: 51175 - DNA, 390 bp, Glycine max
  Peptide Sequence Number=SeqID_167953
atgcctgatgctagtcggactgtggacttgaatgtggtttctaggttggtgctaggcttttatgcaagtgttaggtcggtgctgactgctgggtttttatgcaagtgccaagttaggtttgggtttctatgcaagtgccaggtcggtgttgggtttttattcaagtgccaggtcggtactggtttcgggcttaagatggtggcgcggttggttccaggcttggtgtggggtggcaatgttggttctgggcttgagggtgacggtgttggttcgggcttggtgcagggtggcgacgttggttctaggcttgaggatgggtgcctgctggtttcgagctgggagttgctacgtgcacccagcattattgctggggcacccagcaaacagtga

SEQ ID NO: 51176 - DNA, 681 bp, Glycine max
  Peptide Sequence Number=SeqID_167954
atggtaagcaaggtagctggcacctattttccgaggaacctgatgatggggttgtgggatctgagtttgtgcaaaagtatgttggtgagaacttcaagaggaagtttatggactcaagcaaggatcacacactgtaacagattactacacaaaactaaagtgaatttgggaggaactcaacaattaccgtcccatgattccatgcatgcacctgctcagccaaagtctaccacgactaggatttcattattcgattccttaaaggacttgctgagcatttttctgtttctcatggaaccactgccttcaaccaatagagtcttctctatggtcattcaatatgaaaggcaacaactaccaggacaagctattgtggaggagcaaaatagctttgccaatgctgctgagaaacgtcacttttctaacaaaggaaaaggagtttcttatgatggtgctaagggaaatcccactcacaacagtggaaatcaaggctcaaacaaagacaagcatggacaacctcttaggcatcctcgctatcccgaaaggccaggataccataatcatgcatccagtggagctgctgctaacaacatcactgcaaatgcagtccatgaagcaacaaaaaacaatggaaatgaggaagattcatttggactaagtttgaatgtcgcaccagcataa

SEQ ID NO: 51177 - DNA, 366 bp, Glycine max
  Peptide Sequence Number=SeqID_167955
atgagtgtttttggtgcctttaattcatctttgtgcaaggaattctccagttttatggagaaagagttggagatgtctttgatgagagaattgactttcttccttggacttcaagttaaccaaatgaagcatggaacctacctataccaagaaaagtactatgcagaattgattaagaatttcaatatggaaaagtgtaaggaagaaacaataccaatggcaacatccatttatcttgacttggatgaaaaaggtaaatcggtagatgagtcaaagtatagaggtatgattggttatctcctatatttgactacaagccaacttgacatcatgctaagtgtgtgcatatgtgaaagatataaataa

SEQ ID NO: 51178 - DNA, 195 bp, Glycine max
  Peptide Sequence Number=SeqID_167956
atggcagagctcaagttctccagggatctagaatctaactggactcctctggccttgcatagagctgtgatcaaggtagggaatccaagtctggatgtaacattgttcggcttccggcaagtgcaccggatcgcacaagtgtataaattatctatgcaaaaagaaagaaaatcaggcaagagaaatgatgtgtaa

SEQ ID NO: 51179 - DNA, 234 bp, Glycine max
  Peptide Sequence Number=SeqID_167957
atggaacgagaggaaaagaggtttgtgtaccgtatacgttgttcctctgatgaaaacaatgatccagagggagtggaggaaggaattggtgtgacccggaatgtcgttgactccgactcgaagtgccctttcgcttcttcgatggttccgccatttgaagagctttttgagatttcaatcagttcaaatgaaagagaatggaaaaagaagaagtttgggctttgtggggagtga

SEQ ID NO: 51180 - DNA, 252 bp, Glycine max
  Peptide Sequence Number=SeqID_167958
atggcaatcaattcgtggggctccggactcaatggtggaggatgcatgaacgacattcaatttatggggcttcgaataagatttgatgatagagaatgcatgaacagcgcttggcaatcaattcatggggctccagactcaatggcaatcaattcatggggctccggactcaatgctggaggaagcatgaacgacaatcaattcaagggtgtcatcttccgcacttacaagatctgtcatactgacttttga

SEQ ID NO: 51181 - DNA, 282 bp, Glycine max
  Peptide Sequence Number=SeqID_167959
atggttggcataggttatttttcttgtagtgatcagaagagcacagagtccgccataaagaatcttgaggtccaagtgggacaacttgcaaagcaattggcggatagatcatcaagcagttttacagctaatacagagaaaaatcccaaggaggaatgtaaagctgtgatgactagaagtagaatggcaatccaacgagatgatagtgaagctggaaagaagatggaggaacataaacaacagctggcacctaagccagcacttgaacctgtttctgatttt

SEQ ID NO: 51182 - DNA, 1635 bp, Glycine max
  Peptide Sequence Number=SeqID_167960
atggataattcaaagtcttctgggagaaggcatgaagaatggtctcctacccctttgtctgacaagaaaaggatggaagtgtctgtaaaacacaggaaggtcaaacaagcattggcgacgtttagaaacttagttgacaagctcaatcatcagtataaagcgtctcaacctgtgaatttaatggcgaagactaaagctatgatggaagcagcaatgatgatgagacaaaagcatcaatgggagaacgataaaaagcatgtgggacatgtagtaggcatcgagttttggaatggtattgattatatgggaacaggcaagaactcgttggccacaagcattgttgtaaccaatcgatacgataatgctaggaaatccaatggtaccttggtttacagtggtcatggaggaaatcccaatgttaagagtaatgtttctattcaggatcagaagttgcaagggggaaatttggctctgaagaatagcatggatacaaaaagtcctgtgagggttatactgaaattttgtaaaaagtttgaagttggcagcaatttcgattacttgtatgtttatgatggcttgtatttagtggataagatgactgaagaaagagggaaacttggaaaacttgtgttcaagtttacactgaataggatttcagagcaaccccaaagttgtgttgccctcaaagatgatgttatgggcaatgatgacagttcaagacaacttgcaagttctaggccaagaaacagacacaaatccagaggaagtgtagtccaaaaggatgttgttcgagttaacgatctttcaaaaggaaaagaaaaatttcctattcgggtggtgacattaacaaattgtgttcatatacccaaatccttttactacattgttaagagcatctattcagataagttcaaccaggcaacgattccgtgtggctgtgattgtgaagatggatgtgtgaactgtgacaaatgtgtttgcattattaagaatggtgggataatggcatatgattgtaaaaaaagacttgcttctcccatgggatcattgcttatttatgaatgtggcccttcttgcaagtgctcctcttcttgcatcaaccgagtaagccagcatgggatccagttccaactggaaatcttcatgacagaattgaaaggttggggtgttagaacacgctctttcattccctctggaagctttgtatgtgagtacattggagaagtccgggacagtagacaaagtggattgagtatagatgttgatgatgactatttatttcacacgggtgttggaaagggcttcatcgatgcaacaaaatgtggaaacattggaagatttataaatcatagctgttctccgaatctccatgtcaaagatgttatgtatgatcatgatgacaagaatcttcctcacaaaatgctgtttgctgcaaaggacattcctgctggtagagagctgagttttgattataattccaagggaaaatttatcaacgataggagtaatagctgctactgtggatcacaggaatgcaatggtcagatctatattaaaggtggtgctgatgatgctgagtatgtcaaggatgcccatgtcattaagaacacattcacaagtgttaaagggggttaa

SEQ ID NO: 51183 - DNA, 303 bp, Glycine max
  Peptide Sequence Number=SeqID_167961
atggctcagggatggtggcctgagatgatgcatcctgtacctattgaggttcctggccaggataccttctcaatgaactgctctaccgacagaatggaccctggaggagctaccacctatgagcctggaggagctggtgtaggagtagcagaagtggaaggagctagtagagtagaagaaaaaggaacattagttggtctcacccttgccttcctcccccctctgaagttaactgtaactcctctagctctgcatagggtagtgatcaaggctggaaatctgagcctagaagagttactctga

SEQ ID NO: 51184 - DNA, 393 bp, Glycine max
  Peptide Sequence Number=SeqID_167962
atgaggtcctatggtggtcacagctcgaccggagagggagatgacaggtggatgcattttgcggagcacgtactacctatgggtaagctttgtctagtgcttgggcaggtaggtgaccagcccagagatgcaccagccgcagaccctgaggagtacatacagccgcccagcccccaggttccagtggcatttgacccctctccacatgcagtggatgattatgacggctatgaggtgattgcacagaggttggagcgtgtgctcaaccttaggatggtcactgcaggcacagagttatatgatattatgcaggattgcctgacgatcgccagaggaggatccagtgctgatggaagtgtcagggctcgacagagacggcacacagagcattga

SEQ ID NO: 51185 - DNA, 435 bp, Glycine max
  Peptide Sequence Number=SeqID_167963
atgtccaggatcaacgagctagtcgatggagtgtctagggtcatgcctttcggcctcaaaaacacaagcgctacataccaacaactgatggaccgagtctttaaacaagttggacgaaatgttgaggtatatgtggatgacatggtcatcaaaggcaagttcctcggcttcatgatcagtcaccaagggattgaagccagccctgacaaatgtgctaccatactggagatgcacaaccccaccaacgtccaagaagttcagaagctgaacggtaggctagcatccctgtccaggttcctcttaaagctcgtcgaaaatgcaaaaccattatacaaactactcaagaaagccgagcccttcctatgggacgagaattatgaacaagctttctcggctttcaagaagattatagccacaccgccagttttgagttga

SEQ ID NO: 51186 - DNA, 1139 bp, Glycine max
  Peptide Sequence Number=SeqID_167964
atggcagattatgctgggatggattcctggcatcacgtcggtgatgagtcagtgctcatgactggtgaggtgtcatctcgcggatctatgtttcagggctcggatttgagacccttcatcgacgctcatgacttgagggctttcagccgctataagtctgtcttgacggttacaatctaccctatcaggatatcttatggtgaagctcctggagagcttgccttgaccaaaggtgttcatcaagtccacgatatcaacggaacttccctgatcgataaggaccctggacaacatgaagttggcaataatggtggatacaaccacgaggtcgtcctagtttgtggggttgatacctgtgaaagtgataggagggagactttgttgtggtggtgtgtcgacaaagttaatgtcgatgtcccaaatggcatggaaatggttgttgctcacactgttgttgctaatgtctttgtctaccttgatctttcactctatctcttattctgtctacttcatggttcctatgttgcttctcttggtgtcctcagggtcttactcctgcttggtgggctcagtagtcttctgtgttatgaccaatactatggtgatacctatagtatttggttgtgtctgatcccaagcctgggaggttttgtcgggggtagcttgatggatacctctaagttgaaagctccatccaaaatcgtagagcgattagctattaaggttggtcttggtacttccttcttacttattacgcttatgttcaacttgtcggacttcattcctaaatatggatatttcttccatttggatgtagcccttggctcattcgtgcaactcatccatggcgaagagcatggaatgcaacactacctcaggactggccaaggtggtcgaggtcatacgatgaaatttgctagttgcgtactacgcattgaatcgttcgacgaaggtgtcaaagctgtctatggacctagaggttcacctgagtcaggaaggcatccaaatgctcatctggatctattgtcccttatatcactcgaggttgagtggtttccaccccatgggtatgtcttcctccacaatgtggttgacagaaggatgtcgacgagtagtccatctgctagacagtgcatatg

SEQ ID NO: 51187 - DNA, 186 bp, Glycine max
  Peptide Sequence Number=SeqID_167965
atgtatcgcatatgtgtaatagccagccggtgtggcggtagatttgttggttgcgacgaccatggaaatagattggaagtgacagtggtgatgaaaaagaaggaaacaaaaggaaaaaaagttaccaattgcaaccaagtgaggtgtagtgaaaagaagatgagagttgaaattctaatttcataa

SEQ ID NO: 51188 - DNA, 735 bp, Glycine max
  Peptide Sequence Number=SeqID_167966
atgtcccatctaaacggcgcctactacggccccgccgttcccccgccgaaatcctaccaccgtccctcccacggcggcggcggccgcgacggctgctgctgcggctgcctgagctgcttctgtggctgcatcttcgactgcatcctcggcctaatctgcaagatcctgaccacaatcatcataatcctggcagttctcgcttttctgttctggtttatcgtgcgccccaacgtgatcaaattccacgtcacagacgcctccctcacgcgcttcgactacaccaccaacaacactctccactatgacctcactctcaacgtgtcgatccgcaacccgaaccgcagggtcggcgtctactacgatcaaatcgaagcgctcgcgctgtacgaggatgttttgttcgggaacctgacattgggttctttctaccagcaccacaagaacaccaccttcgtgagtcccattttcaagggccagcgcgtgactccactcgccaaggtccaggtttcggagtttgacaaggaaaagggttctggggtttacaccatagatttgaagctcttcatgacggttcggttcaagttcttgctgttcaagagtgggagtttgaagcccaagattcggtgtgcgttgcacgtgccactgaaatcgcgtaacgcaacaacctctccggacgctgcgtttcaacccactgagtgcgattgggattacgggaaaaagtggtggatccattag

SEQ ID NO: 51189 - DNA, 210 bp, Glycine max
  Peptide Sequence Number=SeqID_167967
atgtcttctgccactgcctccaacactttcttccttcactcttgtttcctcctcttctgtctcctctcggctccttcctgtgtttccatgttctctgatttcgatgcaacagcacctcaacagagcccagagaaggcacacttaacagaaacaaaacgccatctaagcgtggtgacggttgagattctcccgtttatggcgtcaccttga

SEQ ID NO: 51190 - DNA, 858 bp, Glycine max
  Peptide Sequence Number=SeqID_167968
atgagtacttctaatcaagttaaagaacaatgtgatgacaccaaacctttatggaattatgtttcaaagattaaaggtctaagtgtagacgatgaaaattttgaagttagatgcagtttctgtgaaatagtttttaatgggtcttacactggagtaagggcacacttgttaaaaattataggaagagaagttagaagttgtcagaagataactccttcaaggcttgcgaaacttacaaagatgcataatgaggctgcattaagaatagagaggccaaaaaaaaaattgtctttttatctttggtatcaacctccaggttacaataagttgagaactaccttatttgcaaatgaaagaagacatgtagagaacctattacaaccaataaaaaatacatggaaagaaaaaggtgtgagcattgtaaatgatgggtggagtgatcctcagagaatacctcttatcaatttcatggttgtgattgagagtggaccgatgtttttaaaggccttaaattgttctgttgagttgctagctcttgctcccataagatttgcttccaccatagtgatgctaaagaggtttaaacatttgaaaaaaggatttcaagagatagttattagtgagcaatggtcttcttataaggaagatgatattaacaaggaaaaatttgtgaaagagacaattttggatgacatttggtgggacaaggttgattgtatactttctttcactactcctatctatgatgttcttagaaaaacagttacagatgcagcttgtcttcatttggtgtatgaaatgtgggactcaatgattgaaaatgtgaagaaggtcatatatcgacataaaagaatgtga

SEQ ID NO: 51191 - DNA, 678 bp, Glycine max
  Peptide Sequence Number=SeqID_167969
gtgagtgatgctagcggttatttggagaggacattcttgagtcctgcatccatgagggcaatcaatcttattcgtaaatggatggaggatgctggtttgagaacttgggtggaccaaatgggaaatgtacatggtcgcgttgatggtgctaatgcaaatgctgaagctttattgattggatctcacatggacactgttgttgatgctgggatgtttgatggatcactaggaattgtctctgcaatatctgccttgaaggctatgcatgtcaatggaaagctacaaaagctaaagcgccccgttgaggtgattgcatttagtgatgaagagggtgttagatttcaaactactttcttgggcagtggtgctatagctggtattttgcctggcacaacattggagatatctgataagaggtttcacctagcaactttctggttacattttatgacctctttcagggaggtgatgattaaagattttcttaaggagaactcaatagacattacagaagaaagtcttttaaagctcaagtatgacccaaagtctgtttggggctatgttgaggttcacattgagcagggtcctgtgctagaacaagttggtttcccacttggtgtggttaaaggcatagctgggcagacacgattgaagttatggttgttccctatgatgtga

SEQ ID NO: 51192 - DNA, 147 bp, Glycine max
  Peptide Sequence Number=SeqID_167970
atgcatttctattttggtaacatgatcaatgggcgggtacccccatcattgcttttgtgtacaaagtcaggcaaagagagagtgacagtaaagcttgctgatgttgttgctgttgatgttattcaacctattcaggatgatgcatag

SEQ ID NO: 51193 - DNA, 1758 bp, Glycine max
  Peptide Sequence Number=SeqID_167971
atggcttccacaagagacaaagatgaggctgaacctcaaagaggctattggagatggagcaaacaagatttcttgcctgaggagtccttccaaagctggaacaactacgtttccgccctttctcaaacacggctaaggttcaaggaccgtctcttagcaagatcagatgatgccactgagacagaggaactcaagaaacaaagtgagcatgacatgaaacgttgcctcaactggtgggacctcatatggttcggttttggcgcggtgatcggagcaggaatctttgtgctcactggtcaacaggctcatgacagtgctggaccagccattgtcttatcctatgttgcctcaggcttctcagcaatgctttctgttttctgctacacagagtttgctgtggaagttccttctgcaggaggctcatttgcttacttgagagttgaattaggagactttgttgctttcataactgccggcaacattcttcttgagagtgttattggaagtgcagcagtggcaagatcatggacttcatacttcacaagccttttgaaccgtccaaagaattcgctgtgcattaaaacaaatctcaaagagggttacaacttgctggaccctatagcttctgtggttctggtgattgcttcagcaatcacaatcatcagcacaagaaaaacttcagttctcaattggatagcatctgccatcaacactgctgttattatatttgtgattgttgcagggtttcttcatgctgacacatcaaatttgactccgtttttaccttatggggctaaaggggtgtttaaggctgctgcaattctttactttgcatatggagggtttgatagtattgcaaccatggctgaagaaaccaagaatccatcaagggacataccaataggattggttgggtcaatgtccatgatcacagtgatttattgcttgatggcactctcactgagcatgatgcagaaatacacagaaattgacactggtgctgctttctcagttgcatttcagaatgtaggaatgaagtgggctaaatatgtggtagcttttggtgcacttaaagggatgaccacagtgcttcttgtggcaagattgtcgcaggcacgatacattactcacattgcgcgttgccacatgatccctccgtggtttgctcttgtgcaccctaagacaggaactcctataaatgctacactcttgattaccattgcaagtgccaccatagcctttttcacaggcttggatgtgttgtcaagcttgatatcggtgagcgcgctcttcgtgttcatgatgatctctgctgcccttttggtgaggaggtactatgtgagaggggtcacaccaagagagaatttgataaagctagttatctttttggtgctcattattgcttcctcaattggaatttcagcttattggggacttaggcctaatggttggattggatacactgtgactgttcctatctggttcttggcaacactagggatgcaactttttttgactcagcaaagggtgccaagagtttggggtgttccacttgttccatgggtgccatctttgtcaattgcaacaaatgtattcctcatggggtctttggagtatgatgccttcataagatttggggtgtgcactgtggtaatgctgatctattactttttctttggcctccatgcaacttatgatatggctcacccacaagagaagctgccatccaaagttgaatacacagaacataaaaaatga

SEQ ID NO: 51194 - DNA, 1770 bp, Glycine max
  Peptide Sequence Number=SeqID_167972
atgggttcttacaaattgggcgatttgtctttctattccctcattgaaagccacgcctcttccctcgattttcggtccctggaagaggtgcttcatcaaatgaagcgcgaaaggagggtatttttagagaagaatttcattgttatgttcaaagcttatgggaaggcccatttgcctgagaaagctgtggacttgtttcacagaatgtggggtgagtttcagtgcaaacaaaccgtgaaatcattcaattctgttctcaatgtgattgttcaagagggtcttttcaatcgtgcattggagttttacaatcatgttgttgcatccaagagtttgaacattcaccctaatgcactcacttttaatttggtcattaaggccatgtgtaggcttggtttggttgataaagcaattgaggtttttagagagattccactcaggaattgtgctccggataattatacctattcgacattgatgcatgggttgtgcaaggaagagagaattgatgaggcggtttcgttgttggacgaaatgcaggttgaggggaccttcccgaacctggttgcgtttaatgtgttgatcagtgcgttgtgcaagaagggtgacttggggcgcgctgccaagctggttgataatatgtttctgaagggttgtgtcccgaatgaagttacgtacaatgcccttgttcatgggttgtgcctcaaggggaagttggagaaggcggtgagtctgttgaatcagatggtgtcaaataagtgtgtgcctaatgatgttacttttggaacacttattaatgggtttgttatgcaaggtagagcatctgatggaactcgtgtgttggtttccttagaggcaagaggtcatcgggggaatgagtatgtatactcatcccttattagcggcctgtgcaaggagggaaaattcaatcaggcaatggagttgtggaaggaaatggttggaaaaggatgtggaccaaataccatagtttatagtgctcttatagatggtctttgccgagaagggaagctggatgaagcaagggggttcttatctgaaatgaagaataaaggttacttgcccaattctttcacttacagctccctaatgaggggttattttgaagcaggtgatagccataaagctattcttgtttggaaagagatggcaaacaataattgtattcataatgaggtttgttacagtatactcattaatggcttgtgcaaggatgggaagtttatggaggccttaatggtgtggaagcaaatgctgagtagaggaattaaattagatgttgtggcttacagttcaatgattcatggcttctgtaatgcaaacttagtagaacagggactgaaacttttcaatcagatgctttgtcaagggccagtggtacaaccggatgtgatcacatataacatacttttaaatgctttttgcatacagaagagcatctttcgtgccattgatattctaaatattatgctagatcaaggttgtgatcctgattttattacgtgcgacattttcttgaaaactttaagagaaaatatgaacccacctcaagatgggagggagtttctagatgagcttgtagtccggttagttaagcgacagagaacaataggtgcttccaaaattatagaagtgatgatgcataaatttttgctgccaaaagcttctacttgggccatggttgttcaacaggtctgcaaaccaaagaatgttcgaaaggccatcagtgaatgttggagcaggctaagttgctga

SEQ ID NO: 51195 - DNA, 2760 bp, Glycine max
  Peptide Sequence Number=SeqID_167973
atgacaaacttcaaccttgaaggcaacaacttctacgagaaaatcccaaaagaattgggacggttgtcacgattacagaaactctctatcgaaaacaactcattgggaggggaaattcctacaaacttgacaggttgtactcatctcaaactcttgaacttaggtgggaacaatttgactggcaaaataccgatcgaaattggctcacttcagaagcttacatatttgagcctttatatgaatcaattaactggaggaatcccatcattcatagggaatctttcatccttaattgttttctcagtggatactaacaacttagagggagatattccgcaggaaatatgccatctcaaaaacttgacagaggtagaattgggtatcaacaaactgagtgggacattgccttcatgtctttataatatgtcatctctcactacaatctcagcttcagtaaatcaacttagaggctctcttccacccaacatgttccacacccttcccaatctccaagaactttatattggtggcaatcatatctcagggccaatcccaccttccatcacaaatgcatctgccctcttagtacttgacatcaattcaaacaatttcataggacaagttccaagtctgaggaagctacaagatcttcaacgtctatctttgcctgtgaacaatctaggtaacaattcaactaatggtttggagttcataaaatcattggcaaattgtagtaagttgcaaatgttagctatatcctacaatgattttggaggtcatttgccaaattccttgggcaatttatccacccagcttagtcaactatatctcggaggtaattggatatcaggagaaatccctgcatcaataggaaatctaattggcttaactctcttggggatagaagataacctcattgatgggattatcccaataacttttgggaagcttcagaagatgcaaaagttagacttaggcacaaacaagctgtcaggagagataggaacctttttaagaaaccttagtcaattgttttatttgggtttgggagataatatgttagaaggaaatattcctccaagcataggaaattgccaaaagttacaatatctaggtctttggcaaaacaaccttaaaggaaccatacccttagaaatttttaatctttcctctctaacaaatgtgttggatttgtcacagaactcattgagtgggattataccggaagaagtgggcatccttaaacatgtagatttgctaaatttgtctgaaaatcatttgtctggtcgcattcctgaaactatcggagaatgcataatgttagagtacctatatttgcaagggaattccttatatggaatcataccatcctctttggcttcactgattggtctaatagaattagacctctcaaaaaatcgcttgtctggaacaattcctgatgttctgcaaaatatttctgttttggaattgttgaatgtatcttttaacatgttggatggtgaggtaccaactgaaggtgtctttcaaaatgcaagtgggttaggggtgatcggaaatagtaaactttgtggaggcatttcagaactgcatctaccaccatgccgtatcaaaggtaaaaaacttgcaaaacaccacaagttcaggatgatagcaattttagttagtgtggttgcttttcttgtcatactttcaattattctaactatctactggatgagaaagaggagtaacaaaccatctatggattctccaacaattgaccagctggctaaagtttcataccaaatcctacacaatggaactaatggattctcgactacacaattgatagggtctggaaattttagctctgtctacaaaggaacacttgagttagaagacaaagttgttgccattaaggtcctaaaccttcaaaagaaaggagctcacaagagtttcattgttgaatgcaatgcacttaaaaatattaagcatcgaaatctagttcagattttaacatgttgttccagcacagattataaaggtcaagaatttaaagctctaatttttgagtacatgaaaaatggaagcttagaccaatggttgcatccaaggactctaagtgcagagcatccaagaacattaaaccttgatcaaagattaaatatcatgattgatgttgcttttgcaatacattatcttcattatgaatgtgagcaatcgatcattcattgtgatttaaagccaagcaatgtccttcttgatgatgacatgattgctcatgtaagtgattttggcatagcaagacttctttcaaccattaatggtaccacttctaaggaaacaagtacaattggaataagggggactgttggctatgctcctccagagtatggagtgagttctgaggtgtctatgaatggtgacatgtacagtttagggattcttattttggagatgctcaccggaagaagacccacagatgaaatctttgaagatggtaaaaatttgcataactttgtggaaaattcatttcctgataatcttttacaaattttggacccatcacttgtacctaaacatgaagaagcaacaatagaagaagaaaacattcagaatcttactccaactgttgagaagtgcttagtttcactctttaaaattggacttgcttgttcagtgcaatcaccaagagaaagaatgaatatggtttatgtcactagagagctaagcaaaatcagaaaattctttctcgctggtaagataaatggagaatga

SEQ ID NO: 51196 - DNA, 240 bp, Glycine max
  Peptide Sequence Number=SeqID_167974
atggtgagccatgttgggagtttacttgaaaaaattgaaactcataagtcaaaaccctcctcactcattcttagtggtgattacaatggtgataatactagtggtggtaatggtagtagtggcgataatgatggtgacaatgatgatgaaggtaggcaatggcaattgtggttaaggttgttcactatcaactcaaacaagaaaactaaattgaaaaataattctaaagaattgagttga

SEQ ID NO: 51197 - DNA, 246 bp, Glycine max
  Peptide Sequence Number=SeqID_167975
atggcaggatatcttgtgcagaagttgcaaattgattgcacattcacaaggcaagcacatgaagtaggcgccaggatggagatgcatttttgtgctagtgagcctacatttggaggtggtgtggtgtggttgttgctttcatcttacaaggaaaatatattaggaaacaagatcgcattttacgatccaggcaagcctaacgtcaacaaggtcaagtccaacatgaacaacaacatgagccaatag

SEQ ID NO: 51198 - DNA, 468 bp, Glycine max
  Peptide Sequence Number=SeqID_167976
atgttaaccaggcttgaagctgaaatgctgaatattgatttagtaacccttttcattaaaaacctaaatctattttcagttatttctgtagaattgtttattgctgattgtagcaccttgcataggatatcatctatgcggactaccagtgtgagaggtgcttcttatgtctggtgtagcattgtgaaatctgttgacaagcttcgggatggttttggtccttgtttaggtgtggggcagtccttgatccttctggttctccaattgggagaatgtacaaaggaatttggcaaagctgcgcgctccacttccagagaatttagcattatgggttacagaaaatggcattgtggtctggctaggcttttgatgaggctctcccaaccaactgtaaaaaacatgcgtggcacttgggaatgcattcagcgtgtacttgatgctcatctcacagggaggatgtttgcatga

SEQ ID NO: 51199 - DNA, 282 bp, Glycine max
  Peptide Sequence Number=SeqID_167977
atggttttggattttgattcttctgagttgagcaagcatatacctacaatcaatcaagagactgcaattgctgcacctgaaccaaatgaaactctcatgaaaactaggtctggagaactcataagaccaaatgataaaaataaaaaaaggatctactttggtcagaatatgacctggaactggatgggattttctgctgaagggagtggtaaaatcatcaaagtgggagattctgtttatgtgcttcagaaggtctcttcaactgctgaagcagctgcttga

SEQ ID NO: 51200 - DNA, 201 bp, Glycine max
  Peptide Sequence Number=SeqID_167978
atgttgctaagtagcaacgtcatctatatctgtgtaaaagtggtcatgttggcgcgcatgatccacactcgtctctttgcagcggcacgggaactaattaaaggaaactactggccccttaatcgggagcgcaagtctcgattaagaattaagggcaaaggaccttatattctcttaaggtgtggctatggagcctactga

SEQ ID NO: 51201 - DNA, 222 bp, Glycine max
  Peptide Sequence Number=SeqID_167979
atgtcatctattgtttactgggatcgcgcccgcaaaacacctagtggacccggagaagtccaacagggtcctggggtttctagctctgattacgagcctttgtcagttctacgggatgcccgttccccccagcaagggatcacacccgcaaaacacccagtggacccggagaagtccaacaggggcttggggtttctagctctgattacaggcctttgttag

SEQ ID NO: 51202 - DNA, 225 bp, Glycine max
  Peptide Sequence Number=SeqID_167980
gtggtgttcgtcattggaagtgcggtagacagactttgtggtagatttagggatggcctttgtggatacctgggtggtggtcacagcatgggtttctccctcatcctcaccctctttatttgccccagttttctcagtcgtcctagtaggatgatcaaatttgcctcttttcggacccacattgatcctttcactggcgaagaccaaatctgcaaagctttgagg

SEQ ID NO: 51203 - DNA, 531 bp, Glycine max
  Peptide Sequence Number=SeqID_167981
atggcagcagagctgacgctgattcacggcgtgccggttgactgtagcgagcgcgaatttctgcaggcgctgcaaaacgcgctgatctggattaatttccgcttctatcttgcgccgctgttctggattgtggtcggtggcccttacgggccagtgttgctggtggggtatgcgtttctgcgcgcctggcagagctggctggcaaaacaccgttccccgctggaacgcgcacagtccggcatcgatcgcattctgcacgtgctggactggattccggtgcggctggccggtgtggcctatgcgctgctgggccacggcgagcgtgcgctgccggcatggtttgccgcgctcagtgatgtgcatcgtccacagtatcaggtgctgaccagcctggcgcagttctcgctggcgcgcgatccgcatctggataaagtggaaacgccacgggtcgccgtggcgctggccaaacgcgtttcactggtgctggtcgtggtagtggcgctgttgaccatctacggcacgttagtgtga

SEQ ID NO: 51204 - DNA, 195 bp, Glycine max
  Peptide Sequence Number=SeqID_167982
atggtgtcattggattggcgaggaaagcaaaagggattcaactcacggttctatggattacgattccagcacaataataggacctcaaacacactgttgctgaagtacactattagtggggatgcaaggaagaacttaaaaatattaaaaaataacctcaatctcataatgtgtatggagattactattaaatga

SEQ ID NO: 51205 - DNA, 678 bp, Glycine max
  Peptide Sequence Number=SeqID_167983
atggcagatggatcatcaacaccagcaacaccttctgccaaagtttcagccatcttcatataccctattaaatcatgccgtgcaatttctgtttctcgtgctcctctcactcctactggatttcgatgggatagacaatggatggtggtgaattcccaagggaggatgtacactcaaagagttgaaccaaggcttgctttggttgaggttgaattgccatctgaggcatttcttgaaaactgggaacctacacaagactcctacatggtggtgaatgcacctgggatgcaacctctcaaaatatgtttgagccaacaagggaaggaggtagcaaatgctgtctcagtatgggaatggactggatctgccttggatgagggagctgaagcatcacagtggttctcagattatttaggaaaaccatgtcaactggtccgcttcaattcagaatcttcactgacagagcaaaacttaactactgaatttgtagtccctaattcccatgagagttatacttctgaagttcgaccagtggatcctgattacgtcaagggacaacatcagaccacatttactgatggttatccattcttactcgcgtctcaggaatcattggatgaactaaacgagcatctaaaggagcccgtttctattaaccgatttagacccaagtattga

SEQ ID NO: 51206 - DNA, 328 bp, Glycine max
  Peptide Sequence Number=SeqID_167984
gggcaactgtcataccctaatttcatcctggaactatcattcgctgatgttttgattctcgctaatcgaaaggtgttgttcgacaccaatttcagcacaaggcgtgagatcattcgacgttttggtcaaggatgcggaaaatacccaaggggagtagcaaaaggggaggctgaggaaggggttgggcattcagcattgagaggttttttgagagaaattaaagagaagaagaagaaaaaagagaaaaaggaggccaaggcgctaccaaattgcgactgtaatcaacttctacatcgctcttcattcggtgttcttcgttcctcacccg

SEQ ID NO: 51207 - DNA, 222 bp, Glycine max
  Peptide Sequence Number=SeqID_167985
atggtgaaaaagagggtaagttttgaattgcaaaaagtagcagttggactaagctcagcaattaagcgcttatccatcgctaagcgcagcttcaacgcacttagcgcaaaagagaatttggcagagcatcaacatcaaaaccgcgcgttaagcgtagaaggtgccatcagccaggctcagcgcaagactggcgctaagcccaattccacttacttgagctaa

SEQ ID NO: 51208 - DNA, 306 bp, Glycine max
  Peptide Sequence Number=SeqID_167986
atgtcattcttgaccccttcaagaaagacgttgttgttcctatacaacaaaaggtgttgttcgacaccagtttctgcacaagacatgagatcattcgacgttttggtcaaggatacggaaaatacccaaagggaggggcaaaagggtcatttcaagaaatttctagaccctggcttgcctgggcccccaaattgcttaaggctgaaggaaccagctcgcctgggcgagccaatttcttcaggactaagcatcagcttgcctgggcgagctaccacaatcccaaatgccctcatttcctataaatag

SEQ ID NO: 51209 - DNA, 183 bp, Glycine max
  Peptide Sequence Number=SeqID_167987
atgaaggcgggaatgatggctttggagatgccattggagtgggtcgttacaccaaacatcatcaaaaggcgtgctttgttgtggcagacttactctaacgcaacaaaagtggtttcctgccgaagtgctcaacatgaaagcttaagagagtggttttccagcatgaagaggacgtgtatttaa

SEQ ID NO: 51210 - DNA, 502 bp, Glycine max
  Peptide Sequence Number=SeqID_167988
atgcttcaaccatatgagatcagcataggcttaaaggagcactcaaacccggtgacccccaaggcctacactccgaagagtccgtcagggcctctccctcctgattcagcaacgtatttcttgtgttcgcacacaaatcctagaggcgggttgtggcttaagcttagcagtttggtccctcatatatttcaagggattgttgttcagtggatattcagatggatcaatcaaggcaaggatcatatgggaggtgacaagaaccacctttcatgttcagccaagactaagaagaaatcaatgctacctacttctaaggcatccctaatttcaacaccaaaaagttcaaagcctgcatcaaaaactcctaccaaaatagtgacacctgcttcttcaactagaaagggaacctctccatctttgactaggaggaaaattacttctagtggggagagcagaaaatttgctaacaaacctttggacatgtctttgaccttgcctccaa

SEQ ID NO: 51211 - DNA, 171 bp, Glycine max
  Peptide Sequence Number=SeqID_167989
atggctagaagtagaaggtctaacttccattgtccatgcattagccacaaggcacccaagcgcaagaccctctttcttttacggttctcgtctgccaacggcattgaagcaagcagtctttgtcctgtctatccagccggggaagagccaagtcccttagagaggggatga

SEQ ID NO: 51212 - DNA, 153 bp, Glycine max
  Peptide Sequence Number=SeqID_167990
atgggaatccgaaggggctcatggggatggggagtggaaagaggacgagaaatattggaatgtatatacaatgacaaatttgaatttgtcactcttgttgttgcttcttctgcaaagagaagttctaattacttgatactgcctcacacgtag

SEQ ID NO: 51213 - DNA, 291 bp, Glycine max
  Peptide Sequence Number=SeqID_167991
atggctacttcaatgaagctaaggcagtttgttctcttgctaattgttttcacattgcttgtagtgagttcagaagcaaggctagtccctgagttctcaacattgatcagcaaaaagattaataggaaacttggtttacgtgaattgatcaacaatgtacgaaatggtgatgagtggcaccaaaagaggtcaatgctaggtggaagtgacttgattgttgataacgagggatcagattgcactgtcataatcaagggttctaccttgttgattgagtatgatgtgaatgtg

SEQ ID NO: 51214 - DNA, 321 bp, Glycine max
  Peptide Sequence Number=SeqID_167992
atggaaattagactgagaacaaagatccaattttggaggttggcgaagaaggaggaggagatggacgttgctagagaggctaggagaaagtttggtgatgagagttctggtgacggtgccgaggtagtcataggcggtggccatggtgatgggctgggaggcgcggtgcttctgccgcaattggctcatcttcacacgcttaagtcatccatcacacacacgaggtggaagatgaaggttaaggagaagaaggagcgaaggggaatcaaaatcaggcatttcattgcgaccaaggtggaagatgcagaaaccctaccatag

SEQ ID NO: 51215 - DNA, 486 bp, Glycine max
  Peptide Sequence Number=SeqID_167993
atgatgtcaaagaaagcaggaggaaaatacatctccaactggcacagtataattgcagcctcattttccaggtcatcaaacttgacaagatcaaggactttgctacatatggcattgaagaaaaagcacaggagagttatggctaacctgactttgttaggcaaaatgtctcgtatgaccagtacgaaagatcaaagaaatgtagaagcaaagcttcatggtgaatcaaaggtgattcaaaggtgttttgatgataataatgatgatgacaaaggtgatgacaaaaagctcaaagatcaatcaaagaacaactcaagtgaatcaagaacaattcaagagttcaagaatcatgaagaattcaagactcaagaagaaagcctagaatcaagaatcaagattcaaggttcaagatctcaagaatcaagatcaagattcaagactcaagattccagaatgaagaaaagactcaatcaagataagtattaa

SEQ ID NO: 51216 - DNA, 672 bp, Glycine max
  Peptide Sequence Number=SeqID_167994
atggtgggaatggtggcggcggtgacggcagcggtggaggaaggagaggaatccgatagcctgagaattctcctgatcgtcgaggaacagatcctccgacatgcagaacgcgttgtggaggaaaatgacagcggcgtcgagcatgagaatcaaaatgaggacagatctgacgctggtgaggaaaaaaacgaagacggtgaagaggtagaggaaggtccaagaggcgaggaggccaatgtggaggatgagagagaaatgattagtgaatgttggacaaatgggctcaataacttaagaaggggagaagtttttgcggacacgaagggtggctttggaggactcgggtttcgagaacgtggagcggtctgcgagctccgaccaggggcgacattggtcgaggccgtggtggagggaggtggaaaggttgttgatgaaggcacagaaggtcaggttgttcgccggagccttgatggcgccgccgcctgcactggtggttcttgcagtggtttgggggttggagatggggaggacaggaggcgcagtggaggacatgatgcttattcaaagacggtcaaaatgaaaaaaccgtctttgtattaccaatacaactatgatggtctttgtcaacccatcgttgtactccttaaagtcattattgaaggtggttattaa

SEQ ID NO: 51217 - DNA, 363 bp, Glycine max
  Peptide Sequence Number=SeqID_167995
cctatccctcttaagttattgaggccgttgttccaacaagtggctcttatgttcaatggtgagggttatcattattggaaaatccgaatgcagatctttaaagaagccatagatttaaagatatgggaagccattaaatttgattcctttattcctacaatgaagaatgaaaaatctgacaagaagaatttcaaagagaagaaagaaaagaaaggatacatcacttgggaagataatgtcataaattcttcaagtgattcagagaataaaatcataagtctgggtatcatgatgaaagactatgaaaacggagaagagcaaagtcaatacattgatagcaatttctccaaacacatggcatga

SEQ ID NO: 51218 - DNA, 528 bp, Glycine max
  Peptide Sequence Number=SeqID_167996
tccttccccggagacatgccgcagccgttctccacggacaccgagatcagtggctacctcttcgacttcctcttcgcggcgcaggacgcatccacttcgtcacttctgtgggcggtggcgttgctcgaattgcacgcagagctgctcgcaaaggtcattggagtgaagctcgtggtccacatccacccatgccgtcctctgccagagagagaaaacgacaaagagaaagggagatacaaggcaacaatgagagaggaaaatgaaaggagagacaaggctgcaacttaccaatttactattacccctagggtcaaaagtgtcttggataaaattgtggaagatgggaggtattgtgttgtcacacatggtggcaatgatgagtatcaggtagacctagaaaagcaagagaaaagattcatgttgagagaccttcaggaacacaagaggctaagagatcaaacactctcaggtgttccacttgtaatgagtttgcacaaaactcttggatttgtcaaagggctccagtga

SEQ ID NO: 51219 - DNA, 846 bp, Glycine max
  Peptide Sequence Number=SeqID_167997
atggtgggagaaatgttggtggcgaaagctataagtttggagagtagtagaaaaatcctacagttatataatgatgagatagcttggaggttatgggaattggctagggttcttgatctagaagggagtcaccttaatggttttgttgggttgtgcgtagtatggaatctcaatggcaacaattgtgatctaatcaatatacactcatcttgctctttgaatgagctagaaaagaaaattgttggcagatttggtgatgtcaagatgaggatttggagacgattggaaaaaggttggcatgtggaggtgttcgatggtttgggtgctaatataaattctaaagtggaggagctggaggtggtgaatacaaggttgtgtgtgagggttgaagatgtaggagggaggaggttgattctttctaaagaattttggagattgttgaagaaatggcccaaaaatatagggtgggatggatttatgaggaagtacctccattgcacaaagatagtcatttcagaacgtgaggctcgtcgtggaccggcttgtcgaagccctaggcatgtgcaccaagatgagcaaaacgaggatgcagacattagtggaagagccttcgtgcctcatcgattactggatgcaagacacgctcagggaaatcaaggaggccaagctcgccggagacatgccgcagccgttctccaccaacaccgagatcagtggctacctcttcgacttcctcttcgcggcgcaagatgcatccacttcgtcacttctgtgggcagtggcgttgctcgaattgcacgcagagtgagggacatgacacttaggcggtggcacgtgaggtggtga

SEQ ID NO: 51220 - DNA, 234 bp, Glycine max
  Peptide Sequence Number=SeqID_167998
atgacaaaaaaagatgcaaagaagatggcggatagggtacctgggaatggccactttgatgacggcgacggaggacatcagtgtaggttttgggtgagagaagaggtagccgccataggatttgggagaagagattgtggcaacggaggggtttggttggagggttttgagcaactaagagagggaacaaaagtttttgaaggagctaggggaaggaatgaccagatagagtga

SEQ ID NO: 51221 - DNA, 168 bp, Glycine max
  Peptide Sequence Number=SeqID_167999
atgcaagccaaatcgccatgcacgctggcgatttcacgagggaaggggttgggcagacacaggggtgcaggaggcgcaggagttgcagagggaatcaccattgtgactagcgatttgcgcttcgggtatcgccactgctgctggcgatttgcgcttcgtgaattataa

SEQ ID NO: 51222 - DNA, 336 bp, Glycine max
  Peptide Sequence Number=SeqID_168000
atggtaggaacacaacatggcaaaagggaagatttggtgaaaatacaatcatcagtaacattgatacagcttgcatacggggcagattctgctgctgtggcaatcaccacgatagatcttgttagcaagagttttgtgggtaatgttgggtcctgcacaaagattaataggcccgtggacattatcacagttgtggggggtcaaggatactcattacctgcagatatacagtatcttgatgctagatgggatgttcttgttgtgcttcctctgcgtgattgttttgcccaagagatcaacatgctatgcccccttgatgggtttgtagtcctctaa

SEQ ID NO: 51223 - DNA, 219 bp, Glycine max
  Peptide Sequence Number=SeqID_168001
atgattggggatagaacaaagtataactccaacgatatcccagtgtttggggtcacgtgcaactccttgagtggagttaggtcaccctacgagactgtggtggcaactacagaatctccaagagaagcaatgacaaaaaaagatgcaaagaagatggcggatagggtacctgggaatggccactttgatgacggcgacggaggacatcagtgtaggtga

SEQ ID NO: 51224 - DNA, 429 bp, Glycine max
  Peptide Sequence Number=SeqID_168002
atggtgcctactaggcaccctctggacccagagaagtccaatagggccttggggttttcggctctgatcacaggcctatgtcagtcctacggagttcctgacatccccagcaaggccgctggcacaccgccaccacctcggcaggtcgactcggctgggccactgggcgtggagcgttatctacagcatttggttcaccagcaggtagccaaccaccatggacagcctcagtcagcaggggcagagttccaccccttttgtatgccctaccccagagcagtttgggctgaggtcgcattgcctggagactggcccgatgcccagacaggggaggagcctgcaggatcccccagaggggcggatgaatcccttatggatgaagatatgactgacctgctcggtttcttgggagggagtggggccacatga

SEQ ID NO: 51225 - DNA, 138 bp, Glycine max
  Peptide Sequence Number=SeqID_168003
atggttcctcataccttgttgcttgatctagcaattgttcttcatcaattcgaaggtggtcctggtggagggcctgattttggtcgtggttccggtggttatggttcaccttgcaattttggctgtcattggagttaa

SEQ ID NO: 51226 - DNA, 213 bp, Glycine max
  Peptide Sequence Number=SeqID_168004
atgattggggatagaacaaagtataactccaacgatatcccaggggtcacgtgcaactccttgagtggagctaggtcaccctacgagactgtggtggcaactacagaatctccaagagaagcaatgacaaaaaaagatgcaaagaagatggcggatagggtaccaggaaatggccactttgatgacggcgacggaggacatcagtgtaggtga

SEQ ID NO: 51227 - DNA, 1410 bp, Glycine max
  Peptide Sequence Number=SeqID_168005
atgccgagcgtggccgtgaaactctacagcgtcttcttcaagtttcttttaaagcaccgtttgcagaaccggatccaaggccggcccgaagactccgacccgttcggcgtcacgacccgacccgacgaatcggtggctccggccaacccgtcattctccgatggtgttgccactaaagacatccacatcgaccccttaacatctctctcgattagaattttccttccagattccgcgctcgaacctaattcccaacctagctccaaacccgaacctggatcggtgaaccacgaaacgtcgtcgttgcgcgcggtgaggcgcaacagctatgagccggcaatcttctcgccgcgggaggaggagcgacggaacagcggcggcgacagtggcggttgcggcggcgcttaccgggggtacgcgccgtcgccggcggggaatggtcgccggaaaaagttaccggtggttctgcagttccacggtggcgggtgggtgagcgggagcaacgattcggttgcgaacgacgtgttctgccggcgggtcgcgaggctctgcgaggcggtggtggtggcggtggggtaccggctggcgccggagaatcggtatccggccgcgttcgaggacgggctgaaggtgctgaattggctggcgaagcaggcaaatttggcggagtgcactaagtcaatgggggggaggaggaggttggagggtcagcacaagcatattgtggaaacctttggggcatcagtggttgagccttggttggctgctcatggaaatccatcaaggggtctctacactctactaaccattttggagccttgtctttctgggtcgcttttacttgctgttgtaatgctcagtttgttcttaatgtgtgttcttcttggcgtgagttgcggtgcaaatattgcagactatgtggctcgaaaagctgtagaaacaggcacacttttggaccctgtcaaggtagtggcacaggtcctgatgtatccattttttattggaagtgtgcctactcgttctgaaattaagttggcaaactcttacttttacgacaaggcaatgtgtatgctagcatggaaactattcctacctgaggaagagtttagcctagaccatccagccgccaatcccctagccccaggtcacggtcctcctttaaagaagatgcctccaacattgacagtagtggcagaacatgactggatgagggaccgcgccattgcttattcagaggagcttaggaaggtgaatgttgatgcacctgtttatgagtataaagatgcagtccatgaatttgcaacacttgacgtacttctcaaaagccctcaggcccaggtttgtgccgaggacattgccatctgggtcaagaaatatatttcgcttcgaggtcatgaattctcatattga

SEQ ID NO: 51228 - DNA, 879 bp, Glycine max
  Peptide Sequence Number=SeqID_168006
atggctaacaagtttgtggttagcagaggattggaaaaaaaaatggaccccgacctctgcaaagcaaccaatgtcatctttggccttgctctgggatacaagtctatcattattcctatttttgccattgcaatcagcatttttgtgagttttacttttgctgcaatgtatggcattgctatggctgcccttgggatgctgagcaccattgcgacagggttggctattgatgcctatgggccaatcagtgacaatgcaggaggtattgctgagatggcaggcatgagccattgtattcgtgagagaactgatgcccttgatgctgctggcaacactactgctgccatacgcaagaaagcagaattagggttttatatcgcgcatagtgtggtagcagcagctgagcttgtttccgttgccgcttcacccaccgtagcaaccatgatcattcccgagaagaaccgtaaagagatatgcaaatacctcttccaaggtgattcggcagtgaccgtgatggataccgtggtggtccacgcaggcctcatttttcaggtcgttgcccggaagcaacgcgctgtatggctcgagtacagtgtcaaaagagcaagggccgctgcatcgccgcccggatgtagtgaaaagaggattcgctttggtacatggaatataggcacacttactggaaaatctatggaaatagtggatgttatggtgatgaggaagatcaattttatgtgcctacaagaaactaagtggacaagtgaaaaagcgaaagaattagacaactcgggatttaagctgtggtatacgggaaaaatcagatcaagaaatggggtagggattattgtggacaaggagtggaagaaggatgtcgtggat

SEQ ID NO: 51229 - DNA, 222 bp, Glycine max
  Peptide Sequence Number=SeqID_168007
atggaaaggatccaaaagtccccttctagtgacaactccaaagggtggtttcatgtaactttactagcttctagagatatcatcctcttagcgacaatgcatcaccaaaagaggaaaactctagatgaggcttcactattattaagcgagtcggagacccagcatgaccacagatcgacctccactccttatggctcacatataccggggtatagggcctaa

SEQ ID NO: 51230 - DNA, 318 bp, Glycine max
  Peptide Sequence Number=SeqID_168008
atggtggagaagacaaagggtagaaaggaggaggtggttactctgaagtacaccattaacctagctccacaagcgcctccatggctggggcgtaaccaaggaagagtcacggaagctttgacatacatgacaagtcctcaacattgttcagctggtggtgatgatagacaacatgttgatagagtggccaaaggcaacatcaaaggtggtgtgaagggcacatgcgttctccttcacataaggggtaatgttgtttgtgataagttattcaaaattagaattggaaatttaaaaattcactattttgttaaaggctaa

SEQ ID NO: 51231 - DNA, 177 bp, Glycine max
  Peptide Sequence Number=SeqID_168009
atggttgtgcaatgcttgtttctgctgtcacgggaaagtgttgagaggaacgaggagaagggttatgtacgcttgcgtgagctaaatttaaaggtgggcaactggggatggtgtgcttatgcctgggcttgtggaagtgggatatttgttttgcgccatcgcccgatcgccacctag

SEQ ID NO: 51232 - DNA, 2610 bp, Glycine max
  Peptide Sequence Number=SeqID_168010
atgagaacaggaagctgcgccgtgcaacagggtctaaccccagaggccgcgagcatagtgaagcaagcggtgacgcttgcgaagcgtcgcggccacgcgcaggtgacgcccctccacgtggcgaacaccatgctttccatcaccaacgggcttctgagaacagcttgtctccaatcccactctcaccctctccagtgcaaggccttggagctttgcttcaacgttgccctaaatcgcttaccggcttcgacttcttcgagtcccatgttgcaaggctctcaccaccaccactctcacgcgtgcccctctatctcaaacgcccttgttgcagctttcaaacgcgctcaagcacaccaacgacgtggatctgttgagaatcagcaacagcctctcttggcagtgaaaattgaactcgagcaactcattatttcgatcttggatgaccctagtgttagccgagtcatgagagaagctgatttcaatagcacacaagttaaaagcaacgttgaacaagcggtttctttggaaatatgctctcagaataatggtagtggtaataacaataacaacaataataataaggcagaggaaaataatagtagtagtggagagaaagggttggtgttggatcctattagggttgaggatgttgctagtgttattgaaaatttggggtgtgagagaaagagaagtgttgtgattgtgggagagtgtgttactagccttgaaggtgtagttaggggagtgatggaaaagattgataaaggggatgttggtgatgagtgtactctcaggggtgtcaagtttatctctctttctctttcttcttttgggaatgtttcaagagtggaggtggagcaaaaggtggaggagcttaggggtcttgtgaaggcaagtgaacatagcaaagggtatgttttgtatttgggggatctcaagtgggtgttagattttagggctagcggatcacaaggcagagggtgttattgtcctgtggatcacatggttggggagattgggaagcttgtgaatgggactgaagagaatggtggaaggttttgggttatgggtgttgccacttttcaagcttacatgagatgcaaaaatggccagccatcgttggagactctttggtgtcttcatcctatcactattcctgctggaagcttgcgcttgagtctcatcactgacagtggtctacaagaccagcccacaaacaagaaagctgacaacagaactagctggctcttacttgaaggagtgggggatgatcagaaacaacaagcttgcttcgcggaaccttccacaaagaatgagaccatcaccgaagttcgaagcttgcaaagcagtagtacttgtaatagtgactcctcaagttcaacccttcctgcatggctccaacagtacaaaaatgagaataaaggaatcaactataatgatcagaactctgtcccagtgggagagctttgcaaaaagtggaaatttatgtgtagttcaatccaaaagcaaccttatccttccgacaaaaccatcacattatcctcggtgtcaccttcttcatcaacctcaaacttctcatacggacaacaacatcctaatttgcaccaaacccataacgagtggcaagtggctgaaccacccaaagattcattaaacaaccaccatttctggatctccaacaatggttccaacaacaccaatgaacccactttgagagtgtacattccagagaacaataagcaaccattctcatcaccaaatccaagttctaaccctaattccacttcttccagtgacatcatggaagtggaacacgtgagcaagttcaaagagttaaactcggagaatcttaaaaccttatgcaatgctttggagaaaaaattgccgtggcagaaagacataatacccgaaattgcgagcacccttttgcaatgccgttctggcatggtgagaagaaaagggaaagtgatgataaacagtgaagaagtgaaagaagaaacgtggttgttcttccaaggtgttgatgttgaagccaaggagaaaatagcaagagaattggctcggcttgttttcgggtcccaaaaccacgtcgtttcgattgcacttagcacttttgcttcaacaagagcagattctactgaggattatagcaggaacaaaagatcaagagaagaaacaagttgcagttacattgaaaggttcgtagaagcaatggcttctaaccctcatagggtgtttcttgttgaagatatagagcaagcagattattgttctcaacttggtttcaaaagggccattgagaggggaagagtggtggattcaaaaggtgaagaggttgcacttcgtgatgctatcatcattctaagctgtgaaagtatcagttctaggtcaagggcttgttctccctcggtcaaacaaaaatcgttaaccgaggtagaaatgaatggcgacattaataatgccactttggaggagacaagcccttttgtttctttggatttgaatatttccattgatgatgaaaacaatgttgaggataggtcagaggatgaaattgggcttcttgaatcggtagacggaaaagttatcttcaactttgaggaattgtga

SEQ ID NO: 51233 - DNA, 420 bp, Glycine max
  Peptide Sequence Number=SeqID_168011
gatgatgacgagtgtagtagtgatggaagcaccaagaaaggccctctagcgaaggtgttgtggtatctttcgatcattcagaggttcaagagtagtctgtttgctaatctagatgacgcaaaagaccttacatggcatgcaaatgggagaaattatgatggaatgctctgtcatcctgttgattcctctcagtggaagaagattaatagtcattatcctgaattcgacaaagaggcaagaaatcttaggcttggactgaccaatgatggaatgaatctacaaccaggaaatgacattgatgtttatctcagtcccttgattgaagacttgacaaagttatgggacaagagggttattgtgcttgatggggccattgtgcatgccctatctatgaagaagacacgagctaagtacaactga

SEQ ID NO: 51234 - DNA, 162 bp, Glycine max
  Peptide Sequence Number=SeqID_168012
atgtacttggagattgttcttggttgtgtagttctggaatttggagctagaagtggatatttgactgcttcacatgcaagggcaattgctccttcaggacttgtctatacgtttgatttccatgaacaaagggcttcatcggctagatataaggacatttaa

SEQ ID NO: 51235 - DNA, 165 bp, Glycine max
  Peptide Sequence Number=SeqID_168013
atggatctttatattgggaagattgttcaagaactgcatgcaataagagggatgcgcattagaggggtggaaatagacaacgctaagagtatctggaatatgatcgaaccaaattcagaaagtttacacgagactgatcatatgaagtctgccgatggaaactag

SEQ ID NO: 51236 - DNA, 207 bp, Glycine max
  Peptide Sequence Number=SeqID_168014
catgcaacatcaaaggaggctggcggggttggtgcacaaccaaatcgaatggttaaggggtggcacagcgatggtaaaggtcgtaatgccaaagggatcattactgtcgggcatagagggggaggggctataattggagataccattgtttctggtacagaagttcctataaaaatgaaaaatgtcctacatttgagtgcagtttga

SEQ ID NO: 51237 - DNA, 225 bp, Glycine max
  Peptide Sequence Number=SeqID_168015
atggccaccaccacaaccaccatgattatcgtcaccattactatccaccaccactaccaccgccctatgatcatcgtcaccaacatgatcactgttgttgtcactgccaccaccatcggcgatagtgttggcatggcaacagcaacaatcatgttgatggcgacgatggtggtcatgacggcgatcatagtggaggttgttgtggtgacgacaattttgacataa

SEQ ID NO: 51238 - DNA, 609 bp, Glycine max
  Peptide Sequence Number=SeqID_168016
atggatcactccattttttacctttaccttcttgtttcatcttttttttttattttccctttgtttctgaatgttgtctatgccagtaaaaagtgctacattgtatacttgggagctcattctcatggcccaaccccttcatctattgacctagaaactgccacacattttcattatgattttctgggttcaatcttgggaagccatgaaaaggccaaagaagcaattatttattcatataataaacaaatcaatggctttgcggcagcatttgaagaggaagaagctgcagatattgcagaaaacccaaacacggtatcagtgttcttgagcaaagagcataaactgcacactactcggtcatgggagtttcttggactgcaaagaaatggtaggaacacaacatggcaaaagggaagatttggtgaaaatacaatcatcagtaacattgatacaaattctgctgctgtggcaatcaccacgacagatcttgttagcaagagtgtggcaattgagtctctggttggaggaactaagctcaaagttgggggaatggctaaaggttctggaatgatccggtttaacaatccattccttgaattaaactag

SEQ ID NO: 51239 - DNA, 225 bp, Glycine max
  Peptide Sequence Number=SeqID_168017
atgacaaaaaaagatgcaaagaagatggcggatagggtacctgggaatggccactttgatgacgacgacggaggacaacagtgtaggttgcaggtgaaccatacgagggttgaggttagaggaaaattagtgtcgagaataaagggggaggttttgggtgagagaagaggtagccgccataggatttgggagaagagattgtggcaacagaggggtttggtttga

SEQ ID NO: 51240 - DNA, 3066 bp, Glycine max
  Peptide Sequence Number=SeqID_168018
atggccactgagtctagttttgtgcaagcagccatcccatgctttgatggtcactatgaccattggagtatgctcatgcaaaatttcttacgatcaaaagaattttggtcagttattgaatcagggattcaagaatcaccacgtgcacagcttcaagccttgaggagagattttgagacactggctatgaaggatggagaatctgtgaccaattattttgcaagaacaatggagattagtaacaagatgtggttccatggcgaaaagatgacagatgtcactattgttgagaagattttgcgctccctaacaacaaatttcaattatgttgtttgctcaattgaagaatcaaaagagatagatgtgctgtctattgatgaattgccaagctccttgttggttcatgagcagaaaatgcacagaagctctaccacagaggagcgagcactgaaggcctctaccgctaccaatacttattcctccgatttcagaggaaggggaagggggagaggtagaggtaggggtagaggaagaggagaatgtggaagcagagaagataacaagaatcccagagctaatactacaagcaaaggcagaggacaatactctgacagatccaagctagagtgctttagatgtcataaatttggccactatgcttctgaatgctattctaggctgcctaatgatagagaaaagggggagagttcaaattttactgaaaataaggaagttgaaactctacatatggttattcaagaaggaagaaaaactgagtcaggtatatggtatgtggatacaggttgcagtaaccacatgagtggattaatgggaaaaggtgatgtcaagataaaaaccaagaatggctttgtggaaacaacctcaaatgtgttgtatgctcctgatttaaaaagcaatttattaagcgcgggtcaattacatgagaaatgttatgtcattacaattcagaagggagcatgtgaaatttatgatcctgttagaggtgccatcgcaattgttcaaatgagttcaaacagattgttcccattgaaaattgaaagtattcagacttgcttcaagactgacatggtagatccatcatggttgtggcactttcgttatggtcacttgaattttagtggactaaagaccctgcaacagaaaaacatggtgacaggccttcctcaaattactattccttcccaagtttgtgaagaatgtgttgttggcaaacaacatcgatctcaatttcccaaaggaaagtcatggagagcaaaagatgtcttggaactggaaaaatcagaagcgttttctacatttaaaagcttcaaagcaagtgttgaaaatgaagcaggaaagtctataaagactcttcgcacagatcgaggtgatgaatattgctccaaagaatttgaaattttttgtgcagaacatggcattcgaagagagcttacaactgcatatgcaccacaacaaaatgtaaattggagcattcatgttttgaatagaagtccaaccttttctattcaaaatatgacaccagaagaagcttggaaagggaggaggccaacggtagatcatttcagaatctttggatgcatagcatatgctcatgtaccagagaagattgtgaccagtagggatgttgtttttgatgaagaaaacacttgggaatgggaaaggcagcaacctagtcaagtcatttacgacaacgatactgaacacgagcaaatatcagcaccttacatgcccgaaaactccacaaattcaactcctatagcaactgtaacttcaccaacaaccactagcatcaacgaagaagaagctcaatctcattctcgtgttagaagaaggccagtgtggatgaaagattacgaggtaactggaattcaaaatccaattactcactttgctttgtttgtagattgcgatcctacaacttttgatagtgctgtcaaagaagaaaaatggcgcaaagccatgaacgatgagattgatgctattgaaagaaatgacacatgggagctgtgtgatcttccaagaggacaaaaaacaattggtgtgaaatgggtcttcaaaacaaagttgaatgagaacggtgaagttgacaagtacaaggctcgtttggttgctaagggatacaagcaacaatatgggactgattacacagaactcgatgtcaaatccgcattcttgcatggatacttggaagaacaggtatatgttaatcaaccccctagttatgttaagattggaactgaggaaaaagtttacaaattgaagaaagccctttatggactaaaacaagcccctcaggcttgggatgaagggaaaattctcatcgtttgcttatatgttgatgaccttatttttactggaaattgtgatgccatgtttaaagaatttaggaagtctatgatggatgagtttggaatgtctgatcttggactgatgcattattttcttggcatagaagtggtacaatcaaatgctggtatttttatttctcaaaagaaatatgtgggagaaatcttggacagattccacatgcagaattgcaattctgcaataactccagcagcatttggttgcaagttgcacaaagatcatgaagggaaaaaggttgacaacacatttttcaaacaaattgttggcagtttgatgtatctaactgcaacaagaccagacataatgtattatgtgagcttagttagcaggtacatggagtatcctacagaagaacatttgctagctgccaaaagaatccttcgttacttgcaaggaacaagagatttcggcacaaaagctgaatttgttgctacaactgcttgcgcttgtcaggcaatatggctaagaagaattttagaggaattgagcaagcatattgacgtgagatactatttcttgcgtgaactaacaaaggagaaaattgttgagcttattcactgcaaaagtgaagatcaagtagctgatttgttcacaaagcctctcaaattagcgtcattccagaaacttagagccttgcttggagtatgcacaatggaagaagccgtgcaagggacttga

SEQ ID NO: 51241 - DNA, 289 bp, Glycine max
  Peptide Sequence Number=SeqID_168019
atgatgatatccactgccaaaggtgcacagtcttacagtgacattagaacagtcaatggtgtggtatatggtacatttaaggaaacatgttttgcaaaaggctttctaggtagtgatcaagaatttattagtgctttacaagaagctaataattggggtactgcacactacctaagaaaattatttgtcaaaattttatttatgaacaccatggacagaccagaatatgtttggcaacagacatggcaatggatggcagatgatatcacattcgatcatagaaaacaag

SEQ ID NO: 51242 - DNA, 534 bp, Glycine max
  Peptide Sequence Number=SeqID_168020
atggacatcatcagatttacagcaccattccgtgttcaaaagaaccttctgcaagttccatactcttatcataggcaatggatgcgcaattacctaaaatatgttctattccactttgatggcaacaaacatttcatccgagtaaggacacatcatagcaaatgtttcattgctgatggtttaaatgaatttagaaaggcacacaatctaaatgagagtgtcattttgcgtttcgttgctgtggacaaaaatactaccttcacgatacttcccgcagcagcttccagatttgtctatggttcaaagaaaagtattaccatacagcgcgaccttccaaaatgcacccagtggcacatcaccatccacaatgacatcccagcaattgcaaaaccatggttcaactttattcatgaaaaaaaattgatacccggagatgcggtagccttctactaccgttttgacgaacatgcatgggaattgctcatcagaaaagatattgaatgggacaacaacgagatcaacttcgacgactga

SEQ ID NO: 51243 - DNA, 802 bp, Glycine max
  Peptide Sequence Number=SeqID_168021
gtcgactctagaggatcccaccttaaatggaggcatcacagaaatagtgagtgctttaggtcatggaaaagaaattgtaggaactgatgttaccagtacctatcctgaaactttaaaagcaacagccaaagatctgggacatgtagcaaaagctattggcaatacagattatcagaaactgaatgataaaatcgatgcggatctgaaacaggttcagccgattgctaaaaaacctaaagtactgtttatttatgcaagaggaaatatgctgatggtttccggtacgaagacaccaatggatgctttgatcggtcttgcaggcggacaaaatgcagttacggaatttgaagatttcaaaccgctgacccctgaggctgtagtaaaagcgaatccggatgtattattctttttctcatcaggcttacagggtgcaggaggaaacgaaggagcgcttaaaatgccaggtgtttctcaaacaaatgccggcaagaataaaaagatcattgctatggacggaggacttgtttcaggattcggaccaagattaggagaggctgcagttgtaaaaggaaatggaaatatatcgcctagcgatacatacgtgatatgggatgtccgtgctgcgagaatcgttatggcaatcttaattggaagcatgctggcggtgtccggaacaggattgcagggactttttaagaatcctttggcgacgggggatctaataggacttacttcgggagcaacattacttgcagccattgctattgttttaggaggacatttcaaacagtatcttcctgag

SEQ ID NO: 51244 - DNA, 426 bp, Glycine max
  Peptide Sequence Number=SeqID_168022
atgcccatttttgtgttgaaaaaggaaaacgaaaataatcagttgtgcatctctgttttctactatattaaaaggcaaaatgaacagcgttgtgaacaagaaattgaagatattaagcgaggtgttaggtctggaaacatcacgcctgatacttcggcaattagattctctgatgaagcgcttgatgagcaaaagcatagcatcagggttgctgatgaaaaagtagccttggctgtccaggcttatgatttggtagatacaaacatacaacaacttgatcagtatctgaaaaagtttgatgaggagattcggcgtgaaagagaaaacgctgcaataactggagtacctgcttcaggtcctgaaggtaatacaaaatctggaaggggtaatgaaagtggtactggtagaggagggcgaaaaaactaa

SEQ ID NO: 51245 - DNA, 723 bp, Glycine max
  Peptide Sequence Number=SeqID_168023
atggagctacatcagctagtgcaaatgaaggggacgttctatccagaactagtcaaggtattctacacatgtactcgtgctgaccttgaaggtaatattttctctactattaatggagtagatatgttcatacatgttgttgtgtggaaggaagttgttggtctggacatgggtagagtccacaagtttgatgaaactacaaatggctaccacaagatgcaaaactacaaaggaatgcttcttgatcctacaaggagattgagaaatcgccttagagttggtggattaactgttgaagataggatgctggtttacctcatcacttacattctcacaccaagattcattgattattttaaggttgatttttctaatgagattgtagattacactaaagactctagtgagataactgaaaggcatctcaagaagcttggtatgaggtatgttgatcatgaatggataatggctagaaagcttgttgctggaaacattgaagaaatggaagaagatgataaagatgaagctcaacatgagcctacacctcaatggagtctttttgaatccctcatgattcagaagatggatgtcgtgcttcacctctatcaagagcacttagacgaagttcatagttccttagagaatattaattctaggctggaaaacttagaaactaggctcagccttagcaaccttcataaccataatgaggatgatgcttag

SEQ ID NO: 51246 - DNA, 621 bp, Glycine max
  Peptide Sequence Number=SeqID_168024
atgatgacatggggtccttcagggaatgtggtctattcttcttttgccttcaaatggctcaaagccaagaatccatcgtctaattccgctcaaagtgtgaattggtcctgggtttggagtctaaagttaccggaaaatattcttcattttctttggctcacatttcatgagagccttcctactattcaggtttggaggttcttgaggctggataccaatgtggccttctactctggggatctacaacactggctcacggacaacattaaatcaacacgtggaatgttgtttactgcaacgtgctgggtgatatggaagacgtgcaatgcattcattttcggagctaatacttggagcttatggagcattattaatcaaattcaaaaccttcacatggacatcattaaggtcattgcggcaaatcaactagtcacaaagctggagctttctgctatacttcatggactacaaaaagcatgggataatgaccacagatcctttggctatgaaactgattctaagatatgcttggagttagctactaatactttggaaccacatatatcatcctcatttgcccatcatcagcaaaattcaagaccttctagctcaagattgtaa

SEQ ID NO: 51247 - DNA, 744 bp, Glycine max
  Peptide Sequence Number=SeqID_168025
atgtctttgggatcatcggctactgttttcggtgttgcaatgttgcttgcctttgcacttatgacaatgccaatgtgcatggcagacacagaacccataaatatagttgagttgtacatgcatgacattcttggtggcagtaacccaacagcacgcccggtgacagggttactaggcagcatatacagtggccaagtgccatttgccaccccagtaggattcaataccccacaaggtggaattcccatccccaatgccaatggtgccattcctaaagtgaatggtgtcactggaattccattaggcaccggtttggccggcaccacctttgcaccaaacaacaacaaccaaaacaatgcacagttagagatagggcctgatgggttggggcttggttttggcacaatcactgtgattgatgatgtgttgacctctcaaattgagttggggtcacaagtagttgggaaggctcaaggggtgtatgtagcaagttcttcagatgggactaggcagatgatggcattcacagcgcttttcgaagaaggcgagtatggtgatagcttgaacttctatggcttgtacaagataggaagcagcatgtcacagttgtctgttttagggggcacagggaagttcaagaatgcaaaggggtttgctgagctgagacctcttatcccaccagggcaagtctccactgatggtgctgagacactgctcaggatcactgtccatttgaactactaa

SEQ ID NO: 51248 - DNA, 570 bp, Glycine max
  Peptide Sequence Number=SeqID_168026
atggattgtgctactcaaatgaggtctaggaaaaggatgtgggaaaatgttagaaatatggaatctattttgccacttgattataagaagggtccaggtcgacccaagaaattaaggagaagggaactcgatgaggttcccaatcctaccaaactaaagggaaaaaacaacatagtaccaatggagtgtgatttgcctcctcctccacctccttctccagttgctaaggaagttgccaataaagacaacacttgggaaaacaacaaatcacaacaagttgagaatgatgtgcataataacatggtaaatgagcaaaatgctagaaaggtacagaaaagaaaaactccatcacaattaaaaaaggcaaaaccaactcctcctgtcaagaaaacaaaatcaactcctcctatcaagaatgcaaaatcagctatttgtcaagaatgcaaaagcagcaggatccacaaaatacacgtgacatccaacatggtactgcgagacacgtgccaaccctccacgtcagtcctgcaacatgagcacggacacccagcccttagcaattgggatccctaa

SEQ ID NO: 51249 - DNA, 381 bp, Glycine max
  Peptide Sequence Number=SeqID_168027
atggcagtggataaaaaggaagtgcagaaacttctctttttgtttctcagtggttgtgtaacactgaactatgcattaatactgatacgtgatgctgaggggtttgtagggggcatcatcgctggtgcgtatttgcagggtgtatgcatgatcaaagtggtgattaaatccccgagactaagctttgtgttcacatggctcacgagaaacgacacaactttgatgctgttggcttgcttggaaattgatgttgtgatatatggtcattttggggctggacttcgtggaggccgatgtgggacttggattttttccaatacacacccagcacttcttgggcttgctgcgtggataacaatggtgggtggtcctttggattaa

SEQ ID NO: 51250 - DNA, 465 bp, Glycine max
  Peptide Sequence Number=SeqID_168028
atgggaggacactcagatatgcatgctacttatcataaattgcatgttgtgctattttggaaaggcatgtggaaggatgtaaaggagtacattagacattatgatgtttgtcaacgatacaaatatgaaaatatgtcatcccttggattattacaacccttgcctaagcctcagggtattttttttcctgatattaccatggatttcattgaaggattgcctaaatccaatggtagctctgtaatttttgtggttgttgataggatgatcaaatatgcccattttatgcctttttcccatccttataatgctgccacagtagctagggctttcttagataatgtctataagctacatgattttccttctagcatacttagtgatagagatgttgtatttgtgagattacaaggggtatcattaagggcttccacagtgtatcgtccacagatggatggacaataa

SEQ ID NO: 51251 - DNA, 603 bp, Glycine max
  Peptide Sequence Number=SeqID_168029
atggtggccgctccctcgcctcgcaaagagaacgtgtacatggcgaagctcgccgagcaggacgagcactatgaagagatggtggagttcatggggaagtataatcatttgggccaaacaatagagcttcacgcagacgtcacgaatgggccagaactagtttcagcgccccaagttaaacgtctcattcgcaccgggtctacatcaactttattccacttatgccttctacccacaacccgccccgacccaccacaacatcatcttcctcacccagttcccgctatagaagccttactccaccattaccaacatatcttccagacaccgcccacccttccctccccccccccccccaagagaagtaactcatcgtatcaatctccttccttcgacttccccggtgaacatacggccctacaggtacctgcacttctagaaaaccgagatagaaaggcaagtctccgatctcctttcagttggcctgatacgaccaagcacgagcccgtattcctccccaattcttctggtaaagaagaaggacgacacttggcggatgtgcgtgaactagatgttggcctttatgtgcatagtattacgtaa

SEQ ID NO: 51252 - DNA, 357 bp, Glycine max
  Peptide Sequence Number=SeqID_168030
atggttgattcaacggatgactcctcaaccatgaagaaattgagaaaaatgaataaacaaaagagtgatcttaatcacttacttagtgtgcaaaggcatactaccgataagaccagtttggggtataacaagaaaattgaccttcctaagaaaaccaagttcgcacccctcaaaaaggtgtgcctagaagcaaaatactcactatggtacttggataatggttgctttaggcatatgaccggcgacaagtccaaacttactgaccttgtgttaaggaaatgtggatatgtcgcttatggagataacactaagattagaattatgagagaaggaaacataacacaagactcaaaataa

SEQ ID NO: 51253 - DNA, 240 bp, Glycine max
  Peptide Sequence Number=SeqID_168031
cgttcgcgcttcgtttcttcttatgacgacaccgtttccgaagaaggctccgatcgtgaatttcaacctccctcactaccgaatgcttcccctattgataacaccgatgagtggaagcggaaatttactatgctcttgagggacaagagtaagcaagagttggtctcgagggagaaaaaggataggcgtgattttgaccgaatagcagttctagcaagcagaatggggttgtataggtga

SEQ ID NO: 51254 - DNA, 300 bp, Glycine max
  Peptide Sequence Number=SeqID_168032
atggctagtaacccatcaagagttcaaaaaaaggaaaatcccaagcagccatcaatcgcttggacacttggttcactgatgaaggaaataagaggtttcaattttcccaacctgctaaaagttcaagggctaactaagcaagtgcagatgaaagggactttctacctagaactggtcaaagttttctacacatttactcgtgctggccttgaaggaaatctcttctcaactgtaaatggagtagacatggagatagatgttattgtgtggaaggaagttgctagtctagtcatgggtgaa

SEQ ID NO: 51255 - DNA, 285 bp, Glycine max
  Peptide Sequence Number=SeqID_168033
atgaggtatgccaaccatgaatggataattcctagagagcctaccgcgagaaacattgatgagatggaagaggatgatggagctggagctcaacatgagcttgcacctcaatggagtccttttgaatctctcatgattcagaagatggatgccatgcttcacctccatcaagagcacttagtcaaagtacatatctccttagagaatatcaatactaggttgaaaaacagagaaactaagctcagccttaggaaccttcctaaactcaacaaggacgatgcttag

SEQ ID NO: 51256 - DNA, 204 bp, Glycine max
  Peptide Sequence Number=SeqID_168034
atgaggggtcggtgtgcgatgtatccatatctagaaatcactctcgattgtcatccacatgattttgtaagatcaccaagacctaggaggattggtggtagtgattgggcccaatggatcagaggactcacccttgcaaccaccaatttcaagggaagatcatggagctatcgctattgctacacgatgaaggaagaagcataa

SEQ ID NO: 51257 - DNA, 285 bp, Glycine max
  Peptide Sequence Number=SeqID_168035
atggctggtattttttttctgaaaaagaaaaatagtttggagttcttcgggcacaatgtcaacgggaggcctactagatctaccttccaccaggacacgattgttgaagtttacgaggatgcgggagatttcagtgatgatgaggatctcacgctatctaagattgcctactaccgagatgttattgatgaagagatacttgagggagagatgctttcatccgacgaggaacatgattcctcaggagacgagagtgacccttccaaagatatgacatcgtcctag

SEQ ID NO: 51258 - DNA, 258 bp, Glycine max
  Peptide Sequence Number=SeqID_168036
atgaaggttcaggagttgtttacgcacggggaaggtattagcaccccacgcacccgtcacaagggacgacaacctctaatcgagtgtgcaaaacatgacttcaaaattatacctttggacctcagaacctctttccccagcctcccttcacgcctatttatagcaaaacaaggcatttgggatgaaggtagctcgcccaggcgagctggttacttcaccatgaagttattttggtggcccaggcgagccagaggctag

SEQ ID NO: 51259 - DNA, 336 bp, Glycine max
  Peptide Sequence Number=SeqID_168037
atggctcaactgatttctgatgccatctactgtttgcaaggattgtgcccacaagacactcaatcgacccagagaaagtgcttgttgcccccagcaaggtcatcaggccccctattaaatagggtctccatcgagaagtactgcgcccccaggcaggtgcagggcgaggcaccacagcagcctggggacgaccagcagcgggcgacagatgcaccaccaccacttccagagtccacctcagctcatttacaaaggctggagcgttgcctacaacacatggccgaccagcaggcggccaaccaccggggcaggtacgagcagatactaggctcgtga

SEQ ID NO: 51260 - DNA, 195 bp, Glycine max
  Peptide Sequence Number=SeqID_168038
atggctgaagtagacaaggtgcaagtgcggatgaaggccgacatggaggccatgaaagaacagatggccacaatggtggaggccatgatgagcatgaagaagataatggagcgacctgtgctcctaagtttttcgacttccaagactattcaatcagaaattactcgtgctacacatttggtgagggtgccgtaa

SEQ ID NO: 51261 - DNA, 195 bp, Glycine max
  Peptide Sequence Number=SeqID_168039
atgttagctactggtaatcgattactgccttctggtaatcaattaccagagagtaaaactcttggtgttgagggaagaagcccagagtatcaagaacctctggatttgaggtcaaatcctttccaagggggatgggatgatgcaatcctacaccccaagggtattagattgaagactccaagagtattgggctag

SEQ ID NO: 51262 - DNA, 801 bp, Glycine max
  Peptide Sequence Number=SeqID_168040
atgggtcaacttcaacggcaagccttccgcaaagcctatggtaagatttgggacctagctagggtagaagtctccacagagtccattgcctcccttgcccagtattatgatcatccgttgaggtgcttcacttttggggacttccaactatcacccatggtggaagaattcgaagaaatcctaggatgtcctctagggggaaggaaaccatacctcttctcagggttctatccctcattagctagaatttctaaaatagtccaaatctcggcgcaggaattagaccaccaaaagcaagtcgaaaatggggtggtcgggataccgagaaaatgtttggaggcaaaagcaagaatcttggcaggtagaagcgaatgggccccgttcatagacgttctcgcactgttgatctttggaggagtcctctttccgaatgtggatgggttggtggacctggcagcgatcgacgcttttctcgcctatcataaccacaaggaaagcccggttgacgctattttggccgacctgtatgacacgttcgaccgaagatatgaaaagagcggcgcaagaattgtttgttgtacaccggctctctatgtgtggctggtttcgcacctttttctccaagaaggtaggcccgtctatccgctacaaggtcaccgctcgtgcatcgaaaaaggaaaggcgaattgggaccaactcttggctagcatggaggggcgtctgttaattggttccctcgctagaaggaaggaagaatcaggattctatcttcatgcgaaggatgtccaaatgttcccttga

SEQ ID NO: 51263 - DNA, 630 bp, Glycine max
  Peptide Sequence Number=SeqID_168041
atggcgacggaactcgaacaattggctgaaaaacaccgtcgccaccacacagaagctgcagtaggcgatggacagcgcatgctggggctggtcggcgccgggcagccacaggccttcgggccggtaacggaaagcagcgtaggcaaaaccggctgccaggagcgcggcgcaaagaatgtagagcctttccctgagccagcaccacaggatcaggctcatcagcgtgatggccagggccgagcccatgtacgcgtaaagcagcatggcggccggcgccatgcttctgccgggaaagaccgcaatgccctgggctgcctgggggttgggcagcaagcgggtgagcagtgccagaagcgctgcggctgccagggcttgcgccagccatcgcattgcagaatccgttggccagtgcctccggcggccttcggtgggattgtcttgggtgtggatcaaggggccgattggttgatgtggcgagcgcccatgcatgcccgacgtcagggtcagtgcatgggcgtgcacgtttgcgggaggcattgtgcaccggccgccgttgcgggaaagcgctgccgggtgtctgcggatgcctgccgggtgccccaatgcaacaggccgccccactgcggataa

SEQ ID NO: 51264 - DNA, 785 bp, Glycine max
  Peptide Sequence Number=SeqID_168042
atgggagctgggagggcgtcagtcgacgttggagcccagctgcatgtccttgtacttcacgatgtgcgtgcccttgaccaggcggtagccgccccagatcagcaggaacaacggcaggccgatataggtggcgaccacgccggtccagtcgatgcggtctgccatgaaggcctcgtagttctggcccagcgtgatcaccatgcacagcacgaaggcgaagatggggccgaacgggaaccacgatgcacggtagggcagccggttcaggtccaggccctgggcctcgtagcccttgcggaagcggtagtggctgatggcgatgcccagccaggcgatgaagcccgtcatgcccgacagattcagcagccagatgtagaccagctgggggctgaagatgttggtcagaaagcacagcgcagccacgaccgtggtggccagcagggccatcgtgggcacgccgcgcttgttgacgtacgagaacatgcgcggcgccatgcgctggcaggccagcgtatagagcatgcgcgtggaggcgtacatgcccgagttgccggccgacagcaccgaggtcagcaccacggcgttcatcacggcggcggccgacagcaggcccgcgcgctcgaagaccagggtgaaggggctcacgctgatgtcgcccaggtcgttcttgagcagttgcggatcggtgtaggggatcagcaggctgatgaccaggatggccaggacgtagaacagcaaaatgcgccagaacacctggcgcacggcgcggggcacgttcttggcgg

SEQ ID NO: 51265 - DNA, 355 bp, Glycine max
  Peptide Sequence Number=SeqID_168043
atggggatcgttaatgtcacaccagactctttttctgatgggggacagtttaaccaggtagatgctgcggttgcacatgcacttgaattaattgcgcagggtgcagatgtgttggatattggtggagagtctacacggcctaacgcaactcccgtcacactagatgaagaattacggcgagtgattcctgtgattgaggcactggttgcacatgatattccggtacccatttctatcgatacctataagccggccgtgatgcgtgctgccattgctgcaggggcaagtattgtgaatgatgtacgtggcttgcaggaggatggcgcactggaggccatagtaaatagcgaagcag

SEQ ID NO: 51266 - DNA, 414 bp, Glycine max
  Peptide Sequence Number=SeqID_168044
atggcacgtgacatggtcaccaagttcggtatgtcagatactttgggtaccatggtttacgcgggtagtgagcaggattcctggatgggtagcatgtcttcccgtacggtgtctgaagcgacccagcaaaaagtcgatgctgaaattcgccgtatcctagatgagcagtatggtattgcccgtaaactgctcgaagacaaccgcgataaggtagaggctatgactaaggctttgatggagtatgaaaccattgatgctgaccagattaatgacatcatggctggtttgcctgtgcgagcacctaaacagaaaaatggcccaaccatgacttctggtggtagcgggacaggtactattgtgaaccctacgccacaaccgactgcgaagggcgatgaaactgaaagccatgcctag

SEQ ID NO: 51267 - DNA, 792 bp, Glycine max
  Peptide Sequence Number=SeqID_168045
atggaaaaaactttagcagattttaggtggtatagagataccttcctaactagagtctacaccagagaagatagccaacaacctttttggaaagaaaaatttctagccggtcttccaagatcattaggagataaggttagagacaaaatccgtagccaatctgtcaatggagatattccatatgagagtttaagttattgccaattaatttcatatgtccagaaagtagctttaaaaatatgtcaagatgacaaagttcaaagagaactagccaaagaaaaggcccaaacaaagagagatttaggatctttctgtgaacaatttggactaccagtctgtcgaaaacaaaagaagaaacaaaaccttaggaaagaatcccatgaaaataaaactttcaacaaaaagagatttccaagaaggagatactcgcataaacccatgaccagtaaggaatctgacactcctaaaccgaaaataaaacccaaaataacatgttacaattgtggaaaacaaggccacattagcaaatattgtaggttaaagagaaaattgagaaatcttaacctagaaccaaccattgaagagcagattaataatctgcttattgaaaccttagaggaagaaacaaaaacttcatcttccacattctctgaggagaacctcaacataatcaaacaagatgaccagccatcatctacggacgatgatgaacgagaaatcaatactctaacaagagaacaagatctcttgtttgaggcaaacaattccataccagatccccaggaaaagaag

SEQ ID NO: 51268 - DNA, 729 bp, Glycine max
  Peptide Sequence Number=SeqID_168046
gaagacccgagccaggcgccgaagccgttcaacgttcctgcggtggaccccaagtacagcaccctgccggagcaggtcgaccgcaaggccggcgtgccgcagacccgcgagttcccccagttgaagttcccggcgctgcagcgcgccacgctgaagaacggcacccaggtgatcctggccgaacgccatgagattccggtggtgcagttcagctaccagttcccgggcggcttcagcgccgaccagggccgcaagccgggcaccggcaacttcaccatgagcctgatgaccgaaggcgccggcaagctcggttcgctggccttcgccgatgccgctgacgcgctgggcgccagccttgacgcttcggctggcctggactcgatgagcgtggacctgtcggcactgaaggagaacctggcaccgtcgctggcgctgtatcgcgacctgctgcgcgagccgcgcttcgaacagggcgagatcgaccgggtcaaggcgacctggatcgccggcatccagcaggagaaggtcaacccgggtgcggtggcgatgcgcgtgctgccgccgctgctgtacggcaagggccacccgtatgccattccgttcaccggcagcggtgacgaggcggcgatcaatggcctgacccgcgaggacctggtcgacttccatcacgactggctgcgcccgcagaacggcaccctgatcgtggtcggtgacaccaccctggcgtga

SEQ ID NO: 51269 - DNA, 261 bp, Glycine max
  Peptide Sequence Number=SeqID_168047
atgacaccagcgaggaagttgcacgtcttgatgtggccaccgtcgacaagggagaagaagtctttattgtggaccttgatggtaagggagaacgaaaggtcgatagtgcatgggtttggcgttggcttgaatcccaatgcaattgagtcagatctaggcaaggcagatcttcgagtcatactggtagatgaggaaggcgccaccgttagaggtgttaggttttgctatttgattttcggttttgggtctttgaatttctga

SEQ ID NO: 51270 - DNA, 681 bp, Glycine max
  Peptide Sequence Number=SeqID_168048
atggataaggctgaagagtggcaaaatatcatggatgcttgggaactattgttgcattctctggatgaagaatcgtataatgaatgcttgaaaatctttacaaattgtttagaagacacaggtgactcttggggaaacttaaccttgacacatgaggttaatgcattgttaaagagactttcaccactagacgtgtgtggtaaaatcaccttaaagactaaattttatgaacttgcatttctgaataccacttcaatgtgtccccctccagagaaagcaaaaacaaagggtgcgttgaagtctgtaaaatgtactaaacgtgaaccttcaatgtgggagaatgtcaatgaaatgagcacaatggttggtagttttggaactccaagtgtggctcacaaggttggtcgtgacaagaagaagagaaaaatggatcattatatggatgaatttcttgatgagttgcaacaatacattatgaacactaaagatgtcacaccagatgaaaattgtggttataggacaattgtagctttgctaggccaagggataattgtcccttgcctcctgttgtaccccaatggacaaaatattgcacaccgaagcccgtttatggaaaaatccttacatgaaatacattcaagctttcaactcaatacatttcaaccagctagaggatcttaa

SEQ ID NO: 51271 - DNA, 246 bp, Glycine max
  Peptide Sequence Number=SeqID_168049
atgaagaatgaaagcgaacaaaacaagaatgaattgcaagcttcagattcggaaacttaccgattgaagaccgaagaacgacaaagaatggcgaaaaacttccacggaatcgctcacggaaacgtctcggaagcgttacggaagcacctcggcttggattttttccttctttctcttcccctcactaatttcaagagaaaaggggaggtggttgccgcccataggcttctagaggaagatttctga

SEQ ID NO: 51272 - DNA, 588 bp, Glycine max
  Peptide Sequence Number=SeqID_168050
atggccaacccgttctttggcggcctgacgcggctgatgacgcttgaagcgcaaaaaatggggtatgacaccctggtgttcgactcctatgagtctcaggaaagcgaagacagaatcatcgacaaactgattggctacaacgtcgatgcgatcattctctcggtcatttccaacgatcatctgtaccagccttcctatctaaaacggttggaaacattgaatatcccggtggttttgatcgaccgggagctggataatcgccactgcagcggagtgtatatcgataacctggactgcggcctccaggcggggcgctggctgctggaacagaaggcgcagcgggtagtggtggtctccgggccggaaaactccaacgtcgcgcgtgacagggtaactggcttgcaagcggcattacaaggcaaggtggcgtcgcttgaagtgctgtatgccgatttctttatggatgtcgcctggcaagagacgagccgatggctggccaataaccgcgcgccggactttttcgtcggctgcaataaccagatctccctgggcattatcaaggcctgcatcgagcatcggctgccgtga

SEQ ID NO: 51273 - DNA, 768 bp, Glycine max
  Peptide Sequence Number=SeqID_168051
atggtgcaaaatcaatttcaaactaacatacaagtcttcagaagtgataatgggagggaatattttaacacgatcctgggaaatttttttcttgaaaatgggattgtccatcatagttcttgtgctaatacaccccaacaaaatgggattgcaaagagaaaaaataaacacctcttagaggtggctagggctttactcttttctactaaagttcccaaatatctatggggtgaggctgttttgactgatgcatatttaattaactattctgaaacttgcattgctgcaccgaaacaaaaaggccaagattcattagttgaacccactctcataatgagtgaggtccttgctgaatccagggctacatcttcaaagcaaaattgtaacaaacaatctttggatactggaaataaagaagaattaaccttaatgccacaacaggataatccttgtaaggaaatagcaaacaggctcattgattgtgaccgaatttggaaaggaaagggttacatgaggagaaacaaggaagttgaagatgcacaaactctccagcataaccatgagtctgaaccgaggaagaatttaattagtggtaaaggtaaaccttcttcttctaactccaatgatcaagataacccttccaaaatgaatatagccatggttcttcgaaaaggagttagatcttgtactaagcatcctctatccaaatttatgtcatattcaaatttatcttcatcttttgctgcgtttacctcccggttgtcttga

SEQ ID NO: 51274 - DNA, 270 bp, Glycine max
  Peptide Sequence Number=SeqID_168052
atggatgaagtctgctgtccaatctgcctaaactacgacaatgatgctggtcatttgttttttggatgcaccaaaattatgccgttgtggtgggagaccttgtcatggataaatacgctcactgtttttccagaaaggccaaaagaacactttcttcaacattctcaatgcaatctgaatggacttattcaacatatatggaaccataggaataagattgttttctcaggtgacagctttgatggtgttcagaagagacatgctgtgtaa

SEQ ID NO: 51275 - DNA, 603 bp, Glycine max
  Peptide Sequence Number=SeqID_168053
gctggccttcaccgcggccgggtcgaggtgggcgtggtagccggtgatcaccccttcgcgctcgagcctgcgtacacgctcggtgcatggcgtggtcgacaggccgacccgctcgcccagttcggtgaaggagatgcggccctcggcctgcaggatgcgcaggatcttgcggtcgatcttgtccagttcgcgggtacgggtggccatggccgtcaaccttggggaatgaattgcaggagaacatcctgccggttgatttcaaaacaggcaaatcaactgggaatggctgtctatacttccccaattatggtcccggcacgctccagtgtagggaatgatcgggccgggtttgaagtcacggtcatcgatcgtcagcccggcccggcgctggaaaccagcttcgccaatgctggccagctgtcgttcggctacacctcgccgtgggcggccccgggcgtgccgaagaaggccatcggctggctgttcgagaagcacgcgccgctggcgatcaagccgggcatggacctggcccagtaccgttggctgtggcagatgctgcgcaactgcacccacgagcgctacgcgatcaacaaggcgcgcatg

SEQ ID NO: 51276 - DNA, 276 bp, Glycine max
  Peptide Sequence Number=SeqID_168054
atggaatctatagttttgcaggctgtgaagaatggtgatactatttttattggtcaatacctgtttactggaagtgaaacaacctcagtgtggctagaggtcagcgaagtgaatggtgatgatgtcacttgtgtcataaaaaattctgctactcttgctgggtcactgtatactttacatgtctctcaaattcatatcgaccttcccactcttgacaataaggataaggagagtattgtacagatagctgcagtattcaattgcactctctgctaa

SEQ ID NO: 51277 - DNA, 282 bp, Glycine max
  Peptide Sequence Number=SeqID_168055
atgtgggtgtcccttcaagcttcgttacaagccagtggttggaggagaaggctggatgggcaattgactaaagctgaaaaaacagttattgctgatatgacgaagtccatggtgaagccaagaaacattctgctgactttgaaggaacacaatgccaatagttgtacgaccattaaacatatatacaatgcaagaagtgcatttcgttcttccataagaggaagcgatattgaaatgcaacatctgatgaagcttcttaaacgtgatcagtatattcattga

SEQ ID NO: 51278 - DNA, 372 bp, Glycine max
  Peptide Sequence Number=SeqID_168056
atggtgcctacaaaacagagactcacgcattccacaactaacagccaagctaattccctttctacccttcctatcactagtgagaatacaagctattcacttattggttttgggcctgcactgatacaccctgaagggtttatcccacatagtagcccggtccctatcaatttcgcccgctgcaaaattggccttgacctcaaagccaaaggaaggaaatttggtgcggagggtctccgaagttgcatcttctactggttgagttttccaaaggatgagctattcttggactgtgcagcccctctgctgacactcacaatccattttaatcaatggtcaagtagtattagacaaggttttttgtatcagtag

SEQ ID NO: 51279 - DNA, 354 bp, Glycine max
  Peptide Sequence Number=SeqID_168057
atgcaactagattatgaggctttgatgaagaatcacacttggtatttagtgcatcttcaatcaaacagaaaagctattggttgtaaatgggattttagggttaaggaaaatgcagatggctctatcaataagtttaaggctagactggttgccaaaggttttactcaagttcaaggttttgatttttcagaaaccttttctccagtagtgaaacctgtcactattcggattattttaactctagcaatcacaaatcagtggattcttgctcaactagatgtgaataatggcttgcttaatgagactgtctacatgtctcaatcccttgttttccaaaaatcaaatccctctatg

SEQ ID NO: 51280 - DNA, 228 bp, Glycine max
  Peptide Sequence Number=SeqID_168058
atggttaataacttgtcatatctatccttaccattggattctgactatctagttatagaatgtgatggttgtgaacaaggatggggagccattctaaagaaaaagaacaacaaatatgaaaaaattcatgatgaagacatttgtaggtatgcttcaggaaagtaccatacaaaaccacagataaccaaggagttcctctccttacaaaagcctctccttctagaaaag

SEQ ID NO: 51281 - DNA, 1107 bp, Glycine max
  Peptide Sequence Number=SeqID_168059
acttttagagggctgcacgtcctcaccttcagagggctgcacgctctcacctttagaggactacacgtcctcaccttcagagggctgcacgccctcgcctttagaggactatacatcctcaccatcagagaactaaacgtcctcgcctttagagggctacaagccctcgccttcagaggactacacgtcctcaccttcagaggactacacgtcctcaccttcagagggcttcatgccctcacctttagaggactacacgtcctcgccttcagagggctgcacaccctcaccttcagaggacaacacttccactctttcagagtactacacgtcgtcacctttagagggctgcacgccctcacctttagaagactacacgtcctcgccttcaaagggctacactccctcgcctttagaggactacacatcctcaccttcagaggactacacgtcctcgcctttagagggctacaggccctcgccttcagaggactacacatcctcaccttcagagggctacaaggcctcaccattagaggactgcacgtcctcgccttcagagggccgcacatcctcgccttcagaggattgtacgtcctccccttcagaggaccacacgtcctcactttcagagggccgcacgctttcacctttagaggactacacgtccttgccttcagagggctgcgcgcccttgcctttagaggactacatgtcctcaccttcaaaggagtacatgtcctcgcctacagagggctacacaacctcgccttcagaggactgcacgtcctcaccttcagaggattacaagtcctcacctttagagggctacatgcccttacctttagaggactacacgtcctcgccttcaaagggctgcacgccctcgcttttataggtctgtacgtcctcatcttcaaaggactactcgtcctcaccttcagagggctgcacgctctcatctttagaggactacacgtcctcgccttcagagggctgcacgccttcgcctttagaggactatacatcctcaccttcagaggactacacgtcctcgccttcagagggctacacgcccttgcctttagaggacttcacgtcctcacc

SEQ ID NO: 51282 - DNA, 243 bp, Glycine max
  Peptide Sequence Number=SeqID_168060
atggacatccttgtccctcatcctctaacaaacgcatgtttgcttattcaactttcaccggaatgtgggtgcaagccattggtctatttgctcaagcgacctgcgctcctgagtgttgacttccaagactgttcaattagagattactcgtcttgcacgttggtgggggtgccaaagtttgtcttcttagagaagcgagttgtcaagaataggatgttggacaaatggcctcagttaccttaa

SEQ ID NO: 51283 - DNA, 532 bp, Glycine max
  Peptide Sequence Number=SeqID_168061
atgtccttggcgcaggcggtcagcgccaggatggccagcagcagcagggcagccagcaggagtcggatgggtagcttgagcaacatggcggtctcagaagcggtaggcaaggtcgaacacgatgcgcagttcgcgctcgcgctggccgtcgtacgggcggctgatgccggtgaccatcgcgcccatgtccagcacgtcgttggcgcggtagcgctggccatagcccagggcgatgacgccgccggtgccgtagccctgctgggtgtaggtgccggcgccgatcgtgccgatttgttcccaggcggtttcgtagcggcggtacagcgtgtgcgtgacgcgcgcgccgggcagcaccatcaggtccgagcgcgggttgtagtagggcgcgtcgtcgcggctgttgcgctgggtcgacaggtccagcgtcaggtcggccttcaggtgcggcgcggtgtagacgcgctcgcgcccgtccagccccagttcccagcgctggttgccgtcggaaaagcgcgacggcgacagcgacagg

SEQ ID NO: 51284 - DNA, 261 bp, Glycine max
  Peptide Sequence Number=SeqID_168062
atggagactaaggtagtctcggccgatagaccaaaggtggcggatgaccacaatttgtctccgcgtgtcaacgggctcgcttgcctctggttgacgaagaggaacgcgaggaacgggaaccagagaaacggcacgcaaaccgaggtaggattttggcatttcaaaaggtcagatttttctcttcatgtggctgagcatgagtcacatcaagagaaaaaggtgggcccttttgctccattcaaatggagacatgtggcatag

SEQ ID NO: 51285 - DNA, 282 bp, Glycine max
  Peptide Sequence Number=SeqID_168063
atggggttgaaccaaacacatgttttaaaaaaaggttcatcaaggcaaagtcaagtatggaagaaagaacgcgctttatggctcccttatagaacgtgtgctagagttagagtaatgggtgaaacagacgaggtgcaagagcggataaaggccgacttggaggccatgaaagagcaaatggccataatgatgaagaccatgaaagagaaaatggccataatgatgaaggccatgaaagagaaaatggccataatgatggaggctatgatgagcacctactag

SEQ ID NO: 51286 - DNA, 621 bp, Glycine max
  Peptide Sequence Number=SeqID_168064
atggctacccctatgcatccttccacaatcaatgacaaggatgaaaaaggtaatgatactcctgagaaggagtacaaaggatattgtggtgctgatgttgctagtgataagaacgaaaaccgtagcaatcaaaaaccttcaacctcatccacctctaaatatgagatttctcactcaccctctcctaaaacacaagacaaaggaaaggcaaatgctatccacatctcttttgggttagactctgaagcaactaggaccatcatagcccttcgtgcaaaaggtattgtgattgggttccctaaaaggaaatgttctgtgaagattaagaagtctgtaaggaagaggcaacaagctaagtatgaagcccctgctttgttccaagacaagaagcttcaagaaaaaattgatgttggttgggtcagcaagaaggttgtcaatggaagaggtgtgattagcctgtctaatgatcctttacatttacatggaactggaggtcctatgacaaggtccaagactaagaggatgaaatgctttgagtctgacttgatgaatctctttgggaataagaagcatccatgggctgagttgatcaattttggtggactattaatattgggctaa

SEQ ID NO: 51287 - DNA, 474 bp, Glycine max
  Peptide Sequence Number=SeqID_168065
atggcatgcgaagacgatgatggtcatccatttctaattgtttttgagattgttgtagttccctttgctatccagagacaagcgagtccgatggcatgcggagaccatcacgataatctatttttttgtcactttcaaggcactaaggcttttgctgatgcaccttatgtcttttatgctctttcttttgacaggtttcgctcattgagctattggtcgccctgggccaatctggaatgttctggaggaagcaagagctcacctgggcaagcatgttgcttcaggtggaagctaccagctctcctaggcgagctgggcggcaaccacctcccccattttttctataaaatggcatggagggctaagggaaaaaggatcagcacctttggcactcagaattcacttaaaattagtgagaagaaaaagaaaggaggaaaagatccaagtcgagacgcttccgtaatgcttccatga

SEQ ID NO: 51288 - DNA, 405 bp, Glycine max
  Peptide Sequence Number=SeqID_168066
atgtctcctaaagacctacaacagctgatccaacaaataagggatcagcttgaggagtcaatcatagaaaaagtgactcgacaggtgatggcatctttcagccagatgcagtcccagtttcagtctcagattcattcacagggacttgcactgcctccagagccagaggttggtccctcagggaacgatccagagacgggaaaaatttatgagggatccacaacagttcataatttccctttgttgcatggccaagtgaaggttggtgttgaggaggttaaagatgcagaggcttccgttcctgtacccactgacgaggttaccttagtggggcagacacttaacaccttccttgcttggccgacacatctcgtgaagcatttatcagaacatttgtgtctctag

SEQ ID NO: 51289 - DNA, 597 bp, Glycine max
  Peptide Sequence Number=SeqID_168067
atggccgtagagcaggatggtgtcgtcgccggtttcggcgccggtagccggaatttccaggaagatcagcggggtacggccttccaggcgcaccacttcaaccttcaggccgggcagctgctgggccttggcccagttctccatcagcgtgaccgcctgttccatgtagccgttctgcacccaattggcgtcgaacatcggcgacttgttgggaatgcggatgtagtcgaccaactgcgggacgatctcgctgtcccacttgtcattgacgaattggccgagcttggcgctaaatccaggaaaccgataggctgtgtgcatgtggtgacggacactgttcctaccgacgggattgccggtcgggacggccagaatcacaaggagatacacgttgtgccttggtttgtcgtgttgagggcgctggtactggttgtggggatcgctggggcgcatgccgccgaaccgatcgacatcaaccgcgccgatgcccaggcgctgcagcagggattgacgatggtcggagccgccaaggccgaggcgatcgtcgagcaccggcgcagacacggcccgtttcaccgcgtcgaggacctgacgcag

SEQ ID NO: 51290 - DNA, 138 bp, Glycine max
  Peptide Sequence Number=SeqID_168068
atggcgctaagcgcgccttcgaggaactttagcattgacagatgtattgtttccttggaacttgatagagcaggacaagataactgtagtgctagacatagtgtgcagggttctagtttttattatgatgctgtttaa

SEQ ID NO: 51291 - DNA, 505 bp, Glycine max
  Peptide Sequence Number=SeqID_168069
agggttacaggtcttcacctttagagagctacacgtcctcaccttcagagagctacacgtcctcgccttaagaggactgcacatcctcgccttcagaggactacacgtccttgactttagagggctgcacttcctcgccttaagaggttttcatgccctcgccttcaaagggctacacgcctttgccattagagggttgcacgcctttgccattagagggttgcacgccctcgcctttagagggttgcacaccctcgccttcagagggctacatgtcctcaccttcagagggctacacgtcctcgccttcataggattgcacgttgtcgcaacctacccttcggcgggagggcgacgcgaggctcacgggtgcatcttccaagggaggaaggcacgtggagtcgccaccaatgtttatttgaggaaaacgtcgaaaaaaccagaaagggtgtttccctcgctccgacgtatccttaattgcaatgaggaaatcgaacctacgtag

SEQ ID NO: 51292 - DNA, 604 bp, Glycine max
  Peptide Sequence Number=SeqID_168070
acaacaaaaagtttatacggataaccactcgggtatttccgccagtcagcgtgactcaaaagtcagtatgacagatcttgtgagcgcggaagatgacggcgcagaagacgacgttagtctctgcgtgctatcaggcttttcgtcttacagacagcaaaaagtttatacggataaccactcgggtatttccgccagtcagcgtgactcaaaagtcagtatgacagatcttgtgagcgcggaagatgacggcgcagaagacgacgttagtctctgcgtgctatcaggcttttcatcttacagacagcaaaaagtttatacggataaccactcgggtatttccgcccgtcagcgtgactcaaaagtcagtatgacagatcttgtgagcgcggaagatgagggcgcagaagtcgacgttagtctctgcgtgctatcaggcttttcgtcttatagacaccaaaaagtttatacggataaccactcgggtatttccgccagtcagcgtgacccaaaagtcagtatgacagatcttgtgagcgcggaagatgacgtaaatctccttgtgtcaatgggcttgtcggccgcgattgacgaagggcgcagatga

SEQ ID NO: 51293 - DNA, 1198 bp, Glycine max
  Peptide Sequence Number=SeqID_168071
tcaaatgcacaatcttggttgtagtcagattcatgactttaagacaagttcacaagaggcagttggtccaatgcaattagagctggatgatatctgggcgagtcttgacggttcaagaaatggcattagagaaatccttggaagatcaaattcaatcgatggctgtcattcaattcccagagatgaccaagaatatgcggaggaacttttggttgcttgggagcattacaagcagaacgttcactcccggaacatccttctggagaggaacgtcactttatctgtcatggagtacgatgagttccgcagggagcgttacaaggccttgacgaggcagcttgatgatcgcattgatgtagccttggtcaaggaattctatgctaatttgttcgatccagagaataagtccctgaggcaggttagagtgaggggcaagctgataaagttcgatgctgagacgcttaacattctgggagaccctggtggttttggagccaagggagaggtacttcgcttactccaggttctgccattcacacctagacccttaggagctcgccaccagattgtgtattctagggcgagggcgaggttggtaaacgggttggtgatgaagatggacatggacttgggctccatcatctctggagagatctcacagatggcccagtccaactcctctcggctaggcttccctgcactcattacagccctatgcatcgccagaggagtggtccctaactcactcacttttgagtccttgagccctgccattaatttggcatatatcctgaagaattattggaacccggatgatcccacgatcatatttttggggacccataagacttgggctcgaggacctgatgctttttcttttgctccccctgctccagctctagcaccaccaactcccactcctgcacctccagcacactccggcacctccgctcaaagcacaaagattttagtaagtgctgatgttgtagagtcttcaccatggcttatgcctggtgattcttctcctcttgggggaggtgaggctcctacagcccaggagccacatccagagccggaggcatcacccaaggccactatggaggagacaccagaggtcacccctactgcctcaccacttgtggaggctactgagaaagaggatggcactgcagacacaaattatgcagctgatatagag

SEQ ID NO: 51294 - DNA, 204 bp, Glycine max
  Peptide Sequence Number=SeqID_168072
atgaaagttggatatgttctacgaaatgcaattgcgcacactttcactgttgggatttgcgagataatattcgtggagggagaaaaggaatcgcatgaagacagtacaagtggaggtttcaatcccttctccgtctctctgacgtttgggaactctatcggagcagtcggaggaaaaattggaggaatctcaagaaagcgctag

SEQ ID NO: 51295 - DNA, 962 bp, Glycine max
  Peptide Sequence Number=SeqID_168073
atggtgagacaccctttatccaagagaggcaacaaatacctaagaaaattcatgaaatggccacactctccttacaagacttcatggcaccacaacttcggtgaagaacaagccatgaaaaatctcaaacaagcaaccctagaaatgggttcttcccaacatccccaaagacccaaccttccctacccttttctcctctccactctccttgactccttcaaagcctatagcattgacccaactccaaaagcttacaccttgactcctcaaaaccctaaccagcacctcccaaagtttgaaacacccgagtccatcctggtgtaccttattaggttctatggtcttgctgacagggtccaagatgctgttgatttgttcttcagaatccccaggaagagggagtgtctcgagatggttccacggatcttgctgaagagccagcatatgaatattcatgtcgaggaatcgactttccgggttttgatcagggccttgtttagaattaagaaggtgggttatgccgttaagatgctgaattgtatgatagaagatgggtgtggtttggatgagaagatatgttctttgataatatctgcattgtgtgagcaaaaggatttgaccagtgttgaggctttggttgtttggagggatatgaggaaactaggattttgtcctggtgtcatggattatacaaacatgattaggttcttggtgaaggaagggaggggcatggattctttccacattctgaaccagcagaaacaggatggaattaatcctgatattgtttcttatactatggtcttgagtgggattgtagcagaaggggagtatgtgatgctaggtgaactatttgatgaaatgcttaataaggtagacaaggcgcttcagattgttgcttctatggaggagttagaatgcaaatcgaatgtggttacttacaatactatattgggtgcctt

SEQ ID NO: 51296 - DNA, 963 bp, Glycine max
  Peptide Sequence Number=SeqID_168074
atggaaaatcaattcccagttatcagtgattcctactgtgttccttatcttatcaatctacgaatcaatacagaaaaaggtatcacttacgacgcaaacaatgtccgtcacttttatatcaaagataaattattcacacttcacaagcgacgtgtcctgtgtgataatcaaggaaaccccatcgtcactctatacaagaagagaatgacattgcatgggcgatgccaagtttttaggggttataaaagcaaagatttctctcaattgctcttttcagtgaagagatcagcaatgataccgagtgggatgattaacttagaggtcttcctcgctaacaaccaaagagaaagtgcctgtgactttagagtcaacgtttgtagagataaaagatcatgcactgtttatgccggtgaatctcctagaattgttgccacgaacatcctctataacttagcttatacaatatacacaacaaaaggctcggtttcgcacagcacacttccctctccaatggaaaatcatcaattcccagttatcagtgtgattcctactgtgttccttatcctatcaatctacaaatcaatacaaaaaaagatggataataatgacggcttcaatgttttggtctatccccatgcggactacgcattcatagtggcactacttatgattgttagcgagatgaaacattattttgacgaaatggtgtatttggccgccggaatggcaccacttggagttgtgtcgcaacctaccattcggcaggagggcgacacgagggctcacgggtgcgtcttccatgggaggaagatgcgcggagtcgccaccaatgtttattcgagaaaaacgtcggaaaaatcgaaaagatgtgatttacgaactttaagtgtgaaaggttccagagttgtatttacgcatggggaaggtattagcaccccacgcgtccgtcacaaaggacgatag

SEQ ID NO: 51297 - DNA, 381 bp, Glycine max
  Peptide Sequence Number=SeqID_168075
atgtctgtggtgcaaatcgagcacagggaagtatggctagctgagtgcccgggccattttggccacttggagcttgccaagccaatgtttcatattgggtttttgaagacgggcctcatgttcccttgccaatcagtcttagctataatgcgttgtgcttgcttcaactgctctaaaattctagctaatgagttcaagctagccttaagaatccggaatcccaaaaataggatgagaaagattctggatgcctgcaaaaacaaaagcaagtgtgaagggggagatgatattgacattcatggtaaagatatcggggagctggttaaaaagagtcgtggtggctgcggtgctcagcagccaaagattactattgagggatga

SEQ ID NO: 51298 - DNA, 783 bp, Glycine max
  Peptide Sequence Number=SeqID_168076
atggcattcccagttatcagcagtgactactgtgctccttacgctatcaatcttcaaatcaatacaaaaacaggtttcacgtacgacgcaaacaatgcctgtcgcttttatatcgaagataaattattcacacttcacaagcgacgtgtcttgtgtgataatcaaggaaaccccattgtcactctatacaagaagagaatgacattgcatgggcgatgccaagtttttaggggttataaaagcaaagatttctctcaattgctcttttcagtgaagagatcatcaatgataccgagtgggatggttaacttagaggtcttcctcgctaacaaccaaagagaaaagataaaagatcatgcactgtttatgccggtgaatctcctagaattgttgccacgtgactacaatgatgatgataatgatgtcaacaataacaattacgatgatagtggtgatagtagtggagatgacattagtggtggtgacgatgtcgatgatggtatcagtcaatggtgtggtggagacatgggcaatggtgatagagaggtcgtattggtggtggtggtagtggtaacaatgttagtaacgatggtggttgttgcgttgttgatgatggttgtagtggcagcgctagtgatagatgtaatattgttggtaatgattatggtggtgtcaataacggcaacggtgacattgatggtggtggtggggataataatgctagtgatgatggtgatgtcggtggtgacaatggaggcaatgacgatattttgtttggaatga

SEQ ID NO: 51299 - DNA, 297 bp, Glycine max
  Peptide Sequence Number=SeqID_168077
atgatgtttttcgatcgacatttggcagcatctcaagttcacgggagacaatttaaagctggtgtcgttgatggttctgtcagactttatgatgtcagaacacctgaaatgctcgcctctgaattaagccttcatagacaaagagtaaaagaagttgtgggattggctttaattcaaccaggattagaccaaggaaaggctggagatatccaatttcttgatataagaaatcatagcagtgcctatcttactattgaagctcatagggtgttcactcacagctttagcggtagatag

SEQ ID NO: 51300 - DNA, 297 bp, Glycine max
  Peptide Sequence Number=SeqID_168078
atggaattctatagccacaacatcactgctacatctgctttatcccatgtaccaaaggtattggctgtggattttggggcatctttcccagttgggttaaatattttgcagctcaatagtgttggtattttcgacttcggtgggggtggacgtggccaaggtgagtttcatgatctcgcagtgagtgatgaaaaggatgagatagaacctggtacttgtagagtggagtcggagctgcaggtccttgtttgtaaggactgttacgattttgtgacaatccttacagataattactag

SEQ ID NO: 51301 - DNA, 1170 bp, Glycine max
  Peptide Sequence Number=SeqID_168079
atggtcaatagtagcattacaaacattgttgggattggtgatgtgtgcattcaaaccaataatggtggcacactaagattgaagggcatgcaacatgtgccggatttgcgtttgaatatgatttttgtgcatgctctggatttagatggatatcccaacagttttggtgatggaaaatggaagcttaccaaaggttcattgatggttgcgaaaggcatagtgtattcaacactatacaaaactcaagtcaagctgatcagagatggactgaatgcagttgaggatcatgctttgccagatttagtatcttgcaagaaaacttcaaagttgaaggagaatgttctggacatggtttattttgatgtatgtggacccatgaaagttgagactcttggaggtagcaaatattttgtgacgtttattgatgatgcttcacagaaaatatgggtatctccatctattcctttggtctttgacatccctgaaagcgtatggtctggtcgtgatatcaattactatcatttgaaggtgttcagatgcaaagcttttgctcatgtaagcaaggagcagagacaaaaacttgatgataaagccattccttgtatatatttgggctacgaagatgaggaatttgactatagtgtacaaggtggtaaggttgatcttacactagtcacccgtgttagaagaattgccacagaatggggaaagcttgatgatgaacatagggttattgatgagccagcaatagaagatggtgatgataaaggtgttgaggagccaaaaacttttgcagaagttaaaactcataaggataaagtccaatggaggaaagtgatgcaagaaaagatagattccttgcataaaaatgatactgatgagcttgtgaaacttcatgagggtagaaaagcattgaagaataagtgggtgttcgagcttaagaaagatggtgacaagctagtgaagtataaagctagcttagtagtaaaaggttttggacaaaagagaggaataaactttgatgaaattttctctccagttgtgaagatgagttctattagagttatactcacattggttgctagcttggatttagagcttgaacaaatggatgtaaaggctgcatttcttcatggagattttgatgaagagatctacatggataaataa

SEQ ID NO: 51302 - DNA, 324 bp, Glycine max
  Peptide Sequence Number=SeqID_168080
atggttcaagttggtgaccggctcagacgagtatgcaagtaccgcaggtggccagaatggctagcggcacagcgtgccccgcaggtggagcggggtggccagatggctagcgggcaaggcaagtaccggggagatgtgttgggttacaagtgtgaggtgaagtcccacatcgggtctccttatgtgatgactcgtggtccacaggtgtacccctcgaatctccccaacaagagcaacaccacttccccatcaattacacgggttgtggtgaccttcttcaccatagtgataacacttaaagtttcttcaaggctgagattgtga

SEQ ID NO: 51303 - DNA, 678 bp, Glycine max
  Peptide Sequence Number=SeqID_168081
atgaagaatgtcaagccagttagcacaccactggccaatcatttcaagctcagcaaaatgagttgtcctactattatagttgaaaaagaagttatggttgctatactgtactcctcagcgatcgggagtttgatgcatgcaatggtctgcacaagattagatattgcttatgtggtcgaagtggttagcaggtttctctctaatcttggtaatggccattgggaagctatgaagtggattttgaggtatctgaaaggtacttgtaataagtgcttatgttttggaggagcagaaccaactttggaaggttatacaaatgtggatatggcaagtgacatggatgggggagctatatctaggcaatctaaattgcagaagtgtgtagccttattaactactaaagcaggaaaaaaagatgctttggttgaagagatttcttcaatagttgggaatgaagcaagaaagttatgttatcattgtgatcgtcaaagtgctttggatttaagtaagaatgtgatgtatcactcttgcataaaacacattgatgtaagataccgttggttgtggcaagaagtggaagaacaacacttcaagttgaaaaagattcacactgataaaaaccttgcaaatatgatgataaaagttgtagaacatgaaaagcttcaactttatgcctag

SEQ ID NO: 51304 - DNA, 301 bp, Glycine max
  Peptide Sequence Number=SeqID_168082
atgaaaggtaagaagaggtgcatcaggaggaatgaagcatccttgttgaacctaggaagcaacaatttggtttccgctcttggcctcgacaacatccgagagagagttacatcactcctaaagctgcattgcaactaccaagatctacaagatttaatgcctcctgagcagtaccaatatctctccacttcgcaatcgatgaagacgagcatggaatttgcgtctagttcatggcagggatgttgggggcgcgatggaaacgacaaggtcgttgtggatgttgaagttggagatggcggag

SEQ ID NO: 51305 - DNA, 544 bp, Glycine max
  Peptide Sequence Number=SeqID_168083
atgtttccaacggatttccaaacacacccgaagccattcagtcgccactgcatttatctaaacgccctctttttctacaatttccatattcctatcacgcagaacactccttactctgtccttaggccgccacttggagacgaggccgctgtcggaggggccagcggggacggcggcctcgaaggcgtcgtggcggagctcgcagaggaaaacggtgtggggaaggtaggccatgctggtggcggcattaccggcatagttgccgctgctgctgctggagatggcagcttcggagtcacggcggtgcgcaaaatcggcgtcgtcgttgctactgctgttgttaacagcggcgacggcggcggaggtggtggaatcgtcgaggtggctgtggatggagggaacgacaagaacggtgatggtgatgatgatgatgatggttatggtgttggcattgatgatggtagggatggtgatgatgatgaaggggggcgcatagaacagtggcggcaggcactgtctctacctgaagggaaaacggaaacga

SEQ ID NO: 51306 - DNA, 369 bp, Glycine max
  Peptide Sequence Number=SeqID_168084
atggaatattttgaaagttcgtggacctcaacttccgagcgcagttcaagattgcgcgccatgcggcggttctcgaaggcgctggccgccatccccggcgtgttcgtcgggggcacggaggagatgaaacacaccgtttcgactacgcacgacgccgcgaggaggtgttttaggagtagggggcttccggttctaccgtggaggaagaaccggttcatgcagaacaagtggttggggccgtgtcaccgaaccgcgagagatatttccataggatttagcggtggtgttagttgcagggtggtggagttcgacgatgtcgtttcggaagcgggatgtggcggtggcaatgacattgttgttcgtagatga

SEQ ID NO: 51307 - DNA, 132 bp, Glycine max
  Peptide Sequence Number=SeqID_168085
atggatttggatcctctgaagtgtgacgagtggaatgctagtgcttgcattaggaagtggcttgtttacattaattggaggttgctagcttgtcacattggcagcatggtggaaattggttgtgacacctga

SEQ ID NO: 51308 - DNA, 3408 bp, Glycine max
  Peptide Sequence Number=SeqID_168086
atggcaccacaaaaggcattggagtcaattggaaaaactttgagcagtcagtatgaaagatggcaaccaaaggcccgctataaatgtcaacttgatccgacagtggatgaggtgaagaagctttgtactacttgtcgtaaatatgcaaagtcggaaagagttttattccattacaatgggcatggtgtgccaaaaccaactgctaatggtgaaatttgggtcttcaataagaccccatcaatttacgtcattgattgctctgcggctgggatgattgtgaatttcttcattgagcttcatgaatggagtccttccaactcctctgtgtcccaaagggattgcattctgcttgcagcatgtgaagcacatgagactttgcctcagagtgcagaattcccagctgatgtgtttacatcttgccttaccacacctataaagatggcattgcgatggttttgtactcgttcattacttcgtgaatcacttgttaattcacttatagacaagatccctggccgtccaaatgaccgaaagacacttctgggtgaattgaattggatctttacagcagtaactgatacgattgcctggaatgttcttcctcatgatctttttcagagactgttcagacaggatttgcttgttgcaagtctgtttcgaaattttctacttgctgagcgaatcatgcgatctgcaaattgttctcctgtctctcacccaatgttacctccgacccatcagcatcatatgtgggatgcatgggacatggctgctgagctctgcctctctcaacttccatctttagttgaggatcctaattctgaatttcagcgtagtacatttttcaccgagcagttgacagcatttgaggtatggcttgaccatggttctgaacataagaaaccaccagagcagttgcctatagttcttcaggcattatctgttggaatattcccatatgttctaaagctgttacaaacaacaacaccagaactacgacagatccttgtattcatatggacaaagattcttgcacttgataaggttgatctagtgaaggatggtggtcatatctattttattaagtttcttgacagcatggaagcatatccagagcaacgcgcaatggctgcttttgttttggctgtgattgtggatggtcatagacgaggccaagaagcttgtattgaagctggtttgattcatgtctgcttaaagcatcttcagagttcatgtcctaatgattcacaaactgaaccccttttccttcagtggctttgcctgtgtttggggaaattgtgggaagacttttcagaggcacaaacaattggtttgcaggaagatgccactactatatttgctcctctactgtctgaaccccagccagaggttagggcttctgctgtttttgcactaggtaccattcttgatgtgggatttgattcatgtagaagtgttggtggagatgaagaatgtgatgatgatgataagtttagggctgaagttagtatagttaagagtatgttaggtgttgcttcagatggtagtccattggtgagggcagaggtagcagtggctctagcacgatttgcttttggccacaacaagcacctgaaatctattgctgctgcatattggaagcctcaagctaattctttgattaattccttaccttcattggctaatataaaaggttcggttggtggatatgctaaacagaaccaacacatgccttatggaagtatcgtttctcctcaaattggtcctattagggttggaaatgacaattctccagtgattcgagatggccgcgtgtcttcaagcagtcctctcgctggttcaggaatcatgcatggatccccattgtctgatgattcatctcatcattctgattcaggaattctgaatgatggtttcagcaatggagtggttaaccacactggaccaaagcccttggacaatgcattgtattcgcaatgtgtacttgctatgtgtactttagcaaaggatccttctccacgcattgcaaatcttggtcgccgggtactgtccataataggtattgaacaagtggttgcaaaaccattgaagtttagtggtgttcggactgctgaatctacagcttctccactggctcgttcatcttcttggtttgatatgaatggaggacacttgccactgaccttcagaactcctccagtcagtcctcctcgcccaagttatataactcgaatgcgtagagtttgttcattggagtttaggccccacctgatggattctcctgactcaggattagctgatccactcttaggttctggtggagcttctgggacttcagatcgaagctttcttccacaatcaactatatatagttggagttgtgggcacttttccaaaccacttttaactgctgcagatgatagcgaagaggcatcagccagaagagaagagagggaaaaatttgcattggagcacataggcaaatgccagcactctgctgttagcaggctaataaatccaattgctaaatgggacataaagggtacacaaacagcattgctgcaacctttctctcctatagtgatagctgcagatgagaatgaacgtatcaggatatggaaccatgaggaggctacactgcttaacagttttgataatcatgattttcccgacaaaggaatttctaagctctgccttgtaaatgagcttgatgatagcttgcttcttgctgcttcatctgatggaaacattcggatttggaaggactatactcttaagggtaaacaaaaacttgtcactgcattctcttcaattcatggtcataaacctggtgtgaggagtctgaatgcagttgttgattggcaacaacaatgtggctatctgtatgcatcgggtgagatatcatctattatgctatgggatgttgataaagagcagcttgttaattctaaatcttcatcatcagattgcagtgtctcagtgttggcagcatcacaagttcatgggggacaatttgcagctggtttcgtggatggttctgttcgactttatgatgtcagaacacctgatatgcctcatacacaaagagtagaaaaggttgtggggattggctttcagcctggattagaccaaggaaagattgttagcgcttcccaggctggggatatccaatttcttgatataagaaatcatagcagtgcgtatcttactattgaagctcataggggttcactcacagctttagcgggtgatcaactaggcaccattaaatactatcctaccctaatggcccagaaaattggttctgtaagctgcctcaatttccatccataccaagtattacttgctgctggtgctgcagatgcatgcgtttgtatttatgctgatgacaacactcaagcaagatga

SEQ ID NO: 51309 - DNA, 1350 bp, Glycine max
  Peptide Sequence Number=SeqID_168087
atgggtgcggcgatgcacatcacgcacggttatattcaggccagtaccttgcacttgcctaaccggcggctacaaggtgccaaatattacatggatttggtaacggtgaccggcactgaaaatcttatgatggctgctgcgctggcgcagggcatcactgtgctggagaatgcggccaaagagccggaagtggttgaccttgcagaatgcctgaataaaatgggcgccaagatcacaggcgccggcacggataccattacgattgaaggcgtggaacgcctgactggtgcagagcatcatatcgtctgtgaccggattgaggcaggtacctatatggtcgcggccgccatgaccggtggcgaggtgactttgaaaaacgcgcgcgctgatttgctggaggcggtgattgaaaagttgcgtgaggcaggtgccagcattagtcacgacagtcatagcattaccgtgaaaagtgatggcaagttgaaagcggttaatgtgcgtactgccccacatccggcatttcctaccgacatgcaggcacaatttatggccatgaatacagtggcagagggtgtgtctaccgtcattgaaactatttttgaaaaccgctttatgcatgtgcaggaattgcagcgcatgggggcgaatattgatgtgcagggcaatactgccttggtgcagggtgtccctgcattggaaggtgccagtgtaatggcgactgatttacgcgcatctgctggcttggtgctggcaggattggtggcagatggtgaaacagtgatcgaccgcatttatcatctggatcgtggttatgaaaagctggaagagaagttgaatcaattgggcgccaaagaagatccggaatcttcacgtaaactgattttgcccaccaaccgtgacgatgtgcgcctggtaattgtacgcgcgaccgatgtgccgacctatgtgcaatatggtgcagccgacattggcatcgccggtaaggatgtactggatgagcatggtggcgaaggtttgtaccagccattggacttgaatatcgcccgctgcaaaatgatggtagcggtgcgggatgattttgattatgaggccagtatccgccaaggtgcacgtctgaaggtggtcaccaaatatgtgaaaacggcacgcgagcattttgccgccaaaggcatgcatgtggacctgattaaattatatggttctatggagttgggtccattggttggcttggcggatgcgattgttgacttggtgagtacagggggcacattgcgcgccaacaagcttaaagcggttgaggatattggtgccatcagctcacgcttggtggtgaaccaggcttcttacaaa

SEQ ID NO: 51310 - DNA, 3078 bp, Glycine max
  Peptide Sequence Number=SeqID_168088
atggcagatcctgctagttatgggagtcttgagcgtgatattgaacaagatgaaacaacactaatttggatttctcacaagaaggaaaggaatttgaaattatcttcagtttcacgtattatacctggacaaagaactatatgcaaggaccaagatgaggcagaggtatggtttacaggccttaagacattaatttctactggaaagcttaggcgcattggaagtgaattatttaatgatggtgctgattttattccaaacggtggtccttttggtgcagcactagaatttgctataagcatttctcataacaagaaggtctcttttgattttgcttctcgtgagccttcattgaatttggcaaccacagatgtggggttagagcgacgtgctaataatatgcaaccaagaacaagcattggagatggttttcgtgtcagcgtgtcgagtacaccgagtgttttgagtacagggtcaggaccagatgacatagaatcacttggtgatgtttatatatggggagaggtttgggcaagtggggtttcacctgatggattttccacacaagccccttccacaacagatgtgttgattcctaagccattggagtcaagtgttgttcttgatgttcaacagattgcatctggtgtgaggcacattgctttggtaacaaggcaaggggaggtttttacttggggagaagaatgtgggggaagacttggccatggaattgatagagatttcggtcgccctcaacttgttgagtttttggcagttactagtatggattttgttgcatgtggagagaatcatacatgtgctgtttctacatatgatgatattttctcatggggtgatggtacatacaatgttggacttcttggtcatggaactgatgttagccattggataccaaaaagaattagtaccggtcctttagaagggcttcaagttatatccattgcatgtggcacatggcattcagcactagcaacttctaatggaaaactttttaccttcggtgatggaacatttggagttttaggccatggaaacagagaaagtattccatatccaaaggaggtgaaatttttaaatggatcgaaaaccattaaggttgcatgtggagtgtggcacacggcagccattgtagaggttacttttcaatccaattcaaacgtttcatccaggaagcttttcacttggggagatggcgacaaatatcgtttaggacatgggaacaagggaacataccttcaaccaacttgtgtctctgcacttattaaatataatttccaccagatagcatgtggacacaccatgactgttgccctcactacatctggtcacgtctttactatgggaagcaatgaaaatggtcaactaggaaaccgtttggctgatgaaaaagtacctatcctagtgcaagacaagttggtgggtgaatttgttgaggaaatagcatgtggttctcatcatgttgctgccttgacatcaagaagtgaactatatacatgggggaaaggtgccaatgggagattgggacatggagacatagaggatagaaaatccccaacattagtagaatccttaagagataggcatgtaaagaatatctcttgtggctcaaactttacatcttgcatatgcattcataaatgggtctctggagttgaccaatctgtttgcactggttgtagacaaccatttggtttcactagaaagaggcataattgctacaattgtggattagtgcattgccatggttgtagttcaaaaaaggtattgaaagcatcattggctccaacaccgggaaaacctcatcgcgtgtgtgactcttgttataataagcttaaagctgttgaggcatgtgctagttctaatcttcataggaaaatgaccacaacacctcgctattccatagatggtagggaaagatttggtcaaggagaagtaaagtcttcaagacttattttgcctcctatcacagaaccaatgaaatttcatcagataatggctaataagatgggaaacaaacatgattattcttccatgtctccaacttcccaagttccatcacttttgcaattgaatgatattgcatttggtaactcaataagttcaactcaaaatgttttgaagtctgctatagctcctagtccaacaccaactccacctgtcaaccaaagaccagcatctccttattcaagaagggcaagccctccacgttctagagcttcaggattttctagaagtcttgttgatagtttgaggaagacaaatgaacttttgaatcaagaagtttcaaaaatgcaaaatcagattcgaagttcgaagctaagaaatgacatggaaattcaaaagctccaaaaaactatcaccgaagctacctcctttgctgtagaggaatcctctaagcataaagccatgaaagaattttttgagtctacggtggatcagatgaaggaaatgattgagaagttgcctccagatgttttagatagtgaaaattggaaaatcatgcttactcgagctgaggattttctaaaagaaaaatcagaatttgaaacaccatcaaatgtgaagtctcaacaacaacatgaacttaatacacctaactcatatagtagctcttctaaattgcaagaacatggaatagaagaaaataatgaaacggtaggagttgacccatcatcacaagatgaaggaaacgttcaagtaagcaatagctcatctttatcaaacaatgaagcatcaatgccttcacaaaatgattcaaaatcacaacactcttcaaggccaggcaaagaaggagaaatgcaggtcatggaacaatttgaacctggggtacatgtgactctaatagtaaagcctggtggtgtcagaattttcaaacgagtcaaattcagtaaacgaaggttccatgaacatcaagcagaagaatggtggagcaaaaataaagatagagtgcttaggaaatatagtactccacaggctacaaattttgaaggtattaggtcatctaacactctaccaccaccacctacagaagaaaatattgaggcaatgtcttcctaa

SEQ ID NO: 51311 - DNA, 771 bp, Glycine max
  Peptide Sequence Number=SeqID_168089
atggagcgatgccatgaggaagagctcgaaaagctaaaggttgaccacgatcaactcgaggctcatcgcactcaaggggaatcacacccccgaagcataatcaacactcaagaaggtccaagtctctcccacatacaccgtcctgcaaggcagactactcgtcaacacctctttgtcgaccgaatcatggaagttgacataccgctaggttggaaactagtcaacctagagcggtccttcgacactcttgttgagcgttttcaatgcgtaatatgcaatcaaccagtcacaccatatgacattgccgcagtggctaatctacgacaagcagatgatgaatctcttcgaaaattcatggacaggtttggacgcattgttgtccagatctgcaaccttaacccagaggctacatctagatggaggagatgtccaagttcaggaataaggtccaacaagccgaacaaaagcgcgacaagcaagattgactcacacaagttaaacaagaggcataagccagacaagcaccagcctttcccaaaagggttcaagtacgagcattacacacccttgatagtcaatcacactacaatcctaaggagggtttcaacttcaagggtcgacaatgagggagaaaagggcttccaagtgactgttgatctagacaatccatttgctaatgagatactcattgtagaagtagacaaagatgccggtgcaatggagcatactctacttatcgtgcttctagttcacaataacaactacccttag

SEQ ID NO: 51312 - DNA, 243 bp, Glycine max
  Peptide Sequence Number=SeqID_168090
atgttttaccacaacctcacagtgggcaccaaatgtacttaccaaaatctagagctgtcacatgccaaggtggatgtggctaaggtgagctccttaacttcacacgtcggattgggagtagcctttgttaagaggacaaaaagggggacctgtaaaacaaaggacttcgacgctcaattgaaagttcgcctgctgaaggcacatcgtccgtgctcctataccagggctggcatggaaggctaa

SEQ ID NO: 51313 - DNA, 828 bp, Glycine max
  Peptide Sequence Number=SeqID_168091
atgactcaccacgactccctcctcctaaagcgcaccgactacctcgccctcacgcttttcctcagcggcgacaaccacatcatcatccttatcatcaacacaatccagaaagacctcacctccgataactacctcgtcatttgcgccgctcttaataccgtctgcagtctcatcaacgaggagaccatccccgccatgcttcctcgtgtcatcgagcttcttaaccactccaaggacgtcgttaggaagaaggctgttatggtgctacatcgcttctacctcaaatctccgtcctctattgtgccgatgaaactgaaacatgaagaatcatcatcgtcttcttgttcatctcccatcaaattccaaatgttaaggcatcaatgcaataccaacatttttggcctctccttctccttcatattctccctatggtgcctcctcttcttctacatcaagcttcgcctcgttcatggcattggaggtcagttattgtacacctgcgtcgattccatcacgccatcggaagtcgtcgatgctggcgtggcggcggccgcacttgctcttctctcctccttcttcaatctaatcccacacgcattgcacagtgaaggaagagggagtgaaggaagaatagtcataaatgttatcggaatcatcatagggtggtggtttgtggttgggcatggagaggaacatggcgaaggagctggtggtttggctgtgtttagtgccacgtgtgcagagacttgtcacatgggtttggacaaagacttgccacatagacatatgactaacagtggaaattggattttaacggtagggacttag

SEQ ID NO: 51314 - DNA, 354 bp, Glycine max
  Peptide Sequence Number=SeqID_168092
atgcttacggatcaggtgatccgtaaaacacacaacaactttcagatcgcgttctacgccatcgccgacaacattggtggaaaaaaagaaaaggttcacggcgtttacctcgactgtggacgatcacgaagctccctcgatggtggacgacgacgttgctctttgcggaagcctccaaaaatgcaccacgacaccttccttctaatcatggcaacaatggcggcaatggcggcaatctcctcaaccaagaagaagaagaaatcctctgagaagaagaagaagcagaaacgcgaagaagaagaaaagaatgaagaagaagcagaaaggtccgaggaacaagaagcagaatcgtag

SEQ ID NO: 51315 - DNA, 1221 bp, Glycine max
  Peptide Sequence Number=SeqID_168093
atggaagcaattgagccagaacgggctgcaataacatctgacctacggaagaaagtaatgaacgatcttatggagggtttgaaggaccacaattggtttactgggtttgatattgctgatgatctgcctgcaaaattttcgttaaggcagtggatcaagctagccaaggaagtccaagcaacaatttttattgcagtgcatggaggcattggagaagatggtacacttcaatctttgctggatgctgaaggagttccctacacaggtcctggtgcaatggcatcgaagatttgtatggacaaagttgcaacatctgtggctataaaacatgaagctacagtgccaaacattatgtgtcaaaccagcaaaagatggatgctcaactggggtcgcaagactatgaagattagaggaattatgttttacaacttgctgattctattttcattcagctgttctgaggaccttgcaatatatgtcagagctctggaggactgtctactaagaattcctccaaatagcttatcaaaggcacatggtatgattgagatgccaaaccctcctccagaatacttaatttttgaacctttcatagagacggatgaaataattgtgacatccaaatttgaggatgcaactggccatggcctcacgtggaaagggcacagcagatgggtagaaataactgttggcgtcataggaaaacgtggatcaatgcactcgctaagtcctagtgtaactgtcaaggaatctggtgatattttgtcacttgaggagaagttccaaggtgggactggcatcaatctgactccgcctcccttgtcaattatgagtgagaatgctttgaagagatgtaaacagcacattgaactgattgcaaacactctacaattggaaggattttcacgtattgatgcatttgtaaatgttgacagtggagaggtaaatactgtgcctggaatgacaccttccactgttctgattcatcaggcactagtagaacagccaccgttgtatcctcatcagttcttccgtaagcttcttgatttggcatctgaaagtttgtatcttcttaaactgactttgaagaaagattctaaatgtgttttcaacaaagctggtgagcccttaaaaggtagtgaggttgtatggcaagaagcacatgtgcgtgggtcatcaacaattgatgaaatcagactaaactctcactttagtccatga

SEQ ID NO: 51316 - DNA, 600 bp, Glycine max
  Peptide Sequence Number=SeqID_168094
atggagaatgtatttatgcaattcatggaaacatcccatgctagctttaaagccaatcaaaactcaactcaaaatctagagattgaggttggcaagaattactccatggaaaattgttggcgggagcaagagttacaaccttgcaatcaatatgaagatgaaagaatttataatcttgataatttgttgatgcaactcatgaaaacatctgaagctactcaacacgcaattcaaaatattgaaattcaagttgaggttgaaagtcataaggaaagtcttgtagaagagtatgattcaagagaaaaagacaaagaaaaaagtgagcagagaacacaacaacaacgggagaaatgctcacaagtagaaattcaacaagaaagtattctccaagtcaatacccctcctcatcaattgattggcaaggaagaaaggcatggagaacgtgataaatctttcagtgtcattctctccttgaacaccaacacttctcttgcaattgtatggaaggcattttcgggatacatgagtttcatggagtctctggctaagaagcgaaaatgcaaagaagatgtgttctatgtaacattcatgccaccttga

SEQ ID NO: 51317 - DNA, 717 bp, Glycine max
  Peptide Sequence Number=SeqID_168095
atggccacgtcatcacttgccggcaactgcacccttctccgccacagcgagactcaatcctgctcgctgttgtcctcgcccggaggtagttctgttaagctcttctggtcgaagaagcacgaggccagcacgtgccatgctgcacgtgtcgctgccgtgccacgtgcttccgcgcgtgaggtggcggtggttggtggtggagtggttgagaaggggagggagaaagggagggtgctgaagactttgtctgatttagcaaagcatctagctacagctgtggacatagtatttccagttatacacggtcaatttggtgaagatggtggcattcaggaattgctggaaaagtataatgttccatttgttggcacaggatcaaaggagtgctgccaagcatttgacaaggggtatgaaacaaagaaatcagaactatcagaatggtttgaaaagcaccagctggaccctgacttagggaaagttgtggtaaaaccaacaagaggagggtcaagcattggtgttagagttgcatatggtgtgaatgattctcttgtaaaagccaatgaaattatgtctgagggaatcgacaataaagtgctaatagaaatatatcttgaaggtgggagtgagtttacagccattgtccttgatgtaggatctgcttcagatagttttcctgttgtactacttccgactgaggagactgagtatctatattga

SEQ ID NO: 51318 - DNA, 2223 bp, Glycine max
  Peptide Sequence Number=SeqID_168096
atggctgaccacggaaccaggaagacgaccaccgatcgtctcgaagacgccatcacgcgtctaaccaatagccaagcctccatcaatgaacgatacgctgacctctccagcaaggttgattcgattttggatcacctccgtctccgcgactccggtcagccaaccaccgccactgccaataaccataaccaccagcgtaacattgtcaagctggatatacctcgttttgatggccgagatcccctcagatggatctttaagatcactcaactctttcaatatcaaaacactccagaggaagagagaataactgtggcttctctttacctcgacggcgtcgccttaagctggtaccaatggatgtacagcaacggcctcatcacgtcatgggactccttcctccaagccttagaatctcgatttgctcctacgttttatgatgatccgaaaggtgcactgttcaaattgatgcaacgcggctccgtgaatgaatatttgaccgaattcgagcgattagtgaatcgtgtcatcggacttcctcctccattccttttgagttgttttatttcaggattaaaccctgatattcgacgtgaagttcttgcacttcaacctatttctctcttgcaggccacaactttggctaagctccaggaggagaaactccacgatagattccgccacctcgcacttatactcagccatcgtcattcgcgagtcaaatctccgaaaccacgaacaagccaaaaccgccctacgtgcgtcggcctgtgttataattgtgacgaaaaatggaacgcgaaccaccgctgcaaaggccgaatcatgctactcatagcggacgaacaatcctcaccgatacctgtcgatcttggtcccgaggaagaaccaatcactgtggttcctgatccacccgaaccaccacctgataccgattgttctcacattagtttacacgcattatctggtctgccctcgtcggaaactttccgtatcttcggcatgatcaagcatgcacgactcaccttcctcattgacagtgggagtacccacaatttccttcaaccccgaattgcgcacttccttagactttcagttcaagctactcatcctctccacgtccttgtcggtaatggctcaatgttggagtgtggtcaaacctgccctgacattccggtaaccatccaggggcactccttcaccgtcaccttccatctccttcagatcagtggcaccgacgcggtcctaggcattgactggttaaagaaacttgggcctgtaactactgattacaccacgttcattatgcagtttaaccacctaggccaggatatctcacttaaggcaaatgttactcttgggccagaactgacttctgcggcccaactcaaacgccttatccacacgggttcagcttcagcattttttcacttacgtgtggtgcccgataacccgcccgaaccacccacggcccaacattccatcccctccatcacgaacctactccagcgctatagtcatctcttccaaactccatcccaactaccacccccacgcagtgtggtccatcgcattcctttacaaccatcatcggcaccgatcaacgtcagaccctaccgctatcctcattttcagaaaaatgagatagaaaagcagatctccgacctcctctcagccggcttgattcaccctagtaccagtccctattcttctccggtactcctcgtgaagaagaaggatgggacctggcgtctatgcgtggactaccgtgcgcttaatgccatcacgatccgtgaccgcttccctatccctaccattgaagaattattagatgagcttggccatgctcactggttctccaagctggacctccggcaaggccatacttgtgccgtttcgccaccgtattctttgatgatatactggtgtatagtgactcactgcaagcacacgtcgagcacctggagaccatcttcaatgcattattacaaggagagcatcgactatctaggtcacatcgtttccggtaagggggtcgcaccggaaccttctaaggttcaggccatcaccaactggccacctccttcatcagccaaggcactaagatccttcctcggtctcaccgatttctaccggaaatttgtgaagggttatgcttctatcgctgcccctctcacgagcttactttgcaaggacactttctcgtggaccccggaagcctag

SEQ ID NO: 51319 - DNA, 435 bp, Glycine max
  Peptide Sequence Number=SeqID_168097
atgcaaaacaaggcaacagttgaaatgctctacatggcactattagggcaagaaacaatggacaatgtggccaaactgctagcaagtgaccttgagtggtggttccatggccctcctcaatgccaccacatgatgaaggtgctcacaggggaaacagatcacaccaagggcttccggttcgagccgaagcaagtcaccgccattggagactgcgtgattgccgaggggtgggagggcaaggcctattgggtgcacgtttggaccctcaaaaatggcctcataactcagtttagagagtactttaacacgtggcttgtggtgagggatttgaggacaccaaggagggaagatagcaaagatagcatgacattgtgggaaagccagcctcgtgatctctatcaccggtcactgccaggacttgtgttaaccatttag

SEQ ID NO: 51320 - DNA, 150 bp, Glycine max
  Peptide Sequence Number=SeqID_168098
atggagcttgaggatctggtcttggagaatctcgtagcacagtgcaagcttagcacgagcacgtcgtcacacttgggaaccctagaggggagtcgaagagtgaaaatgcagagcgcaagagagtacagagagctagacatcaaatattaa

SEQ ID NO: 51321 - DNA, 316 bp, Glycine max
  Peptide Sequence Number=SeqID_168099
tggttcatccggaagaattccggaagactcgcacttccggaagaagtttcaaacttccggaagacctttctggaagaacccttcttccggagtgtttccggaagaaccacttcttccggaagtgatcatggccagaacacgaggtttaggtcgtgccataggtagatttgtaggcagagatagagttgctgacgaggatgctggcgatgttcccgagaggcgtaggcctactgcctcagcccgtaggctacgcgttcatcagatgactacggagggacgtgatatggctgaggacgtcgctgacatgactgatgat

SEQ ID NO: 51322 - DNA, 816 bp, Glycine max
  Peptide Sequence Number=SeqID_168100
atgctcaagaaggatgctgtcgctgcgcggctgaactccgacgaggggatcagctacaccgagttcagctaccagatcctgcagggcatggacttcctcgagctgtaccgccagtacgactgcgtgctgcagacgggcgggtccgaccagtggggcaacctcaccagcggaaccgatctcatccggcgcgcggagggcgtggccgtgcacgccatcggcaccccgttgatcaccaacagcgacggcaccaagttcggcaagagcgagggcaacgccatctggcttgacgccgagatgtgcagtccgtaccggatgtaccagttctggctgggcacggcggacagcgacgtgatcgagcgcctcaaggtcttcacgttcctcactcgcgccgagatcgaggagtacgcgcagctcgtggcggacgagccgttccgccgcgcggctcagaagcgtctcgcgctcgaggtggtcgcgaccgtccacggtctcgaggcgacggcggcggtgatcgccgcctcggaggcgctgttcgggcagggtgacctgactgccctggacgcggacacgctccgcaccgccctggaggaactgccgaatgcgagcgtgactgcgggtaccccggtgatcgatgcgctggtgtcgaccggactggtctcgagcctgtccgaggcgagacgcgcgatcgctcagggcggtgtctcgctcgacggctcgcgcgtcgaggacgaggccgcgaccgtccaggggactcttcccgggggagtctccgtgctccgtcgcggcaagaagaccctcgccggtctgttcgtcgactga

SEQ ID NO: 51323 - DNA, 120 bp, Glycine max
  Peptide Sequence Number=SeqID_168101
atgatgccgtatacagtctttggtcaaaagggatttggaatagagttgataaaggatatatgtgggttaggaaaggaagagctggctgcaaactcagggtttgggatgttggtggcatga

SEQ ID NO: 51324 - DNA, 654 bp, Glycine max
  Peptide Sequence Number=SeqID_168102
atgaagtggcgtctcctctctctctcttccttcttcattccgctgccattcatcttccaagaagcaaaagaatccattgatgaagaagatcctaggcctacaagctccaatgaagcttacatcatgtggtatcagagcatgaaggacaagagatggcatcctctcagagtcttctatccaatacccttgtggcaggatttaaagggtgccatcctgctaatccaagatcaattccaagattctccactaagtgtgcttaggtgtcatgaggcatcccatggacccgaaatctaccctaagactcatgagaaccctagggtcttttcttgcatctctggcacaatctacttggagtcttctatccaatgcccttgcagggaaagccttgggatggagaagtcagctgaaataaggcctaaagagctaagccattcaattcctaagactagatcaaccctttcaatgggtaagaggtggtgtgcaattctaggttgtaaaatattgtgtgagctacccgaatccacaagaattgtcattggaaggttgttgacacgtccaatacattttaaggtctttggggaaggggaacctgttaaggcatgggggaaatatggaaatggacagggtcagcatcacttcggtgatccgttgtga

SEQ ID NO: 51325 - DNA, 1041 bp, Glycine max
  Peptide Sequence Number=SeqID_168103
atgcaaaggcttgatagagctcgggttctggtcagaaccccatggacgccgacagtagagcacatagtcatagcccatatagatggcgacgcccacaaaatttcaatcgtagaggagaattgcaatgcggggatagtatgcgcaaggcaccatcagagtgtttgggggtcatcggaggaaatcctttccgacagtgatgacaccggcaccttgcaatcgtggccgatcgataattcaccgccttctaccaccttcgtaatgcacggtgacaacacattctggcaaagcttggtaaaatccaatggtcaaaccggtacctgtagcccattgggtattactcgtagtagaaagaaacgtggtctgtgtaaagctattagccactcaggagctgaaaaaggaaaggagataaaccttgaagaatgcaacccaactttactagtagtagagtacgaggaattggaaagtcaacttgcaggggcagaaggacagtttacgcaaaaaggggaagatatcccacaacgttttctggccaacacaggggagaaccaaaaaggggagccagatgccttggaccaaggacttgtgggggagaattttcaaaaacatagtaacgggcctctagaggagtttttaaataagtcacgtgacatcactgtggacttatttgggcctaatcctaatatgggccttcatagacctacaaccccaacgaaccagcaaattaaccagcagaaaaaaacctgtaagtgctttgcagaaaaacccagtaaccacaagcacaatgctgcctcatgtggttcggacgaagttttggagtctccaaaacagcataacttccatcaaagcccttccccttcaagtatcctcaatataaatgacatggaggttaaggatgatgcttataggaacttagccaaggaattgggagtttctttcgcagatgataaaagcaatggtgcaaagttgatgactgatatggacaacactgaaaatcctccaaaatcagcagctgtgttgggaaatgaagacaatgcctcatga

SEQ ID NO: 51326 - DNA, 624 bp, Glycine max
  Peptide Sequence Number=SeqID_168104
atggcattacctatacaagagaagattggtgtagcacccattgaggataagatgacaaaattggctaaggtggcgctcggcgcgccagacagggtcccaccacctctgctcgccgcgtcctccgccgccgccgcgtcctccgccgcctccacggcgtcctccgccgcgaccggcggaggaggaggcacccctgcggccgcctccctggtagttggggcggtaggccatgacgggggaggagattcgaagggcggaagaggcagcgaggcatttataggagggaccgcgggaagtggaagcacatacacgagtgcgagttgcaacgtgtgggggtgccaatctctagcgtgcgaaggagaaattgagtttgatggatacaattcaaatgatgggaaatttgaggaggttgatatagaggatgattttttggaggatgatggggttgcttttgaggatgatgggtttgatgatgaagaaggttgcgacaatgaggtttcggatgaagagggttatgatgaaactgttttggaagacgatgatattgcaaggctaaattttgttgatcttgatgttgcttatgaattttataagtggtatgcacgaaccaatgaattttctatttga

SEQ ID NO: 51327 - DNA, 567 bp, Glycine max
  Peptide Sequence Number=SeqID_168105
atgcctcgctgcctcttccgccctactttctacaccgcccaccatcgcctcactctcaccttcctacacccgcccgcatccaaacttttccccacagaccttcgaatctcctcccccgtcatggcctaccgccccaactaccagggaggcggccgcaggggtgcctcctcctccgccggtcgcggcggaggacgccgtggaggcggcggaggacgcggcggcggcggaggacgcggcgagcagaggtggtgggaccctgtctggcgcgccgagcgcctgaggcaacaacaagcggagaaggaggtgttggatgagaatgagtggtgggataagatagagaagatgaagagaggaggggagcaggagatggtgattaagcgtaactttagtattgcagaccagaaaaccctagctgatatggcctatcagcatgagctctacttagagaagaccggtagactctgtagtgaggagagtagaccagatggagagaaggcaaacaattcgagacagaggaagacccaaaaagactataagagaggttatcaagaaggatctcgaacttaa

SEQ ID NO: 51328 - DNA, 834 bp, Glycine max
  Peptide Sequence Number=SeqID_168106
atgagagagagagagagagagaatgagagacagagagaacgagtcaaagagtgcgagagaaacactgagagagacacaatcagggatcgagagtggataactgtgaggaaccgaaagagagagagacagcgtggatggcagcacccgacggagggcctcagacaacactacggcggacagcggcaacgaaggactggacaacaacgcaaccactatcaagtaaactggcatgacagacctgacgtcatgacattttacttcactagatttccggaggacacatcggagaaggagctgtggtaccatttcaagcagatgggggacgtgagggaaattttcatccctaaacaccgaaacaaagaaggaaggaggtatgggttcgtgagatacaaaggagtctcaaacgcgagctacatggaaagaaaattagataacatgatcgttgggggcttcaaattgcacttgaacatcccaaagtatgggagaggaaaggaggaaaaagaactaaccgcagccaaacaaagggggcataaggagggtgataatccgaggtgcaacgtggcagtagagcaaaacacgaagagatcgtatgcggaggttgtcatttcacacgcagagaacaaggaaagaagaagcggtacctcctccttgacgacgacacatgggagaacccattcttccatcacacttgagatttcggaggagacgaagaaaagatatgcagatacctgggtaggaagactgaagagacaacaggtgttcgaacgagttgaggacgaactctcgtggacccttggctcagaagtatcgccgaaataccttggagatgacttg

SEQ ID NO: 51329 - DNA, 2634 bp, Glycine max
  Peptide Sequence Number=SeqID_168107
atgtccacagacattgagagaagagtaggaaatcttttgaatagctcacaatcaacgggggcagcaccatctagtttgccttctgtatcagctgaccttggacataaacaatctgcagccactataaaatctgtttcttcacgacaggctgattcttctaaggagaaacttagtgttgcactcaaggaagggcaagaacttgtacaggcaagtgatagtttgaaggaaatgaaatcatttagggagaagcttcctgcatttaaaatgaagtctgagtttctgaaagctgttcaagaaaatcaggtattagtagtttcaggagagacgggctgtggtaaaacaacacagttgccacaattcattctagaagaagaaatatcgtgtttgcgcggagctgattgcaacataatttgtactcagcctcgtcgagtatctgcaatttctgttgcagctcgaatatctgctgaaagaggtgagagtctcggagaagcagttggataccaaatccgtcttgaatcaaaacgttctgcagaaacacgccttcttttctgcaccactggtgtattacttcggcagttgattgtcactggtgcttgtattgaacataaaattcatactgtacaagacccagacttgataggtgttagtcatttgctggtggacgaaattcatgaaagaggcatgaatgaagactttttaattataattttacgtgaccttcttccaaggcgtccagatttgcgtctcattctgatgagtgccaccattaatgctgatatgttctctaaatactttgccaatgccccaacaatgcacataccgggatttacttaccctgtggcagagcacttcctagaagatgtgttggagaaaactcgatacagcatcaagtcagattttgacaattttgaggggaattcaaggagaaggaaacaacaggattcaaagaaggatcctttgactgaaatgtttgaggcatgtatatttgacccatcaattcatgatattgatgtagatactaattacaaaaattacagcttgggtgttagaaaatctcttgaagcttggtcaggctcgcagattgatttgggtttggtagaggcaacaattgagtatatatgtcggaatgaagctggtggagcaattcttgtatttctcactggctgggatgaaatttctaagctgcttgacaaactaaaaggaaataacttagttggagactctagcaagtttttaatccttcctttacatggctcaatgcctactgtcaaccaatgtgaaatatttgaccgtcctccccctaacaagaggcaaatgatcagtaaagatgagggaaaaattgtgctagcaacaaatattgctgagagtagcatcaccatagatgacgttgtgtatgtcatagactgtggcaaagcaaaggagaccagctatgatgctctaaataagcttgcttgcttgttgccatcgtggatttcaaaggcttcagctcatcagagacgtggtcgtgctggtcgagtgcaacctggagtttgctataggttgtatccaaaactgatccatgatgcaatgcctcaatatcagttagctgaaatcctccgaacacctttgcaagagttgtgccttcatattaaaagtttgcagcttgggactgtaggatcatttttagaaaaggcacttcagccaccagatcctttagctgttaagaatgctattgaacttctcaaaacaattggggcgttagatgaacaggaggagctcactccactgggtcggcatctttgtaacatacctttggacccaaatatagggaagatgcttctcatgggctctatatttcagtgcctaaatcctgccttaactattgctgctgctcttgcataccgcaacccatttgtcttacccataaacagaaaagaggaagccgatgcagcaaaacaatcttttgcaggtgattcttgcagtgatcacttagcccttctcaaagcttttgaaggatggaaggaggcaaagcgaagtgggaacgaaaaacaatttggttgggataatttcctatcccttgcaaccttgcggttgattgacgatatgagaatgcagtttctcaatttattatctgacatcggatttgttgacaagtccaggggtgctactgcttacaaccagtatagtcatgatttggagatggtttgtgcaattctttgtgctgggctctaccctaacgttgtgcagtgcaaaagaagaggaaaacggacagcattctacactaaagaagtagggaaggttgacatccatccggcttctgttaatgctggggttcatctcttccctcttccctacatggtgtatagtgaaaaggtgaaaacaaccagcatctatattagagactctaccaacatttcagattatgccctacttctgtttggtggtaatcttgtccctagcaaaagtggtgagggcattgacatgcttggaggttaccttcatttctctgcttcaaaaagtgtcattgagttaataaggaaattgcgtggggagcttgacaagcttctgaacagaaaaattgaagaaccaggatttgatgtttcgtctgaaggaaagggagtggttgctgctgctgttgaattgctgcacagttaa

SEQ ID NO: 51330 - DNA, 147 bp, Glycine max
  Peptide Sequence Number=SeqID_168108
atggagaaggatgaagaattcaataagtggtttattggtaaatggaggataatgagggtgcttgatggagttttcgatgctaggcaaggagcttttataggtggaaggaatttgcttgatggggtggttgtggccggatgggaatag

SEQ ID NO: 51331 - DNA, 921 bp, Glycine max
  Peptide Sequence Number=SeqID_168109
atgaatgacttgttctctggctccttctcccgcaacaacgaccaagtcttgcctgaccaccaccaccatgtgatcgagatggcggccgcgtcatcaccaacagccgagggcagcgcgaaccttgaaaagttctttcaagaagttgagcaggtgaaagaggacctgaaggagctggagcgtctccatgagaatctacgtgggaaccacgagaagagcaagacccttcacagcgcgaaggctgtgaaggagcttcgctcacgcatggatgctgatgtggcactcgctttaaagaaagcgaagctcgtcaaggtccggctcgagacgctggaccggtccaatcaggtgagccgaaacttgcctggtttggaacctggttcgtcctcggaccggaccagaacgtctgtggtgagcggactgaggaagaagctgaaggactctatggacagcttcaacagcctcagacaacagatatcatcggagtacagggaaaccgtgcagcgtagatattatacggtcaccggagagaatcccgatgacaaaaccattgacctcctcatttctactggtgagagtgaaacattcttgcagaaagcgatcgagcagcaaggtagagccagcgtgatggacacaatccaagagattcaagagaggcacgacacagtcaaggaaatagagagaaacctaaacgagcttcaccaagtgttcttggacatggccgtgttggtgcaatcccagggagaacaattggacgacatcgaaagccacgtggcacgcgccaattcatacgtgcggggtggggtccagcagctgcacgtggcaaggaagcaccaaaagaacacccgaaagtggacatgcatagccatcatattgctcattattatcatcttgatcatagtcctccctatagttctaagaaaatga

SEQ ID NO: 51332 - DNA, 204 bp, Glycine max
  Peptide Sequence Number=SeqID_168110
atgttgcagaaaggtgcaatggcagctataactttgttaattgtcaccattgccatcgagtattgttcttgtgtgagaaggccaacaacgctagaagcatactttgttatcgttgactattttgcttccctcacttctttcaggattgatttgtcactcaagataggtcttgttcaattaaaggagattgggtgcgaagtctga

SEQ ID NO: 51333 - DNA, 195 bp, Glycine max
  Peptide Sequence Number=SeqID_168111
atgatgaaaagagagaaagagaaaaatgagaaactcacaaaacaaaattgtgaagttcttcgaagtgatgactatagcgttgtggcggaagcagagcaacagttgaaagatactaatgttgtgtctgtctatgatgtgttgttctgttactcacataaaacgatttcttcttccttcctctttcaacagaaatag

SEQ ID NO: 51334 - DNA, 279 bp, Glycine max
  Peptide Sequence Number=SeqID_168112
atggagaagagaaaggatgacacaacgaagtgcgcgagtttggaagcaacaagaattttgagggcgtggttggtcgatggtgagcctcaagaaagagcaaggatccatggcgggagagagcgaaggcacgacacggaggaggaggatgtggtgcaagtagcagcacgacgtagaagagatgggagttggttgcgacggcgcggttgggtgatgattgggtcatgttggtgcgaggttagggatggtggtgactggcagatttgggctagaggttattag

SEQ ID NO: 51335 - DNA, 957 bp, Glycine max
  Peptide Sequence Number=SeqID_168113
atgtggttctccatggctgcttcaacttcaactgctacttcctcccttatctgcaacatttcactcacctttaacttcccacacacactcataccctcgaaacccctcaatctcaacccccaactattctttgcttctcccctctcactctcactttaccatttccccctctcttcactttccttccaagacactcaaaaaccccttcaacgcgaaaccttccaaaaaccagagccgaatgcgtcacatacaaaccaatcctccagactctttgtgggaaacttgccttactcattgctctcttcccagttggctcagcggttcggagaggctggcaatgttgtatccgtggagattgtgtatgatgacatcatggatagaagtagagggtttgcgtttgttacaatggggagcatggaggatgctgaacgagcgattcgaatgtttgatggctctgaaattggaggtagaattatgaaggtaaacttcacagcgatacccaaaagaggcaaacggctagtaatgggttcaaactatagaggctttgtagacagccctcacaagatttatgctggaaaccttggttggggtctgacttcacaagatcttagggatgcctttgctgagcagcctggcttcctgagtgccaaggtcatctatgaaaggaacagtggaaggtctaggggatatgggtttgtctcttttgaaactgctgaggatgtagaggctgctttgaattctatgaatggtgtggaggttcaaggccggcccttacggctgaatctagctacagataagaatacttcatctcctctgttagttcttagtcacattggcatatgccaactacaccttcaggcaatttattgtaatggaattgaagggaacatagatcaaaaccataagtcacaaaacattacgcagatagtcattagaaaagtaatgaatgcagtatag

SEQ ID NO: 51336 - DNA, 726 bp, Glycine max
  Peptide Sequence Number=SeqID_168114
atgtcaggtgatgcagaaaatcctcaggcaaccttatcactgcagtcatcacttgctgagccccacaatcgttttgagatagggtttaatcagccaatggtaatttattcaaatcagccacttgatattaagtcaggcattgtaggacggataatgcttccaattaacttgacatccgatgacggaccaacttacgtaaatgcgaagcagtaccatggaatcatcagacgtcggctatcacgtgcaaaagccgtacttgagaacaaaatgattaaacgtcgcaagccatatatgcatgaatcacgccatctacatgcattgcggcgaccaagaggatgtggtggtcgcttcttgaacacaaaaggctctactaatggaaatggtagaaatgaaagcaaagtgaataaaactggcggccgacaattgcagtccagtgcctctcagagttctgaagtcctgcattctgaggttggaactttaaattcctcaaaggagacaaatcgaagcagtccaaacatctctggttcagaggtgactagcatgtattcaagggaaggttttgatggtttttctgtcaatcgtcttggatcttccgttcactccctagtggacatggtattatcacgcccactaaatgggttgcagcagtatcagcaccaccctatccttgcaagggaccaggcttgtcatgacatggtcatacatgctaatggcttcatatcctga

SEQ ID NO: 51337 - DNA, 309 bp, Glycine max
  Peptide Sequence Number=SeqID_168115
atgagagaagaaagtgggaagaagtggagagaaagaaagaaaagaacgaacccactgctagctttggatgttgaagtcgtagaaggagacatatttgctcatggatggcctggaaggagtggccaggatcgacgtcgatgtcgggccgttgatgtcagtgagggggattgtgggggaggagggggaggagacgaagaggggattggattcgttgtcgatgttgggccaggaggatttgagccagcccaggacgtggtcgaaggagcggttctccatgaactagccgcacaagcacaagtaggacgctag

SEQ ID NO: 51338 - DNA, 369 bp, Glycine max
  Peptide Sequence Number=SeqID_168116
atgcatgcatgcaccacgcaaaccgctaatggaactggcgagtttgttgtttccgaaggaatcgccagttacaatggcgatatcgccatgcatagggaaccgccagtcaaactggcgagttccaagttgcagaagttacagtcgtacatcatgaattcggttataacagtgttgtatttcaatgcaagggtatatgaaggaaatgatggtgtaatatttgaaggcagtaaaaaagcgattcagattaaacgtggaattagtttcaatgcgttgaagaaaaaaattggagataaggtgcaaccgccaagaaatgtgagcaatttacatggtgatgaagatgatgatgattatcttgtgtctaactcatac

SEQ ID NO: 51339 - DNA, 265 bp, Glycine max
  Peptide Sequence Number=SeqID_168117
atggcgatgcaaaccgtttacctgaaagaacatgaaggacttgtctacaattctgttggacagttgtcatctgtaacttcagctccatggtggagtgccttaggatctcaaccagtttatggggagtattgtggtcaaatcaaacccttttcgttcgagatttccaactacgtcgaccaattcccagccggtaagcaagcggtacgaggagttgaacaattgttggataaaggacatacaacaacccagtttaccatctttccag

SEQ ID NO: 51340 - DNA, 192 bp, Glycine max
  Peptide Sequence Number=SeqID_168118
atggctaccttggggctggagattttggttgaatctgcctcaagtgttattttgaagatgatattatcatttgaccttgcttttgctttgattccgctcctaaagttcagtagcagcaaagtgactagcagcacaagcattgaagagggaagtggaagattttgcacgaaggttaaattctgcttggcctga

SEQ ID NO: 51341 - DNA, 393 bp, Glycine max
  Peptide Sequence Number=SeqID_168119
atgacatgtggagacaaattatggccattccacacctctttgccattcaacacagtcgtgtccgatggcacgcagagacaaattatggtcattctgcaccccttttgtcatccagaggcggcgagcccgatgacatgcagagacaaattatggtcattccgcacccctttgccattcagacacagtcgtgtccgatggcacgcagagacaaattatggtcattctgcgccccttttgtcatccagaggcggcgggcccgatgacatgcggagacaaattatggtcattccgtacccctttgccattcagacacagtcgtgtccaatggcacgcagagacaaattatggtcattctgcgccccttttgccatccagaggcggcgggcccgatga

SEQ ID NO: 51342 - DNA, 435 bp, Glycine max
  Peptide Sequence Number=SeqID_168120
atggtgagctttgctagggttttagagaaaggagatgaaggtgtatccatggaggaagaggatctatttatgcgaagtatgaagaaagtaaaagaggaccaaaaggagaaaggaagtggagatgatgtgtcttatgctgataatgaaggatgtagtccttatgtacagagtaaaggaggaaatatggaggatgtagtctttatgtatgaagtaaaggataatagtgttttggaggaagtcccaaaggagagtttaaacactatggatcagaaacttgatgaacatgtgattccactatctgatgttgaactaataagagccttggatgatggcaaactgatgagaatcctgaaactggtcaaatacaggctaaaggcccaagtggagaaggataaagcccccgagtggagagtgagtggtaaaaggcaagagtga

SEQ ID NO: 51343 - DNA, 369 bp, Glycine max
  Peptide Sequence Number=SeqID_168121
atggagtttgttgagtcgaaccctctcttccaaaaccccaaatcaatgtcttattttgttcttctcctccaacttggtgtgggattggcgtttggagggctgattttaaaagagaaatccctcctcccactggtagtgagaaggtggtctccaaaaactctcttggcaactaataggttcatttgtgagatctgcaacaagggatttcaaagacaccacaatctccaacttcacagaatagggcacaatttaccatggaagctgaagcagagatcaagcaacgagattataaggaagaaggtgtatgtctgcccagaagctagatgtgtgtaccacgacccttcaagggcaagtaaattgctggactaa

SEQ ID NO: 51344 - DNA, 309 bp, Glycine max
  Peptide Sequence Number=SeqID_168122
atggaggccatgatgagtatgagaagcatgatggaggtcaatatggctacagttgttgccgcaagtaccgccacagaggtggtcccgactcacccacctagctttaatcaaggaggtgaggcattaggaggtccgggaagcccctattttgtgcaagttcaaaacaagcattccttcccaccaagtggatttcctcccaactatacaccactcaatgttgtacatgctcctgatgagaatgttgacaactccgcacccatacccattgagagtcaacagccccaatctgatcatgagcatgtctcttaa

SEQ ID NO: 51345 - DNA, 408 bp, Glycine max
  Peptide Sequence Number=SeqID_168123
atggcgatatctacgttgcatagggaaccaccagtcaaaatgacgagttccaagcaggagagggcacaggcgggaagcgccattggcgctagcgggttgcagggaagaactcgccaccagtactggcgagttgcttgttcaaaaaaaaatttgcctataaagcaacgcaagacagctgctcccttatgcatgcattcctttcttctctttggatcccttcactgcattcctttcttctcttattcctgcttccagtgcactagtttcttctcttcctactacgggtttgtgttcttggtgaagtttttgatcttgcttgccctacactgtttggttgcttttcttagtgcgtgtttgaggttagatttttgtttagttagaatgctcaagaatgctctcagtttttga

SEQ ID NO: 51346 - DNA, 204 bp, Glycine max
  Peptide Sequence Number=SeqID_168124
atgacaggcaactacagaggagcacgtgagggaggagaaggtgaaaacgaggtcatagattccaaatctgttgtgtgtgaggccatggatctgagcgatgacggagagggaaatggcagtcttcgacacgtcggtgccgccacgaggactgatgaggatcttgatattattgttcttcgtattgttgggatgtgtgggtgttaa

SEQ ID NO: 51347 - DNA, 696 bp, Glycine max
  Peptide Sequence Number=SeqID_168125
atggaaaatggaatggtggtggatctgaaaaaagatgttgctaccttgttttgtccaacttcaaggggtgttgttcctgttagtgttgccaagtctgtcactttcactgcaacagactgcaccaaccaaccaactgctttgggtgcttctgttctcagggaaactattccacactctccaaaaccattacatgagaataagccccagatttctgttgcaactgcaaaggcgcaagttgtgggatggccaccaatccgttcattcaggaagaactcaatggcttctcagcctcagaagaatgatgttgctgctaatgcagaagccaagtctggatgcctttatgttaaagtcaacatggaaggctccccatacttaaggaaagtggatctgaatagttttaccacttacaaggacctctctttggcacttgaaaagatgtttagttgttttacactcagtcaatgtggctcatatggggtttctagtcgggaaaatttaagtgaaagtagattgatggatctccttcatggttcaaaatatgttcttatctatgaagacaaggatggagattggatgctagttggtgatgttctgtgggaatcccaaggatcagctgcttacatcagttggcacatggcctcatggtttggagagtttacactaggaagaataaaggaaggaatggcagaatgctaa

SEQ ID NO: 51348 - DNA, 1239 bp, Glycine max
  Peptide Sequence Number=SeqID_168126
acatatgggtttgctagggtttatccccctctaaccccatcgacgtcacccctccacctctctgcctccatggaccctatttgttcatggagcttcctttctttcgattggccgcttgcaccacctcccaaacaaccatctcagcccccatcctttgctgaagcactatgcaacactttagatatcccgcttagtcagctatgtaagccatgtttgaagggtgaatcaatatcgatcaagatctcagaagaaaaaaaaaagtacaagaaagggttatatggctgtaagaacagcttttacgaacttctgagcatagccaaaggaattgtcttcgtaaaaatctcagaacctaaacccaggtatcttgcatacccaatgttgggtctaactctgcgatcttcctttggaatattggaggcgcctcttcagtcactacgcttccccctttttgctcttgccaccatagccaacatcacgcaaggcactgcaaatcctctaaaggctcctcgcatatctcctgctaaagctctgaaggaggaaacacaagaacctggcccctccaaccaaaaccaaaagcaggctccaaagcttagtgctcgccatatgcctaccaaggcttgcaaggacgcaacccaacaaaacctagagaatgcttatcatatttctgatgcagaatctgattcaaaccctggacatattgttcccactccccctctgggtgcaagctctcccccaactagcagacaaggtgttcaaatgtcttcttcaggtaaggctgacattgtggatgaggaacatgatgaatctggccaagaggaagaggacgagaatagagggttcatagaggcggtcgtctccctcttcccgcttcctatgataatttccaggcttggacggatgccagtgcccttaaccacattgataccattggtgctctctatgcctagtcaaatggtcgtcatactaataggcacattgaagctcacctggatagggccatcgataacgatgattgcctggatagttgggactccttatcctgttgcaaccttaccagaaaatcattgtgttgaaaatgacctcatagctactttaattctctccttggcttcctctgacaacaagtgtatgctcactaatttgcctatcaaagaagaagttagactcgtttttgctatgaatggttacagggcttcaagcctagatggttttggagggagcttcttccaagcattctag

SEQ ID NO: 51349 - DNA, 267 bp, Glycine max
  Peptide Sequence Number=SeqID_168127
atggcgggtccaaggaactttaagtatccctcttacgcgttctacatggattatttgactatcttttgtaaaggtgatgctaacaaccttaaaagcttaatggacctcttcctaagatttggagatgcttcaggacaacaccttggtcttcataaatgtagattttttgtcggtaacctctctagagccagattgcacatctctactaggctagtttttgttcaaggccaactccttttaactaccttggggtccctatcttcaaag

SEQ ID NO: 51350 - DNA, 384 bp, Glycine max
  Peptide Sequence Number=SeqID_168128
atgttgtccatttgtatctgcaagtataagtggtggctggagaaattagctaacataagcttgcgacaaagtgctgcatatgaagtttggaattttagctttaacattctttatcattcaactcaggttatcgctgtgctatttggaggaatgtctattctagcgggtcatatcacagttgagaaacttaccaagtttatattatacagtgaatggttaatttattctacctggtgggtgggagacaatatatccaatttgatgcaatcggttggggctagcgaaaaacttttctttgtgtatgctgtaagagataatatcatcgatcctgtcaaagacaaggtacctggtcctctgaacttttctagaaaaatcattatttaa

SEQ ID NO: 51351 - DNA, 294 bp, Glycine max
  Peptide Sequence Number=SeqID_168129
atggcttctgaggttatgccaatacactcggtaatgttccttccctacatgaagccttactgctcctcagagatgatcttaggggctacagaggccagcctgataaggagtcccaactatccaggcaatcatcgttatcgatggccctatccaggcatagagagcaccaatggtatcaatgtggttaagggcactggcatccgtccaagcctggaaattatcataggaagcgggaagagggagacgaccgcctctacactcatgctccctaagtatagcattaaagtcccttaa

SEQ ID NO: 51352 - DNA, 357 bp, Glycine max
  Peptide Sequence Number=SeqID_168130
atgtcagtgaaaaatctcattgggcacctaggagtacatgacaagacaaacaacacactagtaagtcaagtaactctcatttggcttcaaggaacattcaaactgagtgtatttacccctaaggcctacactctgaagagtctgtcaggatctctccctcttgattcaggattttcaagcgttagaaagaaggagaaggaattgaaaccttcatttcactgtctccatgcaaaggacgtttctctatccaaggaccttatttcgcaaatcccaacgataggagtctgtggaaataaattccaaacttgttgttcaaatttcatgatgatccaatggttaacgagtccgagattgtag

SEQ ID NO: 51353 - DNA, 126 bp, Glycine max
  Peptide Sequence Number=SeqID_168131
atgttggaggagctgaaggcatatgctaatgaaaaccgtaagaagctctttcaaccccttcccaacacctctatgggcatagccacattgattttttgggatagggcaatgctcatgatacattaa

SEQ ID NO: 51354 - DNA, 441 bp, Glycine max
  Peptide Sequence Number=SeqID_168132
atggaaattaaagaagttagagtgcaagttcctttaacttgtgcctctaacagtaaagtgagtattcctctagatgttgttccaaacaacaatgaagaagagcaacacaataatgagtccatgattcaaaatgaacttattctagaggaaccacaagaagtagcattaaggaggtctcaaagagaaaggaggtcaactatttcaaatgactatgtgtggttggaagccatgacaaaagagttaagatccatggaacataatagtgtttggaaccttgtagaattgccaaaaggttgcaagaaagttgattgtaaatggatttttaagactaaacgtgactctcgtggcaaccttgaacattacaaggttagacttattgctaaaggttttactcagagatatgatgttgattataaagagacattttcatcaatttcatga

SEQ ID NO: 51355 - DNA, 3667 bp, Glycine max
  Peptide Sequence Number=SeqID_168133
tgatagtgaaaagagtgataagctcattcagcatttggtgcaaatacttttgaagcagatgaggaatacaccattgaatgtggctccttacacagttgggctggacgatagagttgaagagttgaaaaagctgttagatgtgaaatccaacgatgtaagggttttggggttgtatggaatgggaggggttggtaagacaaccctagccaagagcctcttcaacagccttgttgttcacaattttgagcgacgcagtttcattacaaatattagatcacaagtctccaaacatgatggtttggtttctcttcaaaacacaattcatggtgatctttctggtgggaaaaaggatccaatcaacgatgtcaatgatggtatttctgctatcaaaagaatagtacaagagaatcgagttttgttgatcttagatgatgttgatgaagtagagcagcttaaatttttgatgggtgagagggaatggttttacaaaggaagccgtgttgtaataaccacaagggatagagaagttttaactaaggctaagagttatgttgataaacattatgaggtgaaggaattggaattctctccatcaatggaattgttttgttaccatgcaatgagaagaaaggaacctgcagagggttttttggaccttgcaaagcaaattgtggagaagacgggagggttgcccttggctttggaagtttttggctcttttctgtttgacaagaggacgatgagggaatggaaagatgctgtggagaagatgaaacagattagtccttctggtattcatgatgtgctgaaaatcagttttgatgcgttggatgaacaagagaaatgtatattccttgacattgcttgtttgtttgtgcaaatggaaatgaagagggaggatgtggttgatatattgaatgggtgtaattttagaggagatatagcactgactgtactcactgcaagatgtctaattaaaatcactggtgatggtaaactgtggatgcatgatcaagttagagacatgggaaggcaaattgtgcatagtgaaaaccttgcagaccctggtctacgtagcaggctctgggatcgtgatgaaatcttgattgtcttaaagagtatgaagggaacaagaaatgttcaagggatagtcgtagattgtgttaagagaagaatgtccactcctagagatcgctctgctgatgaaattacttgggaaaattttcgacgtaagcctagttgtaaattggcattagaatatattaaagagaagtataaaaagtatgtgcgggatagagaagagaaagcaaaagaggttgtacttcaggctaagaactttgaatcaatggtttccttaagattgcttcaaattaattattcgagattggaaggacaattcagatgccttcccccaggactgaaatggctacaatggaaacaatgtccattaaggtatatgccttctagctatagtcctttggaacttgctgtcatggatctctcggaaagtaacattgaaactctgtggagcagaagcaataacaaggtggctgagcacttgatggttttaaacctctccaattgccaccgtttgacagcaactcctgatttaactgggtatctctctcttaaaaaaattgttttggaagaatgctctcatttaattaggattcatgaatcacttggaaatctaagttccttagttcacttaaacttgcgtttctgctataaccttgtcgaactacctagtgatgtctctgggatgaaacatctcgaggaccttattctttccgactgctggaaattgaaagcattaccaaaagacttaagttgcatgatttgtttaagacaacttcttattgataacactgctgtaactgagcttcctgagtccatcttccacctcacaaaacttgaaaatctgagtgcaaatggatgcaactctctgaagaggttacctacctgcattgggaaactctgctccctgcaagaattgtcactcaatcatacagcattagaggaattgccatattctgttggttctttggaaaaactagagaagcttagtttggtggggtgcaagtcactgtcagtgattcctaactctattgggaacctaatttcattggctcaattatttttggacataagtggaattaaagaattgcctgcttctattggttctttatcatatttaaggaaactgtctgtgggaggctgcacttctcttgacaaattgcctgtgtcaatagaagcattagtttctattgttgaacttcagttagatgggacaaaaattaccactttgccagatcaaattgatgccatgcaaatgttagagaagcttgagatgaaaaattgtgagaatctgaggtttctaccagtatcatttggctgtctgtcagctcttaccagtttggacttgcatgagacaaatattactgaattgccagaatcaataggaatgttggaaaatcttattcggttgaggttagacatgtgcaaacagctccaaaggcttccagattcctttggaaatttgaaatctttgcaatggttacagatgaaggaaacaacacttactcatctacctgatagctttgggatgctcacaagcctggtaaaactagacatggaaagaaggctctatcttaatggggctactggggtcataattcctaacaaacaagaacctaattcaaaggcaatattaagatctttttgcaacctaaccttgctggaagagttaaatgctcatggatggggaatgtgtggaaaaattccagatgactttgaaaagctatcatcactagaaactttaagtttaggccacaacaatattttcagtcttccagccagcatgataggactatcctatctcaaaaagcttttattgtcagattgcagggagctcatttttctgcctcctcttccatctagccttgaagaacttaatcttgcaaactgtattgcagtacagtacatgcatgatatttcaaacttgaagctcttagaggagttgaaccttacaaattgtgaaaaggtggtggatataccaggccttgaacacttgaagtccttaaggaggttgtacatgaatggttgcattggatgctcccatgctgtcaagagaagatttaccaaggttctacttaaaaaattggagattttgattatgcctggaagcagagtcccggactggtttacagcagaaccagttgtcttttccaagcaaagaaaccgtgagcttaagggtattatttgttctggtgttctctctttcaataatatacctgaaaaccaaagagaaggactgcagttagaggatgttcaaggaaaaatcttcaatttgactgataaagtgtttagcacaacgtttcgccttctaggagtacctaggacaaataaagaccacatatttttgcgcagatttggagttaattcttcgttagtttttcagttacaagataaatataccttacatttgaaaaagagagaccctcctcttattgagaggctggagctgaagaactgcagaattcttttagtttttgaaggcgatgatgattacgtgggagacgaaggatcactagatgaaagccaatactctgtttcacaaaaattagccaagttcttcaactttgctgcaaatgacccatgtgtgtga

SEQ ID NO: 51356 - DNA, 336 bp, Glycine max
  Peptide Sequence Number=SeqID_168134
atggccaatagggatgaagtgcaagaactatcatcaaaagagagtaattcctggaatgtcagaattcaaagtggagaagtacaaaaaagggatgttgacttgagagagggagggttggtggctctagatcagttggacatacacaaaaatagcaatggtgagagagacagcaaaggtgaaatatttgaatatgagacacaagagcaggaagcacaagaagagggagaaaagtatgaagagatacgtgaaggggagatggagaagatagaagatggttatgaaatcgggctacttgggcccaataggtctatctcttataagagttttccattataa

SEQ ID NO: 51357 - DNA, 460 bp, Glycine max
  Peptide Sequence Number=SeqID_168135
ggatcgcgcccataagacacgcagtggacccggaggagcccaacagggccttggggtttccagctctggttacgggcctctgttagtcctacagggtgcccgttccccccagcaagggatcgtgctcgcaagacacccagtggacctgaagaagtctaacagggtcttagagttgccagctctgattataggcctctgtcagttctacggagtgtccatcgcccccagtaaggtcatcaagccccctattaaccggactttcatcgagaagtactgcgcccccaggcaggcgcagggcgagacaccacaacagcctaggaatggtcggcagcaggcaacagacgcaccgccgccacctccaaagcccctcagctcatcttcaaaagctggagcattgcctacgacttgtggtcgacagcaagcgaccaagtccaaagccaaagataaacaaaagtactag

SEQ ID NO: 51358 - DNA, 480 bp, Glycine max
  Peptide Sequence Number=SeqID_168136
atgggtgaagtagaggaggtacaagagaagatgaaggccgacatggaggccatgaaagaacaaatggccacgatgatggaggccaagatgatcatgaagaagataatggaagccagtgcggttgcagttgtcgctaccaacactgttgctaagtacggacgaccccatgatgtgcaaattcaaaacgagcatgccttcccaccacatggcttgcctcccaactatacaccacccaatgtggcatacactcccaatgaggatgtcaataaatgctcattgagagtcgacaacctcatcatatacatgtctctcaacccatgggggagacacatgaaattccccaccacaatcaagccgacttcgggccttgcctcggatatgccactgaagggcaagcagttggactacaagtcctcgccttcagaggactacacgttctcagcatcagagggctacatgccctcgccttcagaggactag

SEQ ID NO: 51359 - DNA, 288 bp, Glycine max
  Peptide Sequence Number=SeqID_168137
atgacaaaagacaaggttgatacctcaaagccctacactagggcaatgaggggcaccgtgcatgagcttcaagcgaacctaggggcagatcaaagggacaaaccctgggatttcaatggattgattaaacgtcaaacggcttcattgtcgtcactccaaaatggtcaagtgactaaatcaaacagaacatacactttgagggagttccaggagagatttgccaaagataggataaggttgcctgaattatcacctctttcgaaaggacagtccatttgggttttctga

SEQ ID NO: 51360 - DNA, 501 bp, Glycine max
  Peptide Sequence Number=SeqID_168138
atgatgcttactgcatgtaaaggagctacttcatttgaagatattagaacagttgaaaatgttctataccctacatatagagaaacatgctttgcaatgggttttttgcaagatgatagagaatttgtggaagcaatcaaagaagctaaggaccagggtgtccttactaaacctgaagaactctggaatcagacatggaattggttagctgaagacattgcatatcattataaaaaaattaactttgaacacaaagactatcctacaatgccatatcctgagggtggaaatcctgcatcatgtctagagaatagcttgatattgtctgaacttaattacaacaatgatgaggctagattagaattcgaaaatctttttctatcgatgacaggtacaggaaaaacatacatatggagaacattagcaagttcactgagggcaaaaaatcaaattgtgattatggttgcttctagtggcacagcttctttgttattgccatga

SEQ ID NO: 51361 - DNA, 291 bp, Glycine max
  Peptide Sequence Number=SeqID_168139
atgaaacaaattcaggaagcattgtctactccaatcgatgcagctactgactttgatgaggatgaattggaagcagaacttgaagacctagagggtgttgaattggaagaacaacttcttcagcctacaactagagctccagctgctctagtgcatgttccagctggctgcaacccactcgccttgtgtcttcaaagcccactgccaaggaagatgaattggcagctttgcaggctgagatggcactttgagcaactggttttgaataggccagaattttgcaggcattga

SEQ ID NO: 51362 - DNA, 1740 bp, Glycine max
  Peptide Sequence Number=SeqID_168140
gagataatatttcttttaagaatccgttctactgcgaattaactgcacattattgggtttggaaaaatgaatctcttgccgattatgtcggttttatgcattatcgccgtcatctgaatttctctcaaaatcagaatttttcggaggataattggggggtagttaattcacctgttatcgatgtagagtatgaaaaccaatttgggctaacggatgctgagatacagaagtgtattttaggttttgatctgatattacctaaaaaatggtcagttacttctgcgggcagtaaaaataatctcgaacattataaaaatggagaatttttacatttacaggattatctgactgcacttgaaatagttgaagagctatatccagattataaaacagctattcaagaatttaacaatgcaacagatggttattatacgaatatgtttgtgatgggtaaagacatgttcatagactattcagaatggttgtttgagattttggctattcttgaaagtcgcatctctatgagcaattacaactcgcaggaaaaacgagttattggacatattgcagaacgtctttttaacatttatattattaggcaacaacaaaatcgtgctcttaaggtaaaagaactgcagcgaacttttgttacaaatgagacattcaacggaaagttaaatccagttttttcaaatgctgcgccaatagtaattagttttgatgacaattatgccatcagtggaggtgccctaataaactcaattgtccggcactcggataataatactaattatgatattgttgtactcgaaaacaaggttagcaatcttaataagaggcgcttaaaccatcttgtttcggcgcataagaatgtttcactcaggttttttgatgtgaatgcatttactgaaatgaatggtgtgcatacgcgtgcacattttagtgcatcaacctatgctcgcttgttcataccgcagcttttccgtgaatatgacaaagtgatatttatcgattccgatactgtggtgaaggccgatctggctaatttacttagtgtcgatctcggtaaccatcttgttgctgcagttaaagatatcgtcatggaaggctttgtcaagtttggtgccatgtcggaatctgatgatggcgtgatgcctgctggcgagtacctggaaaaaacgctcaaaatgagtaatccagacgagtattttcaggcgggaataatcctctttaacatcgcccaaatggtaaaagaggataccttctctgagctcattaaagcgctcaaagagaagaaatactggttcctggatcaggatattatgaataaagtgttctatggccgggttgaatttttaccgctggaatggaatgtttatcatggtaatggcaacacggatgattttttcccaaatctcaagttcgctacatacatgcgatttttgaaggccaggcaagcaccatgtatgattcactatgctggtgaaaacaaaccgtggaatacggatagagttgacttttatgatgattttctggaaaacatcatcaataccccatgggaaaaagaggtttactctcgtcagttatcaataataaatttatcaagcccagcgcaagctgtgtctcaacccccaattctattccaaacaaaagtcaaaaaaatgttaatgccttatctcaataaatatgctcctgtaggtttttctggagcagttatcgcgcgcgagcttgcagaacaag

SEQ ID NO: 51363 - DNA, 816 bp, Glycine max
  Peptide Sequence Number=SeqID_168141
atgcacgagtgcgatccggcgcgcgatctgcgcaacgtcggggtggccgtgccgctgcacggggtcaatccgccgaaacagcatccgcgcgagtatgacggcagccactattgcgtgctggtcagcgagaccgtgccgcagccgcagccgggcagcgatcagatcaatcgtgcttacgaagaaggctggattggccgcgaaggttaccgtaaggccgacggcagccggcagcgctgggcgctggcgtttatcggcgatacgctgtccgccgccggtgaaaagctgccggaggtgtttatcgttgatctgccggagaacgatgccgattacgccagggcgggcgctctgccgctgcagggaacggaaagcgagctgccggcgccgccgcagggcgtcaggcagcggcgggtgacctttaccggcgatcgtcgttttccgggcgtggccggcgcaccgcgccactggctgcgcagctcgccggacggcagccagatcgcgtttttgatgaaggacgacggcggcgtggtgcagctgtggacggtgtcgccgaacggcggggagccgcgccaggtgagccacagcgagcatgatatccagtctgccttcagctggcacccgcagggcggggcgattgccttggtgtgtgacaacagcgtgatgctgtgcgaggtcgccggcggccgtctgcagcgtttgacgcagcgcagcgcgcagccgccgtcgggggacgccgtggtgttttcaccggacggcaagaaagtggcgtttatgcgcgagatagcgggattcaaccagatctttgtggttgaggtgtaa

SEQ ID NO: 51364 - DNA, 186 bp, Glycine max
  Peptide Sequence Number=SeqID_168142
atgagtgagatacgaaggtttggaggtttgggaatggaggaacgtcgtaagagaaaaaggggctgcgcagggatttctggaaaatgtgatatttatagagcaggacgcgtggccatctattctagtgtaatcgattacagtattcatgtaatcgattaccagaacaaaaaaatagccttttcctaa

SEQ ID NO: 51365 - DNA, 678 bp, Glycine max
  Peptide Sequence Number=SeqID_168143
atggaaggatttgaagtcgaggtattcataaagagatttgctgagaatttcataattgcagcaggatatggcttctatcaaacaagaaaaaatggttttcctcaaaattatgcttctagaagaggaagaggaagtcaaagtggctttggtagaggaaactcaataggaagaggaaatgaatgctatagaaagcatggctatcctcttggacacaagttttacaagtctcaaggtccgaacatcaacaatgtcagtgcagaaaatgaggaaggtgataactcagcccaagaaaggaaacaagaaacacaaaatgaggatgtgaaactaacttctcaacagtataaagctttgatggcactattgcaacaaaaaaacacaactcacaacaattcacatgtgaatcaaattgtggcagttagcaacataggtagtactctatccattacttgtagtgtaagcaagactagtcaagataggtggatccttgactcagatgattattcaaggtttgtttgggttttccttatgaattcaaaagctaaaacacaatctcatttaaagaactttgttgccaatgttgaaagttctatgatgatattggcattatacatcaatgttcttgtgttgaaactctctaacagaatgggattgttgaaagaagacatcaacatctattaa

SEQ ID NO: 51366 - DNA, 288 bp, Glycine max
  Peptide Sequence Number=SeqID_168144
atggtacatcaacaagtagtagttgtggttggtgtagttgttaacggcgcagaggaacttggtgtgaatgaaaaaaatggagaggaagctagtgcgcatcaacacattgattgttctgatgccttcaatacttctcaagtgtctgctaccagtgattatgtgttgcattgggctcaatctgctgcttatgatattggttttgtggcggtgattatgaggtcagacacagatactggtattagaggaaggatctcatttgttttaattggttgtgaaaggagtgattag

SEQ ID NO: 51367 - DNA, 612 bp, Glycine max
  Peptide Sequence Number=SeqID_168145
atggaagtggcccaattctcaatagttgaggctggtaagtcaactcctatgaaatattatagtccaacacatggtttcattcttcatatgagttccacaagtgaggtagtgaggctcagtgatattaaggcgcaagctaggagaatttggggaaatggcacacatattagcgtcacatacaatggaaaccaaaatattatggtgggaagaattgttggattagaagaaagggatcaatgggaagcatcgaagatagggcagaccttagggtattggaaggaaggggaaattaatgtgactttcatcaacatttattcttcgtgtgaattaaagaagagaaggatatgggaggatttgaagaataaaaaggaatatagaaattgtgctacttggtgtattatgaatgatttcaattgcattataagacctaatgaaagacagggagaggctatggtcgagtatgatagaaggaagtcaagtgagttcaatcaatctatccaagatttaggtatagaggatatacccttgatcggaaggaaatttacttgtttaggccaaatggaaatgcaagaagtaggattcatagagtattggtgtcaagagactagatag

SEQ ID NO: 51368 - DNA, 915 bp, Glycine max
  Peptide Sequence Number=SeqID_168146
atgaaaagcaggttccttagaaaattgaaacacattccaaccattaccaacttgaaacaaggtccagcccttcagctcaatccaccagtctatgatgatcaagatcacaagccccacaacctggctgaactagagattggcctcaatggaagtgaagatgataagcattatgagttaaaagaaatgcgatttgaagccacacccaccaaaggttccaaagagaaagagcttgttgagaaaaacttattagtggtttctagtcctagtaaaagcatgcatcaacaaattcaagtcaaagagtacccatctctaacagattttgaagagatacatccaccaggtggaagccaagcagtgattctctacaccacaagcttgagaggcataagaaaaacatttcaggactgcaacacggtacgctttttgatgagaagcttcaagataacataccatgagagggatgtttctctacacttggagtatagagaggaattgtggaagatcttgggttgcaaagtgatccctccaaggcttttcattaaagggaggtacattggaggagctgatgaagttgtaggattgcatgagatggggtggcttggaaagcttttggaaggaacaccaatggactttgctgatggtccttgcaaagttgcaaagtgttcaccaccaatggtgacaacaagaatgaatgcttcatcaggtgtcctgaatgcaatgagaatggacttgtcaaatgcaccatttgctgctactagaaattggtctaagaccaagcaaaagaaaacggaactagatgaagaaaatggaactacaaacaatgatcattcaagggtaaagaggatcaaaatagaagcaggaaaattctgtggatatgttgttggctaccttatgattgcgggagcatgcacgtga

SEQ ID NO: 51369 - DNA, 864 bp, Glycine max
  Peptide Sequence Number=SeqID_168147
atggaacttgggagagattttgatactggtggtcaaccaacacaaaaaggaatttaccgtgttgacctattgactagacaaatagcttcaccagtagaagtggactctggctacggaaagcctattgagatttgtcatgcccctctgatggcagtgactgtggcggagcatacatcattcgtcttccatgcggaccttgtgataggtaattaccatgtgagagtttccattcgggctcgtgggtacataccaaaagaatcactttggcctgacttggctgaatttgtggatggtgctctaggtcacattggtaacatggcaagagttttaggggagcaagtgaatggtgggaagccaacatggccttatgttatccatggtcactatgctgatgttggggaggagtctagaagagtggctattgaggattcagcttccccacatggcattcgtcttctgatagaggactatcattatgcttctgatactgaactccaagccttttcgaaagaacttgtagaggttggtcatgctaacaagaaaaatgagccatggtggccaaacatgcaaacttgtgaagagttgattgaactttgcacaactctcataagacagtatccatatgaaggttatgtccttaaccgatcaaccctcagcaggtgtttcatacctgagaaaggctcccctgagtattatgagcccttgctaacaaccctcaaaaggcatttttttagaacaattacagcaaagaatcagacccttacactcacagaggtgttgtcatttatcaatgcaagttacgttgaagaaaagtcggaataccactctccactagccaagattctgtttcaggccaactcataa

SEQ ID NO: 51370 - DNA, 195 bp, Glycine max
  Peptide Sequence Number=SeqID_168148
atgtctttgttgccgatattggatcgaaagccctgctggcaatccttgattcagaagttccaggggtttgaagaaaaacctagaggcgttgaggttcaaaaagaagctagaggaaaggtttcagcgcgaaagggcaagatctgcttcaaccaaaagctgctaacactagggttagaagctacaaccaaggcttaa

SEQ ID NO: 51371 - DNA, 342 bp, Glycine max
  Peptide Sequence Number=SeqID_168149
atggatacacacttccagtatgttcaaaccactttgaaattcctggcctcattgaagtgttctacagtttgggagcaagaagacaagaaagctgaggctgatttgcaagttggagaaccaagttatttggcctcgtttttatacatcaattcctgtacatttttggatgaaaaagagaaaagcctcaatgaagccctaaatcacatacaacttcttaagagggagttagcaggaaaggatgcagagattcgacaaatgaaagctcatatttcagagctaaatttgcatgcagaagcacaggccatggagtacaagcaaaaatttagtaattctgtggaataa

SEQ ID NO: 51372 - DNA, 312 bp, Glycine max
  Peptide Sequence Number=SeqID_168150
atggctggtagcattgatagtgcaccagcaagggtgcagccaagccattatgctgcaccattcaataggagtgtttttccttctggttttctatttggaatagggtctacagcttacgagatagaaggagcagcaactatagacggcaaaggaccaagtatatcggacacctacactaaacaacaaccagggtacatcctttgtggtacaagtagagggtacatctacttgggtttgactgagaacaagagagggtacatctcttgtggatcagttctagggaagggtacatcccttgtggatcagttctag

SEQ ID NO: 51373 - DNA, 543 bp, Glycine max
  Peptide Sequence Number=SeqID_168151
atgactcgagggcccggtagcatgcagagactaacgtcgtcatctgcacctttgtcatccagagacggcatgtccgatgacatacagagataccttatggttatccacaccttttgtcagctagagggaagcgagctcgttgacacgcagagactaatgtcgtcatctgcacctttgtcatccagagatggcaagtcgaatgacatgcggagataccttatggttatccgcaccttttgtcagctagaggcaagcgagcctgttgacacacagagactaacgtcgtcatctgcacctttcccagagatgtcagtgtcttccggccgagactgcgaaaaagtctcgtttgctatcttgactaacgtcgttatctgcacctttgtcatccagagacggcagctagaggcaagcgagcccgttgacacgcagagactaacatcgtcatctgcatctttcccaaagatgtcagcgtctttcagccgagactacgaaaaagtctcgtttgctatccgtcagactcaagggtccggtatcatgcaatga

SEQ ID NO: 51374 - DNA, 2892 bp, Glycine max
  Peptide Sequence Number=SeqID_168152
atgaacgtggttgagtggagtcctgaactttgcacgtcggcctggaggggtgcctttgtcaagaggacaagagggaagacttgcaaaacaaagaactccgatgatcaagcttgttgcttgggtgctgagtgtgtgatgggattgtgtaaagggcctatccgggttatagtgatccttccctcattttgcttctggggtgtgaggagaggtagcagcggtggagatgcgaagggactaagttttgaaatagaagttctctctgactttggtggcgagtgtcgctacgctttagcactagcacctagttgcccacccttcttctttatgtacaaatgtatgtttgaggtcttgggtatcattctacccttgaccacttttcagtgtgctctattggagcacttgaatgtggctttttcccaacttcactggaatagttgggcaatggtgcagacctttgaaattatgtgtcctttcttgaacatccagccgagaccattttttcaagtcttggttactgatgtcatggctgatggtatgccactgatgcttaacaaggacggggagctccgcgtcctgttctactggcaatctgaccctaccaggttcaagtcatatgatgaggatcttgtgacccttgtggagagggtcgacaaaggaatttgggagcatctgtcggcctcattggacgcgcgggccattttgtctcttccttcagcgagcgatcctctcattgccttggattgtaaagtgcctaacgtcgcccttatttatgatactcacgaagcagatgggaccatgccaccatctatcgttgctccatccattggagaagaggatcaacctggtggtaaggttggccctgttgttgttggggctgaggcccctatgtgccttcgtgccctgaggcaagctgcagggttgatgcccactacgggtcaccttttgactgcgcatgatgtgcctttggctccaccggtcgtcgaggctcttattgctactcctgctacttctactcctttacctcctcccgttacctttgctgctgttgaagctactgtgcctgccactcaggctgactctgttgtggtgtcgtcgtccactatcgtgatacctttgctaagtgctggtgtggcaatcactggtgctcccatcatgttgcccccttcctcgtcagctcaattggcttctctctctactttcttggcggcggtggcgtcgccttcttcgttctctcgccctcgagtcttccttgatcacttgtacacctctagtgatgctaacttgttgtggggtgcaacttataagctggagcagaagaccccggttggttttatgtcagccttcgacaagaactttattaggtcagctggggtgcaaaatgctattgactttgccaaagcttttctccaaaggagtttggaaattatgaaggagaatgttgccaagtggagggctactactcaaacactttggcaagtggagtggcctaaggtggccaatgccaccatcgtttttgccgaggttgttaggtcaaaccgccaactatcttccaaagttggtggtgtgttggccaagttgctacggacccagctagatggtgatgaactgtttaaacactgtaaggacatgcaagcagagaagatggacttgggtggtaaagtggagagtgtggcggctgagagggacgagattgccaaggtagttgcttatttagaggccctgcttaaggagtcagaatccaagttggcggagtttgagctatgggttactaaggaaaagaaggccaatagggagcttgaggaagagctacttttgtacaagaaggagaccagcttcttcgcaaaggaccttgacttgggtctcttcgatcccttcaaggatgttaatgatggtgtcttgcttgatgaggatgacattgctgtagaggacgaggttgttgatgaagagcatggtgctgcggagcaaggcgaggataactattgtggtattgtaaaaagtagaaagacgcagagtcattgcaagtttgatttcaacatggttaaaggtcttgtcgcccatctggtcttgcctaaccagtgtggggacaggtcgcttaacctgctaagtttctcctctgatggttatgaggagttaatgactcaccaagggcagaccttgagttttccaagccctttgaactatggaccaggggactgtctgacgggttttgggcatcgtgctcttgcatacataccactcgtcgtgggtggcacacactggagacgtgataataagctctggatatatgtgtcactcgctgtgggtgacatatactggagtcatgatggtagtacgcttttgcatgtatgccatttgtcgtgggtgatatacactggagtcgtgatagtgatacgctcttgcatgtatgccactcgccgtgggtgtgatacacacttgtataagttcctcgtacaaagtggcgtatattggagacttagtgcaagaagaggggctcaccaagggcgaatattggattttaagagcctcgaagctatgtctatggatgctcttgtcttgataagagaaatgtcagctgaagtagaacttcagttgagtggcgttccacattcttggaattgctttgccatccaactcctgcagtcggtacgctccattgtcaaggttggttgtgactctgaagggaccttcttagttggggccaagctttcatgctcagggatcttttctggcttcacctcggacttgccacatgaggtcgccggtagtctccttgtcgatggttcctcgacttcaacgaagatcatggcatttgtgccatatggccctgaggatgactctgttagctacctctgtctatccgttagtataaggatgttagatagaggtgactag

SEQ ID NO: 51375 - DNA, 582 bp, Glycine max
  Peptide Sequence Number=SeqID_168153
atggtgttgattaagcctttgatttgttgtgcgagttcctattcagctggaggaggggtgtgtaacacctatacccaggtttcgtctgacccttgtcaagcttatgcctcttatccgacttgtgcaagtcggccttggtgttggctcgcgcttgtcaggcttttgtctgacttggtggacttcattacaaaatctgaacatttctttcatctggatgtagcccttagctcgctcacgcagctcgtccatgctactgggtggttttttgcacagactgtctgcaaacttgctgagactggccaaggcaatcgaggtcatgtggtgagacttggtagtggcgtactgcatactgaatcgttcgacaagggtgctgaagatgtctacggacctaggtgggagtccaccataccaggtcaatactgctcccttgagggatgtcgggaaaacacaacatataatcctgtcatcgttggaatagagtggtttctaccccaagggtatgtctacctccatgatgcggtcgacaaaaggatatcgacggacagtctgccttggtggacgatgcatgtagaagagacttaa

SEQ ID NO: 51376 - DNA, 561 bp, Glycine max
  Peptide Sequence Number=SeqID_168154
atgctcctcgccttacacctcagcaagtttgcagacagtctgtgcaaaaaaccacccagtagcatggacgagctgcgtgagcgagctaagggctacatccagatgaaagaaatgttcagattttgtaatgaagtccaccaagtcagacaaaagcctgacaagcgcgagccaacaccaaggccgacttgcacaagtcggataagaggcataagcttgacaagggtcagacgaaacctgggtataggaagcattcaacctagaggcacccattcggctaccccaaacaaaacctcccaggctagggtcaagcgcaaccaaatactgtacatatcaccatggtattggtcacaacaccgaagacttttgagtcctaaaggacaagatagaagaacttatacaggctgggagcaagacctaaaggacaccaaaatgagcaacataggaaccaagaagcagacaaaagaagagcagaagacagaggcagacaaagacgacagccataaaggcatgagcgacctcctccagctgaataggaactcgcacaacaaatcaaaggcttaa

SEQ ID NO: 51377 - DNA, 171 bp, Glycine max
  Peptide Sequence Number=SeqID_168155
atgtatttgaatatcttatctataggaaggtccccctcttgtcctcttgacaaaggcacctctctaagccgacgtgcgaatttcaggatcccacttaaccacgtccaccctgatgtgtcacggttccagattttggtaagaacatttgctgcccaccataggctgcggtaa

SEQ ID NO: 51378 - DNA, 408 bp, Glycine max
  Peptide Sequence Number=SeqID_168156
atgtcaggaatccaccctagcataatctactacaaacttgctatctgctcccaggccaaaccattatcacaaaagaaaagaaagatgagagaagagtggtgtaaagccgtcaaagaagaagtcgacaagctcctccatgcaaactttatcagaaaggccaacgggaaatggcgaatgtgcaccgactacactgatctgaatagggcatgccccaaagacacatactttttgcccagcatcgacgagctagtcaatggaacattcgggttccatgcgctaaacttcttggacgcctactctagatataaccagatcaggatgcatcctccggacgaggacaaaacaacattcatcactgaagatgccaacttttgctacaatgttatgggtcatgcctttcgatcttaa

SEQ ID NO: 51379 - DNA, 183 bp, Glycine max
  Peptide Sequence Number=SeqID_168157
atgacgaaacacctcaggcactgtaggcacgcagggggaggggagcaggctaggtttggcgttgcagcagggtatatgatgaattcagttattttgatgctttgttcctgcttaaaaattgaactttttgtatatgatgaattcggttataacagtcttgtatttcaatggaagggtatatga

SEQ ID NO: 51380 - DNA, 288 bp, Glycine max
  Peptide Sequence Number=SeqID_168158
atggggaagaacaagggtcgtcaattgcactcagctgcaaagcaaattatggtgaaaggtatcacctcaggttcaggtaaatcccaaacatctgctacttctggtctggctggttgcttggatgttgtccaagcaaatcagaatgttcatactgcttcacaggataatcttgtaggcaaggtgctcgtaaaacaggcagggacaagttctgcaaaaactgatgatgtcacacaccaagtgtctgataatttgtcggaatgcagtgctgaatttgaatcttccccagag

SEQ ID NO: 51381 - DNA, 138 bp, Glycine max
  Peptide Sequence Number=SeqID_168159
agaaagagagaacttggtgtccttgtcaatggcgaaattgagatcggagaggagatcgaagcagaggagtggcaactccaaatcagcagtagagtgaggagtgaggagccacagcgtagattaggttttaggaattag

SEQ ID NO: 51382 - DNA, 1398 bp, Glycine max
  Peptide Sequence Number=SeqID_168160
atggaatttaagagtcaaacatgtgatatggataaaactcctgagaagcttgtggataagcatgacttaggcatgcatgtaaatgaggttgttaccataaccaacattgactacaatcatatcctatttaatgaagaaaacaaccagaaatcaatcttcaatagggttcaaactgatgatattgatagtgaacctgataattacgtggatactctcaacaccattgaatcaaaatctgaaaatgatattgattatataacaaaacgagaggtgcaacagttatcttcatgtgtcacttgtggaacaattgaaaatggagttattgaagctcttcccaatttattggacaataatttatctgatgtcgtttccaaaactgattatgttgttcccttaaatgaagaaaaagggaatttagccgactcactgcaagaaaatcatgttcttgatcttgtatcaaagtctaatgcatctaatttgggatatgttagtccatctcatgatcttgatagagaaaatatgaccagagacaatgcttccttaaacaaagaaccatttagggatttgtttgactcactgcaagctattcctcctctaacatcaaagccacatgcatctaatttgggacctgtaagtccatcagatgttccttataagccacatgcatctaatttgggacctgggcatccatcagatgtcccttatggtgaagaaatgactagagacattgcttgcttaaacaaagaaacatttaggtatttgcccgactcaatgcaagaaattcctcctctcacaatagagccgcatacatcaaatttgggacccgtgaattcatcaaatgctccttatagtgaagaaatgaccacaaataatgtttccttaaacaaagaaatgtttggaaatttgcccaactcattgcaagaaactcctgctctaacattagagccatatgcatctaatttggcatctgtgagaccattagatatttctgttagcaaagggatagccaagaatatagttgattcttatccctcaaagactctttccttatgcactgatacctacattggttcttctattgttaatgatacaatgtcagcaccaattgagactaatatatcattttctagttccaataactctaatttaccaaatgatgaagtagataagaacaacaaaaatatctacaaatctgaagagacttctagagagtctttggctaatcatttcattaggttctggactaatggtggactattaggacttgagccatcaaaaccttctgactttaacaagtcaacttctttaagtcaagggtctttgagcactaaaagtgaaacaaatggtggttctcatcataactcaatgcaaaagagcaatggttataaaaaggaatag

SEQ ID NO: 51383 - DNA, 291 bp, Glycine max
  Peptide Sequence Number=SeqID_168161
atgaataccacaacaacccataacctcattggaaacattctctccactccaagtgcaaccaagaattctcttattctcaaatacgtaacaaagaatgacaaagattcaaaaagagaaaatgaaatggataaggaaagagaaagtgacgattttatggggactaattggaagggatttggttcaaagtctgaatgtgtttggatggagaatgatgaagataacgatggtgttcaagtggaattaaaggctggtttaagtttggcaatttttaggaaacaaagaaaaccgtaa

SEQ ID NO: 51384 - DNA, 2340 bp, Glycine max
  Peptide Sequence Number=SeqID_168162
atggtggtgaagatgatgcggtggaggccgtggccccctctcgtctcgaagaagtacgaggttaagctcgtcgtgaaaaccctcactctccagggctgcgatctggtgcgtgcgtccgcagagaaaggcttcatgctccagattaagtggaagggtcccaagcttaccctaagctcgctgagacgcaacgccgttgcgagaaacttcaccagagaagcgcaccctgaacaaaacgacgacgtcgttttgtgggacgaggagtttcacgcactctgcaccctcaacgcgtacaaagacaatgcctttcacccctgggaaatcgctttctctctcttcaacggtttgaatcaaaggtcaaagactaaggttcctgtggttggaactgcgactttgaatctagctgaatttgcatctgtggttgatcaaaaggattttgatttgaacattccactcacaatttctggtggctctgcggagtcttcttctccttcactcagtatatcgattagtttggtggagttaagagcggttcaagagagtacagagttagttcataataaatccatagtgcctgtggcttcggcttcttcgcctttggttcagtcaggagatactaccttggttgagaaagacgagctttcgacgatcaaagccggtcttcgaaaagtgaagattttgaccgagtttgtttctgttaggaaggcaaagaaaacctgccctgaggaggaggggagtgagggcaatttctcagccaggagtgaggatggtgaatacaattacccctttgactctgattccctcgacgatttcgaagagggcgattcggatgaggtgaaggaagattcgagtgtgaggaagtcgtttagttatgggaaactggcgtatgccaatgctgggggggctttttactccagcatgagggtgaatggtgagggtgaggactggttttactacagcaatcacagatcagatgttggggtttcgcataaagaggattctttgaccgtgtcagtgactgagccttatgtgttgcaaagctcaaggcgtagtatactgccttggaggaagaggaagttgagtttcagatctcctaaatctaagggggagccattgttgaagaaggcttatggcgaagaaggcggtgatgacattgattatgatcgcagacagcttagctctgatgaatccctttcactcgggtacttgttgactagtgatctgacatttgtgaagactgaggatgattcaggtgcaaatcgatcatcggtgtccgaatttggggatgacaattttgctgtcgggagttgggagcagaaagaagtaatgagccgtgatggtcacatgaaacttcagacacaggtcttctttgcttcaattgatcagcgcagtgaacgtgcagcgggtgagagtgcgtgtaccgctcttgttgcggtaatggctgattggttccaaaacaatcgtgatctcatgccaataaagtcccagtttgatagtcttattcgggaaggctcgttagaatggaggaacttgtgtgaaaatcagacctatagggagcgattccctgacaaacattttgatcttgaaacagtcatccaagccaaaatacgccccctttctgtggttcctggcaagtccttcattggatttttccacccagaaggaatggatgaagggagattcgattttctgcatggggccatgtctttcgataacatctgggatgagattagtcatgctggacggcagtgcactaacaatgatgaaccccagatttatattattagttggaatgaccatttcttcatcctcaaagttgaagctgatgcttactgcatcatcgacactttgggggagaggctctatgaaggatgcaatcaggcgtatgtcttgaaattcgacagcaacacggtaatatacaaaatgcaagatgttgctcaagggtctggcgaaaaaccagccagtgatcttcgaactgttgcagaagtattagagcagaatgacagacagatccaaccaatcaatggcaaagaggttgattctgttgttgacacagaagaacatttgaagagtgaccaagaagaggaggttgtgtgcagagggaaagaagcatgcaaagaatacattaaaagcttcttggcagcaatccctattagagaattgcaagcagatgtcaagaaaggtttaatatcatcaactcaaacaccatttcatcataggctacaaattgagtttcactacactcaggtgttgcagtcttgtgttgcacctccagtagtggctgaaccatccatgactgtgccagagactcttgctcttgcagtaactgaggtttccgcataa

SEQ ID NO: 51385 - DNA, 450 bp, Glycine max
  Peptide Sequence Number=SeqID_168163
atgtggacaacgccacttggacagcaagagtatctgattttgggtcgtcgaccgaggcatcgggatccagttggatcaattggatacattgatccggagcactgcgatggtctaaatgtgttgacagcaaagaatgatgtgtatgggttcggagttgtaattattgaacttttaacagtaaagagagctatattaaaggatgcgaaagatggaatcaccccattattaagtgtggtggaccttgcagtgcctgctattttggctctggatttggtgaaaattttggatccgaaagtctcaccaccggatccggatgaagcattggcagtggagttagtggcctattctgctgtccattgtgtgagtttggaagggaaaaatatacctaccatggctgacattgtgctcaatttggagcgggctttggctatttgtaataatagtatatga

SEQ ID NO: 51386 - DNA, 964 bp, Glycine max
  Peptide Sequence Number=SeqID_168164
atgagccaagtgattcaaactccagaacaacaggtgtatttgtataagttgttggagtacgattactctatccagtacaagagcaagaagtccaacatagttgcggatgcattatcacgagctagtgataccttcaaagcattggctcagcaggttcaaacagactcttcttcccaaccagacttcaagctacacaatggcttactattattccaagggaaaatttggttggactccctcaattccttttggtctttttcaatggaagaatatcatcccacacccttgggaggtcacatgggctttgccaaaactttgcatcaacttcagcagaacttttattggcctgatatgcgtaaggagcccctccttgtcccttcttctatttgggaagacttatcattggatttcattataagcctcccacagtcccatggatacactaccatcttggtggtcgttgatcacttctcgaagggggcagactttagcgccttacactcccactttactactttcaaagttgcctctcttttcatggatatgatctgtaaactccatggctttccaaggagcttagtcttgaactgggaccaaatatttgtgagtcagttttggcgtgaactattcaaactatgtggaactaaactctgcataagcacctcttatcatccggagacagatggcaaaactgaggtccttaaccgttccttggagcaacactttcggtccttcgttcacaatgaaccctctgaccccttacctcccaattcctttgataaccacccactaattgaacccttgcatatcatggacaacaagtgggacacagacacttcacccctttcattgtcgattctagtacaatggagtagtctagcacccaaagatacttctttggagaagtgggatgatttgaaactgacgttccaccttgaggacaaggtgtttctcctagtgacgg

SEQ ID NO: 51387 - DNA, 1086 bp, Glycine max
  Peptide Sequence Number=SeqID_168165
atggctgccaaacaggagaagggactctgctataattgtgaggataaatggaatccaaatcacagggacaccggccttagaatccttccgactctacggtcagctaaattccttgctttaccgacggagtccacttccgctctgcaagtgatggtgggaaatggaaccgttcttccttgcaaccaactatgccccaatatcgtcctgtgccttcatgggtgtccattcattgttgatcttcatgtccttcccattagtggtgtggacattgttcttggtatccagtgtcttaaacaattgggacctatcatcacggattatgatgccttgacgatgatgttcgtccatgctagggagatcgagaaacaagttgtggaaatgttatccgttggtttaatcaaaatgagccacaacctattatcctcaccggctttgaactctataacggtgaagaaccattttcctatgcctactatcgatgagctcttggaagaactaagcaatgcttcctggttttctaaacttgatttgcggcaaggttttcaccaaattctgatggatgaaaatgacactctgaagatcgcctttcacacacaccaaggccattatgaatatcgtgtaatgccattcagactttgcaatgctccatccacattccaggaaacaatgaatgagctccttaaaccattcctttgcaagtttgatgcggtcttcttcgacgacatcttggtttacagtccctcattcgctactcatctttaccatttgcaatgcgtctttgaaactttgatagctgcacagtcttttcttaaagcttccaaatgtttatttgcccaacaacaattagagtatctgggcaacattgtttcacacaacaatgtggcacctgacccctccaagattcaggctatggtggagtggctgggttgtacagaaaattcattcaaggaggctcaattcatgtttgataatctcaaatgtgccatgacccaagctttagtgctggctctactggatttctctgtgcctttcacgctcgagactgatgctttaggcctagccatgggggttgtccttatgcaatga

SEQ ID NO: 51388 - DNA, 345 bp, Glycine max
  Peptide Sequence Number=SeqID_168166
atggtgactatagtgacaagtgaagtaacggtaacaatgtcaatggtgacgacggcaacggcagaggatggtgatggtagtagtaatgtcggtggtcatagcgatggtggtggtgacaataatgatggttgtgacattaatgttgatagtggtggtggtaatgttagtaataatagtggtgatagtgacggcggcagcaacaatgacaatggtcgttgtagtggtgacaatgacgatgttatgagcggtgtgatagtaatggtgatggtgacgataatggtgatagtggtgacaacgacaacaatgacaatggtcgttgtagtggtgacaatgacggtgctatga

SEQ ID NO: 51389 - DNA, 327 bp, Glycine max
  Peptide Sequence Number=SeqID_168167
atgatgcggttctgtattacaacagaaggtggaacatgcaccgccaaaaacaactttgtgggttacgcgttcaccggaataaatccaaaaaaatttgatattccaaaaggatgtagcatagatcaactgaaggatttgatcaagcaagtagcacctaaagggaatcctcctcatgggattcacgaatcccaagttgtaaggcgtttgttttatcgacaacctagtcatttggagtattctgagaaagttttagaatttaaaattgttgagctgaaatgtgacgacgacgtgctgaaggtgctggtagagtctaattactggaaataa

SEQ ID NO: 51390 - DNA, 933 bp, Glycine max
  Peptide Sequence Number=SeqID_168168
atggattcgatgcttcttcgatcttttcctaatattaacaacgcttcttctctcgccaccactgcgacctctgaaaaatcttttgagtctgaacctcaagcttttgatccaaaaagcattttggactctgtcaagaattccttggatgctttctacaggttttccagacctcacacagttattggcacagcattaagcataatttctgtgtccctccttgctgttgagaaaatatcagatatatctccattattttttactggtgtgttggaggctgtggttgctgccctgtttatgaatatttatattgttggtttgaatcaattgtctgatgttgaaatagacaagataaacaagccgtatcttccattagcatctggggaatattcctttgaaactggtgtcactattgttgcatctttttcaattctgagtttttggcttggctgggttgtaggttcatggccattattttgggccctttttgtaagctttgtgctaggaactgcttattcaatcaatgtgcctctgttgagatggaagaggtttgcagtgcttgcagcgatgtgcattctagctgttcgggcagtaatagttcaacttgcatttttccttcacatccagactcatgtatacaagaggccacctgtcttttcaagatcattgatttttgctactgcattcatgagcttcttctctgtagttatagcactgtttaaggatatacctgacattgaaggagataaagtatttggcatccaatctttttcagtgcgtttaggtcagaagccggtattctggacttgtgttatccttcttgaaatagcttatggagtcgccctcctggtgggagctgcatctccttgtctttggagcaaaattgtcacggtgtattgtatcctcatgttgggtaatcaatattccctcaaataa

SEQ ID NO: 51391 - DNA, 255 bp, Glycine max
  Peptide Sequence Number=SeqID_168169
atggcagtattagctagaacggattccatatgcttccggggcaaaccacacaaagtaatgggaaatacgtttggtgttcttgtacaacactatttattatactatatcaaacatgctactttcagcctcactaagaattacattttttcaaaaaatcaaatacttgtattactcaaccagaagagaggagattacaaaaagaaaagccttcagccaagcgcttacaatcataaaccagacctgcaaagtaactaa

SEQ ID NO: 51392 - DNA, 1238 bp, Glycine max
  Peptide Sequence Number=SeqID_168170
acccaaacgcggtcttacttcttcctcacttgtcctctgttttgaatttctctgctctgcatgcaacagagtcccttgttagattgttcattgcaatgaggtatattcggagcaacagcttcaagaggctcttctcattcagaagacgcagttcaagggaacagattctgagtcctaacagtaagggtgaagaaaactatgagatttttccgcatgaagaagaaccttctcgaagaccctcttggaagtgcttctcttatgaagagttgtttgatgccaccaatggcttcagctcagaaaatttggtgggaaaaggagggtatgcagaggtttacaaaggaaccatgagtggtagtgaggaaattgctgtgaagagactcacaaaaacttcaagggatgagagaaaggagaaggaatttttgacagagattggtacaattggtcatgtgaaccattccaacgttttgcctcttttggggtgttgtattgacaatggcctttaccttgtttttgagttatcttccacaggttctgttgcatctcttcttcatgatgaaagattgcctcccttagattggaaaacgaggcacaagatagccatcggaactgcacgaggccttcactacttgcataaaggttgcaagaggaggataatccaccgggacattaaggcttcaaacattttgttaacaaaggattttgaaccacagatatctgattttggactagcaaagtggcttccatctcaatggactcatcattcaattgcccctatagaagggacatttggacatttggccccagagtactacttgcatggagttgttgatgagaagacagatgtgtttgcctttggtgtgttcttgttagaagtaatctctggcagaaaaccagtggatgggtctcaccaaagcttacatagctgggctaaaccaattttgaacaagggagagatagaagagttggtggatccaaggcttgagggggcttatgatgtgactcagttaaaaagttttgcctgcgctgcctctctttgtattcgggcatcttcaacttggcgacctaccatgagtgaggtattagagataatggaggaaggagagacggatatagagaagtggaaaatgccagaggaagaaaaagagcaagaagaggagttctggggttttgaggatctggaatatgaatatgacagctccttttcaatgtctttacttgactccattggaagtacttaa

SEQ ID NO: 51393 - DNA, 2277 bp, Glycine max
  Peptide Sequence Number=SeqID_168171
atgatacgcggaggcgaaaactacgtttcttccgctccggcgttctcgaacgacggcaagcgccttctcgtttgcagcggctccaccgtgtccatcttcagcaccgccaccggctccctcgtttcctccctcgaaggtcacaccgccgccgtcaccgccgtcgtggtgatcccctcctccactggcctaagctactgctggaccgcttccgtcgacggaaccatccgccactgggacttctccgttcccgaatgcgtcaagattatcgacctttgcttacccatcttctctatggtggtgccttcgattttgtctccgcgggaagaaaacgggaagaagacggcgaatgctattgcttacgtgtctgttcaagttataaacgcaccggacaatcgccccaagcctctttatggacagatcaggaagtgtaatttgacccactttcgctccgttagccaacttatcttgaaagagaccgaacgaccagaatctttaaccattagtcacttgggaaattttttgggtataaaagacaagcggaaacttcatatatgggcagttcctaaaaaggactctgattctgctgtgtctaagaagattaccctgcatcatacaaagacctttactgttcttgcattccatccgacagagagaactgtggctgccggtgatgtaactggaagaattttaatttggcatgaatttggtgctcagaagttcttgaacagtagcggattagtgaatggaagatcaatggatcaggaaaataaggatggggtaaggcaaaatgatgatgctgaatcaagcgtcacacggcattggcactcttctggagtgaggtgtctatctttctcttcagatggagcctacctttactcagataatcaagtgcttatattgaagaagccttcaaagccaatggaaataataagctgtatttctggtatcaagccccctttgccttctcaagatatatgtgaaggtctttccagccgagttgcctttgactgcacttctggtttattggctgtacaaacagagaattatgccatccaattctacagcttgtttgctaatcgcgaagtttatgaggttcaagtttgtgaaagaaaccatcaaccagttgatgaggtcacggtggtggtgagcttggtggagctgtctgtcgatggctctatgatgggtacagttgatgtcaaacttcctgaagatggaataggaggttttatttgcttgaagttttgggatttggatgataacaagagattttcattatctacccttatttatgaaccacacagggatgctcatatttctgctgttgctttccatccaactcgtcctatggctgtcagcacatcctatggtggagatttcaagatatgggtttgcagggaagaaattcagcaaaaaggccagatggttcggagttctggttggaggtgtcatgctgttgggtcatacaaaaataaagccatgagagctgctgctttttcagctgatggttctgtgctggcagttgcagcagacactgttattacattgtgggatcctaataataatgtcctcattgctgttataggagaaactcaaatgcctattatgaggctcgtctttgctggaaagtcagattatcttctgtctgtatgtcatggttcaaaaccgcagctgtctgtttggagtatgtcaaagttagttgcatcttggtcatacagactccaaatagaagctgtctcatctgcaatagatttgtcatattttgctgtccttgctctccttcccgaatcgaatgaatatacatttaaaggtgatgggataatcttattattcaatgtgacagatcctgttcctgtggcttcctggtcagttactaaggccaagggaggaaggcttgcttttctcaaaggagatccatcagaacaagcagttattgatgggaaaccaacgcagacactgcttgcatatataaatggagatcatgaatatgccatctttcatccatctggcggaaaagcctgtgagcttagtatgactaagcaggaggatcttgtgtttgaagaaacaggacaatttggatacacatcaatttatggagagcttcccaagtttgatttgaaaaggaaaatggattcatcgatttcatctgctgcttcttcttccaagaggccttgggtgaccatatttagtggattatcacaatcgttgccacccctcactaaattgtgctcggaatttttggagtccctgcttgagaaaaggacagcaactgtagaatga

SEQ ID NO: 51394 - DNA, 2263 bp, Glycine max
  Peptide Sequence Number=SeqID_168172
atggaagatgataatgaggatcctattagtacaattatacctcagggtactcaagaagatgaaatagtagaatctggagatcatcatttgtctttcaatgctttgaaaggtggtaggggagttggtactattaggttcatagcttatattgaaaagttaccagtgactgtgttgattgatggtggcagttctgataattttttgcagccaagggtacaagctcaaggcaatacttttgagttaccagtatttttgcttcctatttctggtgctgatcttattttaagagctagttggttgaagactattggctctcacattgctgattatgatgctctgcaattgaagtttttgtggaagggtaaatttactactttacaaggagattgtgaattgccagatgttgttactaagtctatgcttgacttaccagttacgatgaagcctgaattagccttattattgcacacttacaatgtggcttttgatactcttagcagcttacctccacagagatcccatgattactttattcccttattgagtggttcacaacctgttaaggttaagccttacagataccctcatagtcaaaaggaagaaattgagagattggtgttaggaatggtgtgtactgattatagggatcttaatgcaattactatcatggacaacttccttattcctgctgtggatgagttgattgatgagctttttggagcttccttcttttctaaattggatctaaggtctggttatcaccaaattttgttaaatctggatgacagacataagacaacatttaggactcatcatggccactatgagtggttggttatgccatttggcttaaccaatgctcctgctacttttcagagccttatgaatgacatttttgctggaatattaagaaaatttgtattggttttctttgatgatattctgattgattacttgggacatacactatttggtttaggagtagctatggagggaaataaattggaggctattcaaaagtggcctaagcctacccctttaactgatttgttgaaaaaagattcttttaaaaggagtgttgctgcattagaagcatttcaacaactcaaaattgtcatgacatctgctcctgtattggttattcctaatttcaaggaaatttttgtattggagacggatgcctcaggaagtggagttggtgctgtccttagccaaaataagcatccaattgcttatttttctaagaaattatccttaaggatgcagaagcagtctgcttatattcgagaattctatgctattactcaggctttggcaaaattcaggcattatcttgtgggaaaaattgtgttaccttgtgatgttgggttccttaatcagatcatggtggaatttcacaattctaagattggtggacattctggagttaatagaacaatagctaaacttgtagttgatagattgtccaaagttgggtactttatccttatgaagtctgagtttaacagcaaggttgtggctggagctttcattaccaacattgtcaaaattcatggttttccaaaaaccattttcgatgaccagactgagaatcttaataagacccttgagatgtatctaaggtgctttgtatttgaacatcctaagagttgggttactatgctaccttgggctcaattttggtataatacttccttccaccaaagcttaggtatgacaccatttcaagcagtttttggtagacctccaccagcgatgatgcactacgaggctcaacaatatatcaagatgcaagatgataagaaaagaagagatttgcaatttaaggttggtgatttggttttagttaagctacaaccctataggcaacattcagtggctttgaggaagaatcagaagctaggcatgcactattttggtctatttccagtgattgaaagaattggtactgttgcatataaagtacaactacctgagtctgctaaaatacatcctgtatttcatattgctcttttgaaaccatttcatggcaaaagtcctccaccatatcttccttttccactcacttctagtgaattgggaccaatgctttgcccatggaaggtgttggatgttcgagttgtcaaacgtttaaaagctactttcaaccttgaggacaaggttgcttttgatgaggagggtaatgtaacgtgcataaagaaggaaagagatttggcgcgaaattctgttagaagagagggacacgtggctcacgatccgcaag

SEQ ID NO: 51395 - DNA, 309 bp, Glycine max
  Peptide Sequence Number=SeqID_168173
atggatacaatctcagggactaaattgtctattcacccatacaatttatatacaaatcttaacatgggtttttgtatacagcatttttggcgtgctttgaggcttgaagtgaggccttacttgatggatgaattgggaaaggttgatggtgccttgttggagttgacacatgaacatcagcttagggttaaggatgaaataaggaacaagatctcgacattggagacaactctggccaaacttagagctgaggaagcaaaaccaaaagttgggagaaaaacaataatggaagccaagaataggcagtaa

SEQ ID NO: 51396 - DNA, 126 bp, Glycine max
  Peptide Sequence Number=SeqID_168174
atgtctgaaattgaagcttggcaatgggaagggtgggtattgcctaaggaggataaagttattcttgaatgcatcaaagaagaccgctttttagctatccgtaatttggatgaatgtgattcttga

SEQ ID NO: 51397 - DNA, 798 bp, Glycine max
  Peptide Sequence Number=SeqID_168175
atggcgaaaccgcctcgtgcaaacacgtggcagtggactcgccactgcaaccggcgagaaaggcaaaccgccactgctgatggcgagatagccatgcagcagttttaccgactcatcttccataggtttaattggaaatttagctcttggcatatcaagggtaaggctgcgtacaacatccctcccccataccttcgcatagcgaagagcctccgggcaatggggtacgaagttttttttttagctcttggcatatccaatctgaagtctgcagaacatttctgtgacttgaaccttgctggccgatacacacggccacaaagaaaaagacatacagagcttcaccaaaatgatacaggggaagggtctcttggttttgctagttttttattacgtggaccttctcatgtgcgacaccacaaaggtagttttggagaagcattggctaatcatgaaaagaagttcaagcataacatacagaagctggaggaatggaagaaggctatgcgtgaagctattgttggaagacctaattggtttggtcttggcagtagagtcatcatcacaacttgggaccaaaagttgttagctcatcacggtgttgaaagaatgtacgaggtgaaagaattaaatgaggaagatgctcttcaattacttagttggaaagcttttaagttggaaaaaattgatccacatttcaaggatgttttgaatcaagcaataacttatgcttcaggccttccattagctttcgaagtaataagttccaacttatttggaggaaatatagaaaaatga

SEQ ID NO: 51398 - DNA, 381 bp, Glycine max
  Peptide Sequence Number=SeqID_168176
atggtcttcacagaagatgttccccgcaaatcagaaactgacaacaatccaattactggatatgtagatgctgactatgcaggtgatataaacaagagaaggtcaataattgtctatatattcactctatatggcaatgtagtccgttggaaagcaaatcttcaatctgttgtggctctgtcaaccactgaatcagagtacattgcactgactgaggccataaacgaagctttttggctgaaaggatttgtagaggagctggaaggaaagaaactgaagactgaggttatgtgtgatagccaaagtgctatatgtctctctaagaatcagccattccatgagatgacaaaacatatagatgcaaggtttcatttcatctga

SEQ ID NO: 51399 - DNA, 1311 bp, Glycine max
  Peptide Sequence Number=SeqID_168177
atgggagatgattcttcccctagtttggaaaaattgagggctaactggactccatctcaagaccgatattttctagaacttttgctgtcccatgttcacaaagggaataaaactgggaaagtgtttagcagacaagcctgggtagacatgattaaacaatttaacaccaagtttggtttcaagtatgatgtagaagtgttgaagaaccgtcacaaaagattcaggaagcaatacaatgatatgaaaatgatagttggtcaaaagggatttcagtgggatgggacacaaaacatgatagtagctgatgataaagcatgggatgaatgtataaaggcccatcctgatgctcaacctttcaaaaaaagagtcattccgtattatgatgatttgtgcataatttatggccatgcagttgctgatgggagatacagcctttcgtgttttgatgtagattttgaatacgaagaaaaagatttggatgacaagactatgactagtaaaggagtggatgatcaaactcccccagcagttgttaatcaaggtagaattgactggtctccaatgatggaccaattttttgttgaacttatggtggaccaggtacatcacaacttccggctctataaaattaaaagcatgcctttttattccggcatgtgcatagtatgtcgtaatgatgttactgcaggttgcaagtcaaatcttgaaaatgaatcttctgggggcaataactctgtcccagatactcagctacctaatgcagataaaggagcatcaaatcttgaaaaggaatcttcttggggcaataactttgtcccagatactcatccactacctaatgcagataaaggagcatcagatataggtggtgaaaataattttaccagagaaactcagcctctgcctaatgcagataaagaagtgttgcatattggtggtgaggagaactctgcaagagaaactcagtctcttgctattgcagataatcaagcattacaacatgttggaaaaaatgttcctggtcacctaaaaaggcatcaacctaagatgcccccaaccttgaatgagtctaagaaggcaagagagcatatagctgttgcagtaacatcactaacccagaaagcaaagaaagaagataatttttctgtagataatgttatcagggtgcttcaggctataccagacctggatgatgatttaatattagatgcctgtgattttttggaagatgagacaagagggaggatgtttctggcactggctgctcctttgagaaagaaatggttattgagaaagcttcgttcgcagtga

SEQ ID NO: 51400 - DNA, 243 bp, Glycine max
  Peptide Sequence Number=SeqID_168178
atggcttcgcctcctcatttcgacgaagactttgattttggaggcggttttagcggaacgcattcaggtaataagaggtcatctcccgactatgacgaggatgaatatgaaaatgatccttttggacacaagaaggccaaatctaaagctgaagaagctgcttctggtgtgacaacaggaatgattttgtctcttcgcgagaggtatttctcagtacagctggtgtggaatgtggaatattag

SEQ ID NO: 51401 - DNA, 132 bp, Glycine max
  Peptide Sequence Number=SeqID_168179
atgctacaactacagtgcataataaaagcaaagggaagattagggacacctacctcgaacggaaatggcgtccaaccgaaagaagcagcacctgggctcgcggtgaaggagaaggctcacggaagagggtaa

SEQ ID NO: 51402 - DNA, 300 bp, Glycine max
  Peptide Sequence Number=SeqID_168180
atgtcttcttcggctaacacacaatgggaggtacttatccgcattgttaagtacttgaagaaagctccaaaccaggggattgtatatcaagatcatggacatatgcaagtgggggctttctctgatgtggattgggcaatgtctcctacagtccgtaaatctaccacatgctactatgtatttcttggaggtaatttgatctcttggacgagatctagtgtagaggcagaacatagggttatggctcaaaagatttgggagttgatatgggtgacaaattttggagatgggatttgctaa

SEQ ID NO: 51403 - DNA, 282 bp, Glycine max
  Peptide Sequence Number=SeqID_168181
atgctgagagatgaggccaaccatggagctgagaaaaatttgaggaaaaaaactgttcagcttcagtcacatatttcttaccgccttcgtttttctttacgggcatatgtttcgatgttgtaccttagaaaattttctaacttctcaatcatactaagggggaaacttgtggatcaatttaacattgcggacgatttaatatattcaaaagtaattccatataagcctcagctagccatggcaacaaatgaggttagatccatgatgtggagtagcaattaa

SEQ ID NO: 51404 - DNA, 249 bp, Glycine max
  Peptide Sequence Number=SeqID_168182
atgtcattgctaagccaagatccaaaggggtgtcactggaagcacgaaaaggcagccaaacaatggcaacgggcagcacgtccaacgacaacaggcagtaggtcaagtggcataggggttactagagtacgacaactccaatctcagagtcgtgatggagaaaagatggcatggcaacggccaaataagtttagtgggaacattgagacgagcactatgtgcttggggaaaaaggcacccattgtttga

SEQ ID NO: 51405 - DNA, 222 bp, Glycine max
  Peptide Sequence Number=SeqID_168183
atgacctcttatagttcaaccaccaggctaggcatcccatttgccgatcatcatcagatagaagatctacctctggctattgtgttcttgttggagctgcaagtgaaattacatggttacgacaacttctcttgcaacaacaatttggagacacctaggacactaagcttatttgtgataatcaagctgctcttcacattcatccaatctagtcttccatga

SEQ ID NO: 51406 - DNA, 405 bp, Glycine max
  Peptide Sequence Number=SeqID_168184
atggctttagcctatgctagatccattcaaagggtcactcaccatattatccatgcaccaagttcaaaagtgctgggcgtgagggggtgtattggaaaaatctcaagtcccacatatcctagagataagactaagatagagtatacaagtgggggacaaccctcattctatgagctaacttttggggttaagtcagatccaaacccatattctaagatggtattagattatacaattgggccttggtctcaatctcatagctataaaattgagcttgatgaagaaaatgaggacacaatggaggagaagaaaggtcaaacggtgaacgctttgttgaacatccaaatgataaaattgaagggaagaagatcaaataggctggaaatgagaacaaaatcaatataa

SEQ ID NO: 51407 - DNA, 183 bp, Glycine max
  Peptide Sequence Number=SeqID_168185
atggcggtttccaaactcagaatgatgcaaaggaaatccacgaaggtcagaccaagcttcgttctcaaccgaaaccgcgaggcaagtttggaagattctgcttcggttgaagggctcctctcggtgaggggtttcaacggagaacaacggcgatttgtggtggctactggtggctgtgggtga

SEQ ID NO: 51408 - DNA, 627 bp, Glycine max
  Peptide Sequence Number=SeqID_168186
ctctggaagaggatgaagaagtccaagctctaaaattagagctaggaaaggcaagactcgccaaagaaaaattcaagtcagtcgctacaaatatccggaaagagtgtgtcgagttacgagaggaaaacgcggctactgcaaaagcccttgaacaagaaaccaagagggcccgcaaggaagagcatggccgagataaattccgaggagctatgtggggcagcaacaatgagctcaagctccggagagaggaaagagaccagtcacgagtacatggcatgatcttaaaggaggagttagctgcttgctcaagatccaacaggagtttggcccaacacttagaagccacggagcaaagcatgctagctataatagggcagtacaaagaagagttaaaccagtctttgacccatgaacaaaaactagtagaggatttcgcacaagtgtacgccgaaaaggaagcaagagggagagtgattgatgcattgcatcaagaagcgaccatgtggatggataggttcgccttgaccttaaatggaagtcaagacctcccgcgactactagccaaagcaaaggccatcgctgaagtgtgttcagcccccgaggaaattcacgggctaatcgattact

SEQ ID NO: 51409 - DNA, 420 bp, Glycine max
  Peptide Sequence Number=SeqID_168187
atgaagaacgtcgaagaacggttgaaatcttgcgaaattcctcacggaaaacgttacggaaacgtttcggaagcgcctcggcttagattttcttcacggaaacaatttttccaagcaaattcgaaagagagagaagtgcctaaggggctggaccctttcttcttcacttcctcccctatttatagcaaaataggggaggtggttgccgcccagctcgcccaggcgagctcagctcgcccaggcgagcagggttgcttcctccagaagcaaccgccttctggaggaatcttctggagggcccaaatgggcctggccttgatagcacacaccaaaaacattgaaggatacactaccatgtaccttaaagcatgtctagcaatgcaaatggtcattcaaaacatctacagcaactgggaatga

SEQ ID NO: 51410 - DNA, 297 bp, Glycine max
  Peptide Sequence Number=SeqID_168188
atgccaatctccccctgcagatgtatcgggatcgcgcccacaagtcgcccagtggacccggagaagtccaacagggccctggggtttccagctctggttacgggcctctgtagtcctatagggtgcccgttccccccggcaaggtcacgtcatcatagttctacggagtacctatcacctccagcaagggcatcaggccccctactaatcgagctttcatcaagaagtactgcgtctccaggcaggcgcagggcgaaacaccacagtagcctggggatggccagcagcgggcaatag

SEQ ID NO: 51411 - DNA, 572 bp, Glycine max
  Peptide Sequence Number=SeqID_168189
gagtggggaatagaaaaaacctctctggggccggtgatgagcgctgctttggtcggcctcgcggtgggcgcgttggccgccgggccgttggcggatcgtatcgggcgcaagaaagtgctggtgatctcgctgctgctgttcggcggcttcagtttgctgaccgccttcgccggctcgctgtcaacgctgacgctgttgcgtttcctgacggggctgggattgggggcggccatgcccaatgccgccacgctgatgtcggaatatgcgcctcagcgctgccgggctctgatggtgaatctgatgttttgcggttttcctctcggctcatcgctgggcggcttttcttccgcctggctgatcccgcatttcggatggcagagcgtgatggtgctgggtggcgtcatgccgctgctgctggcgctggaagaggggcagataaaggcggcctcgccgctggggatgattttttcccgtcgctatctgctgggcaccttgatgctgtgcctgacttactttatggggttgatgattttctatctgctgaccagttggctgcccctgttgatccgtga

SEQ ID NO: 51412 - DNA, 297 bp, Glycine max
  Peptide Sequence Number=SeqID_168190
atgcatggtaatgtcaaggaaacaacacatagcatgtttgctccatgcccctatttcaggaacctaatgggggaactaaaagctcgctatttagtgataatttccaaggtggttgcacctaactttcaaaggtccccagtggagtcgccaactgtcgcaaccgacccttcgacgggagggcgacgtgagactcacgggtgcgtcttccaaggaaggaaaacacgcggagtcgccaccaacgtttatttgaggaaaacgttagaaaaaccaaaaaacaaaacggtctacgaattttaa

SEQ ID NO: 51413 - DNA, 2400 bp, Glycine max
  Peptide Sequence Number=SeqID_168191
atgagacggtcatctctagtgagtgcccttcttatagcaaacattctcatggcaacacgccttaccctcactcttcctttctctcgctccatctctccactcttatctcgttccctttcacaactcaaacaattcccaaaatcccacccttgtcccctctggtcctcctccttctccttctgcctccacacactccgcaagtccacttcccctattcgcgcctcttcttctttttctccctccatggctgcttcttctccgctaaacgacgccgtcgaaggcaatcctcttctgcagaacttcgacttcccacccttcgatgtcctcgagcccaaacacgtgcgacccggcattcgcgccctcctcggcaagctggaaagtgaattggaggagctcgaacggaacgtggaaccgtcgtggccaaagttggtggaaccgttggagaagatcgttgaccggttatctgtagtttggggcatgatcaatcatctaaagtctgttaaggatagttcggagctacgttctgctattgaagatgtacaggcagaaaaagttaagtttcagcttagactgggtcaaagcaaacctatttataatgcattcaaagccattcaggagtctcctgattggcagacactcagtgatgctcgaaaacgtattgttgaaagccaaataaaggaggcggttcttaatggagtttctcttgaagatgataaaagagaaagttttaacaaaattgaacaggagctggaaaagttatcacaaaagtttggggagaatgttctggatgcaacaaagaagtttgaaaagctaatcactgataagaaggaaattgaaggattacctgccactgctcttgggttggctgcacagagtgcagtatccaaggggcatgaaaatgccaccgctgagaatgggccatggataattacattagatgctcctagttttattgctgttatgcaacatgctcgcaaccgttctttgcgtgaggaaatctaccgtgcatatgtaacacgtgcatctagtggagatttggataatacaggaataattgatcaaattttaaagctaaggttggaaaaggccaagcttctaaactacaataactatgccgaggttagcatggcaaccaaaatggcaactgttgataaagcagaagaacttcttgaaaagcttcgcagggcttcctgggatcctgcagtgcaaggaaataacttaggtgttgcatctttcttccttgcagatattgaagaccttaaggaattctccaaaagtcagggagcattggaagctggtgatttgactcattgggacattaccttttggagtgagaggctacgtgagtcaaaatatgatattaatgaggaagaactgcgtccctttttctctctgccaaaggttatggatggactctttaaccttgcaaaatcactttttggcattgaaattgagccagctgatggtctagctccggtctggaataatgatgttaggttcttctgtgttaaggattcttctggtagtccaattgcgtatttttattttgatccttatagtcgtcctgctgaaaaaaggcaaggtgcatggatggatgaagtctttgctcgtagtcgtgtgttatcgcgcgatggtacctcagcaagattgcctgttgctcacatggtgtgcaatcaaactcctccagtaggaaacaagccaagtctaatgacattccgtgaggttgagactgttttccatgaatttggtcatgcacttcaacatatgcttactaagcaagatgagggtctggttgctggtattagagggatagagtgggatgctgttgagttaccttctcagttcatggaaaactggtgttaccatagagaaactttaatgggtattgcaaagcattttgaaactggggagagtcttcctgaagaagtatatttgaagcttgttgctgctaggacatttcgagctggctctctaagtcttcgacagttaaaattcgcaagtgtagatctggaacttcatacaaaatatgttccagggggacctgagtcaatctatgatgttgaccgcagagtttctgagaaaacccaagtgattcctccattaccagaggataggttcctttgcagctttagccatatatttgcaggtggatatgcagctggatactatagttacaagtgggctgaggtgctgtctgcagatgctttctctgcatttgaggatgctggattggataatgacaaggctgttaaagaaactgggcgaaagttccgggagaccattcttgctcttggaggtggcaagccaccactagatgtttttgtgcaattccgtgggagagaaccaacaccagatgcattgcttaggcacaatggcctattacaagttgcagcttcgtga

SEQ ID NO: 51414 - DNA, 2145 bp, Glycine max
  Peptide Sequence Number=SeqID_168192
atgactcaagccaatggccaccatcgtgttgatcaaacagtgattgacataaagaaaccgccggtgagcttcactgggggtctggtgttcgagtgcctcacttacaccgttacaaagaagaaaaaggttgaggggaagtggtcgaatgaagaggtggatttgctgcatgatatcaccagctatgcaccaaagggttgcatcactgcagtgatgggccctagtggagcaggaaagtccactctcttggatggccttgctgggaggattgcgagtgggagcctcaaagggagggtctccttggatggtgcgactgtgagtgcaagcttgatcaagagaacttctgcatatatcatgcaggaagacaggcttttcccaatgctcaccgtctatgagactttgatgtttgctgctgattttcgtctggggccactctcacttgctgataagaagcagagggtggagaagctcattaaccagcttggcttatcgcagtcatctcaaaacacctacataggagacgaaggtacaagaggagtctccggcggagagcggcgtcgggtttcaatcggcgtggacatcatccacggcccatccctcctcttcctggacgagccaacctcggggctagactccaccagtgcccacagcgtgatcgagaaagtgcatgacatcgcccgcagcggtagcacggtgatcctcaccatccaccagccctcatccagaatccagctcctcctcgaccaccttatcatcctcgcacgcggccagctcatgttccaaggctcgccccaagacgtggcactccacctgagtcgcatgccacgcaaaattcccaaaggagagagccccatcgagcttctcattgatgtgattcaagagtatgaccagtctgaggttggagttgaagcacttgctgagtttgcacgcactggagtgaagccacctcctttgtctgaacaactacactctctgtcttctgttgcaccctcacctgctccgtcctcgcaccttggccataggtatggggagaaatctcaggacttttcttactcgtcgcaagtgagtagaagggtcgtggatgattttgatcacagtctcagaagtccctataacaacaatacatcaatgtcgtggagcactgggaatagtgcggcgtttttgaaattcactccttcgcggcttaagaatgatcacaagctgcagaataccgcaagaagcaatgcttcacctggctactacacatactcgagtgaaatcctccaagccactccaacaccccatagcagtgactacacagtgaatgagaatgactacatcactgcctcaaacgccacacacgaacaccttggcccaaagtttgcaaattcctacataggagagatttggatccttatgcgtcgcaacttcataaacataaggcgcacccctgaactcttcctttcaagactcatggttctcaccttcatgggcatcatgatggccacaatgttcttcaagccaaaagaaacattgcaaggaatcaccaaccgcctcagcttcttcatcttcacagtgtgcctcttcttcttctcttccaacgacgccgtcccggccttcatccaagaaaggttcatcttcataagggaaacctctcacaacgcctatagagcttccacttacaccattgcaggcataatcactcacatgccattcattcttctccaagcaacttcttatgctgtcattgtttggtttgccctaaaacttcgaggcccttttctttacttcttgcttgttctcttcgtttctcttctttcaaccaattcatttgttgtgtttgtgagctcagttgttccaaattacatccttggttatgctgtggttattgccttcactgccttgttcttcttgttctgtggatacttcttaaacagccaggacattccccatttttggcgttggatgaacaaaatttcaaccatgacgtacccttatgaggggctcttgatgaaccagtatcagaccaatgatacctttgggtttgggtatcttgatggtgcagccattactggttttgatatcttgaaaagtctacatattgacattcttgaacggaaaagcggtgctgatatgggtagcagaactatatatccaccggaagggtag

SEQ ID NO: 51415 - DNA, 2757 bp, Glycine max
  Peptide Sequence Number=SeqID_168193
atggagttaccagatatttggatattaagactggttgtggcatgtgttttttgtctgcatatatttatcagatcggcttctggctatgcaactgaagggtttgaaaacatagcatgctgtgctgattcaaattatacagatccgcaaaccaccttaaattacacaacagattacagatggttccctgataaaggaagttgcagaagaactaaagatgtgttaaatgaaaaagttcgactgttttttgtagatgaaggaaagagatgttacaatttgtcaacaattaagaataaagtatatctgataaggggcacatttccattcaacggtgtaaattcttcctttaatgtttcaattggggtcacacaattaggtgcagtgagatcatccgggctccaggacttggagattgagggagttttcagggctgccaaagactacatagacatatgcttagtgaagggagaagtggatcccttgatttctcatattgaattaaggccattgcctgaagagtatctacatgacttgcctgccagtgttttaaaactgataagcagaaatagtctttggggctcaaaagatgaaatcaggttcccaactgacccaagtgatagaatctggaaagcaacttcaagtccatcatctgctcttctagtgtcttccaatgtcagcaattttgacctcaaatccaatgtgacaccacctctacaagtcctacaaacggctcttacccaccctgagcgattacagttcatgcacagtggcattgatacggaggataatgaatatcgtgtatttctctacttccttgaattaaatagcactgtcaaagcaggcaaaagggtgtttgacatctatgttaatggtgagattaaaaaggagagatttgatatattggctgaagggtccaactatacatacactgtcttgaacgtttcagcaaatggattacttaatctaaccttggtcaaggcctcaggagctgagtttggaccccttttgaatgcttatgagatcctgcagatgcgatcatggattgaagagaccaaccacaaagatgtggaagtgattcagaagattaaagaagaagtgttgttgcaaaatcaaggcaataaagcactagagagttggactggagacccttgttttttcccctggcaaggaataacatgtgacagttcaaatggttcgtctgttatcactaagctggatctgtctgcacataatttcaaaggaccaattcctcccagtatcactgagatgatcaacttaaaactactgaacctgagccacaacaatttcgatggttatatcccctcatttccactgtcctccttgttaatatcaatagatctgagctacaataatcttatgggatcacttccagaatcaattgtctcactgccacatttaaaatcgttgtattttggctgcaacaaacgcatgagcgaaggaggtccagcaaatttgaacagttcactaatcaatactgactacggaagatgcaaaggaaaagaacctagatttggacaagtattcgtcattggtgctattacatgtggatcacttttgattgctttggccgttggaatcatttttgtttgccgctatagacaaaagttgattccatgggaaggatttggtggaaagaactacataatggaaacaaatgtaatattctctttgccaagcaaagatgatttcttaataaagtctgtatcaattcaaacattcactttggaagatattgaggtggccacagaaaggtacaaaactttgattggggaaggaggatttggttctgtttaccgtggcaccctaaacaacagtcaagaagtggcagtgaaagtccggtcagccacatcaactcaaggaactcgagaatttgataatgagctaaacctactttcagcaatacagcatgagaacctggtgcctcttcttggttactgtaatgaaaatgatcaacaaattcttgtgtatcctttcatgtccaatggttctttgcaagatagactctatggggaacctgcaaagagaaaaatattagactggccaactagactgtctattgctcttggtgcagctcgaggtttggcatatcttcacacatttccagggcgttcagtaatacacagggacgtgaaatcaagtaatatacttctagatcatagcatgtgtgctaaggttgccgattttggtttctcaaagtatgctcctcaggaaggagacagtaatgtttcccttgaagtaagaggaactgcagggtacctggatcctgagtactacaaaacccagcaattatctgagaagagtgatgtcttcagctttggcgtggttttacttgaaattgtgagtggcagggaacctctcgacataaagagaccccggaatgagtggagcttggttgaatgggctaagccatacgttcgagcatcaaagatggatgaaattgtggatcctggcatcaagggaggataccatgcagaggcaatgtggagagtggtggaagtagcactgcattgtcttgaacccttctcagcatatagaccaaacatggttgacattgtgcgcgagttagaggatgctctcatcatagaaaacaatgcatcagaatacatgaagtccatagacagccttggaggatccaaccgttactctattgtcatagagaaaagggtgctgccctcaacttcatcaacagcagaatcaaccatcaccacccaagccttatcccatccacagccaagatag

SEQ ID NO: 51416 - DNA, 601 bp, Glycine max
  Peptide Sequence Number=SeqID_168194
atgttgagagtagagcgcctgttcaaaagggctccgaaactgaaggggtggaggattgaggatgtattaaaagagaagggaaaagaatgcatgtgggaaaaggactttgtgaagccggtgaagatggtgcttccaaagctgttcaccatgctgtcttcattgaagaatccatttgaggttgtttccatcgaaaggatattcagctggtggtggaagaataatgaagagaaagacatcgaggagtttatggagacggttgatgatggtgctacaagcgacgaaattgtgggtaaaggaggatttggagactcaacaaccgaccttgactctggtggagttgtaggaagaggttctaagaccttcggcttcaatgttgagagtgtgcaagtgagcgacaaaggtgtctttgagaggagtgtcgaagtcaatggcaacaacgatgattttgatagggcatgggttttcctacatgaaacaccatctgagctcgcagagcgtcgatcggatgtaggcgtaggggaacacgtagaactgcacccgccagtcatgggagcatctgtcgttgtctatcacgtagtgaagatgctcgctgacatggagg

SEQ ID NO: 51417 - DNA, 1920 bp, Glycine max
  Peptide Sequence Number=SeqID_168195
atgtaccctcccgatcccccagttgatccagagctcagacacaccttagcctcgctgaccttttgggccaaactgactctggacattggttaccatgtttggttcttgagccaccaggttgaggaccataaggggataaaacaatcatactggggtatcacccatgatggaatgactacccatcaagtatcacaacaggatttggaagacacttatcagcccccatttcgtagttgtattcagcaagggaaagcaagctgcttgatgtgttcctacaatgaggtgaatggtgttcctgcttgtgctagcgaggaactcctgggactggctagagacaagtgggggtttaaagggtacatcacctcagattgtgatgctgtggccacggtttatgagtatcagaaatacgcaaaatcccaggaggatgctgttgctgacgttctcaaagcaggtatggatattaattgcgggacgtttatgcttcgacatactgaatctgctattgagcaaggaaaggttaaagaggaagatttagatcgagcacttcttaaccttttctctgttcaactgcgccttggactgtttgatggagaccctataagaggtcggtttggcaaattgggaccaaaggatgtttgcacccaagaacacaaaacactggcacttgatgctgcaaggcaggggattgtactgctgaagaatgacaagaagttccttcccttggatagggatattggtgcctccttagctgtcattggtccattggcaactacaaccaaattaggtggtggctactcaggccatcatcttttaaatgtttctctatcttttagaagacccctcaaaaccctgacatcgaactgtatgatgttgtacctactacctaataatgtaggaattccttgctcctcatcaagcttatatgaaggacttggagagtttgcagagaggatatcatacgcttttggttgctatgatgtaccatgtgattctgatgacggttttgctgaggccattgacactgcaaagcaagctgattttgttgttatagttgctgggcttgatgcaacgcaagagacagaggatcatgaccgagttagtcttctcttgcctggtaaacaaatgaaccttgtatcatctgtagctgatgctagtaaaaatccagttattcttgttcttattggtggaggacctcttgatgtctcttttgctgaaaaaaatccacaaatcgcaagtattatttggttgggataccctggtgaagctggtggaaaagctctagctgaaattatctttggagagtttaatccagccggaagactgccaatgacttggtaccctgaggcatttactaatgttcccatgaatgagatgagcatgcgagctgatccttcacgtggttatccaggaaggacctaccggttttatactggaggtagagtatatggatttgggcatggtttaagtttcagtgatttttcatacaatttcttatcagctccaagtaaaattagtttgtctagaaccatcaaagatggttctagaaagagattattatatcaggtagagaatgaggtttatggagttgattatgttccagttaatcagttgcaaaattgcaacaaattgagcttctcagtgcatatttctgtgatgaaccttggtggtttggatggaagccatgttgtaatgttgttctctaaagggccaaaagttgtagatggttctccagaaacccaattggttgggttcagccgtctgcatactatttctagcaaaccaactgaaacaagcattttggtgcatccttgtgaacacttgagctttgcagacaagcaaggaaaaaggattttgcccttgggcccccacactttgagtgtaggggacttagagcacgttgtttcaattgaaatttattga

SEQ ID NO: 51418 - DNA, 1806 bp, Glycine max
  Peptide Sequence Number=SeqID_168196
atggcttttatttatgctgctgctgttgttggctgtgcttcttcttcttcctctcccgctgtttccgaaaatcatgatgttttcatcagctttcgaggagaggatactcgcggtgacttcacaagccatcttcatgctgctctgtgcagaaacggcatccagacctacatagactacaggatccagaaaggatacgaggtttggccacaacttgtgaaagctatcagagagtccactctcttgttggttatcttctcagagaactattcgtcttctagttggtgcttgaatgaactcgttgagctaatggagtgcaagaaacaaggagaagaagacgttcatgtacgcaaacagagtgggagttatcacacggcattggcgaaacacaagaaggattggaaggtgagtaaggagaagatgcaaaaatggaaggacgctctctttgaagcagccaatttatctggcttccattctcaaacatacaggactgaacctgacttgattgaagacattattatagatgttttgcaaaaactaaatcataggtacacaaatgactttagaggccttttcatatctgatgaaaactatacaagcattgaatctttactgaaaactgattcaggggaagttcgagtcattggaatttggggcatgggaggtattgggaaaacaactcttactgctgctatttttcacaaggtttcctctcagtatgaaggaacttgcttcttagaaaatgaggcagaggaatcaagaaggcacggactaaattacatatgcaacagactttttttccaagttactaagggagatcttagtattgacactcctaaaatgataccctctactgttacaagaagactcaggcacaagaaagttttcattgtactagatgatgtgaatactcctcgacttttagaatatttgattggagtggattgtgactggctaggagctggtagcagagtcattgtgacaaccagagataagcatgtacttatacgtggagaagttgacaaaattcataaagtcgaggaaatgaactttcagaactcccttaaactttttagcttaaatgcctttggcataacctatcctaaaaaggaatatgtggagtcgtcaaaaagagctatggtttatgccaaaggaatccctttagctttgaaagtcttgggatcatttcttcgttccaaaaccgaaaatgaatgggatagtgcactaagtaaattgaagaaaattcccaatacagaagttcaggcggtgttcagattgagttatgatggattagatgatgatgagaaaaacatttttctagacatagcttatatagggataagaagtcttttagacaaagctcttatcactactacttcatataataatttcatagatatgcatgatctgttacaagaaatcgagaaattgttcgtgaagaatggaactggtgcagttgaagggatatggttggatatgactcaaattacaaatgtaaatttaagctccaacgcatttagaaagatgccaaacctgagattacttgctttccaaactctcaatcgagactttgagagaattaattctgtgtaccttccaaatggtattgaattctttcctaaaaacttaagatattttgggtggaatggttatgcattagaatctctaccatcaatgcgatacagcaatgtggaaaaactttggcatggagtacagaatctgccaaatttagagacaattgaccttcatggctccaaactccttgtagagtgtccaaatttgtctcttgccccaaaccttaatttgtaa

SEQ ID NO: 51419 - DNA, 252 bp, Glycine max
  Peptide Sequence Number=SeqID_168197
atgagtgaccccaagtatgcttatccctaccctgctcaaggtcaggggtattatcaaggtcctcctgtgatggcaccaccgcaatattatgctgctccaccaccacgcacaagacaaactggattccttgagggatggttaatgagtgctgctgtgatccctcaatcttatgtatcatctgatgtgatcaaaattgctgcaagtaggaaaaacaaaatgaagaagatacaagtacatatatatgcagtgtga

SEQ ID NO: 51420 - DNA, 2484 bp, Glycine max
  Peptide Sequence Number=SeqID_168198
atggaaccacaacaagaaatggagtggaatgaagcccaaaagattccaataagcgtggaccttatagttgtggcaaaaaagcagcttcagttccttgcagctgttgataggaaccgtcacctctatgacggtcctgcccttgaaagggctatctataggtacaatgcttgttggcttcccttgcttgccaagcattccgagactcccatttttgaagggccattggaagttcctcttgactgtgaatgggtttggcactgtcacaggctcaacccggtaaggtacaaatctgactgtgaggaactttatggacgggtacttgacaacttcggtgttgtctctactgttgaaagaatttgtggcaggcaaactgaagaaatctggaataatctgtatcctgatgagccctacaatgttgatttggttaatcttctcccagaggatatctctgaaaggatttctaatcttgaaaaatgcaccaactatgatctgatttcagctgctaagaggcagagcccattcttttaccaggtatcaagaacgcacatgaaaaatgatctctttatcaaggaatctgtggccagatacaaagggtttctgtatctcatcaagagaaacaaggaaaagggtataaaacgcttttgtgttccaacatatgatattgacctaatctggcattctcatcagttacatccagttgcttatggtaaagacctcaatgaagcacttggaaaagtattggagcatgatgatacagactcagacagaactaaaggaaagaaactggatgttggtttttctggaaccaccaaacagtgggaagtcacatttggtacaagatattggaaggctggagcaatgtataggggtaacgcaccgtcccctatcacaagtaaccctttttcatctagcattatatgcaagaaggttgtttcttcaaatgagtacccacaagaagttttgctaccagaccggaaagttatggaggttttcttggagttcattggggttaaaaacttatcagagggacaggaaggagatctgtctgttttattttccaaatcacagcccgatgcattctttgatgctaaaaggagactaagtattttatcagtgtctagagagaaacaggttgcatctttccgatgtgaacctacaggagagctgctttttgaactcatgtcctcttcttcttccaagttatcaataagaaaatcaacaaagacactcggttctgcatctttctctatgaaagactatcttgacccagtttcaaaactctatgttgagaaatggttggagttggtaccaagttctgatactacaagctcaaagccaatcttgttacgtgtagcaatctcatttactgttccagttcctgcctcatatacacttgaaatgactcagtctcgtccattttccaaaaatacatgtctcttcaaccttcctgttaggccccaacatgctaaaatctggacacatgtcacagatgaaaatggcactagaatcatcagccttcaaattagggatttgaagaatgcaatgaacataggaaaccctggaaaggaggttgtgggcctcatgaagtctggtgaaactcacactcttgctgagtttatggaaaatggttggtctgttttggagaatctttggctgtttcaccttccaaacaaatctacaaatgatggccatctctttgagcttactggtgccaaaacggtgagaatttttcccggaagaaagctagactatgaactgagacacaatgggaaacggggaaatgaaatggatttcctaactgctgttgaattctccattgaagaaccctatggcaaagcagtggcattgcttgacttgagatctagacatgtcacggcaaaggaaaagtggatggtgctgcctggaatcattttggcttttattgcttctaatataataaaaaagggaggatatgaaggcatcattgctgaaagtaaagatttgaaggtgaatgggccaaatgaggaaaatgaaaagacagtcttgaatggaatggggttgagttctactaatatgtgcaatgaagatgaggggataacaaacaagtctgaactatccattggaggctgtgggaatgcaatggaaagtggtggctgtggaggctgtggtgctggttgtggcggaggctgtggaaatatgattaagagtggtggttgtggttctggttgtggtggaggctgtggaaatttgattaagggtggtggttgtggcggttgtggtggtggttgtggcggaggctgtggaaatttgattaagagtggtggttgtggtgctggttgtggcggaggctgtggtggtggttgtggaggctgtggaggagggtgtggaaataggttggagagtagtggctgtggtggttgtgggggaggttgtggtggtgatcttatggatagtaaatgtggtattgatgaacatttcaatgaagagctaaagtatgtttcatga

SEQ ID NO: 51421 - DNA, 1347 bp, Glycine max
  Peptide Sequence Number=SeqID_168199
atggaggtgcaggacagaaactcctccgtccacacccaatccatcaccgcagtgaccccacgaaggtcacccaggttccccccccaacaaaacaacgacactcccaccccgaaatccgcgaaacgcagcgtttcctccaacaaatcggacaagtgcgctgttggatcgagaagatccccgaggctgaacaatgttgaacaacgacctccccctctgagacgatgtcccaggttgaacaacgagtcaagcgacaaaaaattgaaagacacgagagtgaagaagggcggtgaagctgaaacgaaggaaaatcgtgtcgtttcggacgagggtttcggtggaggaagaaagaagaagagaaacaggaagaggattgaagttgaaacgcaagaaaacggtgtcgtttcggataagggatttgttggaggaagaaagaaggaggaaaatgaggagagggtgaaaacgaaagcaaattgtttcgttttggatgagggttttgatggaggaagagagaagggggtaaatggggagaagagaaagcgtggtggcgaagaaatcagtaaagggtggacgaaggaacaagaattggctcttcaaagagcgtatcttgctgcaaagcctagcccccatttctggaagaacgtttcgaaactggtgccaggaaagtctcaacaagattgctttgatagaattcactgtgactatatgacaccacctgaaactcagcctcgattgagggcaaagacatttaagtcatcacccattcaccaattttctatatctgcaagtaaacttctcaaacctatggataaaacagctagaagatctaatgttctaaaaccaaagaacattattacccagaagtctgttgacaagctgttacagcgccatcttaaagtagatctagatcgtgaaggggacatattttctgttcttgaaccaaacactgatttttctactaatgctttacagcctagtgaagcactttctactccgaagcagcaaaaggaaaacaaagggttcccgcaaaattgcactgaaacatcatcttcaagccataagaagccaccttcaagattgagtggctcgtgtgttacagaacttgttagtcccccagtactaaagaaagtaaagaacagggtaatgcatgagaaatatatcaatcaattgcgctgtagggaatctaggagaagagcagatgctacaaaaataattgaaggaaccagcatacagaaaagggatgtagttaatgctgcaaaagttgccttgcaagtcaatttcgtggacaatacttctagttctggtgaagataacgatgatggcattgaatttgaagatgaaagtcaatag

SEQ ID NO: 51422 - DNA, 2049 bp, Glycine max
  Peptide Sequence Number=SeqID_168200
atggttactgggtggagaagagcgttctgcacatccatccccaaagacagagaacccaaagtgttgacagagaaacaacaacagcattgcgaaaacaatagcagcaacaacaacaatagcaccaccaccaatcacagtcccaaaatcagttccaagtttagatttttctccaacccatcaacaccccgttgtgaatctcaactttcatcaacccctagcctccgttgtcgaaccacttgctcagtcccaaacagcccaaaacttcaatgcaaaacaaaaactccaaggtttttccataactccaatccctcatcgcccaagtcgccatcgagtttttcacttctcaaatcaactctacgactatccaaaagtcgatgtggaatctgtatgcagagcgcgaggagtgggcaaggaacagcaattttcacagcggaatgctctcacacgtttcacttcccttgcatagtgaagaagcacccgatcgtcacgtgccccgtgtgcaacactagctggaaggagcttccggtgctctccatcaacaacaacaacaacgacaagagcgacaagagaggcttcaaggtctacaacgacgacgagcctctcatgtctccaacttcactctctcgcttcaatcctattcccgagtcagaaaacgaagacgaagaacaagaacaagataacattaacacggagtttaagggctttcatgtcaatccacttcccaatttacattcaacgacggtgattaggaggaacctccagctatcgttgctgccggaggcggccattgtcgccgccaaccgaaactacgagagttacgtcgtcgttttgaagctcaagccgccgcacgtgacgaaaacgtcgcgtcgtgctccaattgacctcatcgccgtgctcgacgtcggtggcgccatgtccggcagcaagctccgtctcatgaaaagctccatgcggcaagtgatctcgtcgctccgtccaaccgatcgtctttccatcgtcgcattctcggccggatccaagcggctgcttccgctgcggcgaatgaccggtggcggccagcggtcagcgcggcggatcgtcgacgcgctcgccgcgattgatcaaacaagagaaggaactccggtgaagaacgacgccgtgaaaaaagccgcgaaagttctcgaggatcgccgcgagaagaacgccgtggcgagcattgtagtcctctccgatctgaacgactcacgcgctggaaacaacatgcacaaaccctcgcttgtttccaccacgcggcttgcccacctcgaagtcccagtgcacgcggtgcggttgggagagtgttcccacgcgctctcagacgacgcgctggcgaatttcgtgggaggtttgttgaacgtggtggctcaggacgttaggattcagttagaggtggtgtcgcgatcccgcgctgtggagattgctggcgtgtattcattatcgggtcgacccgtttctctcgggtcatcggattggatccgactcggtgatctctacgcggaggaagagagagaattcctcgtggaactcaaagtgcctgcggcttccgctgggtcccaccacgtcctgaccgtacgatcctcctatcggaaccccctcactcgtgagcctttgattcccgttgagcaggcaatgctcgttccgcgtccccacgccgtacgatcctcgtgcgccaagatcgaacgcttacggaacctccacgtcactgcgcgagccgtggccgaatcttcccggctcgctgaacataatgatctctctggagctcatcacttgctctcttcggctcgcgcgcttctcttgcagtcaagtaagccggaagaggagtttctccgctggctcgaagccgagcaagccgagctgcaacggcgcagacagaggcaaacacagagaaacagtcgtgttgaagagaaggtggagccgcttacgccgacttcggcttggcgggctgctgagaggttggctaaagtggctatcatgagaaagtctatgaacagagttagtgacttgcatggatttgagaatgccagattttag

SEQ ID NO: 51423 - DNA, 628 bp, Glycine max
  Peptide Sequence Number=SeqID_168201
atgagtaaacagtattttgggacagatggtatccgcggacgtgttggggagtcagtcattacccctgagtttgtcatgaagctgggctatgctgccggtcgcgtattagccagtcatgagcaactacctgcgggtaaccgtccgactgtactcataggtaaagatacgcgtatttccggttatatgctggaggcctcactggaggctgggttgtcagcggccggtgtggatgtgttgttgaccgggccaatgccgacgcctgccgtggcatatttaacgcgtgccctgcgtgcgcaagccggtattgtgatctcggcttcgcataacccatactatgacaatggcatcaaatttttctcggcacaggggaccaagctggccgatgatattgaatatgccattgaggcagagctggcgaaacccatccaagtcatggagtcggcacagctaggcaaggcgaagcgcgtagacgatgcggctggccggtatgtggaattctgtaaaagcactttccctaaccacctggatttgcgcggcctgaaaattgtgctggattgtgcacatggtgccacgtatcacgtcgccccggatgtctttcatgaattaggcgcggatgtgattgctatcg

SEQ ID NO: 51424 - DNA, 627 bp, Glycine max
  Peptide Sequence Number=SeqID_168202
atgtcctacccatcaaagggctacacaccctcgccttcagaggactatacgtcctcctcttcagaaggctacacgcctttgccttcggaggactacatgtcctcccctttacaggactacccgtcctcgccatcagatgactgcacaggactacccgtcctcaccttcagaggactgaatgtcctccttttgggagggctacacgcactcgccttcagaggactatatgtcctcctcttcagaggattacacgtcctccccttcagaggactacacatcctcaccatcaaaggacctcacgtcctcgccttcagagggatacacgtgctgaccttcataggactacacgtcctccccttcagagggctacacgccctcgccttcagaggactacacgtcctcaccatcagagggatacacagcctcaccttcagaaggatacacatcctcctgttcagaggactacacgtccacgctttcagagggctacacgccctcgccttcataggactacacgtcatcgccttcagagggttgcacgccctcgcctttgttgggcttcaccccctcgccttcataggactccacatctgcgccttcagagaactcgaggtcctccgcccttaa

SEQ ID NO: 51425 - DNA, 615 bp, Glycine max
  Peptide Sequence Number=SeqID_168203
atggagaggagtatgattgatgctgccagtggtggatctcttggtgatatgacccctgctgaagctaggaatttgattgagaagatggcttccaactcccaacaatttagtgcaagaaatgatgctattgttcttagaggattccatgaggtgaccatagattcatctccatctactgaaaataaaaagcttgaaggaaaacttgatgccttggtcaacctagtaacccaacttgccatgaatcagaaatctacactcgttgcaagagtctgtggtctatgttcttctgcaaatcaccatacagatctttgtccttctttgcaacaatctggcgtcaatgagcaacttgaagcttatgctgcaaacatttataatagacctcctcagcagcaaaaccaacaacaacagaataattatgatctttcaagcaatagatacaatccaggttggaggaatcatccaaatctgagatggataagtcctccacaacaacaacagcctgtccctcatttccagaatgttgctggtccaagcaaccatatgttcctcctccaatacagcagcagtgacaacaaagacaaccaacaactaaggctcctcctcaaccttccttag

SEQ ID NO: 51426 - DNA, 189 bp, Glycine max
  Peptide Sequence Number=SeqID_168204
atgggggaaagcaacaaaagaaagagaattctcgatcaaagatcggaagagaaaagaagaaatatgcagaaaggtcttaggaccagacaatatctgaacaatacagatttgtcaccaagaaatgatttgcaagatcaagtgatgacatatctctggttcggaactaggacgaaacacttacctgtgtga

SEQ ID NO: 51427 - DNA, 243 bp, Glycine max
  Peptide Sequence Number=SeqID_168205
atggataaatttgacatctttgtccctcatcctctcgtaattagatctttgcttccactggaatgtgggcgcaagccattggtcatgaaaaaagacaaggttgatacctcaaagccctacactggggcaataaggggcactgtgcataagcctcgagcaaacctagggaagataaaaagttctcacccgtcgatgtttttaaatgaaaagagggtgacaaactctgggttttcaatggattga

SEQ ID NO: 51428 - DNA, 249 bp, Glycine max
  Peptide Sequence Number=SeqID_168206
atggggtgtacccatgggcccgaaatctaccctaaggctcataagaaccctagggccttctcttgcatctctggcccaatctacttggagttttctatccaatgcccttgcggggtaggattgcatcagcagtttaatgctagcttcttggccgttgctcaatacccggaatgggtcagcaacatcgtaccaatccctaagaaagaggggaaggtgcaaatgtgcgtggactatcgagatctaaactga

SEQ ID NO: 51429 - DNA, 189 bp, Glycine max
  Peptide Sequence Number=SeqID_168207
atgcttgtcgacaggggtctctccgaaaggggtgcaatcaaatataatcctgcagggttagaaaacgtaatttccagcgcattggaatcaaacttgaatgcagtgaacgggcaaataacccaagataaggtgaaaaccaacttacgtgaggtccaagtaacaagaaggatgacccgctaccattgttaa

SEQ ID NO: 51430 - DNA, 874 bp, Glycine max
  Peptide Sequence Number=SeqID_168208
agggctgcatgccctcgccttcagagggctgcacgccctcactttcagagggctccgtactctcaccttcagagggctacacgccctcgccttcagaggactacacgcactcaccttcagaggactacgcgtcctcgcctttagaggactacatgtcctcgccttcagaggactacacgtcctcaccttcacagggctacacgctctcgcctttaaaggactacatgtcctcacctttagagggccacacgccctcgccttcaaagggctgcacgccctcgcctttagagggctatatgtctttgccttcagagggctgtacaccctcaccttcagagaactacacatcctcgccttcagagggctaaacgtcctcgtcttcagagggctacacgtcctcgccttcagagggctgcatgtcctcactttcagagggctgcaagtcctcaccttcggaggacaaaacgccctcaccttcagaggactacacgtcctcacctttagagagctgcatgccctcgccttcagagggctgcacgccctcgcctttagagggctccataccctcacctttagagggctggacgccctcgcctttagaggactacacggcttcacctgtagagggctacacgccctcacattcagaggacttcacgtcctcacattcagagggctacacgccctcgccgttagagaactacacatccttacctttagagggctacacgccctcgccttcagaggactacgtgtcctcggcttgagagggctacacgccctcgccttcaaagggttactcgtccttgccttcagagggccacatgccctcgccttcagaggactacacgtcctcaccttcaaaggactacaa

SEQ ID NO: 51431 - DNA, 294 bp, Glycine max
  Peptide Sequence Number=SeqID_168209
atgagggttcactgtaatcaagcaagtaagagacctagcatgatcacggattcacctccactccttatgttcccacgaacccggtccccagtggagtcgccaactgtcgcaacctacccttcggcgggagggcgacgcgtgactcgcgggatgtgtgttccacgaaaggaatacgcgcggagtcgccaccaatgtttattcgaggaaaacgtcggaaaaacaggaaaagacgcgatctacgaacttttaagtgaaaggctcgggagttgtatttacgcccggggaaggtattag

SEQ ID NO: 51432 - DNA, 120 bp, Glycine max
  Peptide Sequence Number=SeqID_168210
atgcaatcacagggacttgcactgccttcgaagcctgagggaatgatccagacacgggtgactcaaacaaatgcaggttgtacatcgaagaaaatcctccccgcctgggtgcccttgtag

SEQ ID NO: 51433 - DNA, 444 bp, Glycine max
  Peptide Sequence Number=SeqID_168211
atggatagagtcgcgttccgtaaactatgcgaaatgttgaaaatcataggtgggatgcacccttccagacatatgcgtgttgaagaacaacctcaacatattttcgagaacaacaaagatgacaggtggaaatactttaagaattgtttgggagctcttcatggcacatacatcatggtcaatgtgcttcaagctgaaaaagtaaaaacagagcaaggaaggatggccatgcatggcgccacgaccactggcgccttcgatagggacgagccacgtggctttggaagcgccattcccaccagcgctcaaacgcagagccctaagttgcagcgttgcagactgcagcaagttagggatgtagcgacgcaggggcagcagggacgtgccattgggtattgcgagttgcatgaaggaggcgtcattccctccagcgatttgctttga

SEQ ID NO: 51434 - DNA, 445 bp, Glycine max
  Peptide Sequence Number=SeqID_168212
atggacatcccactgagaagcactaggaagtaccttttcaaaaaaacagacttgttgagattaagggagctagcatctttagtaagtgatccagttgattttcaagctcaccatgggaagttgctcagaattcttagagtagatgttgaggaaggatgcctagagaccctggttcagttctatgacccgctctaccattgcttcacatttcccgattaccagcttgtccccacacttgaagagtactcctacctagttggcttacctgtgccagacaagatacctttccatggttttgagcctacccctaaaccctccgacatcgcagccgctctccatcttaaaacctccatcatccaagcaaaccttacctctaaaggaggcctccaaggtcttcccacccacttcctctaccaacaagcctccatatttgctgaagcagcta

SEQ ID NO: 51435 - DNA, 771 bp, Glycine max
  Peptide Sequence Number=SeqID_168213
cggcgcgccggtcgcaagtggcgtgccgatcctcaaggtcgaggaagccgaagcggctgcaaagtcgcttccgggccgctctacgtcgtcaagagccagatccatgctggcggccgcggcaagggcaagttcaaggaactcggccctgacgcaaagggtggtgttcgccttgccaagtcgatcgacgaagttgtcgctcacgccaaagaaatgctcggcaacacgctggtcacggcgcagacgggcgaagccggcaagcaggtcaaccgtctctacatcgaagacggcgccgacattgcccgcgaactctattgctcgctgctcgtcgaccgctcggtcggccaggttgccttcgtcgtttcgaccgaaggcggcatggacatcgaagccgttgcccatgacacgcccgagaagatccacacgatcgccatcaacccggaaaccggcgtgacggctgccgacgtggctacgatctcgaaagctttgcagctcgacggcgctgctgccgaagatgcgaagtcgctgttcccggcgctttacaaggccttcaacgaaaaggacatggctctcctcgaggtcaatccgctgatcgtcatgaaggatggtcatctgcgcgttctcgacgccaagatgtccttcgacggcaacgcgctgttccgccatgacgacgtcaaggcgctgcgcgacgagaccgaagaagacgccaaggaaatcgaagcctccaagtgggacctcgcctacgttgccctcgacggcaacatcggctgcatg

SEQ ID NO: 51436 - DNA, 459 bp, Glycine max
  Peptide Sequence Number=SeqID_168214
gaatttaaaaatgtgtttcctaaggagattcctcatggactaccaccttcaagaggcatagaacatcaagttgatctcctccccggagcttcatttcctaacaggccaacttacaaaggcaatcaccaagagactcaacgtaaggatgcacatgccaaagttgagtatgtgaaaacattgtatgaccaactgaaggtgcaaattgcaaagaagaatgaaagctatgccaagcaagccaacaagaaaaggaaggaagtggtacttgaacccgatgatgatcctggacatttgaggacaaatgttttccaagaaggagggaatgatgagaatcatgaaactgaccaaatacaggctaaaggcccaagtggagaaggacgaaggccccagtggagaatgattgaaggccccgagtggagaaagatgaaggcccagaggcagaggcactaccaagactactaa

SEQ ID NO: 51437 - DNA, 726 bp, Glycine max
  Peptide Sequence Number=SeqID_168215
atgtatgaatatcctaggagaacccgcacattaacatgtaagcattcctttcgaaattcatatggatgttcatgcttcgttggaaaaagggaaatggctccgaagaagctctctacgaagaggtctagaagagatgccgcagcagaagggcccagtgccacccccgagtttgatagtcatcattttcggagcgctgagcaccaacagcgcttcgaggccatcaaaggatggtcgttccacagagagaggcgtgtccagctcagggaggatgagtatatggactttcaggaggagatagctcacagacgttggacgtcgctggtgactcccatggctaagtttgaccctgagatagtcctagagttctatgttaatgcttggcccatagaggagggagtgcgagacatgcgttcgtgggtgaggggtcagtggattccctttgacgtagatgccctcagccagttcctgggtgacccgctagttttggaggaaggtcaacagtgtgagttcagccaaaggaggaacaaagccgatgggttcgatgaggaagccattacccagctattgagcacactagggcaggatttcgcccggaccgccatagggaggcgtgtgcggatcatgcgcaccagcatgaccactttgacccagacatggatggccctgctgctcagcaatgtcttacctagcgatcacaactctgatctccctctgcctaagtgctag

SEQ ID NO: 51438 - DNA, 285 bp, Glycine max
  Peptide Sequence Number=SeqID_168216
atggctccaaagaaactctccacgaagaggtctagaagagacaccacaggagaagggtccagtgccgccctcgagtttgatagtcatcatttccggagtgccgagcaccagcagctcttcgaggccatcagaggatggaaggccaccagtgtgagttcagccaaaggaggaacagggtcgatgggttcgatgaggaagccattgcccagctgttgtgcacaccggggcaggattttgcccggaccactacagggaggcgggtgcagatcatgcacaccagcatga

SEQ ID NO: 51439 - DNA, 690 bp, Glycine max
  Peptide Sequence Number=SeqID_168217
atgcagcaacctagagcaattgagcagcctgaagcttatgcagcaaatatatacaatagacctcctcaacctcagcagcaaaatcaaccacagcagagcaattatgacctttccagcaacagatacaaccctggatggaggaattaccctaacctcagatggtccagccctcagcaacaacaacaacagcctgctccttccttccaaaatgcttctggcccaagcagaccatacattcctccaccaatccaacaacagcaacaaccccagaaacagccaacagttgaggcccctccacaaccttccctcgaagaacttgtgaggcaaatgactatgcagaacatgcagtttcagcaagagaccagagcctccattcagagcttaaccaataagatgggacaattagctacccaattgaatcaacaacagtcccagaattctgacaagctgccttctcaagctgtccaaaatcccaaaaatgtcagtgtcatttcattgaggtcgggaaagcagtgtcaaggacctcaacctgtagcaccttcctcatctgcaaatgaacctgccaaacttcactctattccagaaaaaagaagcagcacatccctcctcttccgttccctccaagagcagtttccaacaaaaaaatggaagaggcagagaaagagatcttggaaacatttagaaaagtag

SEQ ID NO: 51440 - DNA, 219 bp, Glycine max
  Peptide Sequence Number=SeqID_168218
atgaagtcagatgacatgcggggttacccaatacttacctgcaccatacgtcaaccaggggcaaacgagaccattgaggcgcggagactgacatcgtcttctacaccttttgtcgtcctggcccgtgaagtcagtcaggtgacatgcggggttaccttatggttacccgcacctttcgtcaaccaagggcaaacgattccattgacgtgcggagagtaa

SEQ ID NO: 51441 - DNA, 1151 bp, Glycine max
  Peptide Sequence Number=SeqID_168219
catctggccggacccggccaagctcaccgccctgtcgctgacgccgggcgacatcgtctcggccctgcgcagccacaacgcgcgcgtcaccatcggcgaactgggcaaccaggccgtgccgcaggacgcgccgctgaacgccagcatcgtggcgggggaatcgctgcacacgccggaacaattcgccaacattccgctgcgggcgcaaccggacggcgccacgctgcgcctgaaggacgtggcgcgggtggaactgggcggcaccgactacatgtacctgtcgcgcgtcaacggcatgacgggcaccggcctgggcatcaagctggcgccgggctcgaacgcggtcgagaccacccgccgcatccgcgaaaccatgcacgaactggcgcagtacttcccgccgggcgtgagctgggacatcccaacctgcgcgccacgctgatcccgacgctggtggtgccggtggcgctgctgggcaccctgggggtgatgctggggctgggctattcgatcaacgtgctgacgatgttcggcatggtgctggccatcggcatcctggtggacgacgccatcgtggtggtcgagaacgtcgagcgcatcatggccgaggaaggcctgtcgccgcatgacgccacggtcaaggccatgggccagatcagcggcgccatcgtcggcatcacggtggtgctggtgtcggtgttcgtgccgatggcgttcttcgacggcgcggtcggcaacatctatcgccagttcgccgtgacgctggcggtgtcgatcgccttctcggccttcctggcgctgtcgctgacgccggcgctgtgcgccagcctgttgaaaccgatcccggccggccaccacgagaagcgcggcttcttcggctggttcaatcgcgccttcgcgcgcctgaccacgcgctatacggcgcgcgtggccggcgtgctggcgcggccggtgcgcttcgggctggcctacgcgctggtgatcggcgtggcggcgctgctgttcgcgcggctgccgtcgtcgttcctgcccgacgaggaccagggcagcttcatggccatggtgatcctgccgcagggttcgccgcaggccgagaccatggccgtggtcaaggacgtcgagcgctacatgatggagcacgagccggtgca

SEQ ID NO: 51442 - DNA, 213 bp, Glycine max
  Peptide Sequence Number=SeqID_168220
atgcgccattacttcagaatacaccctaggccaaggccatcccttacaacccctcaattcaacaaaaacaagcaacaatttgaggataaatccctcacatttcttagcaaacacatgcaatttagagcaccaaaatacatcaatggaaagctagaaagcccaagaatgagaggtggctcgcccaggcgagcccagctcgcccaggcgagctaa

SEQ ID NO: 51443 - DNA, 291 bp, Glycine max
  Peptide Sequence Number=SeqID_168221
atgaccaagaatagggtgttgaaagagcataacaagactttcctaaattggttttaccctaactcgcctaggctagcatttggctcgcctgggccatggaattacctcctcgctaagcaaccagctcgcctgggcgagcttaaaccgtcccaaggtgactattttcctataaataggcatgatggggggtgttttaaagggttaggaggttcagcactgaagggaattgagagaattgagataaaagaagaagaaaaagaaaaagaagaaagaagaaagaagaggaaatga

SEQ ID NO: 51444 - DNA, 440 bp, Glycine max
  Peptide Sequence Number=SeqID_168222
gagtgaggggtctgctacctgctgaattgaagccgtatctgccactggttctaaaggctcagaagtggcctcaagatttctcagaagtggctatagcttcttgtgtttcaactgccctcttccttttgatcaggggctctggagtagaagtctcagatgattcatcctccatctgctatgagggaatagagtatggaggtagggtagaaggagctgctaaggtacgtgctggaggaggagctgcagatgtggaaggagcctcagctgaacttgcactcactctcctggcccctctaatagctgtcagaagcaacccctttggacctacatatagctgtgataagagcagggaacccaagttaagaggagttagactgggccatagatgtgatctggccagagatgagagctcctacattcatgtccagttgagagactag

SEQ ID NO: 51445 - DNA, 222 bp, Glycine max
  Peptide Sequence Number=SeqID_168223
atggggcctcatcaagaagagacagaactagtagacttaggaattgacagtgcaaaaagggaagtaaagataggcacgggtatgaccgcacccatccgtgaagaattaacagccctgctaaaagactaccaagacatctttgcttggtcataccaagatatgcccggtttgagttctgacattgtacaacaccgattacccctaaatcccgagtgttccccg

SEQ ID NO: 51446 - DNA, 213 bp, Glycine max
  Peptide Sequence Number=SeqID_168224
atgccattgaagggtaagcagttggcggtatacccctgcaaaacactttggagggccctcaatttcgcccccaatcacaacccttgcattctaaagcaggaaaggctcagcgccattgaaggaggcagagattatgcctttactgacgtagaagagttgttcctagtacccaaatgtggtcattgctttgaagttcaaattgccagactttga

SEQ ID NO: 51447 - DNA, 103 bp, Glycine max
  Peptide Sequence Number=SeqID_168225
tgggctttgggccttcgtaggcgcgctcagcgtgacaccccctcgctcagcgcgtgtagatcccgcgcttagcgcgcatgttgcaggcttagcgcgtgcttct

SEQ ID NO: 51448 - DNA, 207 bp, Glycine max
  Peptide Sequence Number=SeqID_168226
atgtctacgacgagtcttggcaaacgacgtcattcttatgctcttaattacgagcatgccaccgcctcaccttctaagacggttgtctacaaccgtcgtggaatctgcgacgtagaatgctgcttttgtagtagtgttccaatgggaattggagggcgtagagaatttcatgagggagttggatggggtggctttcatacatggtga

SEQ ID NO: 51449 - DNA, 474 bp, Glycine max
  Peptide Sequence Number=SeqID_168227
ggcatcattgttgatgactggaaatttgattattctagtcatgatgctcgtcgtatggcattacgggccaatgcacctctcccttaccctcaattggtcattctatttctccgtcattttcaaattccgcttgataatgaaccatttgttcaagtcaagcgttcctttgctattggtgctggtgcagtgacttcttttggataccataaggatcggaatggtcaatggctgaagaaagatgaacttcctcttcaagataagcatactccttctcctcctcttcagcgagatgattcagccctcatgactgattttctttccgagttacggggtcttcgttcttatgttggtcaacattttgactcgttggatactcgctttgccggaatggatatccgtatcccacagcttgaagaagatgtgggttacattcgtcagagtttcgatcttccaccaccacctccaccttcttag

SEQ ID NO: 51450 - DNA, 246 bp, Glycine max
  Peptide Sequence Number=SeqID_168228
atggggttccgaataagatttgatggtggaggatgcacgaacagtgctatgcaatcaattcgtggggcttcggactcagaagtggaggatgcaatcaattcgtggggctccggactcaatggtggaggatgcatgaacgaaaatcaattcatggggctccgaataagatttgatggtggaggatgcactaacagtgctatgcattcaattcgtggggcttcggactcagaggtggtggatgtatga

SEQ ID NO: 51451 - DNA, 378 bp, Glycine max
  Peptide Sequence Number=SeqID_168229
ttcgtctttgtcgcaaactggcctgcacttccgtcactgcaaccacattgtggagttcgtgtttgtggagttcgtctctgccacttatcgattgagggcgttcttcttctttctccttctgccctaagttcgtctttgtcgcaaactgggctgcgcttccgtgactgcaaccacattgtggagttggtctttgtggagttcgtgtctgccacttatcgattgagggtgggaagcgattttggaagtccattgtggttggttttaagactcccagggaagccatcgaagtcgctgtcaaggttcattgttgcttgtgttctgtgtgctgctaagtcatcagtgctgattaggaatatctccgccactgacgacaattga

SEQ ID NO: 51452 - DNA, 1389 bp, Glycine max
  Peptide Sequence Number=SeqID_168230
atggctacagatgagcaggttcacaaagtttccctgaaagttttggtgaacaaagagcaaaacaaagttctatttgcggaggcagggaaggattttgtggacgctttgttgagtatcttaacattgcctttggggactattgctagactcgtggctaaggagtcaaacattccaccagtgaaatttggcagcctcagctcattgtatgaaagtgtgtctcatcttgaagataagtatctacggacacaaaagtgcaaagaaatgctactgcagccaaggaactctatggaatcttattgccagcacgtgaaactgaacatcgatgacaccgaacccacaaagtactttctttgtgcagaccggacttgtagtattgtaaatgggagacaattgtccattttaagatataaaagatgccgttgtggaaagcaaatgcaaaaagaagtatctggaagagaagcgattctagaaaatggttttgttaatgaaaccgcaacttttataatttgtgacgatctttctgtgttgcccaatgttcttggaacaagtgtaagtcttcttaggaagcttggaatcaaagacatggttaccattgacgaacgaaatgtagatatcagtaagagggaggttgttgatatccttaagttgtctttgctatcaaagacacctttaacagattttatcctggtgaagaaagatgataatttcaacccaataaaccaaccccaaattgggataggagagaaatcatctgatgaaggtagaaagatggatgtgaaagtaatggtaagaaaatcagatagcaaaattctgtttgtagaagcagaggcagattttgctgacttacttttcagtttgctcactttacctctgggtggagtgttgcacatgcttaatggatgctcttccttagacagcatagataaattgtataacagcacttttgaattaaatacagacagatattttaggccacaggaactcaaagacaaactagctaatccccagtgtgctccacaattcaacttacacaaccagatattaccaattggcgccgtgcgcttgccagatattaccaacagtatgcaatttgagattgttgatccagagtcatctattgggggttcatctagcaatggaggatttgccaaagcacaatcgatgtttatggtgacagatgacttggttatgacaccaatgtcgtccatttctggtatttcatttctaaatagatcaaaagtctccctgcttgacctggaggaaagggtcgttaacattggtgtgaaggaggcactagctatcttgaaagcttccttgacctcaacatctgctttgacaaacggtctcaagcaattcatcaaaaaagcatcaattaagagggagatttga

SEQ ID NO: 51453 - DNA, 411 bp, Glycine max
  Peptide Sequence Number=SeqID_168231
atggttgattccacgcgttctaaatctcatttagatcgtctagaagaggccattgccaagttgactatgaatcatctctcgctaacagctactccaaactccatgactcttaagctcgttgagcttttgcagaaaatggtgactcttgaatctcatccttcatctctgacatcatcaatggatcctccttcgctccaccctcctcagttgaaattggaaccgaaacatcttacatctgccttcttctacatggacgggccaacgttggcgtggttccagtggatgtcgtgtaatggccaattggtgtcatggccaacattcactactaaaaaaaaggctttctacatcgatcaattaacatcgcttattgcgaaaaccgatgttaatgaaagcacggtggcatttttgtaa

SEQ ID NO: 51454 - DNA, 282 bp, Glycine max
  Peptide Sequence Number=SeqID_168232
atgtacatggtgacagatgacttggttttgactccaaaatcacccatttctgctgtttcttatctaaatacatcacaagtccccctctccgacttggggcaaagagtcatcaacattgggtctaagtataccgaaggcttcattaatctcaacaatggtctaaagcaattcgtaatgcctgtcaagatagatcgcaaagggaaatttgttgagggttcacgaaggcttggtgttgagaggtcaatgtccatggaaaaaaggtggaaagaatatggtcattaa

SEQ ID NO: 51455 - DNA, 795 bp, Glycine max
  Peptide Sequence Number=SeqID_168233
atgctactgcggcctaggaactggatggaagcttgttgtcaaaaattgaaacttaacatagatgacacagaacctatgaagtactttatttgtgacagctgggattgtgttagaaaagaaagaggtaaccttttaagcacttttaagaataaaaaatgccattgtggaaagcctatggacagagagatttctctagaagaaaggacttcagaaaatggctttgtgaaagaaactgcatcgtttataatctgtgacgatcttcgtgtgatgccaaattctcttggtacaagtgtggatctgtttcatgagcttggagccaaaaacatggaggctattgaggaaagaactgtagaaatcggcaacaaggagttactggatctactcaagtgttcattcctttcaaagacccctctaacggactttatcttaaacaagaaacaatttctttatgtatacacaaaacatcaatgtcagtttgagattggagaggtttcatctaatgtgattaggcagatggttctaaaagtgttgataaggaaatcagataggaagattctgtttgttgaaggacaagaagattttgcagacttcatatttggttttcttaccttgcccttgggaggtgttctgcacatgcttggaggaccagcaatgtacatggtgacggatgacttggttgtaactccaatattatccatttctggtgtttcatatctaaatagatcaaaagtgcgtctttctgacttggagcaaagggtcatcaacattggtctgaaagagatctccagattttag

SEQ ID NO: 51456 - DNA, 213 bp, Glycine max
  Peptide Sequence Number=SeqID_168234
atgtctttactacaaagtatgagcattcccgttagtgacctggcagagaaagtggttagcattggcatcaaggagggtgtccgcatgctacgagcatctttgacctctacatcagccctaacaattggtctcaatcacttgttgaccaaagctaaggaggagaactgtaattacaaatattattctgtttttaggatacatcgtgggcaatag

SEQ ID NO: 51457 - DNA, 396 bp, Glycine max
  Peptide Sequence Number=SeqID_168235
atgtgttgtccaaaagtgatagcggcgtctctaggggtttcccaagattcctcaagatttttctttgttgctctgctagggtttccaagcattagagacaaggagaaaggattagatcttccatttcacggtctccatgaaaaggacatttctttcatcacagatcccaatggtgggggtgtttgggtgaatgcgagaaaaagagagtttcgtgcaagagacatttcactcactccaaacattattttgaaaatatcaacggtgagaatgtgcaaaaataagttccaaaccgattgctcaaatttcacaaccgtccaaaggaaaaaagagagttttgggaaagggagaagggaaaatgaatatgagagaaagagaaagtgtggagatatatcataa

SEQ ID NO: 51458 - DNA, 258 bp, Glycine max
  Peptide Sequence Number=SeqID_168236
atggcgaggtttgacatgagtgagtacatggagaaccacacagtttcaaagcttattggagcactaccaataggctatattggttatgagaatggtggccagctaactgaagttgttctttgtcgcccgccttctttatttctctttgacgaggttgaaaaggctcatgaagatgttttcaaatccaatgatatacagagtaagataccacaagtggaaatgacaagcagacccaagaggaaaaatatctacaccaaa

SEQ ID NO: 51459 - DNA, 600 bp, Glycine max
  Peptide Sequence Number=SeqID_168237
atgactcacagtgtacattcctactttgggagttgctacgtgcactcagcattattgctggggcacccagcaaacagtgaagtggcgaaactgtccttcagcaattcttcttccggaagaagattttttccggaaactttccggaaaatctctttctggaagaaccttcttccggaagaagaatttgtgatttccggaagtacccagaaactacttccggaagaacgtcatccggaatgtttccggaagaaggttcttccggaaacttccggaagaaggttcttccggagtttccattggtggtcccgtgaagtatttgaagatttggtggtcccgtgttccgtatttgaagttttgttagtggttgttcttcctatttcgtcggagagaagaaaagcagtaaaaactatatccggaagaaattttaggcacagtaggaggaaggtccggaatgaccacttccagaagaccttcttccggaagttactaaggcctattccggaagaagtgcttccggaaaacacttccggaagaccttcttccggaatgggtcttagtaacttccggaaaattattagcattttttttatttctgtttga

SEQ ID NO: 51460 - DNA, 308 bp, Glycine max
  Peptide Sequence Number=SeqID_168238
ccaacaaggatcatcccgatgtaggatcaatttgcgtcattctttcaaggtttcattcgtgtctttgtggacgtgaaagcggacggtggttacatgagtacatgaacctcttcgatggcacagagagatttgaacaattaaagttgtccctacttgttgatggcttttcaaaggtttggttcattcaggttcgcgcggccaagagaagtcctgttaacaacattttcaaacaaagtgtgaagtgtaaccaatgtccgttggtcacaaaagatttctaccccagatacataaagaattatgtcccatga

SEQ ID NO: 51461 - DNA, 138 bp, Glycine max
  Peptide Sequence Number=SeqID_168239
atggctgatgttaacactgagcagcaggtcaccttgaaactagtgggtgtccgcatactacaagcatctttgacctctacatcggctctaacaattggtctcagctacttattaaccaaagttaaggaggggaactaa

SEQ ID NO: 51462 - DNA, 598 bp, Glycine max
  Peptide Sequence Number=SeqID_168240
ttcttccggaaagttcttccggaaatttgaaagttcttccggaagagcgtgtcttccggaattcttccggaagaaccacttcttccggaaagtttccggaaaaggttttccgggagtcttccggaagacgtttggttacttccggaagaacacttcttccggaaactttccagaaaatgttcttccggaacttccggaagaacccctaacgggtcttccggaagactccaccgtcagccttttccgccattttttccggcgtactctcgtcttctcccctctcgtcttctaccctaaggttactatcctaaggttccattgctatgctaatagtgctgcacattacaagcaaagggtaaggggaaggggaactaacctgttcgcggagaagaagaagaaagccttggcgcgcctcgcggaaaagaagcttcacggagaagagaagaagaagcaggttccgggagagaagaagaagcaggttccgggagagaagaagaagctgtttgaaacagtgtcttccggaaattacattcgcactttttataattttattttaaagggcaaaatgcatgtaaagaggccggaagtgtctctgtaa

SEQ ID NO: 51463 - DNA, 372 bp, Glycine max
  Peptide Sequence Number=SeqID_168241
atggctcaaaccactgatgcagctgcttctctattagcccttggcgtgcttgatattgatttcaatatagacgataaaaacataacaatcaagatagatgagagcaacaacaacccatattactttgcttttgtcatttggtatcaacaaggaaggagagacataattgttgtgcagctctgtgagactcaaaactttgtgtgcaagttcctggatagaagccatggggcagtgtggactactacctctccaccgagtggacccttgtctttaaggatgttgtttagtgatgaagaagagggagaagaaacatgggttgttcctattaataacatacccggagactggaaggctggtgaaacatacgattag

SEQ ID NO: 51464 - DNA, 232 bp, Glycine max
  Peptide Sequence Number=SeqID_168242
cacctcacaaggaccaaagaaaggtcgcatgtcatcaagcaaaggtccccggacgaaattagggtatgacagtgtccaagcagaggacacaatgggagttaggggcagtggtaacggaggggcaaaagcgaagggggtggaaggcgccactgaggaggaagaggtcgaggaagaggaagaagagaaaggtaaacaaaagcatgatgatgggcttgaggaagagggaaaggag

SEQ ID NO: 51465 - DNA, 664 bp, Glycine max
  Peptide Sequence Number=SeqID_168243
tgcttcggtgtttgccggccccggcgcgggtatcgccctgagcggcctgctcgcggtctatattcaggcgaaatccctttcggccggtgcggcgtggcagatctacggcgtgctggcgctcgtgttgattgcgctggtggcacgctatctgccgcgtgcgggtcagcttcatcgcccggggactgcgcctgagtcgctgcggctgaccgcggatttaaagcgcctgtttgtctggccgatttttggtctcgccgctgtggtggggattgcgctcagcattgccttgcgacatatctccacggctaaccgcaggctggctatcgtgctgtggcttcagagcgcgggtgtcctggcggcatggctgctgccgggcatcggcggtttgctgacgggcgggctgctggtaggtggcgggttcctttgcgccgtgcaactctctcttttatacggccgagagctggcaccgaaccacacgcgttatatggcgggactgctcaccaccgggtatgcgattgggcagttgattggccccgtcacttcggcgttatcaacctggcttacccaccggctggagccggcgctggggctggcgggcgtggcgctgttcgttggaggagccctggtctggaatcgtcacgctgaaaggcaacagcaattgcaataa

SEQ ID NO: 51466 - DNA, 549 bp, Glycine max
  Peptide Sequence Number=SeqID_168244
gatatcctctttcatccatttggataccctggacgtgtccgtgctgctggagccggtgtcaccatcaagcaatactttggatcagctccacggacgaaccagctagaggagtccattacagagaaagtgacgaggcaggtcatggcatccttcagccacatgcaatcccagcttcagtcgcagatgcaatcgcagggacttgcagtgcctcctgagcctctggttggtccctccggtcctccagtgagcacaaaggggagtggtgttgatccctcaggaaacgatcttgagaccggtgactctgacaggtgcggcttgtacatagaagcagatcctgcccgcctggttgccatggggagagtttatgagggatccactgttgttcataacactcctttgttgtctggccaagtaaaggtgagtgtggaggaggttagagatgcagatgctccaattcctgtacccactgatgaggtttccttagtggggcaggcacttcacaccttccttgcttggccgacacatctggtcaagtctttatcacagcag

SEQ ID NO: 51467 - DNA, 1018 bp, Glycine max
  Peptide Sequence Number=SeqID_168245
atggattcttcgttgatagaatggaaagaattaggggaagagggatccccggacaatgaaaacgaatgggaagatcgaaaagttggaagaagaaagaattttttggttcgacgcatagaattagctaagcattttctccgaacaaatatagaaccagaatggatggttttatgtcttttaccagttcttcctcccgaattgagaccgattattcaaatcgatgggggtaaactaatgagctctgatattaatgaactatatagaagagttatctatcggaataatactcttatcgatttattaacaacaagtagatctactccaggagaattagtaatgtgtcaggagaaattggtacaagaagccgtggatacacttcttgataatggaatccgcggacaaccgatgagggacggtcataataaggtttacaaatcattttctgatataattgagggcaaagagggaagatttcgcgagactctacttgggaaacgggttgattattcgggtcgttctgtcattgttgtaggtccatcactttcattacatagatgtggattgccccgcgaaatagcaatagaacttttccagacatttctaattcgtggtctaattcgaaaacattttgcttcgaacataggaattgctaagagtaaaattcgggaaaaagaaccgattgtatgggaaatacttcaagaagttatgcagggacatcccgtattgctgaatagagcgccgactctgcatagattaggtatacaggcattccaacccattttagtagaggggcgtgctatttgtttgcatccattagtttgtaagggattcaatgcagactttgatggggatcaaatggctgttcatgtgcctttatctttagaagctcaagcagaagctcgtttacttatgttttctcatacgaacctcctgtctccggctattggggatcctatttccgtaccaactcaagatatgcttattggactttacatattaacgagcgggaatcgtcgag

SEQ ID NO: 51468 - DNA, 549 bp, Glycine max
  Peptide Sequence Number=SeqID_168246
atggcagaggtctccacggaggccattgcctccctcgcccaatattacgaccggcctttgaggaagcaggttgaaaatggggtggttagggtaccaaggaaatgtttggaagcaaaggcgagagtctgggcaagtcaagatgaatgggccccgttcatggacatgctggcacttttgatcttcggggtggtcctctttccaaatgtggatgggttggtggaccgggcagcgattgatgcttttcttgccttttacgactgcaaggaaagcccggttgtcgctatcttagccgatctatatgacacattcaaccgaagatgtgagaagaacaatgcaaggatcgttttctgtacaccgtctccctacgtatggttggcttcgcacttcttttgccaagagatgagacacgtttgcccgctagaaggccaccgctcatgcaccgagaaaaaagaggcaaactgggaccgactcttagcaagcaaagaaggagcgtctgtcaattggttcccccgatggaaagaaggaagaaccgggattcttatttcgtga

SEQ ID NO: 51469 - DNA, 222 bp, Glycine max
  Peptide Sequence Number=SeqID_168247
atgtcaaatgaagaattgaagttgcaggatccacgatgtcggatacaatgtcctgacatcctgcccgaaaatactggagttgctgcacaatgcataagtcaagataaaatattttcaggaagaatgatagatctcctccagcacaagccgttgcagcccagaaacgcacattgctatataaacatggaggctgcacgagttctgtaccaagtccgggattga

SEQ ID NO: 51470 - DNA, 129 bp, Glycine max
  Peptide Sequence Number=SeqID_168248
atggaagggatgggttcggcagaggtagttgctgatggatggttgtgtggagaggaaacaacgggaagagttaattgctttacaatggctgcaatagcaaccgaggaacaaattcatgagtttcagtaa

SEQ ID NO: 51471 - DNA, 522 bp, Glycine max
  Peptide Sequence Number=SeqID_168249
atgaagcgcacccagcacagtcccacctttttgccttcttgtttttcttctcttccttcttcctccgtgcgcgtctcttccctctggctgccattttcattcgtcttcgaagctttttctggtgccgttgctgcgtttctgcctcaaggagaagctggatttagggtagaagacgaagtgaactctagggatgaacatgatgcaattgatgttccccaaaggcgtaggcctactacatcagcccgtaggcaacaggtacatattgcggttgatgagggtgttcctcaagtgactgaggatgttcctcatatggcggaggatgttcctcagatgactgaggatgtccctcatatggctgacgatgttctgcagatgagtgaagatacgcctcagatgactgcggacgtagatgcgactgttgcagaggacttagatcgtgatggtgctgaggggtcacatgctgatgagggattccctggtggggctcgtgacccatcagttctgacttcatttgcggagcat

SEQ ID NO: 51472 - DNA, 519 bp, Glycine max
  Peptide Sequence Number=SeqID_168250
atggtgatcatagttcgaccggagagggtgctacgccagtttggttacattcaaagcatccctctatcgcctgttagcgcttcattgtcatatgatgatatagatgacaggtggatgcatttctcggaccacgtagtagctatgggtgagctttgtgtagtgcctgggcaggtatctacggattacatgaagtggtttttccagatatctcacccattcatgataccgacccaggcaggtgaccagcccagacatacacctgccccataccataaggactacatgcagccagacatcccacaggttccagtggcattggacccccctcgacttgcagtagtgatcgcaaaaaagttggagcgtgtgctcaaccttaggatggtcactgtaaggacagaattacatgatatcatgcaagattgcctgaagatcgccaggggggtgccagcgcagatggaagtgttagggcccgacaaagatggcgcacagagcattgatgatgtttttaatgctttgtag

SEQ ID NO: 51473 - DNA, 1167 bp, Glycine max
  Peptide Sequence Number=SeqID_168251
atgatttatacttcaattcaggagtgtcctgagctgaagttggtgtcgcacgggaggaaggtggcattaattgggaggccaatgcctaagattgaagggctggttgtcgccacaggattaagtccattgatcgggtgttcagttgtaaccggcgatcctggacttatattcgcatttgtggagaggtggcacagggagaccagcaccatccaccttccagtaggaaagttgacgatcacactagatgatgtgtcgtcactccttcatctccctatcagtggcaccttccacagcttcgaggctctttccgtggacgaggcggtatttttgttgatggagttgcttgaggtgtccggtgaagaggctagagccgagaaaatacgagcgcgcggggcatatgtacacctctcatgggttcgggagatctatgaggcttttcgtgacctgggtcagagtgggggctatgcctggggagctgcggccttggttcatatgtatgaccagttagatgaagcttctaggaccacgacacggcagattggggggtaccttactttattacagtgctggatttatgagcactttccgagtgtgcatcagtgcgtcaccgatgatgcgtacaaggagacgtcccctcgtgcctctcggtggctgatgacaaaggctcatatgaagggaattacaggagcatcgcaccgggcatgttgtgatgctttgacggtcactgacgtgtgctggttgccttacagtgaccatcgaggggttagggggtttgagctgatttcatcgttccagggtcagctgagatggggtcctatggtgatcatagttcgaccggagagggtgctacgccagtttggttacattcaaagcatccctctatcgcctgttagcgcttcattgtcatatgatgatatagatgacaggtggatgcatttctcggaccacgtagtagctatgggtgagctttgtgtagtgcctgggcaggtatctacggattacatgaagtggtttttccagatatctcacccattcatgataccgacccaggcaggtgaccagcccagacatacacctgccccataccataaggactacatgcagccagacatcccacaggttccagtggcattggacccccctcgacttgcagtagctatgaggtga

SEQ ID NO: 51474 - DNA, 1389 bp, Glycine max
  Peptide Sequence Number=SeqID_168252
atggctacagatgagcaggttcacaaagttttcctgaaagttttggtggacaatgagaaaaaaaaagttctctttgctgaggctgagaaggattttgtggacgctttgatgagtatcttaacattgcctttggggactattgctagactcgtggctaaggagtcaaacattccaccagtgaaatttggcagcctcagctcattgtatgaaagtgtgtctcatcttgaagataagtatctacggacgcaaacgtgcaaagaaatgctactgcagccaaggaactctatggaatcttattgccagcagatgaaactgaacatcgacgacactgaacccacaaagtactttctttgcgaaacagtgaagtgtaatcttgatggtcggagacaattgtccattttcagaaatcaaagatgccgttgtggaaatctaatgaacaaagaagtatcaccaaaaggagtgattctagaaaatggttttgttaatgaatccgaaacttttataatttgtgacgatctttctgtgttgcctaatgttcttggaacaagtgtaagtcttcttgggaagcatggaatcaaagacttggctaccattgacgaacgaaatgtaggtatcagtaagaaggaggttgttgatatccttaagttgtctttgctatcaaacacaaccttaacagattttatcctagagaagaaagatgataatttcaacccaatataccaccccgagattgggataggagagaaatcatctgatgaaggtagaaagatggatgtgaaagtaatggtaagaaaatcagatagcaaaattctgtttgctgaagcagaggcagattttgccgacttacttttcagtttgctcactttacctctgggtggagtgttgcacatgcttaatggatgctcttccttagactgcatagataaattgtataacagcacttttgaattaaatacagacagatattttaggtcacaggaactcaaagacaaactagctaatccccagtgtgctccacaattcaacttacacaaccagatattaccaattggcgccgtgcgcttgccagatattaccaacagtatgcaatttgagattgttgatccagagtcatctattgggggttcatctagcaatggaggatttgccaaagcacaatcgatgtttatggtgacagatgacttggttatgacaccaatgtcgtccatttctggtatttcatttctaaatagatcaaaagtctccctgcttgacctggaggaaagggtcgttaacattggtgtgaaggaggcactagctatcttgaaagcttccttgacctcaacatctgctttgacaaacggtctcaagcaattcaccaaaaaagcatcaattaagaaggagatttga

SEQ ID NO: 51475 - DNA, 1062 bp, Glycine max
  Peptide Sequence Number=SeqID_168253
atggctacagatgagcaggtacacaaagtttccctaaaagttttggtggacaaagagaaaaacaaagttatatttgcggaagcagggaaggattttgtggacgctttgttgagtatcttaacattgcctttggggactattgctagactcgtggctaaggagtcaaacattccaccagtgaaatttggcagcctcagctcattgtatgaaagtgtgtctcatcttgaagataagtatctacggacacaaacgtgcaaagaaatgctactgcagccaaggaactctatggaatcttattgcaagcacgtgaaactgaacatcgatgacaccgaacccacaaagtactttctttgtgcaaacctgaattgtagtattgtaagtgggagacaattgtccattttcagatatcaaagatgccgttgtggaaatctaatgaacagagaagtatttccaatagaagtgattccaggaaatggttttgttaatgaaatcgcaacttttataatttgtgacgatctttctgtgttgcccaatgttgttggaacaagtgtaagtcttcttaggaagcttggaatcaaagacatggctaccattgacgaacgaaatgtagatatcagtaagagggaggttgttgatatccttaagttgtctttgctatcaaagacacccttaacagattttatcctagagaagaaagatgataatttcaacccaataaaccaaccccagattgggataggagagaaatcatcttatgaaagtagaaagatggatgtgaaagtactggaactcaaagacaaactagctaatccccagtgtgctccacaattcaacttacacgaccagatattaccaattggcgccgtgtgcttgccattgtattattatgtaaccgttgagtcgtatcaaaagtctccccgcttgacctggaggaaagggttgttaaaaattggtgtgaaggaggcactagctatcttgaaagcttccttgacctcaacatctgctttgacaaacggtctcaagcaattcatcaaaaaagcatcaattaagagggagatttga

SEQ ID NO: 51476 - DNA, 371 bp, Glycine max
  Peptide Sequence Number=SeqID_168254
attcagaggttcccatagaaaaacaaaactgtcacaagcgaaggagatccgagtatggagggagttcaagcgctgttgggatcaacaatcaaggcaacgttctggaaaatctttttgttggcattgggactattgctgtgaattttgaaaaaatatccaacatgatggagaaaagagaaaaagatagagatagagatagagagctcgagggtattatttgggatgttataaaagaaattccaaatttggatgacataacgcgtttcaagacagctgaattgttaaatactaaagcaaaaaaggattttttcttgaagatgtcaccggaagaacgctcatcttggataaactttaagttagggaataattaa

SEQ ID NO: 51477 - DNA, 690 bp, Glycine max
  Peptide Sequence Number=SeqID_168255
atgtgcggaagccagttgaacatagtagtgatgcaaagcttgcagaatccagtggaagtgccgtgggaggctcaccaatttggacttcctgagattggggcaaaattttacatcacacatgcagatctagcagaaataatatcaggtgacaagtgtttaaacatagcgatactacaattgtggaccatatttatgaatgagtgcggtagaagcaaagctgatcagtcactatatggcttgctggagcctcaatctatacaaaatgctaaggaaagacgtcaacaatgccaacaatacattgaaacatgggtcaaggaatcacaaaggcagttgtatttaggagcttacttgcatcaggcacattggcaactatttgttctccacccaagggaaaacacggtcgtttggttttgttctctgaggaagaagcctgatattaacatcaaaggcgcaattaacagtgcaatgaagacaataaccagttcttttgaaggcatgtctaatcaaggtgcacctcggtgggttgaacccaagagtaatgtgcaaagtggagggtttgagtgcggatattatgtcatgcacttgatgtggtgcatcgtgactgccggtttgaaggatgactggcacaagtggttttctgatggctcatcgttagacgtggaggccatcacaacagttcgacagaaatga

SEQ ID NO: 51478 - DNA, 312 bp, Glycine max
  Peptide Sequence Number=SeqID_168256
atgctgacaacttgcatgactttgattcaaagaaatttgcgattaggtcgtgccttagggcacgatactggcagagacgatgagccagtggtctctacgacagaggttgttggagcttcggttgaggctgccgtatatgcggatgagtcgatggcaggaggtgatgtacatgacattggggcagacactcctgcagacacaggcgcacaggctgctgaggatgagcctaagggatttccgggtggtccgagggacccatctgtgctaaccaagtatgcgaatcacgttgcaggcagtgtatggatgggagag

SEQ ID NO: 51479 - DNA, 849 bp, Glycine max
  Peptide Sequence Number=SeqID_168257
atggtgttaaaggataagttaaaggcctgtcaaagggcgaagaggagtttgacggaacaactgagcaaaatggaagagaatatgttgacaattattgatcaatataaggaaaaggtgaacctagctgctagtcatgggttgttagccagagccaaggcaatggttgacaagtacttggctctcaatgaagttcatggtctttccgattactgccaacacatgcacccttaccgaacacgtgccaaagctaaaatcatgagtgaaatagaggaggtgcaagagcagatgaaggccgatatagaggccatgaaggaccaaatgacaaccatgatgagcatgagaagaatgatgaaggtcaacacggctgcagttgccactactagcgctgccgctgaggtagatccgactcacccatctggcgtgaatcaaatgagtcatccagtcccagacgtggtaggtcagggaggagaagcattgggaagtacagacggaccccatgttgtgcaaagcaagaattctttcccaccatatggcttgcctcccaactatgcaccacccaatgttgtacatgtgcccaacgagaacgtcgaccattccgctcctgttccccttgaaagccagcaaccccagttggggcatgcacattttgctcagcccattgagggggggggggggtatgtgaagaaccccgagaccatgctctggtcgacttcgagccttaccccagatatgccactgaggggccagcatttggtggcatgccctagcctaacaccatcgcccgctgcaacccttacatttctcggtgggaagactgcttctggccatggaggaaagagagaaatttga

SEQ ID NO: 51480 - DNA, 342 bp, Glycine max
  Peptide Sequence Number=SeqID_168258
atgaagttgaaacataccattgcgatgaatacatggaagtggcatggcccatattcaccaaggaagaattggaatcaggctgaggattttgggcattctgatgtatgtgttggggatctggcaattattgagcataaccactgcctgtatttgccatggtggaataagcatcaggttgcaagtttaggatattcgggtgtgtatagtgagtacctcatgacaactggggttgactgctgcctgcatttgccactggggtataaaactcgtgtaatgggtttgggatactttgatgtggatattgaggaccttacactgattgagtatgactgctacccatag

SEQ ID NO: 51481 - DNA, 1473 bp, Glycine max
  Peptide Sequence Number=SeqID_168259
atggtgtctctaacttcatctttcaacattcaattgctgcacgagactcgcttcttctcccctttcttcctcccaccaaggcataggagcgtccaattccaccacacacgacgcaacttcgttaactacaaacggaaaacggcacggtgcggcgtcaccagcgccgacgcgtctactccgctgtcaacgtcgttggcgaaggaacctcacaaatacttcgaccacgtcatcatcaccgttcgttccggcgacggaggccacggcgcggtgctgaatcagcagcagcaggagcaggagcagcaaggaaaaacgaagttgaagaaagggaaaggctccttgaagagggatttcgacgggtccctcattctccccatgggtggccacggtggtgacgtgttgctctacgctgacgagtccaaagacacgttgctcgagtttcacaacaaaagccgctaccacgctaagcgcggtggcaacgttgacgccatgggcgttttgacttcgatgcttcgcgatggacttgctgcaccgactctgcgcattcctgttcctgtaggtacagttgtgaaaagcaaacgagggaagatgttggctgatctagcacaaccttgggatgaagttcttgttgcgaggggaggacaaggagggattagcttgttagaaattccacagcataaaaggaaaaagatgatggctcttacaactaatgtgatgagagatgaatcagacaaggttttaattcacggtcaacctggggaggaagttaagttggagttgatcctacgagttgttgctgacattggtctgattggacttccaaatgctgggaaatcaacacttctggcagccattacacttgcaaaacccgacattgctgattatccttttacaacattaatgccaaatcttggacggcttggtggtgatcccagcttgggggcaggaatgtattcatctgaagctacattggcagatttgcctggtcttatagaaggtgctcacttaggaaagggtcttggtcgcaattttttgaggcacctcaggaggacccggctattggtccatgttgtggatgctgccactgagaatcctataaatgactacagaactgtcagagaagagttacgcatgtataatcctgagtaccttgaacgaccatacgttataattttgaataagattgacctaccagaggcaaaggacaaacttcaatcattgactcaagaaattatgagaattggcaacaatggtgctgcttccgaaccaaaaccatgctctgaagttctagatccattgtctgatgaaactgacaggaaggaaaaaagacttgaggactatccacgacctctctctgttgttggagttagtgttctaaagggtatcagaattaatgagatgttaaaggagataaggtcggctttaaggaagtgctcagattccaaagaagcattggctttcggtgtgccaccttga

SEQ ID NO: 51482 - DNA, 852 bp, Glycine max
  Peptide Sequence Number=SeqID_168260
atgggaattcaggagagaaagaaggtgaagaaacctgcacaagccagttccagaaaggggtgtatgagaggcaaaggtggccctgagaatgctaaatgcacctacaaaggtgtgaggcaaagaacctggggaaaatgggttgctgaaatccgtgaaccaaatcgtggtgcaaggctctggcttggaacctttgacaccgctcgtgaggctgctttggcctatgatgctgcagccagaaagctttatggacctgatgcaaaactcaacctcgcagaactctctgtgcctgctcctgctcttgctgcagtgaatccttctcacatgcaacaacaacctcaggttgttcccgaaatgctgatacaacagcagcagcctcttgttcaccctacctttgaccttgtcaatgtcacttctcatccttccggtttcaacaacatcctcaacaacaaccctgtggtggtctcttccatggcttcttcttttcttgcagatgcagcagtgccagtgtacaccagctgcgactctattctctctcttccgtctgcaacaaccaactacaccaacaccaacaccgttccaatggaaatggaaaattactcctcctccatccctactgtggagagcaacggggacaacatgtttcgttccttctgggggccaacaatggacgacaccatgcctgtgtttgatcaatcgatttggaccgaagctgctatgtctcttgatcttcctattattgcagataatggattttatggaagaggagtcggcggaaacaaaggaggcggaaacttcttccttgacgaagttgctgcttgggactccctccatactccttcttgctgcatgtaa

SEQ ID NO: 51483 - DNA, 219 bp, Glycine max
  Peptide Sequence Number=SeqID_168261
atgtggtatgtattggccttacctttcaagaatccaagattgaagtggatcttcacctgccagtgccaagagccagccagtgaccttgagttgttgaaggatgtgataagcaacacaaatgggaaaacaccaaatagtgaggtgtacaatggaacattgaaggttgggtatgagattgttgtgatttctctctgcatcaaggaggagcattggacatga

SEQ ID NO: 51484 - DNA, 426 bp, Glycine max
  Peptide Sequence Number=SeqID_168262
atggcttcaatggcatcttcaagctccttctgcaacctcaagtttatcaccaaacccaacaatggtagaagaagctctcttcgccgtattgtattttgtcagaagcatcacgatgacacacccaccgaccaaatcaaccgaagagaactcatattgagaagcagcgaaatagcgaccattggtgccatcttcaacttcggtgggaaaaaacctgattatcttggagtgcagaaaaacccaccagcattagctctgtgtccgccaactaagaactgcgtgtcaacctctgagaatatcagcgatcgcacacattatgctcctccatggaactataatcctgaaggaaggaaaaaacctgtgagcagagaggaagcaatggaggaactgatagacgtggtaataaatctagctgaactgaaatcttga

SEQ ID NO: 51485 - DNA, 391 bp, Glycine max
  Peptide Sequence Number=SeqID_168263
atgactgagaagcatacaatcctagcagaagtagtaatgaaaactttgaaagagaacaaaatggactattgttataagagtcgaagaaagaagagtagagtgaaattgaggaggggatggatagtaagagaagaagaagaagaaacgtacaatttgttcgtattggcgaggatcaacgtccatgggagggatactgaggaaagggacgaaacacgaaagcgagaaagaagaagaagaaagggtattgttattagttgttattactacaagtcacgtgtgcgtatatgtatgtttctggagtcgaggagtctaagctcaactgcagaaagaaagggtaccaatggaatggaaatatggaactcgagatgccgcagcgcaccctcaacctcaa

SEQ ID NO: 51486 - DNA, 189 bp, Glycine max
  Peptide Sequence Number=SeqID_168264
atggtctctgtcaaatctatcaaaaatgagaagttttttaaagatatggagaatgtgaacaagaaatttaatgaggctttgaagaatctagcagagagcaaaaagattatcactattttgaacgaccaactcatggtcaaagaggagaaggggggagttagtaaaggattcttagatggaatcatttga

SEQ ID NO: 51487 - DNA, 263 bp, Glycine max
  Peptide Sequence Number=SeqID_168265
gaattcgatcagtgtaccaagattggcatgcgaatggaagatgccgtacgaaaaagatagagcagatgctccttgcaaatgccgatctgtttgcttgcaatgccttcgatatgttgggcattgatctgaatttcattttccataagctcactatttttcttgaagctaagccggcggcccagagaaaatgtaaaattgaagaagaaatggggaagttcatggaagcagaaattgaaaaattgttgaaggccaacttcatctga

SEQ ID NO: 51488 - DNA, 1017 bp, Glycine max
  Peptide Sequence Number=SeqID_168266
atggttaattcatcctctctcaacctatacactgatgaccttgttgagatctttattgaactcaaaaagcataacacgagggttaccctgagaaatgcaccttcggggtttgaggagatggaagagaaaccaaaaccattcttcaaattgttgaaaaattcacaagatgagtttgattggaatgaagagtgtgaagagatgtttacaaaattcaagaatttcttggcaactcctcccatcctaacccgacctacgctgtcagagtttggcttaaaatttgagccccgtgggcctatcaaagcccaatgcttgaccgatttcattgtagaactccctccctctctcgaacctaacaacaatgatggtggaaactggtggatgctctatgtggatggttcatgcaatcccatgggtagtggagtaggaatcacactcgaagggccaggagacatctctcataaaaagtcattgaggtttgactttaaaacctttaacaatcaagtagaatgcgaggctttgatcgcagtccttaaattggcaaaggagctcgtcaccggtcgggtgaatggagaattccaagccaaggatgcacatatgcaaagatactacctcttgatggagcccttgctatattgctcagaggaatatgaactcattcacattccccacgaagacaacaatagggacgacatcttgtcaagactagtgagttccaagaggctagaagaatcttggatgaatgacatatggaattacttggtaaacaatcatttgctgattgtcaacaatgaagctaggaaggatgcacagtactttatggaggagatacacagaggcatctatggttttcatttaggaggaaggagcatgacaactcaggaaactcttttccgattgacatatgtcactgatgccaagattcttgtagaagtcggtgaactctcagagggaagagcccattctgatgaaacactcaacgacaaaagccttgctcttgaactagacatgattgactag

SEQ ID NO: 51489 - DNA, 701 bp, Glycine max
  Peptide Sequence Number=SeqID_168267
atggtcaatgaccttaatctgcaattggtagtggataacacttcaggtctggcactgaaaaacatgcaattggatgcttcacagctcagtttacaatcggacaaaaaaccagccgcccgccttgccaagcttgcggtgagtgatatgcaactggccctcgaccagcaaaaagcagacatttctgccattcaactgataggacttaatactgcggttatccggcaggctgaccagcagttaaactggcaggcaatgctggcgcgcgccaccggcaaacagactgcgcatgctgcacctgccagccacacggcaacgcacacaaacccttggtcatatcgcttgaagcgactggctttacagcaggccgatcttcatatcgaagaccagtctacgcctagacctgtcttgctggatattaccgagggcaatattgaactcgctgacttaagccaagacatgtcacggttgttgccaataaaaacgatcttcaaaatcaagcaaggcggccagttcaagctgcaaggcaaactcgccgcgtcacccttcaaaatggaagcgcagagtacactgactgatgtatccctgaagccatttgcaccttatatcgaacaagtcgccttgttacgcctggaaaatggcgcagccagcctgcaagggaaattgcagcaaacaaccagtggtgccaccaaatttgacggcgg

SEQ ID NO: 51490 - DNA, 210 bp, Glycine max
  Peptide Sequence Number=SeqID_168268
atgagaaaacgagcccgttggcgcgtggagactaacatcatattctacaccatttggcgtcctgacccgggaagtcagtcaggtgacatgcggggttaccttatggttacccacaccattcgtcaaccatgggcaaacgagcccatagatgcacggagactaacatcatcttctgtaccgtttgtcgtcctgaccagtgaagtcaggtga

SEQ ID NO: 51491 - DNA, 528 bp, Glycine max
  Peptide Sequence Number=SeqID_168269
atgggacactttcaggtcttcaaggcctgcctctcaagttcgttcaagccgatcaaagcgcaaggaattggtggagaaagctggaagtctgcaaggggaagatcgattggaggctctcctatactctgctatctatctcaaggtcttgttctctctctctctcttcattttcaatcatcttatctatgttcttcttatcgaatatcatcatctgagcccttcttagatcatctcgtgcagtggataaacacagggcaaatttcttgttttgaagatggaggtcaccaccggcccaataggcatgctgagatctcaaggcttatatttcgtgaactagagcgacacactagtcgcaaggatatatctccacaggaagttctagtcattcgtaagattcatccatgtttgccatctttcaaggctgaattcactgcatctgttcctcttactcgaattagagacattgctcatcggaatgacatcccacatgacctaaaggttgttcttttcaaagtacttgaactatga

SEQ ID NO: 51492 - DNA, 747 bp, Glycine max
  Peptide Sequence Number=SeqID_168270
gactggacgtcctcgcctttagagggctacacatcctcgccttcagaggactgcatgttctcaccttcagaggactccaagtcctcgccatcagaggattgaacgtcctcaccttcagaggactccacgtcctcgccatcagaggattgaacgtccacaccttcagagggctacacgccctcgtcaacagaggactagacgtcctcgcattcaaaggactacacgtccttggattcagagggctacacgtccttgccttcggagggctatacaccctcgccttcagaggactacacgtccttgctttcagaggacaacgcgtcctttccatcagaggactacacgtcctcaccttcagaggacttcacgccctcgccttcagaggacaacatgtaatcctctttagagggctacacatcttctccttcataggactacacctcctcgccttaggaggggatacacgtcctagactcaaaggaccgcatgtcctcacattcagagggctgcacgtcctcaccataagtgggatgcatgtcctcgccttcagaggactgcttcacgtcctcgccttcaaaggactgcatgtccccgccttcaatgggcaacacgtccttgccttcagagggctacacgtcgtcgccttcagaggactgcacgtcctcgccatcagaggattgcacgtcctcgccttcaaaggactgcacgtccccgcctttagaggactgcacaacctcgccttcaaag

SEQ ID NO: 51493 - DNA, 426 bp, Glycine max
  Peptide Sequence Number=SeqID_168271
atgacttccttgactcacctcaacctctctcatactggattcatggggaagattcctcctcagatcgggaatctctcaaatttggtgtatcttgacctgagttctgtttctgccaacggaacagtaccctctcagatcgggaatctctctaagcttcgatatcttgacttgagcgacaattattttgaaggtatggcaattccttctttcctttgtgcaatgacctccttgactcacctccacctctcttatactcgattccatgggaagattccatctcagattgggaatctctccaatttgctctatcttggccttggaggtcattctgttgtcgaacctctcatttcattggctacacactctccaatctcttccttctttgacccacctatatttgtcagactgcacactccctcactataa

SEQ ID NO: 51494 - DNA, 141 bp, Glycine max
  Peptide Sequence Number=SeqID_168272
atggccgaccaatgggcgaccaagtccaaagccaaaggggtgaacgctgtgaaaatttttcccggacgcccgaaatggactcgggatgaaatgcacaaattgataaaagaacatattttgggaaacattggggttgattaa

SEQ ID NO: 51495 - DNA, 1398 bp, Glycine max
  Peptide Sequence Number=SeqID_168273
caaataggcgcaaccgcgcccgatcgcgcccagcggcgcggcgcgtgtcgtgaccgcgcgcaggtcggaaccgccctgcttctcggtcaggcccatgccgatcagcgcgccgcgcttgccggccagcggcgcgtcggcgccgtcgaattcgcgcgaatagagcgcgggcagccaatcgccggtgtagtcgatcacgcccgccggctcgcgttgcagcagaggcacggcggcaaaggtcatggtggtgggacacagcgtgccggcctcgacctgaccctgcatcaggtaggccgccgcccgcgccacctgcgcccccggcaccggctggacccaggcgcggctgtgcaggccgcgcgccacgatgccgctcatcaacaattgccaggcgggatggaaatcgacatggtcgatgcgatggccggtccgatcataggcctgcagccgcggcggatagcggttggcgtcgacgccggcggccagggtctgggcgcggccgagccaggccccatgcgcgccgaggtcgccgagccaggcgccagcgccctcgtggaccgccgcctcgcgcaacgccgggtcggtctcgaacagcgaatagtcttccaggggcgggacctggttgagtacggtatgggtcacgaacgacggcatgctggctcctcttcgttgatgcgccgtgcttgccggcgcgccccgcccggcggcctatctggcgatgggcgccacccgctgccagggccgcagggcctcgacctgggcggccagttccagcagccaggcctcgctgcccagcgggcccatgacctggatgccgatcggcaggccgtcggccgacaggccgaacggaatggaaatggcgggcatgcccgtcaggttggccaacggcgcgaacggcgaatagccgatcacgcccttcttgcccaggcgataggccaggtaatcggcgttgtccatcgcatagcggccgatgggcgccggcagttgcgccaacaccggcgacaggaacaggtcgtggccctgcgtgccctcgcgatgcaggaagcggccgatgcggcgcgtgatctcgtggcaggtatcgacgcaagccacgtactgcgcgccggaaatcgcgcgggcgtactcgcgcgcgcccagcgtggtcggctgcaattcgtctgcggcaagacgacgattgcgcgcgccgacgaagctgtcgatggcattggcggcggcgctggcgatcagcggcagcatcggcgacagcacttcctcggaacccaccggcggcgcggccaccaccagttcgtggcccaggccggcgaacaggcgcgcggcctcgtcgaccgccgccgcgacctcgggatggatcgcttcgccttcgtaggtggtgttgatataggcaatgcggcggcgcggcgatga

SEQ ID NO: 51496 - DNA, 402 bp, Glycine max
  Peptide Sequence Number=SeqID_168274
atgaataacaggcttggtttggttgttctgctacttgctcagatcttagtacttcatgtcaaggctcatgagtctgatcaggctcaggcaccactcacagtgctgaacccttttgagcataaaactcaaacaggagttcaacttcatgatgatgaccagaatagtgatcataaagttgcagtttctggagctattgaagagtcaccatcatcatcagaagagaaaagtggagaatctaacgaagctgctgaggcaccacaaattcgaagaatgggaaaacatcattcttcggacagatcagtggcaggtggaggcgtcatcattggagggctcgttactgccatctttgctgctgttttttgctacattcgggttactaggagaagggacactcgttactaa

SEQ ID NO: 51497 - DNA, 2082 bp, Glycine max
  Peptide Sequence Number=SeqID_168275
atggagaagaaaagaaagattgtgcagtatagggagaggctggataggactcttgcctcacctgatcttgcaaatgatgagatgctcaaaaagcttgttagaagtcaactcccacctttagaacctgaagtagaaggatttagagataaattagtagaaaacaagactgcagaggtatctcactttcttgatatgttgaggagtgcttcttcagatgatagtggaagatctaatacatcacacactgattggaaattaaaacaagatggtgaagagtttcgtgttatgtatcgcgaaggacaggagggaaccccctttcatacaatgcttgtagaaggctttgtagatgggcctgttgatgtttcatggcctctgtctctgagggaagctatagtgcactattatctgtttgagtactttcaagatgacttagttgttgttcttacaaattcggtttctgattcaaagaatgtcacggagactctttgtggtttcaacagtgaggcaattcctgaagcaaaggatgttgtaagaatcgatttggtgggaggctttgctttgcaaaaggccttgggggatccattatatgttcgaattcgtgatgctctatataacactagtggatcaaaggctatgaatggtgaagagcttcggcaagttgcaagtgttctccctgctgaagatcttgttgaaagtgagcagggtggggaaaaagatgcatctaaggaagatatgagtaatcaatatgcaaatgatgtcatgccaatggcaatgaatatagaagtacaagatagtagcaaaacatttaatgagattgtagaagtagattgtgaagaaattgtacaaggtgaggaaaaagatgcatctaaggaagatataagttatcgatatgcaaataatgtggtgccaatggcaatgaatactaaagtactagatggtagcaaaaaatttgctgagattgtagaagtagatattgacgaaattttacaaattgaggaggccaatgaagaagtaaaagacattccaaataaggaagttgacatgagtgttctaaggggcaaaaggagtacatatatcagatcagaggtagaacatgctctagaaacattagacaaagccatttcaatggttcgtgaacagcgacttcattctcgggtggcatcttctagcgttgctgatgaagagtcccattttctgaaaaatgatgacagagttgatacatattccttaaaactcactcaaccaagttccaaaaatgaggttagtgttgaggtaccaaatggagatattccggagggagcttcacaagaagcgcttgggaataaccctggcatccaaaactcaaggtgtacaggaacaaatcctaactcaaaggaagtaaattctaacaaagtagtaccaacaacatcagagcaaaacctttcaacacctattttatcaagcccagttgtttcatatcctttggaaaacggagcaattctggaccaaacaaccatcagcaacaagcaattaaacactgattcagtcgaagacgcgtctttagatcatgcagacaagtcaagcaggcagaaaaaactaaacaccattgtaattccaggtaggaattcagatgcaccaaagaaggagaggaagtatgacatagagggtgagaatttggagggcaagtacaaagattggcaaaagaaactgcatcctgatttagtacattcaaaatctcagggggatgggggaggagattttgctgctgaacaatctgcaagggtcattgatgcataccgtactcttagcaagcctttgtcaagaggaatttacttgctaaagctttatggagaagaagttgatgaagaacagacaatttcagattcagaattacttgcagagattctggaaatcagggaagcagttgaagaagcaactaactctgagactttgaatcacattctctctgaggagaagctacataattggtccaatgcctttggtcatgcttttcaaagccaaaactttgaagaagcaaaaatggcaattaggagaatgacttactatagtcgtgtaattgatgaagttgtaaagaagctttga

SEQ ID NO: 51498 - DNA, 471 bp, Glycine max
  Peptide Sequence Number=SeqID_168276
atgcatgtggtgttcttggacgtctttcaagacctcactcagagtggatgctacgcatggggagttgccgccctagtgtatatgtacgataatttgaataatgcgtctaagagcagcgacagacgacttgctagatatatcacactgttacattgttggatttatgagcattttccattagttgttgaggctattactgttgaagactatcatgaaaggaaaccacccccaatccaaggtagtatattcgccaacaatttggctcccaacctcgaagtcttaattgtcaaagccgctagccacgaacaagtccccgtcgatgaaaaatacataagagaaatcccgacattgacgtcgctttccagaagctacatcaatgcttctctcgtcaccatttccaagaggctcaacaagacacgcgattggatcatcgccatcaaagtcgtcttgctcattcacagtagtggatga

SEQ ID NO: 51499 - DNA, 159 bp, Glycine max
  Peptide Sequence Number=SeqID_168277
atgccgtttttgtcatcgaggcaacgggaagctgacgttgttgctaaggatgatcatcacgtggatgacgtagttgacgaggtcttccaacagcctcaagaagcagttgttgatgcccaaggtttttcaagcgggtcgtgtgacatcagttctaactag

SEQ ID NO: 51500 - DNA, 237 bp, Glycine max
  Peptide Sequence Number=SeqID_168278
atgccttttagaggcttgaaaagtgcaacaaaacgaactatgttttcagcattttctggaaaatgcgatgaactcgctaagcgagcgtgctgcgttaagcgagttcatcagtactcattgtgtatatatgcgttttctgaagaactcgttaagcgcgcttaccacgctaagcgagttcatcctttgaggatgaacactcatcctcttgatgaactacctgtggctaagcgaggctga

SEQ ID NO: 51501 - DNA, 264 bp, Glycine max
  Peptide Sequence Number=SeqID_168279
atgtggaggcgatggtggtgcgtctgcggttggctgctgttgttggtattgccccggctgctgtgcctaccttggcatgcaatatttctcagtgaatgtcctattaatgggaggttggataagctttgtcggtgcgatcagtactccgtagaattggcagagacttgtaatcaatgccggaaaacccagtgcactattggacttctcaaggtccaccgggtgtctcggtggtgcaatacctacaaactagtggatggcatctaa

SEQ ID NO: 51502 - DNA, 216 bp, Glycine max
  Peptide Sequence Number=SeqID_168280
atgataaaaacaccatcatactacaagaacgaagtgatcctaaaatgggtaagagatgtggcaactatggtcatactacaaggaatggtggccaacttagtagtggctaaagcatcccagtcaggccataaccataatgatggggcgtcaatcaagcgtgtcaaaacggatagtaatgaattcaatatgttaaataacaataatgggggaaattaa

SEQ ID NO: 51503 - DNA, 357 bp, Glycine max
  Peptide Sequence Number=SeqID_168281
atggcaaagcttgcagttccacctttgctttctctaaggcacttgctggtgctatcacttgctttgaatgtgagtttgattctgaggactgtgtattatgagagtgaaaaaggaagcaaagggttttgtttgaacaaaaacatgatggcggatgcagattctgatgatagagaggggcatcttatccacaaatcacgtttggctatgtcctctacttcgtctctcgttaattctactcgtgcagatcatccaggaggaagggaaacagtgatcaacttggatcaggcccgattgcttacgtcgttcgtctgtgctttgcttcctgctctagttcctgggaaagacagggacaactag

SEQ ID NO: 51504 - DNA, 636 bp, Glycine max
  Peptide Sequence Number=SeqID_168282
atgaagctttgcttctacaacaaagaattaattgaaacttaccttggttgtttatgtgaagttggtagagtgttggaggctaggagatgcatgaattctcttaaaatttttggctacacagtccctttcaattattccttgtttattagagctgggagagtggaagaagcattggcattacttgaagaagttggagaagagaaatccattatagatcagctaacgtgtggaagcattgttcatggtttactgcgcaagggtcaattagaagaggcattagccaaggaggatgccatgaaaccgaaaggcataacacctaccatccatgtggggaggccttttgatgcatggaacatcctctatcgtatgaaactcaaaggacccttccctgattttaaaacgtattctatgtttctcacttgcctttgcaaggctgggagatatgaagaaggaatgagacttatttctgaaatgttggacggaggaattgttccaagtagggtgttgctaggtgcactaggcatattgcttgggcacccaacaataaaagaggtccattgtaccgcttcggtcgaggtgaaagtgttatggaggtacatgggtggtggttgtggtagtagttggtttggttgttaa

SEQ ID NO: 51505 - DNA, 1080 bp, Glycine max
  Peptide Sequence Number=SeqID_168283
atgacattcattactgtggatgctaacttctgctatagggtcatgccctttggcctgaaaaatgaagtgcagaagctgaacggtagactgacgtccttgtcctgcttcctcctaaagcttgctgagaaagagaagtcattctacaagctactcatgaaaactgagccttttctattggatgaagcctatgagcaagccttcttggccttcaagaagactattgccatattgccagtcctaagtcgacccaagctaggagtacctctacttctatacctcacagtagatgatgagcctgttagttcagccctcgtacaggaggaagggaaacacctgcttcccatctattttactcatcgtatccttcatgatgttgaaaagctgtaccagatgataaagaaggtaatggtgacacttataacctcaactcgacacctcaagccatacttccaaagttaccaagtggtagtcaaaacgaactacccaatcaggaaggtgttgcaaaagcccaagctaaaagaaaggatggttgcatggtttatagaactgttagagtttgacctccagtatatgctttgtggtctcatgaagacccaattcatgacagactttctggcaaaagcgtccaacgtgaagggaagcagggcaggcattatccttgaaggacctagcaacattactttagagcaagctctcaagcttaacttcaaagcctcaaacaatcaagttgagtacgaggcacttatagtaggcctaaagctagcaaaagaagttggagccaagaagctaagatgctacattgactcgcagcttatccaagggcaagttgccaacaaatatgaaactaaggagatagtactgctcaggtactaccatattgcaaaaacactcattgacgactttgattgctttgggatgtatcacattccaagagaaagaaacaccagagcagacttactttccaaactggccagctccaaaaagactgggcatatcaaaaccatcatccaggagacactccaggttctaaccatagaccccaaagaggtcatggcaggagagaaagaggaaccagactag

SEQ ID NO: 51506 - DNA, 726 bp, Glycine max
  Peptide Sequence Number=SeqID_168284
atgggaacatcagcaggaaaggccaaggtggttggtactgtaatgggaataggtggagcgatgatgctcaccttctataagaacattgagattcacatctggtcaacgcatgtcaacctgatgccaaatattataaagccacacaatgtgtctcccactaaaatttctggttcttttcttgcttttggcacttgtctatcctattcagtatggacaagatttgtcttcatccgtgctagttaccacaaatacttagacttcaagaaagataccttattatacatcatagccattgacggtttgttcttattggatttcttccacaattatctcaatgaggaagtgtctggttccttcatgacaagattacaagaccaagttcagctaagtggtgtgaagctaaccaaggatgtcatcataagggacatcatcatggtggagaaccaaattccaacctacatcttagtgaggatcttggtgcttgaaagctccaaacctgctgattcagttctagagttcttgggtttgatgctcttgtcattctgcaagaaacactctccactcaaggtaactcacatccccacaggttctgaagctgtctctaaggacactgcttcaacagaaaaagctcatgaacttattatgcagacacagttaaacaagccagcgaatttgcataccaacttgacaaaggataaactaatgaagccctgcttgcttccgtga

SEQ ID NO: 51507 - DNA, 585 bp, Glycine max
  Peptide Sequence Number=SeqID_168285
atggacgagttatgcgaacgagccaaaggctatatagaagtagtggagatgtttacgttcaaaatcgaggtccgacaagcaggacaaaagcgggacaaaagaaaaggaggtaccatgaccgactcacacaagttggacaaacaacagaagctcgataagtgccagcctctcccaaagggacccaggatgaccccatggtcatctccggccaatttcatggtgtccaaggtcctcattgaccaaggcaactctacggacatcccttactggaaaacattccagaggcttgaagtctcatctaatacagtccaggcacattttggaccactcctcgactttgttggagaaagaaaaacgctgaatgaactcagagccatcctcttcacgccttatctcaagatgaaattcctaaccttgatgggagagatcgtgactatcaaggcagaccaaaagcaagcccgacaatgctatgctaaaagtctaaaggtggcaccatatcctcccactagggagcaaagtaggcctcatctcacaattggtggtaacagtcaagtcatgagcatggacgaggggtccccgatctga

SEQ ID NO: 51508 - DNA, 3126 bp, Glycine max
  Peptide Sequence Number=SeqID_168286
atggagctgatcaatgtcagagtagacgtggcaaaggaggacaagaggggtacctgcaaaacaaaggactctgacgctcaatgccacgtcatttgccacgtccattttgtgaaccttggacagtacataagcctcccaagctctgagccagcttgttggcgaaagaggttgtttagtgtcaagggtagtagccttgacaaggtggtaaccttgacgggtgcgagagttgcaagcaaagtcaagcgtgtcaggcgagtgcatcacacgcacattactcttgcatatgtgtcacatcaagagtgggcacatactggagatgtggtgtgtgggttaatggggctgcatcgtggggctcaattcaaaaaccgctggcggattgagaggtcattccaattggcggttcctcttttaaggagacacgctatggagcttttggtagcgagtcctctttgtgtcgtgttggcagaggtgcttctcaccttcatcggatggggctaccttttgctactcctttggacggggaacccgcgtagccatagtgttgggtcgccttcgtcccctcccaccattgctagctatgagtgggtatggaatgatgttttgaaatatcgttcctccattacttctgcaacgagtgtcgctactctagagcatcaactgaggttggccaacccagaagactcctgcaagatggtcgtccaggcttacaggagtgatgattttccctttttgagggcggtgtcggaccattttctcaaggttttggaaactgatgtcgtggctgataggttgccactaatgttcaaccgggataaggaaccctgtttcctattctactggcagttagaccctactaggttgaagtcttttgatgaggatctactgaccctagtggagaaagttgataaggccattttggagcagttgttggccttgttggatgctcgggccatcttgtctcttccttcagcagatgatgttctcgcttccttagatggaaaagtcaaacctactggtaggaccatgccaccttctactgccaattctcctggcccctttgctgctggttcattgggtccgcctttggtcgtgcaggttactgttgctgcttctgctcctccttctttgcctgctcaagaggtttctatttctcctcccactatggttactacaccagtttctttggtcgcttttatcattgctgctccttccaccattgttacacccttattgagcgctggtgtaacaaccacaaatgctctagaaatgccacctccttcttcttcagcttcatcgattccccccttagctattttggcatcggcgtcgccttcctcctcttctcaccctaatgtctccctagatcacgtctattctcgtgatattgattcaatgaggagcatgggatataggccagagcagagaactccgactagctttatgtcttcctttgacaagaacctcattcgatcaattggggttcaaaatgaaactgattctatgacggtcttccttcagagaagtctagtgactctggaggaaaatggacaaaggcaccaggaggcgctaagcaagatggcatccttagaggctgaggtcgccaagtggagggccactgctcggattgtacggagagtgaagtgtcccaaggtggccaatgccattgttgcttttgctgaggtcgtcaggtccaaccaccaattgtcatccaaggtttgtgatgcttttgccaagatgttgcgcataagaccggatggtgacaagttggttgggcgatgttggcacttgttgagggagaataatgaattggttggcaaggtggagagtgttgcagcagaaaaggacgagacttccaaggtagttgctgacctccaggctcggttgagggagaacaagtccaagctagaggagttcgagctgaaggcgtcaaaggagaggaaaaccaacaaggagctagaggaggagttgctggacgtgaaggatggtgaactgcttgatgaagaggaaatagtttctacggaggaggatgctggcgaggagcaagaccttggtggcgtaggatgtaagactgaccttggcggttttgtaggtaatggaggagtaggtgacataagatcatctcagtgtgatttccacttggttgaaggtcttgctgaccagtgtgctggtatttctctttgctttgtgaaacctcttatccaaggacagggctcaccaagggagaaccttgggtttaacgagttttggaccagggatgcgttcatcttgggttttgacgaggctcaccaagggcgaaccttggatttgtcgagcctttggagatgcgagactcaccaaggggcggaccatgggtttgacgatactttggagaagcgagactcaccaagggtgaaccttgggtttgacgagtctttggagaagcaagactcaccaaggatggaccttgggtttaacgagcctttggagaagcgagactcacttagggcgaaccttgggtttaataagtctttggagaagccagactcaccaaggtcaaaccttggttttgacgagcctttggagatgcgagactcaccaaggatagaccttggggcagaccttgggtttgatgagactttcgagaaacaaaacttaccaaggtcagaccttgggtttaacgagcctttggagaagcgagactcaccaagagtagaccttgggtttggcgagcctttggagatgcgagactcaccaaggacggaccttaggtttgacgagcctttggagatgcgagactcactatgggcgaaccttgggtttgacgagcctttagagatacggcattcaccaagggtggaccttaggtttggcatgcctttggagatgcaaccaggaacgtcttgctatgaccctgaccagttgggtccaagctttcctgctcggggatctttccttactcacttcggactcaccacactaggtcgtcaggttgaatggttcgagtatgctaggaagtttttcttttcacaaacccttggacttgttaagccttgtgcacaaggctttaaggatgactctgttggctgcctctacctaatcgttggtctggggatgtttgacaaaagtcacgaggtgcttgacacctag

SEQ ID NO: 51509 - DNA, 528 bp, Glycine max
  Peptide Sequence Number=SeqID_168287
atgaaaaaagacaacaatagatacctcaaagccctaactggggcaatgaaaggcaccatgcttgagcctcaagcaaacctaggggcagatcaaaagttctcacccaaagatgcacctttggcttttcgcctcaccctccctttgaaggtgcaagtcgacttccatgatgtgaacgacaaaggggcatcaactagtcgaccgcccttcatggtagtgtatgtaggagagactaggatggtcttgggtgttaatgtgttgtttcctgtcatggttgttgggggaggattggaactctttagaggtgtctcgcatttgaggccagaccacgtgctaaccattggtggaaaaaggccacgggctttggggcagtggaatgactacaacccttatggtgtggactacggtcatgttgagtttgtcatgaccaacatcgaaagctgccactattcagaagggatgtcatcatttttccatggtcgtactggttaccatagtcatgatgaatgtaccaagactatgatcaagtga

SEQ ID NO: 51510 - DNA, 333 bp, Glycine max
  Peptide Sequence Number=SeqID_168288
atggatttgcgaattgaaggccatgtgatttggccggtgtcttccaatatgcaccacacatttgctattaaacatgttttgacgaccattgcagagtactccgtaaagccccgtcttaaaagaacaacgcaaaaacaactttccaacaagccttcagacatcgatgcttcccgcgcacttttcatcgagatcacagagattctaggagctgataccgtgatcccagaccaatccccatctgggtttttgtttccacttgaaacaccccattctgaagggggtttaaatgatcaaccagcttgcaccgaaggtgtttgtggaaatgccgcatag

SEQ ID NO: 51511 - DNA, 306 bp, Glycine max
  Peptide Sequence Number=SeqID_168289
atgttggatgagtcacttgaaatgaaggaggccttcgagttggaagaaggaatgctcgcatatgtgaagacattatctaaggaggagcacaaaaagaaattaactgaagatgccaagcttgtttccttggtaggagctcttgagcaagccatgcttcgatcacttattgaagtatttcttgtagaagtcggggatgatgttattgagataaatcctagaagtgctcctattcgtccaaggacaaagaatactggttgtaacaagcttggtgtagagctagagttaaagagtcagaagtgtcactga

SEQ ID NO: 51512 - DNA, 294 bp, Glycine max
  Peptide Sequence Number=SeqID_168290
atgtctcaagaagttgatatggattatgaaaataaacaagaatgtggtgtgaatcaaccacctcatgttgattgttcggaagcttttaatacttctcaagtcttcggtacccgagatgatgttttgctgtgggctggatcaattgcccatgaaaacggatttgttgcaattattatgaggagtggtcagtataagtgtaggaagaaagaatttgttagaagagacactgggagtaggaaatgtggttgtcccttcaagcttcgtggaaaaccagtgcatggaggggaaggttag

SEQ ID NO: 51513 - DNA, 1809 bp, Glycine max
  Peptide Sequence Number=SeqID_168291
atgggaaacaactgtgttggatcgagaacttcttctaaagacgtaacaaatggctgttctaattcaagttcattttggtggtcacgcggacacaagaaagatgcttcttctcatgcacacaaaagtggcaacaaaaagagaaccaaagctgcggaaactgttcaaaacaagcctccagagatggtgaaaatcgagagggaggatgtgaagcctcctcatgaatccaaagagactaaaccggcttcggaaccaacaacaacaaaggagcagcagcaggcagcaaaaccaaagaggccacacaatgtgaagaggctagcaagtgcaggccttaaaactgattctgttttgctaaggaaaaccggtaaccttaaggagttttacaatttgggaccgaagctaggacaaggccaatttggaaccactttcctttgtgtggagaagatcagtgggaaagagtatgcttgcaagtcaatactgaagaggaagcttttgacagatgaggatgtggaggatgtgaggagggagattcagataatgcaccacttggcagggagtcctaatgtgatctccatcaaggaggcttttgaggatgctgtcgcggttcatgttgttatggagctgtgtgcagggggtgagctttttgataggattgtcgaaagaggacattacactgagagaaaggctgctaagcttgcaaggactatagttggtgtcattgagtcttgccactcccttggagtcatgcatagggatctcaagcctgagaattttctctttgttaatcagcaagaagaatcccctcttaaggcaatagattttggactgtctgcttttttcaaaccaggtgaaatttttggtgatgtagtaggaagtccttattacgtagcacctgaagttctacgtaagcgttacggccccgaagcagatgtatggagtgctggtgtcataatctacattctcttaagtggggtgcctccattttggggagaatcggagcaagacatattcgaggcgattttgcattccgaacttgatttctcatcggatccttggcctgctatatctgaaagtgcaaaagacttggttaggaagattcttgtcagagatcctactaaaaggatgacagcttatgaagttcttcgtaagattctagcctatgtccctgttagatgtcacccctggattcatgttgatggagctgctccagacaagcctcttgattctgcagttttgagtcgcctgaagcaattttatgcaatgaacaaactcaagaaaatggctctaagagttatagcacaaaatctctctgaagaagaaattgcagggttgaaagaaatgtttaagatgatagacacagacaacagtggtcaaattacttttgaagaactcaaggttggactgaaaaagtttggtgctaatctcaatgaatctgaaatttacgaccttatgcaatcagcagatgttgataacagtggcacaattgactatggagaattcatagctgcaacattgcatctaaacaaggttgaaagagaagatcatttagttgcagcatttgcttattttgataaagatggaagtggctacatcactcaagatgagcttcagcaagcttgtgaagaatttggcattggagatgttcgcttggaggaaatgatccgagaagctgatcaagataatgatggacgaatagactacaatgaatttgttgctatgatgcagaaaggcaatgcagatttgggtaagagggttcgaaagggtagcactagttttagagttggatttagggaagcactacctgtatgttaa

SEQ ID NO: 51514 - DNA, 105 bp, Glycine max
  Peptide Sequence Number=SeqID_168292
ccgaggcggcttccgtaacatttccgtgggtgatttcgcaaaagatttttcaccgttcttcgatgttctttcgttcgtccttcatcgttcttctgtcttcaaccg

SEQ ID NO: 51515 - DNA, 532 bp, Glycine max
  Peptide Sequence Number=SeqID_168293
cgaagagaatttcgaagctgtggaagaagctgaagaagtctgggctctgaaaaccgaactaggtaaagtgagactttctaaagaaaaattcaagcttgtcgctacagacgttcggaaagagtgtgtcgggttacgagaagagaatgcaactactgcaaaagcccttgaacaaaaaaccatgagggctcgcaaggaagagcatggccgtgacaaattccgtgaagcattgtggggcaacaacagtgagctcaagcttcgaagggaagagagagaccgatcacaagcacataacatggtcttaaaagaagagttagccgcttgctcaagatccaaaaggaacttgactcagcgtttatgcgagacagagaccaacatgttagctatcatcaccaagtatcaagaagaactaagcctagccacaacccacgagcgtagggtggcggacgagtatgcccaagtgtacgcagaaaaggaggctagaggaagggtgatcgactcattacaccaagaggcaaccatgtggatggactga

SEQ ID NO: 51516 - DNA, 234 bp, Glycine max
  Peptide Sequence Number=SeqID_168294
atgttacggaacttcatggattgcgcaataatgttttcttttgactttcggcatattacggaacttcacggattgcgcaacaatggatgccaagtacctcgaagtggtcaaacgagggtcgcatcccaacaaacagatggtccccggacgaaattagggtatgacaaagggcattcatgcaaacatttctgggtgactattcctacatcagcatcacttaatgtgcaacaaatt

SEQ ID NO: 51517 - DNA, 899 bp, Glycine max
  Peptide Sequence Number=SeqID_168295
actactcgtcctcaccatcagagaggctacactccctcacctttagaggactacacgtccttgccttcagagagctacatgccctcactagcagaggactacacgtccttgcctttagaggactacacgtcctcaccttcaaaggactacacgtcctccccttcaaagggtttcacaccttcgccttcagaggactacacgtcctccccttgagaggactatacgtcctcaccatccgaggactacacgtcctcgccttcagagggctacacgctctctttttcaaaggactacacgtcctcgccttcagagggctacacgccctcgggttcaaagggctacacgccgtcactttcaaagggctgcatgccctcgcctttagaggactacatgtcctcaccttcatagggctacacgccctcgcctttagaggagtacacgtcctcgacttcaaagggctacacgcccttgcctttagagggctacacgccctcgccatcagaggactacacgtcctcgccttcagagggctacacgccctcgccatcagaggactacctgccctcaccttcagagggctgcacgccctctctttcataggacttcatatctgtgccttcagagaattgaagctactatgcataccggggcaagatttcacccaacgaccacaatgccaatctccccctacagaagtatcagttggtctatgccatgatgacatagggatcgtgcccacaagacacccagtggacctggagaagtccaacagggccctggggtttccagctctggttataggcctctgtcagtcctactgggtgcccgtccccctagcaaggtcactctatcgggatcgcacccgcaagacacccagtggacccggagaagtccaatag

SEQ ID NO: 51518 - DNA, 655 bp, Glycine max
  Peptide Sequence Number=SeqID_168296
cgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgacgaggaggccgggcgcacggggcgccgtggtcatccccctccctcccgacggttcagtggacttctcacaacgtcgcgggcagcgaaccgctcacgtcgccgcaatctgaacacttcaccggaccattcaatcggtaggagcgacgtgcg

SEQ ID NO: 51519 - DNA, 1319 bp, Glycine max
  Peptide Sequence Number=SeqID_168297
ctgaaattcagaccaagaatgaggtatctgaagctgttgtaaaagttgaaggtcccaaatctgcagcaagtaaaatctcaaaacttgccaaggaacatggtggcaaaggtggtgttgcttcaaagaacaacaaatctgccaccaaagacaaacccaatttgaagtctacaacttcatctcagacacacaggccaaacctttccaagagcctttctttgccagccaaatcagctggaggagatggcatgaagaaaagcactaatggaactctcgcgaagccagaaactaagcatgctaatggggctaaagctgaggcttccattcgccgtttaagcaggctgacgaactctgaagttaactcaaaagaggcaaaaacaaacactggaaattctaaccagaggacttctttggcatccatgattagccttaaaacctctgagcttctcttcattgatctccttgttcataacttctatcctgtctaccagtctggaatatctactccagtgaatgcggttaccaagagccttacatctgaggaatcattacctgttgatcagatttcaattccagcaaaaactgaaaaaccaaataaagaggaagatgatgctcattctacaacttcaagtcatactcctcgtaggaggagcagtggttctggattttccttcagattggaagaacgagcagaaaagaggaaggagttcttctcaaagttagaagagaaaattcaggaaaaggaggcagagaaaactaaccagcaagagaaatcaaaggaaaaccaggaggctgagatcaagcaattgaggaagaccatgactttcaaagccactccaatgccaagtttctacaaggaacctcctccaaaagttgaattgaagaagataccaataacgcgcccaaaatctccaaagcttggaaggcacaaaggatctgctgtgaacaaatcagcagacaaatcttgttctagtccacatggaaagcagcaacagaatgatccaaccaaggcaaaggcaaagggtagtaataaagaagtgatttcaaagaaaccaatcagaaaaattcaagccaaggtgcagtctcaggaaagtgcaatcagaaaaactgaaaaggattctgtgaagcccactaaagtcaaccaagatgcaaaagcaggcacaggaaacaatgaagaatgccatgatccatcagttaacaattctgaataccaaaatgacatggagctagaatccaaaaatgaacttgatcagaatgttgcactggtcttgaactcatccccacctgagattgtatcatatgaggttgctgttggagtgtag

SEQ ID NO: 51520 - DNA, 291 bp, Glycine max
  Peptide Sequence Number=SeqID_168298
atgaagagtaactcatcttttacaattattcttggaaatctcattcggtcgatcaaggttcaaaatgccactgattctgcaaaggtcattccacggaggagtctagcaatcttggaggaaaatggacaacgacaccagaaagctctgagcaaggtgacatccttagaggcagaggaaaatggacaacgacaccaaaaaactctgagcaaggtgacgtccttagaggctgaggtcaccaagtggagggtcattactcgaactgtttggagagtgaagcatcctaatacataa

SEQ ID NO: 51521 - DNA, 1110 bp, Glycine max
  Peptide Sequence Number=SeqID_168299
atggaaggcaagaccgaaagtcatgtgacatcggcagaagcctttgtggaagggggggttcaagaagcttgtgatgatgcttgcagcatatgccttgaggatttttgcaaaagtgatcctgccactgtgtcagagaagctcccaatgtcctatgtgttggcaacctatcagcttgagggatactacaagttgtatccatttcatcacagtcaagaactgcttgaggcagtagagctggaaaggagcttgagggataccccatctagaaatgctgcgatttttcatcatccagcacttggtgattttgaattgcagcatttacccatggctatgaatgaggctgatattgaagagcgaataattcaacatttgactgctgcagcagcaatgaggagatcacaccacctcggccagagggaaggccatcgaactaggtcatctgctcatggccgtccacacttcttagtatactcaactcagccaagtgcaccaccatttgctgcaggaggggaaagtgaaccagctgcaattcctgtaggaattccatctaccccacttacatttgacggaaatgagcaatcatctccacagcagatcccctatttccaaactcggggttcttctttaacttctggctctactgtcgcaacaacaaatcttcaaggagttcactctaatgatagaaggtttgcctctcattcttttcctgcaagccaagacagagcacagccatcagaacaatcgttctctgattctctgcgttccagatttaatgcagtatccacgagatacaaagaatcaatttcgaagggcacaaggggatggaaagagaggctgttctctcccaattcttctatgtcagaacttggttcagaagttaagagagaattgaatgccaaaattgctagcgtgtcccgattgatggagcgccttgaaacaacaagagaaaataatagggctgcaggaacttctttatcaaatccaaatcatttggtgaactgttccattgcagagacaagcaaccaaaacaatgtggaagctcgtggagagaactctttgcgtgacaatagtactccaactacattttctgctagctcagattcaaaatga

SEQ ID NO: 51522 - DNA, 462 bp, Glycine max
  Peptide Sequence Number=SeqID_168300
atggttttaaagggtaagatggtaacagaacttgggatccgatcacctgctgtcaagttcttcaatgtttttgcaaagcaacttcacaatttgcaagacattgttgacaaagtctatgatggcaagttgcatgaaggagattggcatgacactggctctgtcaagagctggaatctcaccacagggaaagtacgcacatttaaggagagtattgaagccattgatgaacaaagcaagtcaatatcattcaaaatcttcgatggagaaaatagtaaggattacaagatgtataaggtccacttgcaagtgatcgatattgaggaggaaggtggtgttgttactatatggaccattgaatatgagaagcttaatgaagatgttgctcctccatatcactacttggacattataactgccaccactaaagaaaccgatgctcatgttctgaaggcagagcaataa

SEQ ID NO: 51523 - DNA, 1962 bp, Glycine max
  Peptide Sequence Number=SeqID_168301
atggaaaaggacaagcctgtttctgtcaaagatgctgttttcaaattgcaaatgtcgctccttgaaggcattcaaaatgaagaccagctgtttgctgctgggtctctgatgtcaaggagtgactacgaagacattgtaaccgaacgatccattacaaacgtgtgtggttatccgctctgcagcaatgctttgccatccgatcgcccacggaagggtagataccggatttcactgaaggagcacaaggtctatgacttacacgagacttacatgttttgttgttcaaattgtgttgttagcagcaaagcttttgctgggagcttgcaagcagagagatgctcaggtttagacctggaaaaactaaacaatattcttagcttgtttgagaatttgaatctggaaccagcggagaatttgcaaaagaatgaagatttcggtttgtctgatttgaaaatccaggagaagacagaaacaagcagtggggaggtgtctttagagcagtgggctggaccttcaaatgcaattgagggttatgtaccaaaaccaagagaccatgattctaagggtttgcggaaaaatgttaaaaaagggtccaaagctggtcatggcaagccaattagtgacataaatttaattagcagtgagatgggctttgtgagtactataattatgcaagatgggtatagtgtttcaaaagtactgccaggtcaaagagacgcaaccgctcatcatcaaattaaaccaacagctatagtcaagcagttaggaaaggttgatgctaaagtggtcaggaaagatgatggtagcattcaagatttgtcttcatcttttaagagcagtttaattttaggtacctcagaaaaagaggaggaattagcccaatcatgtgaagctgcgctcaaatcctctcccgattgtgctattaaaaagaaagatgtttattccgtctccatatcagaaagacaatgtgatgtggaacagaatgattctgctaagaaatctgtacaagtcaaagggaaaatgagtagagttactgctaatgatgatgcttccacttccaatttagatcctgccaatgttgaagagaaattccaagtggaaaaagcaggtggatcattaaacactaaacccaaatcttcccttaaatctgcaggtgaaaagaaacttagtcgcactgttacttgggcagataagaaaatcaacagcactgggagtaaagatctttgtgggtttaaaaattttggagatattagaaatgaatctgactcagcaggaaatagtatagatgttgccaatgatgaagatacattacgtcgcgcgtcagcagaagcttgtgttattgcattgagctcagcatcagaagcagttgcttctggagactcggatgtcagtgatgctgtttctgaagctggaatcattatattgccaccaccacatgatgctggtgaggaaggtactctggaggatgttgatatactacaaaatgattcagttactgtgaaatggcctagaaagcctggaatttctgaagctgatttctttgaatctgatgactcatggtttgatgctgcaccagagggtttcagtttaactttgtcaccttttgcaactatgtggaataccctcttttcttggataacatcatcttctttggcatatatatatgggagggatgaaagttttcaagaagaatatctatcagttaatggcagagaatatccctgcaaagttgtcttggcagatggtcgctcatctgaaataaaacaaactttagccagttgtcttgctcgagctttacctacacttgttgctgtgctccggctgccaataccagtatctaccatggagcaagggatggttttgagtggttctcaaataggtatggaagaatatgaggttttgaaggatcttgcagtgccactgggccgagcacctcacatctctgcccaaagtggggcatga

SEQ ID NO: 51524 - DNA, 585 bp, Glycine max
  Peptide Sequence Number=SeqID_168302
atgaagaatttggatggactcaagtatttttttggaatagaggtggcaaggtcacaaagaggcattttcttatctcaaagaaagtatgtgttggacttattgattgagatagggctgctggactgcaaaccaacaaatacttcaatagtccataatcacaaactttctcaatacacagaccaagtgctcgtagataaagggagtgaaaaacatatgaatgcaggaaaccaaatacttcgctatttaaaatcctcaccaggaaaggggttgatgttccctaagaataatcacttgagtgttgaagggtacaccaatgcagattgggcaaggaatgttctagacagaaaatccacatcaggatacttcacatttgtcggagggaatttagttacatggagaagtaaaaagcaaaaagttgtggccttatctagtgctgaagctgagtttaggggcatggccaaaggattttgtgaactattatggcttagaaggttactaatggagattggctttggtgctagcatggagatgaacctattttgtgacaataaagttgcaattgatatctctaaaaatcctgtctag

SEQ ID NO: 51525 - DNA, 2154 bp, Glycine max
  Peptide Sequence Number=SeqID_168303
atggttgattcctcagtgattggtgattccatgaaacaaccattaaacgcttccgccgtcgattccattttggaaaatcttatggccaaaatggcggaggttttgtcaaaagctcagtcaacatcacaatcgtcgttctctgattcctcaacgataccgattagcatcaagttggatggttccaactatgccctatggtcccaagtggcagagatgtacatcttaggcaaagacaaattgggatatattgacagatcattccctccgccaatggaaactgccaaaggggtttgggattccattgctacgacatattttgatggatctgatacttcacaggtttatgaccttcgacataagagaatacaacaagtggtggttgttatcgccactaaaggctcaaaatttggcaaattgccaacactggtggctgggaaacacaactcagtcttgaagtcgaagggtccatctgatggaggaaagtgcacacattgtggaaatgttagacacactcgtgatacctatttcaagctacatgggtatccaaagtggtggcatgagttgcaagctaagaagaaaaaagacaccacgacacctgaggaaggcactggtaaagctgttgtagtcactaccgagtctcaactctcgctttgtcctatgaccagttcctccacctcaatgaaaccaggtaactgtggtaaagttttctgtagttctaactctctggatgcaagtgcatggattattgactctagggcaacaaaccatatgacctttgatcccatggacttctcctattcaactccaccacgtagaactttcattgtgaatgcagttgcatacccagtcacaagcgttggaactatggcattatcaccctcactctctttatctcacattctccttgatgttctcaacaagaagattattgggtgtggtactaagagaagggggctatactacttagatgattttagcaaaggagaagcacatcatgtgcaccatcagtccaataacaaagaacaagaatatggttgttgcatcgtcacttgtattttggctaaaagccatagaacctcctatcatatgagtttgaataaaagtagtgttccttttgctctaatacattctgatgtgtggggaccttcccttgggactatcgtatctggtcattgttggttcgtaatatttgtcgataattgcacacgaatgacatggctttacttaataaagactaaagatgaggggagtttgttaaccatcgtttcaaagcatactcccaacaacatggtctccttcacgagacctcatgctcataaactccacaatagaatggtgttgtcgaatggaaaaatcatcatatcttggagacaacacttacctattgtgttgatgcttcaaccaaggatttttgttcatctccacaaaaaccaatgcaccaaacttgatgcatgtgctattaggtgcttgtttttgggctatggactacacaaaaagggctacaaatgcttggaccctaccaccaacaaaacttatatcaccatggatatagttttcctagaatctgaatctttcttttctcttatggtatccaattcaactttttacggggagttcatgaataaagagctaaattggtacttggtggttccatcatcaattgttgaaaagaaacaaattggagagcatgaatctaaagttgaaggagtaatccatgatgaacctatagaaatgcaacacttaaatataactgaagttgagagtgaagaggatcctcttactaatgaaggaactgctagtgaagaggttcccgtcaatgaagactatatcgatcaaggaagtcaagagccccctctctccataatatccgaccctctcattgagaacaatcctaaggtaagctctcctactatctcatcatctacttattctccaagatatgtattgcttgtcaggaacaaccaaggaaagccacccaatagatactgccctgatgtagaagaaaggcgatcaaaataccccattgcaaattatgtgtctactcaacatttatcaaagcctattcaatccttcacaatgacattattctgctgtcatattccaaagaatgtggaagaagccttagctgatcccaagtgggcacaagccatataa

SEQ ID NO: 51526 - DNA, 246 bp, Glycine max
  Peptide Sequence Number=SeqID_168304
atggcgagaactgattcacacacaactatcattgatggcctgggtgttgctggatggggagttagtggaatagaagcagaagctgcaatgcttggccagacttgtgtggttttggccattggagaacttattgtaagaaatatttatttatctcatatttttgcagcccatgaccatggtcctaccaggattttggtggctgttttgatcgtatatgagagagttggtggctgttttggtgcataa

SEQ ID NO: 51527 - DNA, 99 bp, Glycine max
  Peptide Sequence Number=SeqID_168305
atgactagtgtgcccatggctgaaagattgacatgctacagtaacaacgacggtgttgaaggtgacgacgctttgcccatgcaagggttacaacaatag

SEQ ID NO: 51528 - DNA, 279 bp, Glycine max
  Peptide Sequence Number=SeqID_168306
atgtcgaaaactccaaaggagaaagacgcggaggagcctttgccagaccacctctggtgcgggcgcaccgacaggcggcaatggcggtgccgacgaggtcgccaccaccagtacaagaagaaggttcccaagtcactgaagcttcagtgcaagcgcaaatcgaacaacaacaaagaaggggaaccaaagcctaacaacaacaacaatgttctcaaagacaatgttgaatctaatgcacggagaacctctagaatcatgaagaagaagcacatgctttaa

SEQ ID NO: 51529 - DNA, 900 bp, Glycine max
  Peptide Sequence Number=SeqID_168307
atggatgtgttctttgactcagtggatagtttgtcaactcaagattctgttttagccaaagaagagtttggttctggaaggtgtggttatgacgaaatttgggtgaaggagcctgttagtgtgaaggagaggagggaacgttttctgcagggtttgggcttagctgattcttcttccaaggtttgttcacaagagaaaatgaacttagatgactcatccatcagcttgggattggagaggatcagggagtgcagtggggcaatctcaaatgcttgcattttgcatactgatcaagtagtatctgagaagttgattctctctggaggcaaagcagcttctaaagaaaaaatctctttggatgaattcaaagggtgtccccaagatgaagcagaagcaaacattcaaggaaaagagcatgagttctcttctacagctgaggagcacagacccagagaagctgtttcacaagaagaatttcaggattttgatatgagtaaaagaaagaggaaaaactggtggaagcgctttgtgaacatcaggaaaagtggtgaaggaaatattctcctttcatcttctatggacaagactgttcgcttgtggcaaattggttgtaatcaatgtctaaatgttttccatcacaatgactatgtgacatgcattcaattcaaccctgttgatgaaaactacttcattagtgggtccattgatggtaaggttcgaatatgggggatacgtgaagagcgagttattgactgggcagatatacgagatgccataagtgctataagttaccagcaagatgggaaaggatttgtagttggttctgttacaggcacttgttgtttttatgttgcttcaggtatgcacctcttgtttaacaaatactatcaattactgtaa

SEQ ID NO: 51530 - DNA, 537 bp, Glycine max
  Peptide Sequence Number=SeqID_168308
atggagtcaaacaacatgccagacttgaacggtgtcgctaagaagactaaaggtcgacaaaagatcgaaatgaagaagatgagaaacgagagtaaccttcgggtgacattctcgaagcttcgcactggggttttcaagaaagccagtgagcttgcaaccctttgtggcatggatgtcgctgtgattatgttctcacccagtaatcgagtattttcgtttggcagtcccagtgttgattctgttgtccaacgctataagacacaaggcccacctcccctccttaccttggacctcaacaaggtgcactccactgtggacgaagttgagctccacgcacacctccactgcttgtccaaccaaattgctattgagaagaagcgcacaaaggatttaaatcatttagcgaaggctgcagaggatcagttctggtgggctaggcctattgaaagcatgaccgattcccaacttgacaagtataagaagatgttagaggagtttaagagacaactcaaagaaaaacgtgggaacctaaattga

SEQ ID NO: 51531 - DNA, 900 bp, Glycine max
  Peptide Sequence Number=SeqID_168309
tgggcaattcaacctcccacaccaccagtctcgccgttcgctcctcttattccgaaatgggctcttcccctgagcccatcaatttcagttgttggcaggaagccagggattccgtccatgtctcacttgagactctcaatgaacgaaagtagcaagccatcatttaaatggcgaagggttttgctcaaagtcagcggagaagcacttgctggagaccactctcagaacattgaccctaagataaccatggccattgcaagggaggtggcagcagtgactcgccttggcattgaggttgcactggtagttggtgggggtaacatcttccgtggatcctcctgggctggaagtagtggactagaccgctcatctgcggattatattgggatgttggccactgttatgaatgctatatttcttcaagcaacaatggaaagtattggcattcctactcgggtgcagactgcatttcgtatgtctgaggttgcagaaccatatattcgcagaagggctgtgaggcatttggaaaaaggaagggttgtcatttttgctgctggaactggtaatccattctttaccacagacactgctgcagcactccgatgtgcagaaattaatgccgaggttgtactcaaagcaacaaacgttgatggagtttttgatgaagacccaaagcgtaatccacaagcacgtcttcacgagacactaacctatcaggaggtaacttccaaagatctgtcagtgatggacatgactgccataactttatgccaagaaaataatattccagttgttgtcttcaatcttaacaaacctggtaacattgagaaagctattaaaggagaaagagttggcactttgattggagcaacctggaattctaccgtatcaagaacatga

SEQ ID NO: 51532 - DNA, 234 bp, Glycine max
  Peptide Sequence Number=SeqID_168310
atgctgacatctccagggaaggtgcagatgaagatgttagtcactgcatgctatcgggctttgagtcttacggatagcaaatgggtgtgtatgggttaccgtatagggcgtctccgcgtgccaatggactcacaggtcacaatagcaaaaagtggggtggtcgacaaaagcgaggcttttgctcctacatatcctcaatttatgatgaggaactctgaccaacgtagttgttga

SEQ ID NO: 51533 - DNA, 627 bp, Glycine max
  Peptide Sequence Number=SeqID_168311
atgaacccgccggaattcccctccgccgccgccggaacatcttcgccgccgggaaagaaagagctccagctccaagggacacgcccgccgccgctcagagtcagcaaagactcccacaagatccgcaaaccgccgcttccccccaccgcacaccaaccggcgccgccgccgccgccggagcagcggaagccggtgatcatctacaccgtgtctcccaaagtcctccacgtcaccgtcagcgacttcatgaacgtcgttcagcgcctcaccggaccctcctccggcgcagaacccaatctccgagccggcgacgtatcgccggcggcgagactcgcgtcgatcgagagaacgagcccgtcggagagggagaaagttcgcagcgaagacaacgacgtgacgttgatgttagaaggagtggaagtgggtcaattccccggaatattgtcgccggcgacgttgcccccgatatcaccagggtttttctcggaatcgcaaacgacgtctttttggaatgacttgagccccttttggtcaacgaccagcttcattgcgagtccgtcggggctttttcccggcaacgtgatgtctccgctgccgtcgccggacatctttaatctcttttactaa

SEQ ID NO: 51534 - DNA, 732 bp, Glycine max
  Peptide Sequence Number=SeqID_168312
atgagtacacagtcatcatctgtgtcgaatgtttttcgtcattcatcttcattgttgtcatgctgtcagggcccacctaatttcttgggatgcgcagtaacataccaatttctggcggcattccgtgttgacaggaacctcattgaggtaccatcattatatcataggcaatggacttcgcattacccaccttatgtgttgttcgattacaatggagacaagcactttataaagcttagaaaatttggtaatagatactacttttccgatggacttaaggacttcagaagaaccatgggcattcataaaggtgtcatggtcagttttgctgcacccgacaaaaattggagtttccatctccatttcattccaccactgcatagacaaacatgtggaagacctcccacaatcaccagaactcatgtctttactgtagatgttagccactgtatgatctcacgtccttatccattgttcctgccattggatgctctcaattctgttaatgcatcaacaaaatatatcactgtgcaatgtagtagtggtcgtcatcacctatggaagatctccatgcataatgggctacaatctcttgctgggccatggtaccaattcttaacagaaaatgacttgatggccggagatgaggtcatgttctattaccagcctaaccatgtatgggaggtcctcttcaggaagcagctgacatggcatgaagatgagtccagttga

SEQ ID NO: 51535 - DNA, 201 bp, Glycine max
  Peptide Sequence Number=SeqID_168313
atgtctactgggactaagattttatttgaccagctaaccgaggatgctatgaagctgatggagaatgatgtttatcatgaaaagcaagaggtttttgatcgtgaagcagctaaatatctgcctatgcacgcggttgatttcacgaatatattcaagatggcattgactgggctaaagttgaatttgaagacaacaaagtga

SEQ ID NO: 51536 - DNA, 243 bp, Glycine max
  Peptide Sequence Number=SeqID_168314
atgaaaagatttttgttgaggttgacaggagaggttttgacatcaattgctaaagataggttggttacttcggatgggagtgtaaacatgagagagataatggctaggctatctgacaccccaatgttgtggatctcaaggtggtttacgaagaggaaggttttgttcattggggatggagctttgtgctggaggcgagctgtttcacagattagagaagcatggatggttttcggaatctga

SEQ ID NO: 51537 - DNA, 138 bp, Glycine max
  Peptide Sequence Number=SeqID_168315
atgtatgtcgggatagataaatggagatcgtcaatggcggccacacccaccgatgtcgatgactctggtgacggtgaggtctttgaggaaatggccgttgatgaccaaggtcgatgctgtcatagggtccaatcgtag

SEQ ID NO: 51538 - DNA, 348 bp, Glycine max
  Peptide Sequence Number=SeqID_168316
atggagagggagtggggagaggaggaaggtgtaggtctacaaggtaggaagaaaagagagaagggaagaaaggagaagaagaaccaaaaaagagaaagagagggaggaaagaaaatggatttgaaaagggaaattcaaaatttaataggttttctcaccatcccacgagtcatgaacgaactttgcggcagtgcctcactcttcggcaacgtggtgtttccctctctggcaacacagcagcttcaaggaagacaagccgcacgagacattatgtctcaacaaggccatgtattcactactaaaaaaaaaagctttcaacatcgcccaattaacatcggttatagctaa

SEQ ID NO: 51539 - DNA, 471 bp, Glycine max
  Peptide Sequence Number=SeqID_168317
atgtccctgcttcccaaaacagagcaaaacgacgtccccgtcgtcgacattgacagcgacgaaaacggcgtcgccgccgtagctcctgcaaaaaacgacgcgtcgtcgcacaagactccgtcgccacaagttgagcttgtgcagcaagaaacccctgcgtcgggttccgctctgtctgcctccgacggcctgtctcgaagcttctggaaagccggggactacgttgttggtccctcctcaaagcccactcccttccaaggcccaaaagttaacccttattcttctttctcctccaaaccctgctattcaagcatacccgtaactgttttcactccaattgcaggtcacttggaacatgctcgggtgcaccccaagtttttgcattctaatgcaacttcccataaatgggcttttggaggtgtggtttctctggctctcttgtgtttgaacaaattttgggatttgatttga

SEQ ID NO: 51540 - DNA, 321 bp, Glycine max
  Peptide Sequence Number=SeqID_168318
atgtctgttggactctttgagtttctctatgatcaatcacctgaaagcatgagaagcagtgctactgctttgtattgtatagtgatagcacttgggagctatgctggtacatttgttgtgacacttgtgcataagtatagtggcagtaaggagaggaattggttgcctgataggaacctcaataggggtagattggagtactattacttgcttcccttggaagagattgctgaagtgagcatggaaaaggatttggagttggaacaggccaattcaaaggtctcatgtgtcaattcgaaagatggtggagatgctgaataa

SEQ ID NO: 51541 - DNA, 303 bp, Glycine max
  Peptide Sequence Number=SeqID_168319
atgagattgtatggagaaaaggagaaaggaagtaaccagttgatagataagagaagcaatagtaatggtccaaaagcggccagcaaaggactcagcaatgagagcaccaagaagaggggtgaagctacccgttccaacaaagattgtgagaatgttggaggcagataccaatggcatgttcagcacttgggtaagtaccggttaacaagaccctatcaatatatcatagtagtaagaatatcatattcagggacggacagtggggagaaggaggggccaccaagaccctttgtgtatatatga

SEQ ID NO: 51542 - DNA, 264 bp, Glycine max
  Peptide Sequence Number=SeqID_168320
gtgattgctgaagggttcttggtgaatctgcgaatgaacggaacgaaaaggcgttcgtatacaatgactcctgtcatcatggttactatgagtaaaattcctgatgaggaaattggaaggattctgatgatggattttagctcctcaactctgtgcactgtggccaatttccacaagtttggtggtgcatttgggtctctggcatcctcccctgtgacaattgctgccttgtctaaccatctgtggatacatattgagcattag

SEQ ID NO: 51543 - DNA, 459 bp, Glycine max
  Peptide Sequence Number=SeqID_168321
atgacaaaaaatggtgtggcatctaggaaatggaacctcttcaattggtactttttcagccttggattggcttctcttagtgccttgaccattgtggtttacattcaagacaacactggctggggttggggctttggcataccaactattgtcatgcttgtatccatcatagcctttgtgttgggctcaccactttataagactgagaaaccagaagggagccctttggttcgtttggcccaagtgattgtggcagctataaagaagaggaatgagactttaccaagtgatcccaagtttttgtaccaagatagggacctcgatgctgctatttgtttggaaggaaggctcttacacacggatcaatttaaaatggtcaatcccgaatgtaaaattacatttcgaaatgcacttccttttttggcttccggaattatcattccagagaaggagtgttag

SEQ ID NO: 51544 - DNA, 870 bp, Glycine max
  Peptide Sequence Number=SeqID_168322
atggccgaatccacttgctccaaatcagccatggaacgattggaggaagctctagccaaattggcatcaaatgttactaagaaacttgatgactttctccttcgtgttgcttcccttgaaaccaatactcatcattcaccatctctttcatcttcctccgctatccctacaccaaatccacaaacacttagccaacccaaaatgaagctcaacctcccacaattcgatggttcaaacccctcagcttgttttgcccactcaccatacaaggatcctactggactcctcttcaagctcacacaaaaagggaccgttagagattacttgaaccaatttgaagccctcaccaacagaatcgtaggattgccccctccttttcttttgagctgctttgtatcgggtcttgaccccgagattcgccgtgaagtgcaagcacttcaacccatgtctctggtgcatgcaacgggtttggctcgcctacaggaggagaaactccttgaaggtcgtaaaggtcctcgcagtcgcttatctccgatgcttaacccctcatcacacccctcaccattctcgatactaatccttgttcaatggaagggattatttccggaagatactacatggaagaagtgggaggagcttaaggagaactacaaccttgaggacaaggttgttttggatgttcgtggggatgttatggaaggggagcagaacatggaacattatgtagcaacaaaacaaaatacaaaatcgaaagatgcagaagaggcagcaaaaacagaacatgcagaagaaccaaacaaggaagaatgcagaaagtcaaaaagggaaatgaacaagcctcagtacctggaggactatgcactgaagtaa

SEQ ID NO: 51545 - DNA, 156 bp, Glycine max
  Peptide Sequence Number=SeqID_168323
atgagtgcaaagactgcaaaggacgagttgcagaaatcaatagcagatatggagatagagaagagcgaggtggcggtgaaagaagagacacggaaacgccagcatcgtcgtggaggaatccgaacattgcctttcatccttgtccatgacgactaa

SEQ ID NO: 51546 - DNA, 151 bp, Glycine max
  Peptide Sequence Number=SeqID_168324
atgactcagattgtagagagtgaaaaggagaggatgagaaaccagttcatagatgaaagaagcgacaacaatggtccaaaatcggccagcaaaggagtcagcaatgagagctccaaagagaggagtgaagctagaagttccattaaagttg

SEQ ID NO: 51547 - DNA, 1164 bp, Glycine max
  Peptide Sequence Number=SeqID_168325
atgggatggggttggggccttggaattccaaccattgccatgctcatatccatcattgcctttgtgttgggctcaccgctctataagacagtgaaaccacacggtagtccattggttcgtttgacacaagtggttgcagctgcgataaagaagaggagggaggctttgcctgaggatgacaagcttttgtaccaaaattgggagcttgatgctgctatttctttggaaggaaggcttctacactctgatcaattcaaatgtttggacaaggctgcaattgtgacaaatgaagagggtagtgatccaaatgcaccaccaaacttatggaaactagccacagtccacagagttgaggagctaaaatccatggttagaatgcttccaatttgggcctcaggaatattgctcataaccgcttcatcaaaccagcagagttttgtgattcaacaggctcgcacaatgaacagacacctctctcactccctccaaatccctccagcaagcatgtccatcttcaacgtcctaaccatgatggtaggcgtcgttctctacgaacgccttttcgttccctttgcttttagactcacaaagaacccttctggaatcacatgcctgcagagaatgggagtaggttttgtggttagcatctttgccacactagtttctgcattggtggaaatcaaaagaaaatcagttgctgcaaagtacaacttattggacagtccaaatgccactattcctattagtgtgttctggttggtgcctcagtattgtcttcatggtgtggctgaagttttcatggttgtgggacatttggaatttctctatgatcaatcacctgaaagcatgagaagcaccgctacagcgctatactgcataactactgccattgggaactacgttggcacactattggtgacattggttcataagtattctggcaatgagaggaattggttgcctgataggaacctcaataggggtagattggagtgctattattttcttattagtgggattcaggttgtgaatcttatttattatctaatatgcgcttggttttatacctacaagcccttggaggaaattggtgatataaacaagcaagaagacatggaaaaggacattgaaaaaatcaaacatgtaaatttgttagaggggtag

SEQ ID NO: 51548 - DNA, 153 bp, Glycine max
  Peptide Sequence Number=SeqID_168326
atgtcagacatggatactgtagagaacagcattagaggcaatggcgagatagccgagaaagaagagcaccaacaccataccagtaagacggagcatcgacgaggaggcatcagaaccttacccttcatccttggcagtcctcgggaaagctaa

SEQ ID NO: 51549 - DNA, 174 bp, Glycine max
  Peptide Sequence Number=SeqID_168327
atggaagaaaaagaagaaaaggagatcggaaaacgctatacggacctgtgcctcttaggaggacttatggtgcacgtagggcttagaagggaagaagatgttgatatgctttccggaacattgagactcctacacttaatcgaagaaaatcaaacctttcgttatcatccttaa

SEQ ID NO: 51550 - DNA, 469 bp, Glycine max
  Peptide Sequence Number=SeqID_168328
cgggctatccacaagcattagttctccccctgacctgcctcccaacctcaagatcatcagcggacgacgccttcttccgaaagtcctccctctttgctttgccccagcgaaagagactgaaaaagatccgtatctgattcctcgggtcttgctgcgtcagctaccggtggaagttcaaagcatcgaagatgagtacatggaagcaccaatgaagaaagaagaagcatacataagcggcctctttttctcaccggtgacatcggcgaaagaaagaaggctaccgcgggtagagatcgaccctggggcctccatcaacgtgatgccactgcgggccctagccgatcttggaatgaattcctacgagccggctaagtcagaccaaggttactattccggggtacaatgccgactcgcagccatcggcaagattcgtctcttgtgtgtgccaaacatgggatctgaagactga

SEQ ID NO: 51551 - DNA, 498 bp, Glycine max
  Peptide Sequence Number=SeqID_168329
atggaacagacaaattataccaacaaatatttgcaagttttaggagagtctatcataacaaagaaaatttccaaacaaaaatctcctgaagaatctcaatcaaacatccccatagaaaaacccttattcatacctttcaaaattagcgacaaagctaaacagaagattagggaactaagaaagaacaagtctcttatagaaggagtgggtgaaaacaatagtgaattattgaacaagcttgatagtttacttatagtcatccccgaaactccccaaccttcggaaggaacatcgagaatggtgacaagaagtacctccaaattaattaatgttattaatgaaaatagtgaccaaaactcaaaaaacgctgtagaagcaaagcttcatgatgaatcaagaatgattcaaagatgtcttgatgataacaaaggtgatgacaaaaagctcaaaggtcaatcaaagaatgagttcaagaaagatagaatcaagaaagaatga

SEQ ID NO: 51552 - DNA, 743 bp, Glycine max
  Peptide Sequence Number=SeqID_168330
atggggacaaggggttgcatcagctacaatcccgttcttgctataagacaacttggctatcctatgagaggagcaccactagaggaagagatcgtgcctgtccgcaaggcatggggggtggtacaaaagaaagacaaagagctcagaggcagtgggcctattggtggctaccgtgagtggttgaaagcccacgtgcaaggtttggattggctcccaagtttgagaaccgctaaaagggaggaagttgaggcaccggaggaagacgaagaggagaatgccgaactaagggatgtaaatgtagctaccaccaaggcattggaacaaaagaccaagagggctcgtagggaagagcacggccggaacaagttccgaggggctctatggggtagtaataacgagcttaaactctggagggaggaaagggaccaatcgcgagtagacagtttgatcttgaaagatgaattgaaggcttgctcgaggtccaaaagaagtttgtctcagcggttatgcgagacagagaccaacatgttagctatcatcaccaagtaccaagaggaactaagtctagccacggcccacgagcatagagtggcggacgagtatgcccaagtgtacgcggaaaaggaggctagaggatgggtgatcgactcgttacatcaagaggcaacaatgtggatggaccgattttctcttactttgaacggaagccaagaactttcccgattgctagccaaggccaaagc

SEQ ID NO: 51553 - DNA, 176 bp, Glycine max
  Peptide Sequence Number=SeqID_168331
atgccaagatggcacaagcatgcttcccaaatgaatgaaacggctccgaggaagctcccctcaaagagatccaggaaggataaggcggtcgaaggaactagttctgctcccgagtatgagagtcaccgttttaggagcgctgtacaccagcagcgcttcgaggccatcaagggatg

SEQ ID NO: 51554 - DNA, 537 bp, Glycine max
  Peptide Sequence Number=SeqID_168332
atggagtcaaacaacatgccagacttgaacggtgtcgctaagaagactaaaggtcgacaaaagatcgaaatgaagaagatgagaaatgagagtaaccttcgggtgacattctcaaagcgtcgcactggggttttcaagaaagccagtgagcttgcaaccctttgtggcgtggatgtcgttgtgattatgttctcacccggtaatcgagtattttcgtttggcagtcccagtgttgattctgttgtccaacgctataagacacagggcccacctcccctccttaccttggacctcaacaaggtgcactccactgtggacgaagttgagctccacacacacctccactgcttgtcaaaccaaattgctattgagaagaagcgcacaaaggatttaaatcatttagcaaaggctgcagaggatcagttctggtgggctaggcctattgaaagcatgaccgattcccaacttgacaagtataagaagatgttagaggattttaagagacaactcaaagaaaagcgtgggaacctcaactga

SEQ ID NO: 51555 - DNA, 1662 bp, Glycine max
  Peptide Sequence Number=SeqID_168333
atggttgcttctctcttctacctttctctttctctttccctcatcctaaccctctcctccgccgcgcaccacaaacccccccactcaccgtccaagccaccggctaaccccgccgtgaccgccgcctccccggcaatcgaacaagcctgcgccgcgacgctcttcccgcagcaatgcgaagcctctctctcccaatcccagaacctccctccgaacccgacccctctccagctcctccagtccgccatcgccctctcctccgataacctcgccaccgcgcagaccatggctaagtccctcctcgacgcctccgccgacagccgcaaccgcaccgtcgccgccgccacctgcatcgagatattagccaattcccatcaccgcatttcccttgcctccgacgcgctcccacgcggcaggaccaaggacgcgcgtgcgtggctgggcgccgcactcgcctaccagtacgactgctggaacagcctaaaatacgccaacgacacccaaatggtcggcaaaacgatgtcgttcatcgataacctcgaaattctctccagcaacgccctcagcatggccttttccttcgatgccttcggaaacgacatcgcttcgtggaagccccccgcgacggagcgcgtcggattctgggggactgtggggtcgggtgggcccgggcccgcgggaggggttccgttgaatttgacgcccgacgttacggtgtgtaagaatggaggggatggctgttataagacggtgcaagaggccgttaacgccgcgccggataacggcaaccgaacgaagaggtttgtgatacacattaaagaaggggtttatcaggagaccgttagggttccgttagcgaagaggaatgtggtgttcttgggggacggcatcggcaagacggtcatcaccggcgacgccaacgtcgggcaacaagggatgacaacttacaactctgccaccgtcgcggttcttggcgatggattcatggcaaaggatctgacgatcgaaaacacagcaggtcctgacgctcaccaagcagtggcattcagattagacagtgatctttctgtgattgagaattgcgaattcttaggcaatcaagacactctctatgctcactcactgcgccaattctacaagtcatgcagaattgagggcaacgtggacttcatctttggaaacgctgcagcaattttccaagactgccaaatcctagttcgtcccaggcaagtgaagccagagaagggtgagaacaatgctatcacagcacatggcagaacagaccctgcacaacccacaggctttgttttccagaactgcttgattaatggcactgaggaatatatgacattgtaccacagcaagcctcaggtgcataagaactatttgggtaggccttggaaggagtattctagaacagttttcattaattcgttcttggaggtccttgtgacaccccagggttggatgccatggagtggtgactttgctctcaagacactttactatggggagtttgagagcaagggtcctggctcttatttgtctcagagggtgccctggagtagcaagatccctgctgaacacgtgttaacgtattcagtgcagaatttcattcaaggaaatgattggattccatctattggtagcccatcgtcgtaa

SEQ ID NO: 51556 - DNA, 360 bp, Glycine max
  Peptide Sequence Number=SeqID_168334
atggcggactggaggagctggagaggggtcgggttcggagggaggttctgggattgggagagagaggcttcgcattgctgcgggaagagcgtcgcggcgcaggcttgttcgattgccggggaggcggcggtcacggcggggttagccggtggcttggacggtgagtgggggggtttgtggtgcgcggcggaggagagggttaggatgagggaaagagaaagagaaagtagtatctggtggctgtggtttttgtctcgtgaccgtggattgagaaatggtgtcacggacgggaatggttcagggagacatcacgagatggtgttggaaatgagtgaatgcgacgtggattatgatttatga

SEQ ID NO: 51557 - DNA, 1743 bp, Glycine max
  Peptide Sequence Number=SeqID_168335
atgaccatttgcggcacttatgtaacgcttctgtattctccaaaggtttacaacaacaaccatttatcaagctctggctccgggccaaattttgtgaacaggtggatatgggatggtttagatcctcggtatgtatcgaatgtagatattaactggggtgatatattgcaaattactgcgaaactgacagggaaaaaagaatttcaaggggttggacttgtaaacttcaacaatactgaactagaccattgggaacagcttattcctaatgccacacatgttgttctggagctagagtatgctgcaaaaaatgtgacatgggaatccctatacccagaatggattgatgaggaagaagaaaccgaagtcccggtttgtcattctcttccaagtcttagatctcctggaataaggctcaatctcatagctgtgaagctggctcatgtcaatggagggaattggtctagagatgttgctcggttgcacttgcagttagcagtagctaggcttgcaacctctttcaaaggcaattatcccgtgtacgtgctttttgttaccaacttctttccaatacctaatttgtttacctgcaaagaacttgtgggacatgaaggggatgtgtggttatacaaaccaaacttgaaagttttgggagaaaaactccaccttccagttggatcttgtgaacttgcacttcctttgaggggcaaagagctgagttatgtgggaaatgttcgtagagaagcatatgcaacaattctccattcagctcacgtttatgtttgtggagctattgctgctgcacaaagcatccgcatgtccggttcaactcgagacctagtaatacttgttgatgagacaataagtgagtaccacagaagtggtttagaagcagcagggtggaaaatcaggacaatacaaagaatcagaaatccaaaggctgaaaaagatgcttacaatgaatggaactacagcaagttccgtttgtggcagcttacagaatatgacaagataatattcattgatgcagatttgctcatcctaagaaatatagatttcctatttggaatgccagaaatcactgcaactggaaataatggcactcttttcaactcaggtgtcatggtggttgagccatcaaattgcacattcaagctcctcatggatcatattaatgagtttgagtcctacaatggaggggaccagggatacttaaatgaaatattcacatggtggcacaggataccaagacacatgaactttctgaagcatttttgggttggtgatgaggaagagaagaaacaaatgaagactttgttatttggtgcagaccctccaattctctatgtgcttcactatctaggaatgaagccatggttgtgcttccgggactatgattgtaactggaacagtgatatctttcacgagtttgcaagtgatgttgctcatggaaggtggtggaaggtgcatgatgcaatgcctgaactcttgcaacagttttgcatgctgaagtcaaagcagaaggcacagttggaatgggatcgtaggcaagctgaaatagctaactacacaaatgggcattggcaaattaaagttaaagataagaggttgaagaaatgcattgataacttgtgctcatgggaaaacatgttgaagcattggggagagaccaattggactgatgatgagtcttatactccaactccaccagccatttccacatcatccctttctgatttgtga

SEQ ID NO: 51558 - DNA, 432 bp, Glycine max
  Peptide Sequence Number=SeqID_168336
atggaaacaaaaacaataactgaaagggtgcctagtgatcaaggccgaaaatcccagggccctgttggacctctccgggtccaaagggtgcctagtgggcgccgcccctgcaaacaaataaatggcgttagcaattatctgggccacgcgaacagtcatccgtgtcaagatggtgtacaccatctggcacttaggcagagggagcgtcatccatatctgagtcagagtagtcatgctggtgcgcataatccacacccgcctccccgcagcggtctgggcaaagtcttgcacaacagctgggcgatcgcctcctcgtcaaagccggaggcctggtccctcctctggctgaattcgcaccgttggttctcctccaagatcagtgggtggcctaggaactggctgagggcatctgtgccaaagggaatccactga

SEQ ID NO: 51559 - DNA, 237 bp, Glycine max
  Peptide Sequence Number=SeqID_168337
atggcctcttttgtcgtcacagctacaaagcttggtttaatggcattccagcgcctttggaagcaggattcttatattggatcgagaatgctaatttcaatagcatctttttggagtctatcaaggccaagaaattccagaacaatgaacaatgaagctggagacattcttcctaaatgtgctctgaagttaccttcttttgaaaactgttgtgttcaatttggaaaatacacttga

SEQ ID NO: 51560 - DNA, 790 bp, Glycine max
  Peptide Sequence Number=SeqID_168338
gcagcagtatggtgctcgtgacccgtccctccattctggtatacagacacgcaagattatattgactaagacgggtgttccaagacggtgcaggaggccgttaacgccgcgccagataacattaacggcgatgaccgtcatcaccggcaacgccaacgtcgggcaacaagggatgacaacttacaactctgccgctgtcgcggttcttggcgatggattcatggcaaaggatctgacgatcgaaaacacgggaggtcccgaggctcaccacagatcagacagcaaccaagacactctttatcctcactcactgcgccaattctacaagtcatgcagcattgagggcaacgtggacttcatctttggaaacgctgcagcaattttccaagactgccaaatcctagttcgtcccaggcaagtgaaaccagagaagggtgagaacaacgctatcacggcaaatgcaaggcaagaccctgcacaacccacaggctttgttttccagaattgctcgattaatggcactgaggaatatatggcattgtaccacagcaagcctcagggttggatgccatggagtggtgactttgctctcaagacactttactatggggagtttgagaacaagggtcctggctcttatttgtctcagagggtgccctggagtaggaagatccctgccgaacatgtgttaacgtattcagtgcagaatttcattcaaggaaatgattgggttccatcacctgttggtagcccaactgatcacagcaagtttggagccatcactaaatag

SEQ ID NO: 51561 - DNA, 420 bp, Glycine max
  Peptide Sequence Number=SeqID_168339
atggagtcaaacaacatgccagacttgaacggtgtcgctaagaagactaaaggtcgacaaaagatcgaaatgaagaagatgagaaacgagtattttcaagaaagccatcccagtgttgattctgttgtccaacgctataagacacagggcccacctcccctccttaccttggacctcaacaaggtgcactccactgtggacgaagttgatctccacacacacctccactgcttgtccaaccaaattgctattgagaagaagcgcacaaaggatttaaatcatttagcgaaggctgcagaggatcaattctggtgggctaggcctattgaaagcatgaccgattcccaacttgacaagtataagaagatgttagaggagtttaagagacaactcaaagaaaaacgtgggaacctcaactga

SEQ ID NO: 51562 - DNA, 1227 bp, Glycine max
  Peptide Sequence Number=SeqID_168340
atgggattttcatgcgaggaacctgtttctggacgcaaaggttcaaataaggatgatattgcgaatacaaattacggagtttgggatgcaacaaatgcacaagacactgatggaagttacaacatgcagatctctcctgggcttgatgaggattataaaaataagtgcaatcaatccctaaaagatggctgcagtaaactattcaggagtaggagtcggagccctccacgtagttttaggtgggattcaggtagggttggaggattgacacaaccatattgtagagattttgttgctgggaaatgcagaagaggcaaccgatgtcgtttccttcaccatgacgatcaaaattatggtaatagctgggaaaatagacacatatattctgctccaaatgaaaataataactattctcgtacaattggaagatcatataatagaacttgcttccattatgcacaaggaaggtgtaaaatgggagcatcatgcaagtatgtgcatcatgacaattttgatagaaggcgcacagagagttgtttagagcagggtgttcaacatggttcaaaccagaatagattgcatggtgaatcaacattttcaagtgatatcaagaaatccaattgggctgcaaaaaatgatagtgccaacgttcacacttcccagacagtaggtgcagacatttggcttgataatgaaaaaatgtctcctcctaattggatttatgatgtgagatcttccatccatattaaccaagagcaagggcagagtaagcaacaagttgctccaggacaagtattgcatcagaatgtttctaaaacattcatcaagccagagcctgttgttagattcccgaagcagcgcgatccaacatgtaatagtagggagcaaaagaatgttaatgcaactgggggggtgtcccttgcctattttccaaatagacaacttgtgaagaatgagcatccagttcagttgaaggggattcatacatttaaattttcattggttgagttcgttaaggagcttttgaatccaacatggaaagatggtaaaatcaccaaagaagattataaagcgattgtgaagaaagttactgacaaagtaattgatacagtgcaaggggcacatattcctcagacacaagagaaaattgattgctatttatcatcatcaaaatcaaagcttaacaaacttgtacaggcatatgtggaaaagtttcagaaggcttag

SEQ ID NO: 51563 - DNA, 778 bp, Glycine max
  Peptide Sequence Number=SeqID_168341
atgaatggaaacggtggatttaacactcacttaccagtgtttgatggtaagaactggagtcgttggtcaatacagatgcgtgtgttgttcgaagcacaagatgtgctcgaatttgtgaatgacggagttccggatttggcggaaaatgcgacggaagcgcagaggaatttgcatcgcgaaaagaagaagaaggatcagaaagccttgttctacattcaccagtgtgttgatgcaaagatctttgagaagattgcggaatcgacgacggcgaaagctgcttgggacacgcttgtgcgttgctatggtggtgatgcaactgtgaagaaagtcaagcttcaatcactgaggaaacagtatgagaacctgaatatgaagcacaatgagaaggtagctgattatgtgtctcgcataattactgttacgaacgaaatgaagacctgtggtgagacaatttctgagcagatgattgttgaaaaggtactgcgttccttaactgctcaatttgattatatagttgttgctatagaacagtctaaggacactagtacaatgaagattgatgaattgcaaggtagtttagaagcacttgaattaagagtaattgaaagaggaaatggaaaagaaacagatcaggctttgcaagcagcatctaaggaaaagtggcgtgaaattaagaagaaacagtggttagataagaaggctaaacagaatcccaatagtagtgataaggataaaggaaaatcactggctgataaggcagaatcatcaaataaaggag

SEQ ID NO: 51564 - DNA, 474 bp, Glycine max
  Peptide Sequence Number=SeqID_168342
atgtggatcatcatttgcgattcatcaaagcatgtggatcaacctaaataccctagcagatcaacctatctacaatggtgtagaagtaccagaaagggaaatggcgcttaccttgacggtggatggtggatggtggcgaagatcttcatggcaacctcctcaatgcacctcatgaaagcctcttcacgacaacggtggtgggtgaagaagaagaggaaactcaactgttggtatgaccttttagaaaaaaaggattttggggctgaatgcttcacattatctgaaaacaagaggtcattttgttatttcaataaagtaaacatgacttccaataattctaatgttggtagtggaagtggtgatgttgttgctagtgggagtggaagtggattagtgtcttcctcaataccaaatgaaaatacagctcctttatggaattatgttacaaaattggataaaagtggagaagtatga

SEQ ID NO: 51565 - DNA, 904 bp, Glycine max
  Peptide Sequence Number=SeqID_168343
atggttaagactagaggattagaccatgcgttaggtagggttggtgccaggggtctgggtaaaggaggggatggtgatgatattgacggtgctcccctgcgccaaaggccgaccgcatcggcacgcaggcgacgggtaccagtcattcttgacgatgatgtgcctgtggtacctgcagactcgcctgcggtaccagaggcagaggctgttgtagctggggatgagcccatggtagatgctgccgcacaggacactggtgcagagactaacacacaggataccggtgcagagactaacggggatgagcctgtgggatttcatggtggacccagggacctatcagtgcttacagagtatgctgaccatgttgcgggcagcgtatggtctggacaggaacgtcttgagttgaagttatgctcccatgggaggaaggtgcataacttgggtgggcctgttcctgtaattgagaacatggttactgggacaagattaagttctttgatcgctttccatcttcctgtgggggaggtgtcgatcacgctggacaacgtcgcgtctcttctctatttgcctatcgttggcacattccatgacttccagcctctgtgcaccgacgaggcggtggtgttgttggttgagttactgatggtctcagcagaggtggccatggccgagacaggccaatatggtggaccatatgcgttccatgacctcactcttgttgggcggtatgcatggggagctgctggcctcgtctatatgtacgatcagcttaatgatgccagtctcaacaccagccgacaacttgttggttacatcaccttgttacagtgttggatatacgagcactttccgtcaattgcggagtgcaatgctaatccggactatgacgaggtgtcaccac

SEQ ID NO: 51566 - DNA, 267 bp, Glycine max
  Peptide Sequence Number=SeqID_168344
atggcaaaggaaatagaggggctggtagaggaaaaagagatcgtacctggacgtgcgcataggccaccatcatccccgtgcagtaccggaaacaggggacaccacctagcagtgcttaatggaagtttgaactctaaagcatctcatttctctaacaatggagcaatgtccacaacagactgggaagtgttcctggagatgatgagacttcagccatcagctcccacaacaacagatatcgtgatcatcacagacacagacaaataa

SEQ ID NO: 51567 - DNA, 1389 bp, Glycine max
  Peptide Sequence Number=SeqID_168345
atggacattggtggtgaagtggaagagaccgtgagagagttgaggcaatacttcaaaactggaaaaaccaagagtgtgacatggaggaaaaaccagctcacagctctcttagaccttgttcatgagaatgaagatgctatatttaaggccctccatcaagatcttgggaagcaccctgttgaggcttaccgtgatgagagtgatatcccttttcttttcttcccagctaaaggagaagtgttgtcagaaccacttggtgtggttctcatattttcttcttggaacttcccaatcatactgacattggatccaataattggggcaatatctgctggaaatgttgtagtcataaaaccttcagagcaatctccagcaagctcttcttttcttgccactaccattcctcgctacttggactctaatgccatcaaggtgattgagggaggaccagatgtctgtgaacaactactgctacaaaaatgggacaaaatattcttcactggaagtccacgtgtggcaagcgtagtcatgtctgctgctgcaaagaatttaactcccgttactctagagttgggtggaaaatgccctgccattcttgattcccttccaaatcctttagagtttaagttggcagtaaaaagaattgtaggaggaaagtggggaccttgcagtggtcaagcttgcatagcaatagactatttgcttgttgagaagaagttctcatatgctctgatagaattactaaagaagatcattagaagattttatggtgaaaatccagtggagtcaaaggtaatttcaagaatattaaacaagcagcactttgaaagattatgcaatcttctcaaagaccctcttgttgcggcttccatcgttcatggtggttcagttgacgaagaaaacttgttcattgagccaacaattttgttagatcctccgttagattctcagataatgtcagaagagatatttggcccactgcttcctataatcactatggataaaattcaggaaagtattgaatttatcaatgcaaagccaaaacctcttgccatctatgccttcaccaaagatgaaactttcaagagaaatattctatcagaaacatcctcaggaagtgtcgtatttaacgacacaatggttcaatttttatgtgatacactaccatttggaggtgttggccagagtggttttggaaggtaccatgggaagtactcttttgacactttcagccatgaaaaagctgtaatgcatagaaagctgttccttgaaattgagccaaggtaccctccttggagtaagttcaagctcgagtttatcagattggcatacaggctgaactactttggactattactgcacatgctgggcttgaaaagatacaagtag

SEQ ID NO: 51568 - DNA, 228 bp, Glycine max
  Peptide Sequence Number=SeqID_168346
atgaaaacggaggggagaaaggagacgaactcgtttgcggtagttgcagcttcaatcgcggcagagacgaactcgtttgcggtagttgcagcttcagcaacaatgctagcttcaatcgcgacaacgcagttgggaggaaagagaaagaaagaaggaacgaaatgggagaaaggacaagagggtttgagcgcgcaggggccaaaattaattcgggtttttaatttatga

SEQ ID NO: 51569 - DNA, 1794 bp, Glycine max
  Peptide Sequence Number=SeqID_168347
atggaaccctggcttccccaagacgattttctcctaaaaaacgccattgagggcggagcgtcgttggaatcgctggcgaaaggagcggttcggttctcgcggcggttttccgttaccgaattgcgggatcggtggcaggcgctgctgtacgacccggacgtttccgccgcggcgagagctgcgatggcgaatttggagctgacaaagtacgggggaggcacggggaccggcgaaggtggtggtgggaagaagaggaactctgaaagcattcggaagcattattctgcaatgcagaaaagactgcgccggtgccggcacggtgtggcgggttccgatgcaaagaacgcgactgaagggtgtgatggtttttctttgcctgatatgcctgttaatgttgaaggtaaaagtcacggtttggaagggagagtgaatttgaaaggcgagtgtggcaatggtgtgctgagattaaatgctcctaatgctgtgttgagagatgatgccaagaacgatttgaaatgtctcttcaacttggcaaatgaggatgaggttgtctttatggatctagttaggaaggaggtgctggctgcggataaggataagcctagttatgataatgtcgattcgcttctgttgagttctccctgtgatgttcagggtgatgatgatggccgtgagccattaggtggcggttgtgctgatcaacattgtgtttctgagtctggaaacaatgctggatcatctggtgctgtgcaaactcctcatgctgaacaaagtgagggttttatgatctgtgttcttaacaccgaggacactgacatcccgagcaatgacactacagatatacccattttagttcctgagttggtgcctctaaaattccaaccaattgttgaagagttgggttgtttggagtctatcataaataataaaaaaagaaatgagtcggatggaagcctggagaaagaagttgttctttctcagtcttctgcagctttgcaaacagttcggcaggggttggtgcctaatgtgaattcaagccaccgacctcttgttcttggactgaaaagtgaaaatccagggagaaactcgatatctgcagtttctagacagaataacaatgtcaatgtcaacatcaactcaagacatagcagattagttcgtgcaactgtgatgcctgcctcagatggacatctgaaacaagaggaaacaaatgctccatcttctgtacatgcaaaagctgaggaacataaggctttatctaaatcagaagcaaaaccgttatctcttgatcatgaaggaggtgatattgaagatggcgacgataatgataatgatgatgaacttcctaacttttctgatgttgaggaaatgattcttgaaatggatttatctccaatggatcaagagacaaatgctagtagagaagtcttgcgatatcaacttgatgaaagtaagaggactataatgagattggagcaaagtgctcagtcctctatgggaagagcaatttcatcccagggtgcatttgccgtagtgtatgggcgcatccttgagaaatacattaaaacaagcaaggttatacttggtagagcaacaaatgatgtacatgttgatattgacttggggaaagaagggcaagtggctaccagaatatctagaagacaggctgtaataaagttggaagcagatggttctttcattattaaaaatcttggcaagagatgtatcttcttgaatggaaaagaaattgctacaggacaagtgcggggtcttagtgctggtagtttgatcgag

SEQ ID NO: 51570 - DNA, 252 bp, Glycine max
  Peptide Sequence Number=SeqID_168348
atgaagaaaacagtaatcatattattaataactagcgttaattttatttcagctcaacagatatttcctttgaacacaagtaaaatagattatccaaacggagcctattataaagatttagatggagaacttaatcagtatgttggaacctggaaaggaaaagtcaatctgcaaagaatagaaaaagatggcacaataagtaatatcactttaaatagtactaatcaaccaactccagtaccttgttcttaa

SEQ ID NO: 51571 - DNA, 336 bp, Glycine max
  Peptide Sequence Number=SeqID_168349
atgaatttccaagtgaaccaatggtatgatcttcatcttgtaccaagtgatgaagaccataattttgaacctattgatcaaactcgagcaagaagagaagatgctaatacatggagggttttaacttcagcttcatgtgattgggaatcaaagaaggaagttaaagctcttagctccgttcttcaaaattttgaaagagcttcaagccaagctataggaataccacccaaaatgacaaaagttatctcttcctatttgggtgtgattgaatgtctagacccaggaaaataccttggtcttccttttatatcggggataaaaagaaggctatcttaa

SEQ ID NO: 51572 - DNA, 378 bp, Glycine max
  Peptide Sequence Number=SeqID_168350
atggcattgaacagatactattggcctactaaatataattcaagggctgatttcttgagacaaggagttaaatgtgtgtttatttcacatcaacaaaaggataaacaagaagctaaaaaaatagcagattacttaattaatgcagatttaaaagttaatcatcaatctaataatgctaaaggcgttactgactccataaaaagaggtatcaataatagctcacatatgttagtattggtatcacccaatactctatattcaacatgggtaccttttgaggtgggatatggatatgaccaaacagacttgtgtgtattatgtttaaaaggtatacctaagagtctacctgaatatttaaaagctgcaaaaattgtctga

SEQ ID NO: 51573 - DNA, 2556 bp, Glycine max
  Peptide Sequence Number=SeqID_168351
atgtcttcaacacctccctcaaatccaaaggaagacattccttctggttctggtttcaatgatccattgctcaacccttcaagtccttatttcatccatcctagtgatggtccttcatctgtatctattacccctatccttgacggaaccaactaccagtcttggtctcgtactttccgtatgaccctcatctccagaaacaagatggcatttctcctcggcacaaccccagtcccttcaatcacagaacctactctttactctgcttgggagagatgcaacactctcatcatggagatcttcttcgcattgcagagctctaggaagaaatatatggtctttctcaaggccaagaaataccatcagcgagattttgtcattagattcttaaaaggattggatgaacgattttctgttgtacgctcccaaatcctgcttatggacccccttccgatggtcaatcgagttttctccatggtggttcaacatgaatgtcagctcagtgtcgttcctccttcctctgatgaacccaatagctttgtcaatgcttccaatggctttggcaaaggacgtggtgtgtctggttcgtcgtccacccacaaaaacgcttccaataaaaggtgctcttactgtcaccgcaccggacacactattgatgtctgttgggggaagcacgactatccactaggtcatcctcgctaccctggccgcccacggttcaacaactcttcttctgccaatagcgctacttcagtcgacccagtggagaggccaactgcttcttcaggccctattactttgacacaagcccaatatcaatctctaatggccttgattcaacagcccaactctgcttctgatgcaatggggaacatccttgtccagcccaacaacgccaatctcattcaagttccttttaatgaaagaaatgattctgaccctaatgactatatctgtagctttgagacacatccaaatcaatcatcatcaacatgcttgtatcccctccaatctgttttgtcttattctaacatctctgagtctgagcatcactacatcatgaatttatcttttggggttgaacctcaaagttatcaggaagcggttttgagtccttgttgggttgaagccatgaaagatgaaattgaggctttaaaactcaacaacacttgggaaattgttgatactccagctggtgttaaacccataggatgcaaatggggtttctctcaagtggaaggaattgatttctttgaaacattctctcccgtggtaaaaatgaccactattcgtgtcatcctcactcttgcatctgcaaatatatggcagcttcaacaactcgatgtgagtaatgctttcctccacggtgacttgtctgaagaggtttatatgacaattcctcaaggattgcaaggccatgggtcttctcaaagttgcaaactcaaagaatctttatatggactcaagcaagcaagccgtaaatggtatgaaaagctttctgatcttctcatttcatctggttaccaacagtcacatgcagatcatagtttatttatcaaacacaatggagataaatttacagctttgttgatctatgtggatgatattgtcttaactgggaattctgctactgaaatggcccaaatcaaaaatattatcattcgaattttcaaagttaaggatttaggagcattgaaatactttctgggtttagaaataaatcattctgctgatggtatatatgtatcacaacgtaaatactgtcttgagttgcttgctgattctggaatgatgggttgcaaaccttgttcaacacctatggacagttcattgcggctgcatcaagatgattctagtgatcttcttgatgatcctttatcctataggcgtcttgttggtcgtctaatttatctcaccacaactcgccctgacattgcttttgcaacccaacaactcagccaattcattgctcatcccacaaagtctcatctaggtgctgcaaggagagtcttaagatacctgaagggttctccaagcaaaggtcttcaattcaagagggatactcctatacatttaattggcttcagcgatgctgattgggcgacttgtgttgacacccgcagatcaatcacaggttattgtttcttcattgggaactctctagtgtcttggaaaacaaaaaagcagaatacagtgtctcattcgtcttcgaaagcggagtatcgtgctcttgctacaagtacatgtgaactgcagtggctcacatatcttctcaatgatttaagaatatgttgttccatgcctgcatcattatattgcgacaaccaaagtgctctttacattgcctcaaatccagtgtttcatgaaagaacaaaacacttggaaattgactatcatcttgttcgagaaaaggttcaagcaggtctaatgcggttgctgccagttccatcctttcatcagcttgctaacatgttcactaagacattatcacctcatctcttcaagtcaaatgtatccaagttggagttgattgatctttatacacctctagcttga

SEQ ID NO: 51574 - DNA, 246 bp, Glycine max
  Peptide Sequence Number=SeqID_168352
atgtcaccacggagtattcctaacgtttatgcgagatctatcaccattctttcttccatctatggccctcccttaacagaacccgggaactgcaaatactacgccatgaataggacgggttatgaccaacctcagcgtccaaaaacttcccacttggctaaagattgggaagagataaatgttgaagcagtagttgggcactgcctgagcataagccttaagaagaacctctctacccctccatga

SEQ ID NO: 51575 - DNA, 2028 bp, Glycine max
  Peptide Sequence Number=SeqID_168353
atggcaccattgggaccttccaggcatgtccccgcaccactactgcctgcttggttaattggtccatcaaatgatagaattcatgatgaagagataaagatcttgatcggtagtggtgggcgctctacggtgaagtccgctaagactcgggcattgatggatcctcatttctcaaatgatattccaaattatattcaaataaatgcaaggaacaacaagccaagagccaagtgcagaaaggaatgtagggatgcagttagaaggaaaagggttctggccctcgaagccaactttttcatagcttttctctatcattttggtgcttttgttgtcatggctgactcctctagggccaaaggtacctcagataagctagaggatgttatccttaagctcacaaatcatcaaatttcgcttggagagtccatgcagttgttaaccctcaaatttgaggagctgcttcaacgcataccacccgtacccactgcctccctttcgttaccaccccttgcacctgctttgtctccgacacctgcatccaatcacagaataaaattagatgtaccaagattcgatggtactgatcctcttggttggatctttaagatcaaccaatttttcaggtatcatggtactctagagcatgatcatctcacaattgcttcgttttatatggagggcagagcccttgcctggtttcagtggatgaccaacaatggtcaattcacctcatggtcggtgtttctccaggctctccagaccagatttttgccctctcaatatgaggatcccactagggctcttttcaaacttactcagaaaggaaatccgacgagaggtccaggcactatagcttatgaccctggtgcaggcggttggccttgcacgacttcaagaggaaaaactcctggatgcgcggctgatgcctcgaggatggcttccacacaccaccctggtgccccccttacattcagttccatctcccgtcgtgcttcttccgctgccaccacaaccgccacccccagctctcaagcctctgtcattggaggagatcgcttcgtgccgtcatttggccttgaaaatgctccaattgctaggctccctttctggccaccaagtcgtggtcctcgtggatggcggaagcacccacaatttcattcaggaggagttaatgaccaagctcgggttctcttcgcgagaaacaaccccattgcgggttatggttggagatcacgagtcaaccctgagctcattgacgccaccgtagtttcacagattactcaggaaatagagcacatgtttttactatcacatcgtggtccttgccaaggacgcaccacatatcctggtggggagtctcctcctgacgctaccccggttaatgtgcatccatatcggtacccccactaccagaagtgtgaaattgagcttcaagtcgagaacatgtttccaatttccaccatcgatgagctcttagatgaactgggtggagctaggtggttctcgaaattggaccttttgcaggggtatcatcaaattaggatgcattcaggggacatagctaagacggcttttcttacacaccatggacattatgaattcatgcgcttcattattgttttcttcgacaacatactcatctacaatgactccttcgatgatcacttgattcatttagagaagacatttcagatactctccgacaatcaatttgttcttaagttgtccaaatgctcatttgctcaatcgaaggtagagtatcttggccacatcatttcacaaggcaaaatggaactagttgcagccaaggggatatgctacgatcgcgactcctcttgtcaatgcaactacgacagagccattccagtggacggaccaaacacaggcttaccggacttccagttacctttcatgatggagactgatgcctccagtgtgggaatgggtgcgggagctatttttgataacggcaacggtgaagaagtggcgccaatatttgcttggacatcgttttaccatccttactga

SEQ ID NO: 51576 - DNA, 651 bp, Glycine max
  Peptide Sequence Number=SeqID_168354
atgcattataaggttaataaggttttgaatttacaaatactaagaaaacaacatgggtgttggttaataaggttgctcgaggaaaagaacccttgccatgatgttggtgaaaaggatctcatcaatttggaggagtcttatgaacatcctggtttgactaggtctgatcatcactctccaatggatgtggatgttggggaaaatttggatgttcaagatttggggaatgccccaaatcaggcaaagtcattttttaacatatttttccctcacttagagcataaccgagtgcacaactacttggaggccaatcgtgaaaaactatcaattgtagggatcatcaattgttgtagaggcattcgggttgaggctaatagattgactgctattgatgtggctaccaaagacaagattgataagctccaaaaagcaaaaagtgaagccctcgatgaaatagagtatgctgatttagaaattgggaagttgaagtccaagttgatcaatgaaaaggctgagtcgattgttcaatatgttgtaggtttcaatgcggcgattgaacaagcgaaaattgtgagtctgagtgatgactttagcttcataagtcctttcaaggaagttgttaatagcaaaattgtggatgtcgaggattaa

SEQ ID NO: 51577 - DNA, 327 bp, Glycine max
  Peptide Sequence Number=SeqID_168355
atgtgtgaaggaggcgccaggttaggggtagcctactgcttgcaccagcctacaaacttcctcctgtttaaatcgaggggaacaaggaggtggttgtcattgttgttgctgagaggttgttgttgttgttgtgagggtgttgttgaggcatgtccttttttgtatatattcatgatctttttcactaaagtggtgtcaaacatcagggtggtgcctcatgcaaaacgacaacgtgtagggaccctctgtctcgcacctcttgtaggcaaactccaaggtggctccttctacaaaatgaaaaaagttgaacgcgaggtgtcactttga

SEQ ID NO: 51578 - DNA, 1923 bp, Glycine max
  Peptide Sequence Number=SeqID_168356
atggccacatacacacgaagcgaatccttaatgttccttctcattttctcaactttaacctcaatttcagagccatgtcacatggtggacaaagaagcattactagaattcaagagcaggatcatctctgacccttcaaaactgctgcattcttggacaccttcctctgactgttgccacaattgggaaggcatcgcatgtggttccaccggcagggtcatcagcctcactcgaactggtgtagtgtacgacgtcgatgacatccctctagaaacatacatgtcaggaacgttatcaccttatcttggaaacttgtcaggtttgcaagttttggaccttagcaatctgaagcagttgcatggtccaatgcctccagaactggccaagttatcccacttgagaaaactttttctctactcaaacaagttcactggtggcattccagcaacattccaaaacctttcacggcttgaaaatttgtaccttgacaacaaccaattatctggtaatgttccttcttctgtctttgcctcattgaaatatctttcagaacttagtctatctgggaacaagctttctgggaggattccttcttccattggaagcatggtgtttctcactaggcttgatattcaccaaaacaatttccatggcaacattccttttagcattggcaatcttgtgaatctcaagggcttggatttctcatataatcagattagtggaagaattccagagtcaattgggaggctctcgaatttggtttttctagatctgatgcataatagggtcattgggagcctcccttttcctattggggatttaatttctctaaagttttgcaggttatcagaaaacatgctaaatggcattttgccttattccattggaaaactcaagaatgtgcaaaggctaattcttgagaacaacaaactcactgggatgttacctgccaccattggccatctaaccagcttaaccgatttatttcttacaaacaatgaattcagtggcgaaattccaccttcctttggcaatttaattaaccttcaaacacttgatttgtcaaggaaccaactttctggtgaacttcctcatcaacttgctaaactagatagtttgcaaaccttagacttgtcattcaacccactaggactagccaaagtacccaaatggttttccaaattgagagtttttcagttaaaattggctaacacagggattaaaggccaacttccacagtggctctcatattcatccgtggcaacccttgatttgtcaagcaatgcattaacggggaaattgccttggtggattggaaacatgactcacctttccttcctgaacctctcaaacaacgagtttcattcgtccatcccggtgacattcaagaacctctcttctctgatggaccttgatcttcactccaataagctcacaggctctctcagagtggtgtttgagaaagaggttcagttttcactaggccatttcaacaccattgacctatccaacaacaagttttgtggccccatcggtgagaacattggagaaaaggcctcaatgagttcaattaaatttcttgcattgtcacacaaccctttgggaggatctataccacagtcaattgggaaactgagagaattggaggttctggaccttgaggacagtgagctcttggggaacatacctgaagaacttggttctgttgaaacgttaacaaagattaacctttcaaagaacaagttaagtggcaacataccggacaaggtcataaatttgaagaggcttgaagagtttgatgtgtcaaggaaccgactcagagggaggatccctccacatacggccatgttccctatatcagcttttgttggtaatcttggactgtgtgggccaccacttcctccttgtaaactttgctaa

SEQ ID NO: 51579 - DNA, 453 bp, Glycine max
  Peptide Sequence Number=SeqID_168357
atggcagggaagcggttgcgaataatacgcaccaacatgacgaatttgactcaaatctggatgaccttcctcctcagtaatgtccttctgagtgaccacaactctgatcttaccctacctaaatgtacaacaacgggagtaggatcagcaatctcagccagcaccagatgcaccaccaccacctccacatcaaccaccatccttggagtccatctcagtccacttgcagaggaaggagctccagatgcacatgaccctagcccttacctctggtctactcccgagcaatttagagccactactgcatggcctgaagacaagcctatttttcaggaggaggcaagacctgtagatgctcaaggagctgcccaaggagatggaggaagaggtaaggaagatgaagacatggcagatttggttgattattttatgggaggaaatggagcttcctag

SEQ ID NO: 51580 - DNA, 297 bp, Glycine max
  Peptide Sequence Number=SeqID_168358
atgggtgatttcgcgaagattttcaaccgttcttcgacgttcttcattcgttcttcgtcgttctttggtcttcaaccggataaaaacaacttaaccaaacactttgttctgaaagaactacgtaggtctgatttcctcatcacaattgaggaatacgtaggagcaaagggaaacacccttgtcgaccacaaaaagagaaaaaatataaaagggcataaaagatataagaacgtaaaagggaacataaaaattgaagtcatatttgcacagttgattaaaggctgccgtctcttgtga

SEQ ID NO: 51581 - DNA, 249 bp, Glycine max
  Peptide Sequence Number=SeqID_168359
atgacgtttaatggtaaaccagctatctttagaatatgtccattggatttaatgatgaaatctgtgcattctcagctcaacaattgggctaagcgcgcatccaccgctaagcgtagcttcagcgcgcttagcgcgaaggagaatctagcagagcatcagcatcaaggccgtgcgctaagcgcaataggtgtcttcagccagactcagcgcacgactggcgctaagctcaaatccacttacccgccctag

SEQ ID NO: 51582 - DNA, 331 bp, Glycine max
  Peptide Sequence Number=SeqID_168360
atggctccaaaaaagctttccgcgaagagatctaggagggacgccacggctgaagggaccagtgccacccccgagtttgatagccaccgtttcaggagggccgagcaccaggagcgcttcgaggccatcaaaggatggtcgttccatggagagagacgtgtccagctcaaggacgatgagtacacggattttcaggaagagatagcctgccgacattggacatcgctggtgactcccatggctaagtttgaccctgagatagtcctgaagttttatgctaatgcttggcccacaaaagagggagtgcgagacatgcggtcatgggtgaggg

SEQ ID NO: 51583 - DNA, 264 bp, Glycine max
  Peptide Sequence Number=SeqID_168361
atgaaaggtttcaagtcattcaaggcacatcctatccctcttaagattattgaggccacaaggtctaacaaaaacaaatgcaatgatgttttacctgaacaatgggttgaagggccaatgacatacactggattatatggaatgtttgatgcaccatatttgtttggagagcaaggacaaagttcttcaactgtagtaacccatagtgaaaatcctgagacaaaacaacaacatcatcatcatgagggagaaccaatgatataa

SEQ ID NO: 51584 - DNA, 1917 bp, Glycine max
  Peptide Sequence Number=SeqID_168362
atggtgaatccaggattgttttctgcgaataagtctgtgaattcggtgaaagtaagctttcggataccgtattttacccaatggggtcagaccttgttggtgtgtggctctgttccagtgcttggttcatggaatgtgaagaagggtgtgctgctcaggcccattcatcaaggggctgagctcatctggggtggaagcatcactgtgccaaaagggttccgatgccagtacagctattatgttgtagatgataacaagaatgtgctgagatgggagatggggaagaagcatgaattggtactccctgaaggaattcggagtggccacgagattgagttccgtgatctttggcaggcagctactggctcagatgcactccctttcagaagtgctttcaaagatgtaatttttcggcaatgctgggatttgagtgacacaaccgtaggagtaaaccacattaatattgaaccggaaggagaagctatcttggtccaattcaaaatatcctgcccaaatattgagaaagacacatcaatatatgtcattggtagcaatacaaagttggggcagtggaaagttgaaaatggactaaaactcagctattttggtgaatctgtctggaaaaagagtggtccaaatcgagaagtctctactaactcctcaaggagtgaggcaaaatatatttttctttcagatggcatgatgcgggaaataccttggcgtggtgctggcgtagcaatcccaatgttttctattaggtcggaatctgatctgggtgttggagagtttcttgaccttaagttgctagttgactgggctgtagcaactggtttccatttagttcaacttttaccaatcaatgatacatctgtgcatgggatgtggtgggattcttatccatacagttcactctcagtctttgccttgcatccattgtacctgagagtacaggcactttctaagaacatacccgaggcgatcaagaaagagattgaaaaggcaaagcagcaactagatgggaaggatgttgattatgaggctacaatggctactaaactctcaattgctaagaaagtttttgctcaagagaaagatttgatacttaattcaagttcctttaaggagttcttttctgagaatgagggttggttgaaaccctatgctgctttctgtttcctgcgggacttctttgaaacatcagatcgcactcaatggggtcattttgctcattactcagaagataagctagagaaacttgtatccaaggacagcctgcattatgagataatttgcttccactactatgttcaataccatttacatttacaattatcagaagctgcagaatatgcaagaaagaagggagtgatactaaagggagatcttcctattggggttgacagaaacagtgtggatacctgggtgtatccaaatttgttccgaatgaacacttctactggggcacctccagattattttgataaaaatggccagaattggggtttccctacatataattgggaagaaatgtcaaaggacaactatggttggtggagagctcgattaacacagatggcaaaatattttacagcttacaggattgatcacatattgggattcttccgaatttgggaacttccggatcatgctgcgacaggtcttgttggaaaattccgaccatctattcctcttagtctggaagaacttgaaagagaaggaatatgggactttaatcgcctaagtcgcccatatattaagcgggaattattgcaggaaaaatttggtgatgcttggacttttgttgcaacaacttttctaaatgaaattgacaagaacttctatgagcatacatttagttttaaccataacggaagtgggagcaagttttctgaatatatattagatgcactgttttag

SEQ ID NO: 51585 - DNA, 1440 bp, Glycine max
  Peptide Sequence Number=SeqID_168363
atggctgtgaccattgaccgacatcatggattgaagccatttagccgatcccagaggtgcaagctccaatcctacggtcaccttgatcccaacatcattgaacttaaccaaactggtggtggtgctgctgctctttcttcttctcaacactccttcggattagcatcacttcaagccgaaaacattcaccgcagtttctccactccatgcctccccctaaccacactgctaggaggggaagcagacctcacttcttcttcttctcatccaagggttgagattgttcttggaagtggagctcctccagtgaatgctctagttgttgaggttgccatagccatggcctcaggtgttcatcctatacccctccctagtggcctaggtggtgcctatgttttccgcaaccaaaacggcaacaacattgccgtagcaaagccagtggatgaagagcctttagccttgaacaacccaaagggcttagggggtcaaatgctgggccagcccggcctgaagaaatcgattcgaatcggcgaaactggtatccgagagttagccgcttatcttcttgaccatggaggccttgctggtgtgcctcctactgttttagtcaaattctctcatgctgcattcttcggtgcagcttcttcttgttcttcttctcacacgcctaaaattgcctcactccaacgctttgttagtcatggttttgatgcaggagaattaggcccttctttcttcccagtttcttctgtacaccaaattgggatcctagacattaggattatgaaccttgatagacatgctgggaatatgcttgtgatgaaacatgaccacaacaacagtggctatgttgatggtgttgctgatcttgttcccattgatcacggtttttgcctacctgagtggcttgatgatccttatttcgagtggctgcactggccacaagcctctattcctttctctgagtatgaaattgactacatttccaagcttgatccttttagggatgctgaggctttgagaaacgagcttccttcgtcgttgagggagtcatccattcgcgttcttattgtttgcaccatcttgttgaagcaagctgccgctgctggcctttgtcttgctgaaatagggcaaatgatgactaggaagttttgtggtggtgaagagtcacgtagtgaattggaaaacatttgcttcatggtcaagactagtgtagttcctcgcggtggtggtgacaacaatgataactgcaaagacgaagaaactaatgatgatcaagtatgtgatgaagttgttgctggtgatggcggcattatttctttggctgacctgaaccaaggtgaatgggaagcgtttttggaggtttttagtgagcttttgcatggagtttttgaggctaagagaagtagtgcaaaagcaaaagttggaacatataattga

SEQ ID NO: 51586 - DNA, 690 bp, Glycine max
  Peptide Sequence Number=SeqID_168364
atgcatgtagaatatgattctctcattaaaaatggaacgtggactttagttgatcttccatcatccagaactgttattggttgcaagtgggtttttagggtgaaagaaaatccaaatggctctgtcaataagcacaaatctaggcttgttgcaaaagggttccatcagcagttaggatttgattacaaaaacacattttctcctataatcaaacttgtagctattagactcattctctctcttgccatttctcacaaatggtctcttcaacaattagatgtcaacaatgtctttctctatggtatccttgaagaagaagtgtatatgtctcaacctcttgggtttgtttcctcaaacaaacatcaagcgtgcagattacacaaagccatctatggcctaaagcatgcacccagagcctggtttaataaactcaaggctacttttattagcttcaaattttcttctagcgaatgtgatccatcaccctttatatattatgaaaaagggtttgttatctacatcttggtctatgaagatgacattattgttactggtaacaacatcaacttgattcactcccttgtatctcaattgaattttgtgttttctctcaaagatctgggtgacttagattatttcttgggaattaaaattcaaaaaaccaaagatggatcactcattctcaattag

SEQ ID NO: 51587 - DNA, 225 bp, Glycine max
  Peptide Sequence Number=SeqID_168365
tttcctcgcggtggtggtgacaacaatgatatctgcaaagacgaagaaactaatgatgatcaagtatgtgatgaagttgttgctggtgatggcggcattatttctttggctgacctgaaccaaggtgaatgggaagcgtttttggaggtttttagtgagcttttgcatggagtttttgaggctaagagaagtagtgcaaaagcaaaagttggaacatataattga

SEQ ID NO: 51588 - DNA, 1287 bp, Glycine max
  Peptide Sequence Number=SeqID_168366
atgtcttacttatatgggaaaaggtttgtgggtccaatcacaccactcatcttacaattgagagaagagctctttactcagccttatgaaaaagttaattggaaaaaagtgcgtcatcaatgtgcaaaggaagatctttattatcctcattctttgatacaagacctagtatgggacagtctatacatgtttactgagccactacttacttgttggcctttcaacaaactaattagagaaaaggcccttcaagtaacaatgaaccatattcattacgaagatgagaatagtcgatacataactattgggtgtgtggaaaaggttctatgtatgcttgcttgttgggttgaagatccacagggagatgcctttaagaagcatcttgcaagggtctcagattacttatgggtttctgaagatggaatgaccatgcaaagttttggtagtcaagaatgggatgctggttttgcagttcaagctttgcttgcaactaagctaattgacgaaattggccattcacttgcaaaagggcatgatttcatcaagaagtctcaggtgagagacaacccttcaggagattttaagagtatgtatcgtcatattactaaagggtcttggacattctcagatcaagaccatggatggcaagtttctgattgcactgcagaaggtttaaagagtaaaaaaggtggtatagcagcatgggaaccaataggagctcaagaatggttggaattactcaatcccactgaattttttgaggacattgtaattgagcatgaatatgttgagtgcactggatctgcaattcaagctttagttttgttccagaagctatatccagagcataggaagacagagattaagaatttcattgtcaatgcagttcaattccttgaagatacacaaacaaccaatggttcatggtatggatgttggggagtttgctacacttatggctcttggtttgcacttggtggtctagcagctgccggtaagacttacactaattgtaatgccattcgcaaggctgtgaaatttctacttacaacacagagagaggatggtgggtggggagagagttatctttcaagcccaaaaaagatatacatacctcttgaaggaagtcgatcaaacgttgtacaaacagcatgggctcttatgggtctaatttatgctggacagtcagagagagaccttactcctcttcatcaagctgcaaagttgctcattaattcccagttggaagaaggtgattggccccaacaggtgcatatcaacctttga

SEQ ID NO: 51589 - DNA, 2556 bp, Glycine max
  Peptide Sequence Number=SeqID_168367
atggagagttacctctatctccatccaagcgagaatccagcagtggctctcgtatcaccagttttagactcaagcaactatcactcatggagcaggtccatggtcacagcactaagcgccaagaataaagtagaattcataaatgggaacgcaccagaacctctgagaactgatagaacctacagtgcgtggagtcgctgcaataatatggcagtatcgtggatagtgcattcagtatcggtcgcgatcaggcagagcatcttgtggatgaacaaagctgaggaaatatggaatgacttgaagtcacgatatgcgcaaggagacctcttgagaatctcggaccttcaacaagaagcttcatcaatgaaacaaggaaccctttccgtcacggagtacttcacaaagcttcgtatcatatgggatgaaattgagaacttcagacctgaccccacttgctcttgcaccatcaagtgctcatgctcagtccttaccatcattgcccaacggaaattagaagaccgagccatgcaattcctacgaggattaaacgagcaatacaacaatgtgagatctcacgtgttgctcatggaacccatgcccaccataccaaagatcttctcctatgtagcccaacaagaatgtcagctatcaggtatcaactccttttcaaatctcagtattgaatcaaaagaaaatgtttccattaatgccgtcaagattacttgtgaattctgcggacgaattggtcacaccgaaagtgtttgttacaagaaacatggggtacccacaagctatgaaggaagaagcaaaacctacaacagaaacgggaaaacgtgtacccattgtgggaagatgggacacaccattgatgtgtgttataagaagcatggctaccccccaggatacaagtttggcaacaacaaagtagtaaataacatcatagaaggaaaagctacgagtgatcaaatgcaacgacaagagtctcatgatttggttcgtttttcacctgagcagtatcaagctttgctcgccttaatacaacagccatcttcgggaggctcaatccctacccaatcccaggttgcatccatatcctcatgctccactaacacctcaccaggtacgattctttctctcaaaaccacagaatctacctcctggatattagattcaggagccactgaccacgtctcctcttctttggccaactttcactcatatcatcaagttaatcctattatggttaagttaccaaatggacacgaagttcatgctactcacttaggaacagtacacctcaccccttccattatattgaacgatgttctatacataccttcttttagctttaatctcatatccatatccaaacttatttccacaaacaactatgagttaatcttttcctctaatacttgtgttctgcaggataccaacaccaaagcgaagattggtacaattgaattgagtcatgggctttaccagttcatcttaaaaccatcacactcacgaaccatatgctccaccattattcacccaaaatgtaatgtcatccctatagatttatggcattttcgcatgggtcatccctctatagaaaggctgcaagtcatgcaaacttattatccttctttgcataataacaataagaactttgtatgtactacgtgtcactatgcaaagcataaacgatcatccttttcatcaagcacttcacatgcattaagcatttttgatctcatacatatagatatatggggaccctattcaaaggtttctatgcatgggcatcattattttttaaccattgtaaacgatcattctcgctttacatgggtttatctaatgcaaacaaaagctgaggctcgaaaactcattatcacattcgttacatatgctcaaacgcaatttaataaaaccattaaaatcatacgtagtgataatggtgctgagtttcttatgaatgatttttatgctcaaaggggaatcatacatcaaactacttgtatagagacccctgagcaaaacggcatcgttgaacgaaagcaccaacacctcttgcatgttactcgatctctattatttcaagcaaatcttcctcttaatttttggtgttttgcattacttcatgcaacatatttgatcaactgcatccctactcctttcctccataacaaatctccctatgaacagctatacacacgcccttgtgatatctcgaacctttgggtttttggttgcctatgctacataagcactctcaaatctcacagacaaaagctcgaccgccgtgcccacccatgcatcttcataggtttcaaaccaaacaccaaaggatatttagtatatgatctccattcccatagcataaccacatccagtaacattgttttctatgaagaccactttcctctcttccctgatactccagaatcatccacccctcctacttctatatcatctctcccattctccaataatcccgacagctttgaacaccccattccacccaatgacaatccctcatcctcacatataccttctccttttctatga

SEQ ID NO: 51590 - DNA, 108 bp, Glycine max
  Peptide Sequence Number=SeqID_168368
atgggtttgggtggattagaagcagctaaagaatccgcatctgttgaagtaatgtctgaaataagaatgtcatgtgtagttgctctatcagtctcgggcaacgcgtaa

SEQ ID NO: 51591 - DNA, 237 bp, Glycine max
  Peptide Sequence Number=SeqID_168369
atgggatgcttacaatctccgtggtcttcaattttggtgaatagaagtcctacacaagagttcaaatgtcataaaggttcgtgtcaaggtgatccttcaacaccttttctttttcttattgtgtggtctagtgaggcaagccaaggcaagaaacttgttggtgggattccaagtggggtggataggaatgtggtggaacattatgcggacttcttgaattgtaggattctttcttaa

SEQ ID NO: 51592 - DNA, 288 bp, Glycine max
  Peptide Sequence Number=SeqID_168370
atgcagaaattgattaaggaaaggatggaaaataaggtggttaatctcgtgggtcttaataaggtggtttctggcataaaatggatgaatgggatgaaatatagaaatggcaataacggaagctacagggctccaaatgaggtgattccaaaacgagaggtggattttctggaattgtggtttgaaagaacaagggtggagatgataggaaggaaagaatcactctttccagcgagggcaacacacaaaggttgtgaaagtcctttgatacagccagggtgttcttga

SEQ ID NO: 51593 - DNA, 174 bp, Glycine max
  Peptide Sequence Number=SeqID_168371
atgtgcaatatagtctccaagtgtccttcaaggatgttcttcttccgccatttcaggctcctcaaagataggaagaggcattgcttcttctacaagttcttcgaatctcttgatccaaagggactagatcttcttaagaaactctacctcacatacatggatcaaagcaactaa

SEQ ID NO: 51594 - DNA, 485 bp, Glycine max
  Peptide Sequence Number=SeqID_168372
atggagtcaaacaacatgccagacttgaacggtgtcgctaagaagactaaaggtcgacaaaagattgaaatgaagaagatgagaaacgagagtaaccttccggtgacattctcgaagcttcgcactggggttttcaagaaagccagtgagcttgcaaccctttgtggcgtggatgtcgcagtgattatgttctcacccggtaatcgagtatttttttttggcagtcctagtgttgattctgttgtccaacgctataagacacagggcccacctcccctccttaccttggacctcaacaaggtgcactccactgtggacgaagttgagctccacacacacctccattgcttgtccaaccaaattgctattgagaagaagcgcacaaaggatttaaatcatttagcgaaggctgtagaggatcagttctggtgggctaggcctattgaaagcatgacatattcccaacttgacaagtataagaagat

SEQ ID NO: 51595 - DNA, 543 bp, Glycine max
  Peptide Sequence Number=SeqID_168373
atgggttcagaggaaaccaattttccaagcaaaccttcaagaagggtctctcatcatgttcagtctgatgctacaagggaaacaacaactcatgcttggccacaacataggtcaccatcaccaccaccaccatgtgttaaaggtaacaacaacaacaactccaacaatgaaattgatgtgtccatgtcttcaggtgcacaatattgttactacatgttggaggctatgcctcagccagggccaacatggtccacaacaggaccttgtgtattggctgagccaacaccaacaccatccccatcagcactcattgaagattcttcatgtacttggtggctgggataccttgaaggcttagatggcaatttgaccactttgaaattggatcccccatttgtggaaaatgttgtgatggaaaatggtaaggggcttggttatgaatccactcttgtggatgctatagatcttagttgttgttgtccagatgattggttggtgattccaacaatggaccaggatttgggagacatagttatgccatag

SEQ ID NO: 51596 - DNA, 318 bp, Glycine max
  Peptide Sequence Number=SeqID_168374
tctcggccggaagacgctgacatctccgggtcttggccggaagacgctgacatctctggggaaggtgcagatgacgactctcggccggaagatgctgacatctccagggaaggtgcagatgacgacgttagtcactgcatgctatcgagctttgagtcttacggattgcaaatgagtgtgtgcaggttaccgtataaggcgtctccgcgtgccaacggactcacaggtcacgatagcaaaaagtggggtggtcgacaaaagcgaggcttttgctcctacatatcctcaatttatgatgaggaactcagaccaacgtag

SEQ ID NO: 51597 - DNA, 261 bp, Glycine max
  Peptide Sequence Number=SeqID_168375
atggttcgccagcaaacggccaacaaccgcgtgcaggggcagggctcccctccttttgtacgccctaccccagagcaattcaaggctaaggtcgcgtggcctggagattggcccactgaggagggaaccggacccgcaggatccccgggcgaagcggaggaagcccacatggatgaggatatgaccgacctgcttggttacctgggagagggcggagctacacgaccaaggtcgtcgcacttgttattccatgtcgtctaa

SEQ ID NO: 51598 - DNA, 393 bp, Glycine max
  Peptide Sequence Number=SeqID_168376
atgaccgtggagccagtggttgaagcggtagttgaggaaccagacattgggggaggggacgtcgtggatggagccaccgaggacgtagatgttgggcaaggacggcgtaggcggagtcgacggcgggggaggggatcaggggaaggggagcgaggagggggtcttcatgagagccacggtcttcatgaggacgtcacggttggagagcttgacggggatagccatggcggtgagaacgtcaacgaccttaatggcagccttgtagagaacgttgccgaagacattgcttggtccctttcacaaaggctatggaaacctaaagggggagtaaagaggcagaggggaagtctaagagtcaacagacgaaagagtggagagagaaatgaaatttaa

SEQ ID NO: 51599 - DNA, 327 bp, Glycine max
  Peptide Sequence Number=SeqID_168377
atggaacatagttgtacggaatatgcaaggattgagcctacattcaatcactactacaacatgctgagggaagaagaagatgctgaccgggaaattaattggcttaacaagatttcgcgagaaaaatggactcttgcatgggatgggagagaagttgcaacaatgcttgcatctagccaactttatatggaagtactaaacaaggtcgtcaaagatgcacttagaaagacaaacgctcacacgattcttggttcaggagacaataaacctgagagaggttcggctcactggagatttcacgatcaagctggaagaaaggtggtgtga

SEQ ID NO: 51600 - DNA, 363 bp, Glycine max
  Peptide Sequence Number=SeqID_168378
atgcgtgttggtcgcgaattcgctgtcgcgggagtcctccacggcaagatctacatccttagtggttatgtagctgacacctggtcctcaaccccgccactagccactgggagagagttggcagtccgacggaggtccgtgagaagtggatgcacgccagcaccgtcatcggggagcggatctacgcaatggcagatcgcggtggcatcatggttcaatgtggggcgtggggcgtgggaggagttgaaggggttggagaagggtttgcctaagtttctgtgttgggctaccgtggttgatttgggtgggaaattgtgtgtggtttgggagtgccagaggaatgggaatgaaatggagatttag

SEQ ID NO: 51601 - DNA, 963 bp, Glycine max
  Peptide Sequence Number=SeqID_168379
atgggcatgagcagctacatcgtgcatcgtcaggagattacacgtcgtgagcagagcaccatttactgggttaacgtctcgctgagcttctgtaccggtctgatcatgctggccatcgcctggccggtggcgtggttctaccatctgccggagctgacagcgctgattatgctcaccagcctcaactttctcgtgctcggtcacctgtcgcagtatcaggcgcactatgtgaaaaccaaacgcatggtgacgctggcgaagattgagatgggcaccaagctgtttgccttcctgtgtacggtggcgatgctctatttcacctccctgacggtagcggcagcgattctcgggctgttcatcaacgccttcacgcgcattctctgcatgatctactttggcgagaagtcgtggcgaccaacgtgggagttcgacggcaaaacctttgtcagtgcggtgcgttacggtatctatcagctgggttcacagaccattaaccagctgcgtactcaggccgatgcgctgatcgtcggtaaagtgatgggtgccgagatgctggggatttactcgctggcgaaagagctgattctgcagccgctgaagctggtgtcgccggtgataaaccgcctggcgctgccgcgctttgccgagaagcagcacgatcccgagcagctgaaaaaactcttcctcaagggcaccttcgtcatcatgctgttcagcagcgcgatgtacctggcgattggtattctctctccggtgattgtgcgtgtgctgtacggcgcttcgcatgagcaggtgtatcacctgatcccacggatgctgctgtttggtatgctgcgcccgatgggcggcatgaccggcgcgatctcccaggagaacgaacgcaccaacgtagagttttactggaaaatcgtcgccagcctggtggtggtggtggtgctggccacaacgtggatctggccgaac

SEQ ID NO: 51602 - DNA, 525 bp, Glycine max
  Peptide Sequence Number=SeqID_168380
atggatggtggcgtagctgaccggccactgcgacaggcgcttgatcaccgccgcggcggtggccgggatgtcgaagaacttcaggtcaacgaacacgcgcttgtcgcggcgggccagctcatcgagcacctggaagtactcgccggaggcgagcagttccatgccgatcttgtagaacgccacgctgtcgccgaggcggtcgacccactcaagcgcctgcacgcggtcaggcacgtccagcgcgaagatcaggcgctcgtcgtcgcgcagcggcagcggcgcgcggttcatggtcgggttcggcagcatccaccagcgctcgccgaaccagtcgtggtactgctgcagcagcgcgtcacggccatcgttggtgttggcggtcacttcgacgaaatcgcccagctggtcgccgaactgcatcagcacgcggtacttctgcccggccaggcggcggcggcagttcttctcgctgccggcctgctcgcagccttcgaccacggtgcccaggcccaggaacacgctgtc

SEQ ID NO: 51603 - DNA, 192 bp, Glycine max
  Peptide Sequence Number=SeqID_168381
atggagatttgttttaatgtttactggttctattctgtaaatcatttggatcttatttttgcagcctacagtctggatgaaataaatggcaaaatgaggtctttctgcgaattggcaaagtacagtgcaagtgatggagctactgtgcttgatgtttgctatattcgacatcaacgtcaggttgatccctga

SEQ ID NO: 51604 - DNA, 732 bp, Glycine max
  Peptide Sequence Number=SeqID_168382
atgtggggtagcattgaaggtggttcacttcgtttttctctttccccctccaagtcatggccacttcgattttgccctcaaaccccacatgaaagccattttgacatgtcaaactcaaaactagtgaacatgaataaccctttgacgatttacgtgacaaatagttacttcaaaattggccgtgtcccattaaagttgccatcatcatttattagaaaagccctgaatagaagtgttgctgaaagtgaatcttctaaatatgttgaagatggatcacaatctccatactcagatgttgaggctaatgaggcaataatcttggtggagaaggaagccatggagaaaattcatgagcctcatggacagaaaacaggaacagaacatgcaatagaaatcaagtactctgatgaagaagaagaagaagaaggagaagaaagtataggagacataattttggaaggtgaaaaagaagaaaaagggaatgcagaatcagttttgacagaagagaataagaagctatatggagaaactggacaatttggtgctgaagatgaagacagggagtcagaaattgatgagtttctgattggagaaagtgttgaagaagaggttgtagaagaaccaaactgggtgttaagtactgaggagttgaacaaaaaatttgatgacttcattagaaagatgaaggaagatttgaggatcgaggctcaaagacaattactcatggtttga

SEQ ID NO: 51605 - DNA, 807 bp, Glycine max
  Peptide Sequence Number=SeqID_168383
atgaggatgagggctacgtgggagtacgtgagctcagttggaggtgggcaacaggggatggtggttttatacgtgatttgtggatgtggagaattgttgtgcaccatcgcccgaccgccacctagtaccacatgtgatgggcttgaaaacgaggtcaggaagctaggagggcttctggaagctaggagggcttctggtaatcgattaccaaaggggtgtaatcgattaccaggcttaaaatgggactggaagattgtggaggcctctcgtaatcgattaccaggatgtgtaatcgattacacagaggaacatgccactggtaatcgattaccagttatgtgtaatcgattacacagtgcatttttgcagatcgtgatggcggtgcagctaatccatgatcgagtgcagatggagtgcctagagggagcttgggagaccctcgagggcaatgcgaggtgccgatttcggggcacgattcgattcacggctacttcattagtgcatccagatgaacccgcgcgtacgcttcagcgcactgtggagtggatattacccacgcctacaccataccgtctagtggagctagtccaagtgattgaggtaacgttattcgaggaagaccctgaggaggatcttgaggagctacctcctgagcctactgtggatgctcttgactttctagagggtgatgaggacctactccctaaggtggattctcccgaggacgtcatgtcggcatccgaggcagactctacggaggatagtggccctggagagatggcgatcagtggaggctcttcatcatag

SEQ ID NO: 51606 - DNA, 288 bp, Glycine max
  Peptide Sequence Number=SeqID_168384
atgcagaggatagagctctatatgcaacatttggcggaccaacaggcagtcaaccataggggccaagtgcagctgaacgatagcttttaccagtataccctacaccagcagcgccaggactccagcccttacccatggcctatttttgagcagtttagggccactattgcatggcctagaggcaggcctaattttcaggcaagggcaggtcttgcagaggtctcgggaggtggagacggagctgaggaagacggtgacatggcagatgtcatggatttcttcctttga

SEQ ID NO: 51607 - DNA, 261 bp, Glycine max
  Peptide Sequence Number=SeqID_168385
atggctccaaagaagcttctcactaaaagggcaaggaaggatgccataggggagggatctagcgcagccccacaagagcatcagtgccgctttgaagcaatcaaggattggtctttcctcaaggagagacgggtccaactaagagaaggagaatacatagaactccaagaggaggtttccaggaggcaatggactcaactgacaaagcctatggccaagtacgacccaaagatagtcatggaattctatgcaaatgcctag

SEQ ID NO: 51608 - DNA, 303 bp, Glycine max
  Peptide Sequence Number=SeqID_168386
atgttggaagagaagtttgttactattattgatgctagtagcaatgaagagaaagttcattataaaacttgggcaagatctgatagactcagcctaatgttgatgagaatgactgttgcagacaatattaagacaactctctctaaaatcgaaagtgctaaaaggtttataggattagtgggagagtattctcaaacagctgataagtctgttgttgggacattaatgagtacattgaccaccatgaaatttgatggttcacatactatgtatgaacatgtcattgagatgacaaacattaca

SEQ ID NO: 51609 - DNA, 3156 bp, Glycine max
  Peptide Sequence Number=SeqID_168387
atgcagaaaaacaatgggaatggaaactcactaaatcagttgcctatcttcaaaggtattaattttcatttttggagtctaaaaatgaaaactctcttcaagtcacaagagctatggagcagtgatgagagtgggtttgaagacgatggaactgaggagccagaccaagccttaagggagaaaagaaagaaagattcaaaagcactcttcatcatccaacaagctcttgatgatgaggtgtttccacgcattgtagtagcttctacagcaaaagaagcatggcgtattctcaaccaagaatatgccggagacatgaaagtggtcaatgtaagattacaatctctaagaagagaatttgagtcattccagatgaaggaaaatgagaacatgcaagaatgtttgtcaaggatatctagcacagttcaacagatgagaaccttgggtgaagagatcaaggaaagccaggttgtgagtaaggtgctaagaagcctcacaaagaaatatgatcacatggtggcaacaattgaggaatcaaaggatatggaaacatatacctttgatgaattgaaaggctctcttcattcacatgaagaaagaatatgcaaaggtgatgacaagaaagaagagaaggcttttcaagcaaaaggagagtattcaaacaaggagagagcaaagcaaagttcaggcagaggccgagaggctagttgctggaagaaagaggaggatgaacagaaaggatgtgataaaaaatccaactttgtggagcaagaagagaagctgatcttggcacaacatacatcaaacaatgatgataaaggtggagtgtggtatgtagacagtgggtgctcaaaccacatgtcaagtgccaagtcaatattcaggaccttggatgaaacagcaaagaccaaagtgagactaggagatggaaagcaacttgaagtagaaggaagaggcacgattgcaatcagaactgagcaaggcaacaccaagctcttatgtgatgtgcagtatgtgccaaggttgtctcacaacttgctaagtgtcggccaacttctcaactctggctattctgtgctatttgaaaatggagcttgcttgatccaagacaggagctctaaagagatagtagtgaagattgccattggaaagaacaagatgtttcctctagatttgtcaagccatgggctgcctaaaactggagagcttgagttgtgtgaaggttgcatttatgggaagcaatcaagaggatcatttccaacaggcaaagcatggagagcaagtgagtgccttgaacttcttcatgcagacttatgtggcccaatgaaaacagtctcacttggtggaactaagtctgaaacatttgaaagctttaagattttcgaggctatggttgaaaaacagtctagcttgtatgttagagctttgagaacagacagaggtggtgaattcttgtcaaatgaattcattactttttgtgaggagcaagggataagaagagaatggactgctccatatactccagagcaaaatggagtggccgagaggaaaaatagaactgtggttaagatgacaaggagtatgctcaaagctagaggtgtgccaaacagattctggtgtgaagctgtagcaactgcagtgtatattctcaacgtttctcctaccaaagctttcatgaacatgacaccacttaaagcttggagaagaaagaaaccgtctgaggtctcaaatgtgccagaaaatgatcacactccaagccctcattcaacgccatcaagccagggatcattaactccttcaagccagggatcatctagctcatcaagtgattctgctccaaggagatacagatctttgtcagacttgtatgaaaattgtgactttgcattgatggcagcagatccaacatgctttgaggaagctgaaaaagaagtggagtggcaaaatgcaatgaaagaggagatcaagtccattgagaaaaatgtgacgtggcaattgctaaatcttcctaaagggaagaatatgggagcatccaaaagcacaaagctaggctggtggctaagggcattcctcaatggagacttgcaagaagaggtgtttgttgagcaaccactggggtttgtcaacgctagtgaagaaggcaaggtatacaagctgcaaaaggcattgtatgggctgaaacagactccacgagcctggtatagcaagattgattcattcttccttcaaaatgaatttgagagaagtgagaatgaaccaactctctatgtgaagaaagaagtgaagcaaggagaagatggaatctttctctgtcaaagaaaatatgcagaggattttcttaagaagtttcatatggagaaatgtaaagcaatgagaactcctatgaacacaaatgagaagttgcaacgtgacgatggcattgagaaggcagatgagcagcttttcagaagcttagttggtggcttgaattaccttacatatacgaggcctgatatagctcatagtgtgagtgtagtttcgagatatatgcactctccaactaagcaacacttaggtgcaacacagagggttcttaagtatgttgcaggttcaatcaaacttggaatactttatgagagtgtggataattttaagttggttggctatagtgatagtgactgggcagggtgcttagatgatagaaagagtacatcaggttttgtattaagtcttggcttgggagccatcacttggagctccaagaagcaagacacagtttctttatcatcatctgaagctgaatatgtagttgttggtgcagcagcaaggcagacaatctggttgaggaaattgctaaaggatttgtgctgtgagcaagaaggtgcaatcaaattgtggtgcaataacaggtctgttatagccatgtcaaacaatccagcgttccatgcaagaaccaagcatattgaagttcagcatcacttcataaggaagctagtggcagaagagaagttagtgctaaaattccgtggaacgaatgaacagaatgcagatctcactactacaatattgtctttctacatcggttccaagtggcgttctacatcggttgacacccgtcgtcgtagcaaacgtcgtaaaaagaaaaaccttttctacgacggtcgcaaaagaccgtcttag

SEQ ID NO: 51610 - DNA, 753 bp, Glycine max
  Peptide Sequence Number=SeqID_168388
atggaaaaaacgcacagctccagcgcagaggagcaggatccgacccggcgccacctggatcccccacccgggttaactgctgaagagttcgaggacctcaaaccctccgtgctggagcaccacacctactccgtcacacccacccgccaaagctcctccctcctcgcgcagcgcatccacgcgccaccacacgcggtgtggtccgtcgtgcgctgcttcgacaacccacaggcctacaagcacttcatcaagagctgccacgtcaaggagggcttccagctcgccgtggggtccacccgcgatgtccacgtcatctcagggctaccggctgccaccagcaccgagcgcctcgacctgctcgacgacgacagacacgtcatcggcttcaccatcgtcgggggcgaccacaggctcaggaactaccggtcagtcacctcggtgcacgggttcgagtgcgacggaaagatctggaccgttgttctggaatcgtacgtcgtggacgtgcccgaagggaacaccgaggaggacacgcgtctgtttgctgatactgttgtgaagctgaatctgcagaagctggcgtctgtcagcgaaggaatgtgcggtgacggtgacggtgacggtgacgcatgtcctttgtttggtggattggccaggttgaacttgtttcacgtgggaaataaagtggtggctttatttgttatttcaaaggtctatcctgtggatgttgatttctctctaaaatctgctgtctga

SEQ ID NO: 51611 - DNA, 216 bp, Glycine max
  Peptide Sequence Number=SeqID_168389
atgcttggcaatggaggcgaaaccccctcaaggtatgaattgttgagcatggtgaagaataactccaattcaatagggaaaatggtaattgaggagcaaaatgcttttgatatcaaaatggatacgaggttttggcacattgtctttgatttttattttgtttgtggcaaggaatcaaggggatgccaagatgatggtcttgttttctttgtctga

SEQ ID NO: 51612 - DNA, 312 bp, Glycine max
  Peptide Sequence Number=SeqID_168390
atgggatttcttgtggagcatgagaagttcctttctaaacggaaaattggaggcacaaaagctgcattgcaaaacatttggcttggaaacgaagagattgaaagagggcacgggaagatgatgatgacagcacttggtcttctcaccgttcttggagtttctaggaagagggcacgagaagtggtatcaacgaaagttgaaagaaatggaggatacaagaagtggaatcgacggaggttggaagaaagaggggcacgagaagcgaaatcgcagaatgaagggcacgagatctggaaatttaagtcaccttaa

SEQ ID NO: 51613 - DNA, 132 bp, Glycine max
  Peptide Sequence Number=SeqID_168391
atgggcaccaaacaagcactcttggttgaggctcttccatgcatcagagatgttactcctgaccctctctcttgctattctcatcgtgtagtttgggtgatccctcatgagacaattcacgcatacctctaa

SEQ ID NO: 51614 - DNA, 342 bp, Glycine max
  Peptide Sequence Number=SeqID_168392
atggctccgaagaagctttcggccaagaggtccaggaaagatgccgctggagagggttctagtgcggccccacaggcagatgtggattttgatggacatagggagaggcgagtccatctgagggacgaaaagtatgctgagtttcaagaggaaattgcccggaggcaatgggctcagcttgtagcacccatggctaagttcgatcctgagatagtcatggagttctatgcgaacacttggcctacagaagagggagtcagagacaagtgctcctgggtgaggggcccatgggttcctttcgatgaggatgccatcaaccagtttctggtttcttcctattga

SEQ ID NO: 51615 - DNA, 1050 bp, Glycine max
  Peptide Sequence Number=SeqID_168393
atgacagcacaagaatactatgatggagaaaggcattgcattcttataacagctagagatcctattcctaagagaatgctagtctcggtgcctgagattcaaggaagatttattggcacaaaattacatactttaaaggcagatttttacgaagtggctaaaatgtttggttcgctagcagtatccctttcaataatttcaccaatccaacatccaatttttggagtgatattcaatatggggaataatgattcttcactagccaacactcccatctctgattgcagaaacgaacaatttattgtgttattatcaagaaattttagggaggcacattatgcccttcatgagaaaagaacaatggatccacccacaaaagaaagtgtagaatcacttaagacaacaaatgatattatacttgccatagattttgctgacgaccatgaagaagatctattctcaattatgatgactgggaagcaaatcattgaagctgacaaagatgaccgacttgatcctataagcctactgcccctatctgtcccgaatgcctcaaccggtgaagttggcatttcaactctaccaatggtaatatccacaacaccaactttcatagttggagaagggtctttgaaaggtgtagttggaggcaactcgggaaactgctcaacaagcacagcaattgctgtaggcatggctgatccaagggatgctccaccagctcaaaattccatgctccctcattcaattggaaatacattcgatgttcaaccatactcatcactatcaatgcttccttatgctagttctagtagcagaagtcgcccatatcttccattccaggtgattgggtttggtccacttggtagaattgcttttggaacaagcaccggggttcctcctgcaccaataacacctcaatttaatccttatgatttttggcctcccccatcatctcttacaaattttaatgactatttgctggaatgggagggatctttggctggaaaaattgtcaagaagaatcgtcaattacatctttgggtaaag

SEQ ID NO: 51616 - DNA, 186 bp, Glycine max
  Peptide Sequence Number=SeqID_168394
agacaccatctccacggggtgcttgcggttatggcaatactgcatatagcttcggaaaaatcccccattcctcctctgagaataccccgaaatatggttcaaagaaagtattgcttagagataatggagatagaggagatgcaataagggttgataaggctttcaagaaatcatcaccaaggatat

SEQ ID NO: 51617 - DNA, 153 bp, Glycine max
  Peptide Sequence Number=SeqID_168395
ctttcagttctagagaaatccatgacgaccaagaagtggttaaacttaatcatagatggcaactcgaccttgggtccttattggccaaaaattgtttcagaatatctcgaaaagattgttaggttcgtattttcatcatatcttcaatcttag

SEQ ID NO: 51618 - DNA, 276 bp, Glycine max
  Peptide Sequence Number=SeqID_168396
atgcaagtgctcaacttgggtagagaattcgagatgcagagcatgaaggagactaaaacaattaaagaccatgtcgatcggttgttaagcatagcaaataaagtgtcgcttcttgggaaggactttcctaataaaagaatagtgcaaaaagttctagttattgtacctgaaaagtatgaatcaaagatatcagcatgggaggagtcaaaagatctgtcagtcatcaccttgggagaattgataatgccttgtaataacaggagcaaagaagaatga

SEQ ID NO: 51619 - DNA, 534 bp, Glycine max
  Peptide Sequence Number=SeqID_168397
atggcggaggggctatggggactcgcagagtaccatgggaagagaggggaaatagggaaagcaatgaagtgcctcgagctattccaccgcagaaacaggtcttgcacaagggactcgagctcactgcgtccattggagaaagatcggtcgtggcgagtttggcaccatgattctcgtaaaccacaaaagcgaagaagaagaagctcgcacgacagactgaacgatgcagaagatctgctcatcaagagatggctcttattgctcgaatttagcatccttacattgtgcaatttaaagaggcttgggttgagaagggctgcattgatgaaaaaatcaatcggggtttactttccagaggagtgttccaacatctttctaaccaaggatcaagatgttcgcctagatatttatataggggattttaggcttgctaagacactaaaagcagatgatatggcttctttcgtatgtgccttctatgtggtaattgccttctatcatatacaaatgtcttcatcattggcatgcatttga

SEQ ID NO: 51620 - DNA, 180 bp, Glycine max
  Peptide Sequence Number=SeqID_168398
atggagtggaacgcggggaaaaggaacaaagtgacatggagaagaggaaaagatgtgaggagaaagagaacatcaagaaaaaactccataaccataagtaaaacagtaaccaaagttgctcctcatgctgtcaacacaacatgcccaatcactatcagagtatatatccatgatgcttaa

SEQ ID NO: 51621 - DNA, 243 bp, Glycine max
  Peptide Sequence Number=SeqID_168399
atgaatatcaatgtgaaaggggagtggatcctaatgcacataatgtcatgtccaaattttgtgtctctctcttcgtactattctatcacatcatctgactttacaccaagtactaggacaacagagctagagaagctttttgagaacttcaaggatcgtggatttgtgattcgttgggtcaatgatacagttgctcttgcagtatttcgaacacctccagttgcaacattgataatatcgtaa

SEQ ID NO: 51622 - DNA, 207 bp, Glycine max
  Peptide Sequence Number=SeqID_168400
atggcagaggaagaagaaggtttaagcaaggaagaggctcataaaagttcaaacaatgaagttgttggcacaagctttaccacattgaagaccaatgttacctcaaacatggtttttcctcagacactagagcctttaatcttgtcagtcataccaagtctcatttcactagactacatagtattaatcccatcaggaccgatctaa

SEQ ID NO: 51623 - DNA, 1911 bp, Glycine max
  Peptide Sequence Number=SeqID_168401
atggtggagaagttctcagttgatgtgttgagtgattttccaggtgcacggacaggaagaattccaacactaattgattatatcaaagaggaaggaagtacccatcgtggccattcagaggaatctggggatgatgacaaaggtgaagagattgaaactaccaacaaaagcgttgaagtacataagaagaagaagaatctcacccccatcaaacccataagacctgcttctgtggaaatacttaaccgagtgcaactaaataacacttgtgagactcctcgttcaactataagaggcttcatcaaataccctggccagacagagataaatttcaccaaggaaaatttgagcaaagttgaagaaacactcaaactggctttcattgagttctatcaaaagcttagacttctaaagaactacacctttctaaatgtgttggcattttcaaagataatgaagaaatatgataagatcacattaagaggtgcagcaaaagcttacatgaaaatggttgataagtccaaccttgggagctctgatgaggtcactaggcttatggagagggtggaaaatgtattcattaagcatttttccaactcgaatcgaaataaaggaatgggaatcctgcgaccaaaaccaaagagagaaaggcatcggaccaccatgtattcaatagtcccgaacaatcttaacatgacatataaccgcttcacaggtttttctgccggatgctctgctgctctaacagtggcccttattctaattgttcgtgcccgtaaaatcatggatcattcaggaagtacccagtacatggaaatcatgtttcctctctacagtttatttggatttgtagttttacacatgctgatgtatgctgctaatatatacttctggaggcgatacagagtgaatcactcattcatatttggttttaagcaaggcactgacttaggctaccatcaagtccttttcgttagttttgtcttggcagcattggcactagccagtgtgattgcaaatctagacatggaaatagatccagtgacaaaacaattcgaagagttcactgaacttttgcctcttttcctggttctgagtgtgattgccattttattatgcccattaaacattgtatatcgatcaagccgtatgttcttccttacatgtgtgtgtcactgcatctgtgctcctttgtacaaggtcacactgccagatttcttcatggccgatcaatttactagccaggttcaagccttgagaagttttgagttctacatatgctactatggttggggtgacttcaaacacagagaaacatcttgcaagtcaaatgggatattccgagctttttcattcattgttgctgcgattccatactggtcacgctttcttcagtgcctaagacgcctgtacgaggagaaagatataatgcaaggatataatgctttgaaatacttcctcactattgctgctgtttgcctaaggacagcttctactcttaatcaaggaatgggttggacagtgttggcttggatattctcaatatctacatccattttttctacatattgggaccttgtcttagattggggcctcctccaaagacattccaagaaccgctggctcagagataaactcctaatccctcataaaagcgtatatttcgctgctatggtgatgaatgtcttgttaaggtttgcatggttacagacaatattgaatttcaaattctccttcttgcatagacaagctatggtcagcattgctgccagcttagagattattcgtcgtggcatgtggagtttctttaggatagagaatgagcatttgaacaacgttggcaagtaccgtgcattcaagtctgtgccactacccttcaactacgacgaagaggaagataaggatgagtga

SEQ ID NO: 51624 - DNA, 426 bp, Glycine max
  Peptide Sequence Number=SeqID_168402
atggttttttctataaatagccatgaaggggaaggggcaaaggggacaggaagtttagagagggaaaaacgaagggagaggaaggaaaaagaagaaaagcgaagccgaggcgctgcaaaatcgcaaccgaggatcattccctacatcacttctcttgctaaccttgtaccctgtgcaacagacgactcagatgctaatgatgattaccatagacctatcagtgtggtgtatggcaagagatcaaggaaagaagaagggaaaaatctagttgatgcaccaatggcaaagaagcaggtgactctctttgattctaaggttcctaaacatccaatggtgaagcatgttgttcataggactaaaggtccatttcagaaagttacagtggagaaggcacctattaaggaagcacttgtgcctaagagaagg

SEQ ID NO: 51625 - DNA, 321 bp, Glycine max
  Peptide Sequence Number=SeqID_168403
atggatgatttctcacttcattctaactttaacattgtcactcaaacagcaaatagatctggtgttactttccatgaggatattagtaatgcagctgtattagaaattagaattggcctagagtgggaatttcttattccattaggagtgattttagccattcttgatcctgcgctcattgctgtttcgaaaagtggtcctgcggtcattgctagaaagtcaattgtgttgaagcctccaactcagaactatttgatttataagcaccacttgttcctgagtacaggacagcttgcaacagtatcttcagcaatgccatga

SEQ ID NO: 51626 - DNA, 663 bp, Glycine max
  Peptide Sequence Number=SeqID_168404
atgatgttgtctatgatgatatcgggcccaagacagccaggaaatgacatcgatgtttatctttgtcccttgattgaagacttgacaaagttgtgggacaagtacagtgttaagggccatcatgcatgccttatctgtgaagaagacacaagctacatgcaactgagacatgagaaaaatgtatatgatagtgtcattgggacgctccttaacattcaaggcaagatgaaaaatggtttgaatactcgtcaagatttagctgagatagcggtacatgaagatcttaaaagggtataccaagaatctacaccgtccggaagcatctattgtggaaagtacattgaaaaagcaaaacctgtttggcttcccgagtcttggcatgaggaagtagtgggaggtaagggttcaagagaactacatgtgaagtgtagaagatttgcaacaagctcatttccatacatacttcgccacgaaggtttagtgaaggaaagtaatccaaaaatgtcaaagaatagggtcttgaaagagcataacaatactttcctagattggtttaaagatacaatctttgttgatgataatgcttctgaaatgttaagaaagctagtagataggcctaaaagaaatgttatgacttgggaaggatacgaggggatcctctag

SEQ ID NO: 51627 - DNA, 606 bp, Glycine max
  Peptide Sequence Number=SeqID_168405
atgacagatagtgaggaaaataaaggatacagaagacagatgttgaggatatgggtggcttctggtattgtagccctaaaatctgcagcttctggtgtagaaaaattcacttccaaaatagcacttagtaatcaaattctgccactctttggcaagcatgaggtggcacgtttcaagaaaacagaggcacctctagcaaacagtggcctctcacttgatctacagaaacttaggtgtcgtgttgtacgcatggttgaactgatgaagaagctgaggagctcaagcggaggtattttatggttatgctttgcggttcatatacttatggataggtatgcattcccttcctggagagaaaaggagatagtgtccgaagaaaggagatcactgggtctctctcctttgacaccagaggagtctgccttaattctgcaagccttgggttttgacagggagacaccgatatatatttcagctggtgaaatttatggtggtgaacgtctaagagctgcatttccaagaattatccacaaaacaaaggggatgagaggagagagaagaggtagatgtacaaggcagaacaacagaacgaagataagacaatag

SEQ ID NO: 51628 - DNA, 309 bp, Glycine max
  Peptide Sequence Number=SeqID_168406
atgacgatctcagactcattcaccgttggatcgaattttatcggagcagtcggaggaaaagctggaggaatcaatagagatgctattatcgctgtcagaagacacgtgatcccgcttagaggtaagagatgggttattcatgattggggattagtgaaaacatgtgtagggatctttagagtatcaattggaatgagttttgaggtcaccgggtttgagtactcctttaagcctatgctgatcccatatggttggagcattcttgcgaaacatcatgaccctgactggtctccctatgatcttacttag

SEQ ID NO: 51629 - DNA, 312 bp, Glycine max
  Peptide Sequence Number=SeqID_168407
atgaagtgtgtggcagtggaatggagggtggtgatgagaatcctgaaattagccaaatacaggctgaatgtccaagtggagaaggacgaatgcccaagtggagaaggacaaagcccccgagtggagaaggatgaaggcctagagacagagacactaccaagacaattaatttggcgtcatccaaaactccgtagcctgtatcaaacgttcggccccgtaaggttcacatcaggtggtattcaggttaggggtgataagcttcagggtgatgtgattcagaggagccgtggaatggagggtggtattctgtga

SEQ ID NO: 51630 - DNA, 672 bp, Glycine max
  Peptide Sequence Number=SeqID_168408
gagtcttctatccaatgcacttggggggtaggattgcatcaaagaacaaccgacaaccctacgtcgtcaatcgtcgtgccggccaccagacctatattgagtcgtggcggcaaaatcactatgctggctatggagccatcagaaacttgtgtcgtggtggatgtagatctatcgttgaacaaagtgaataaacctgacatcatctcaacttcgccgaaaaaagaagttgttgttgcaaaaaaaccattgaagaagaaggttgaagagaagaaacctgaggagaaaaaatcaggaaaaaaacctaaagaggacttgatgacgatgaagggaacaatagacgtgaaggagatggatatcaagagcaattccatgaccgttggcaagtaccaaatcgttagccccaacgagggtcaacctctgccagatgcccacagattcaccgtcagggtgacttcgtcttatgggaacaactatcactacggggatcgcgttcagacggggcagtttgcgtttgctgcagtggaggctggagattacatgacttgcttctgggctgtggatcacaaccctgtggaaacgttgactgtggattttgattggaaaacgggtgttgcggccaaggattggtcaaatgttgctaaaaaaggccaagttgatgtgagtactgtgtag

SEQ ID NO: 51631 - DNA, 597 bp, Glycine max
  Peptide Sequence Number=SeqID_168409
atgctgttgaaggactcgctcagtgaaccagattggctaagcgtggctcattcgcttagcgaggcagctagctcgttgagcaaatacaaaaccctggagaatgttgagctagagaccagcgcgcttagcacgcaactagcccgcctagtgaggacgttgtcttttctcgcgcttagtgtagaagcaaagcttcatgatgaatcaagattgattcaaagatgttttgatgataacaaagatggtgacaaaggtgatgacaaaaagctcaaaggtcaatcaaagaatgagttcaagatgttcaagatagaatcaaggacacttcaagattcaagaggaaagttgaagaacacttcaagattcaagaggaaagttgatttcaagaatcaagaatcaagattcaaggatcaagcttccaagaatcaagatcaaaattcaagactcaagattcaagaatcaagagaagacttaatcaagataagtatgaaaaggttttttcaaaaactgagtagcacatggatttttctcaaaacatgtttaccaaagagtttttactctctggtaatcgattaccagattgatgtaattgattaccagtag

SEQ ID NO: 51632 - DNA, 285 bp, Glycine max
  Peptide Sequence Number=SeqID_168410
atggagcattcacgaaggatattcacttggatcaatagctatcgctacagctacacggtggaggaagaagtgcacttccacacacactttggttacatccggcgccactttttgttgttagatgagccccggataccactgatcactttagaggcacatgctacatgtcacttgatttcaaggtgttacaatgacgatgacaatagcgatgacaatggaagtgacaatattgatgttgatggtgatggcgatgacagtactagtggtcgtggaggtggtaactag

SEQ ID NO: 51633 - DNA, 882 bp, Glycine max
  Peptide Sequence Number=SeqID_168411
atgagttcgggtagtagcagcagccacagcagtgagaaggagaaggagaagcagagagtgagtcgcacgtcgctgatactctggcacgcgcaccaaaacgacgccgcagctgtgcggaagctcctccaggaggatccctcgctcgtcaaggccagagactacgacaaccgcacgccgctccacgtggcgtcgctccacggctggatcgacgtcgccacctgtctcatcgagttcggcgccgacgtcaacgcgcaagatcgctggaaaaacacccctctggcggatgcggagggagctaagaagagtaatgtgatcgagcttttgcaatcgcatggtggcttgtcttttgggcaaaatggaagccatttcgagccgaagccggtggcgccgccgttgccaaacaagtgtgattgggaagtcgagccgaccgagcttgacttctccaactcggtgcgaatcgggaaggggtcttttggtgagattttaaaagcccattggcgtggaacaccagttgctgttaaacgtattcttccatctctttccgaagatagattggtgattcaggacttcaggcatgaggttaatttgttggtgaagcttcggcaccccaatattgttcagtttcttggagctgttactgacaggaaaccccttatgctaattactgagtatctaagagggggtgatcttcatcagtacctcaaagaaaaaggcgcgcttagtcctgcaactgctatcagcttttccatggatattgtcagaactgtgacatttgctcctgccacagaagctccttgtttctcttctaccccttctaggctagaaaccttcaaattcactcttattgttcaaagtcctctctataatcaggatatcagctaa

SEQ ID NO: 51634 - DNA, 789 bp, Glycine max
  Peptide Sequence Number=SeqID_168412
atggcctatttgggcaacaacaatgatagaaatattagtggtggtcacgatgacagtgacagtggtgatgatgtagatggtggtggcaatgataatgtggttgtgatagcggtgttggtggtgacaaccaaaggtgatgacgatgttggtggtggcgacgatgataaagttggtattaatgtcaataatgttggtggcgatgataatgtggtggtgatagcggtgttggtggtgacaaccaaaggtgatgataatgttggtggtggtggcaatgacagaggtgatattaatgtcaatgatgttggtggcggtagtggtagtaagaggtggcagtgtggtggtggtggtagttacgacattggtggtggttgttgttgtgatgctagtggtgattgtggtggtggtgacaaaggtgatattgttggtagtggtgctaacaatgatgatgatcgtgagattgatggtagtggtggtggtagcaatgtcgatggtgatggtgatgttgatggcgacgatgcaatgttagtggtgatggtgatgtcagtggcgataacagtggtggtagcaatgctgatggttgtggtggtggcaatcggctatggcaatgacaccaatggtgatggtgtggtggttgcaatgactagggtggtattggtggtagtggttgtaacatcccaattttccatgttgtgtgtttcaaaacctgattttgcactcttgaaggttggaaacttgaatctaaactccttcattcttccttctaaatttcatggagactataagaggtaa

SEQ ID NO: 51635 - DNA, 1563 bp, Glycine max
  Peptide Sequence Number=SeqID_168413
atggtgtcactggatagctgccatgtcagtattattgaacagcaggtaacagtacatatcccgggtttgatgcagagtgcacccatcgcctttgtgcggggggtggctgctggcacaacacagcaaatcattacacgtatgaatatcctgcataccctgcaacgtcagggcatgatcatttacaatcaggcgcgtgcaatcgaaattaccgtagataaaggtttaaccagccagttgctggcagagcaggggattgcgacaccttcgacctggatatgtgagcatcgtggaattgcgcattcattgatgcaacaggcaatggatgccgggaagtcattagtcatcaagcccttgtttggttcccagggcaaaggcgtgcgtttaatcaatccgcaacaatttgccttaccgcaagatccgtttgtcgatggtgtgtattatctgcaagaaaaaattgagtgtggtctgcatcagcatgattaccgtgtatttgtcgtgcgcggtgagccggtggccgtcatgaaacgacaaggtgacggttggttgcataacgtggcccgcggtgcgaaatgtactgcttgtgatgaaccagatgtcgtcgagcttggtgtgaaggctgcacaggcgatcaatattgattatgctggagtggatatcatgcgcgaccagcatggcaaattatgggtgattgaggtcaacagcatccctgcctggcgcggcttgcaaatctctgtacaacaagcctacttgaatgcctgcctggcagagctagaagcgctcaaacccggtaatgtgcatatttttgcggatgggcatggcatgcaggtccaagactttattcacagtgctgaggtatctgcaccggccttatgtgatgaccaagcttttggcgttcgcttattggggcaacgtattttagacgccctagaggtcacgtatgacaaagtaggctgcaataccaatctgggcattgtgttactggccgctccagtggtccaggccttggcaaactgtccgcaacaaccattgcaatatggtttgcaacaagtgctacagcaaaccaccattgctgatgcagcctgcgtgtatcaaggtatcaggctggtgaacccggctggtatggggcagcgccaagaacatgatgtatcagaagcgccgcagattgatttgttagaagcgatgcgtctggccagcgcgcaagatatggttgcacgccaatatgtcgatggctatgccaccatcttttctgcagtgttgccactttaccgcgaactgataaggcgctgggagcgtccagcctgggcactgacgggtgtttacttgtattggctatccacttttcctgatagccatattgcgcgtaaatatggggcggcaacggccgccagcgttcaaaagacggcacagatgcagtaccaagcctttattgccttggaaaatcctaaacattccctgtctgaattactgaagtgggatcatgcactcaaggagcaaaagctcaatcctggcaccagtgcagaccttaccgtgatcgccgccatgtgtgcagccttaacagagtag

SEQ ID NO: 51636 - DNA, 303 bp, Glycine max
  Peptide Sequence Number=SeqID_168414
atgtgtggggaagcgaacaatgatgcagctaaagaatttaattatatggccaaccataacagacaaggatttcacacaggtggtttttcaggataccagcagggaggaaactttaataataatcaaggagaaggctggaggtcacattcaggaaatcaattcaacaaggaacaaggagggtctcaatgtccaatcataagagtactgagtcagcaattaagaacctggaaatccaagagagtgatagtgggtgatgagagtcaaagcaatgaaggagagttaggagcagaggaagagaaatag

SEQ ID NO: 51637 - DNA, 549 bp, Glycine max
  Peptide Sequence Number=SeqID_168415
atgcacaacaagaacatccttccagagaggattgtagagctagcctattcacactatgacgagtttctcaaggagctcgagaggcgctggtggcatagggccttgaccaggcagccagataaccacatagaccttgccttggtcatggaattctatgccaacctctatgatctagaggatcgctcccccaggcaatgcaaggtgcgggggaagctgatcaagtttgatgctgctacacttaaggagtttttggagaccccaatggtcctagagcctggggagaggaaggacctgaccactctcgcgcagacatggagtgtcctttcctacttcaaccttgcccccacttctcatacctctgaccttaatatggacagagcgaggttggtgtacggaattgttataaagatggacattgatatgaatgacagcagaatggagaaggaagagagagaggagacgccacttcaaggagaagatgagtctagaagaagctcaccagcaaaggaggccatggataagagcttggaggaagaaggagatgaatga

SEQ ID NO: 51638 - DNA, 774 bp, Glycine max
  Peptide Sequence Number=SeqID_168416
atggcttctaaaaagagacttgcttcctcttccaggcctcaagagccatatgacacatccagatttgtctctgagatttcatgggagagatatgagatgaatgttcatcacaggaacatcctcccagagcgaaacatggagctgacatactcacactatgatgaattccttcgggaattagagagacgccagtggcacaagaacctgacaaggcagatggagaatcacatagacctagccttgatcaaggagttctactccaacctatatgacctagaggaacgctccctcaggcagtgcaaagtgcgggggaagactatcaaatttgatgccgccacactgaacacctttctggagacaccggtggtactagagcctggggagagcaccttggaagctgtagaggaaggacttgaccactctcgcacagacatgcttagtcatgaagatggacatggacctgggctccatcatttctggccagatatctcagatggcccagcccgaactccttcagacgctccagcacctacacctctagcacctgtaccagattcaaccaacccttttatgcctagtagtgatgtgattgtgcctatgctgcagagtatccaccatggcctttgcctgcacacaaaggctcactcagcaagcatgtctcaccgagcgagagtaagtgaaaatccgctaagcgagcttgggcgcgctaagctcgagaagagacaatgtcctcgctgggcgggttggctatgcactgagcatgttgatctctga

SEQ ID NO: 51639 - DNA, 627 bp, Glycine max
  Peptide Sequence Number=SeqID_168417
atggacgtgggctccatcatctcaggtcagatctctcagatggctcagtccaactcctctaggttgggttttcctacacttatcccggctttatgcatctctagaagagtagtgtctgattcactcaccttcgaatcccttagcccagccattaacctggcttacattagaaagaactcttggaacccagatgatcccactattacatttcatgggtcccgcaaggccagggctagggctccttcaaatgccttaactttagctttagctcctgctcccacaccagcaccagtacctccagcaccagctaacccctccacatcgagcagtaatgccatcttgccgatgctgcagagccttcaccacaacctttgcctggtgatgcagagcattcatgacttggctcaacagaggtcgattatcagcatggaggacttcatgactcaggttgcctggcccagagtccagccttcttttttggggggagaggacactctagaggctagggaggctaagaagacccctgaggagacacctacagccacacccatggagatcactgagggaggaggcgtagcagaggcatgcattgatgaagactatgtagcggatgtcactacggcttag

SEQ ID NO: 51640 - DNA, 342 bp, Glycine max
  Peptide Sequence Number=SeqID_168418
atgcaaagcatgcaaaatctatctcagcagcagccgatgatgagcatggaagactttttagcacaggtagcttgtcctggagtccagcctttctttttggggggaagtgaggctcctgtggtccaggatccatcatttcatgctactgaagacaccctagaggctggggaggctgaagacaccccagaggctaaggcagaggctgaggacacttcagtggaggctcctgaggaagcttcaggcgcaacagatgtagacatggatgaagattatgtagcagacatcactacaggcaggggacttgggatccatggcccattcctgctcaggattgaagcttga

SEQ ID NO: 51641 - DNA, 243 bp, Glycine max
  Peptide Sequence Number=SeqID_168419
atggaaaatctatctcagcagcagccgatgatgagcatggaaaaatttttagcacagggagcttggcctggagtccagcctttctttttggggggaagtgagggtcccgggggccaggatccctcatttcatgctactgaaaaaaccctaaagggtggggagggtgaaaaaacccccaaagctaagggagaagctgaggacacttcagtggaggctcctgaggaagctttcggggcaacaaaa

SEQ ID NO: 51642 - DNA, 282 bp, Glycine max
  Peptide Sequence Number=SeqID_168420
atgatgaggttagattctataaaaattttgaagaagaaaatatggacattagatgatcatgagaacattcagcacaggaatgaagatgtgtcattattcaggaaatgcttgtggctatggttgacttgttttataaatgtacatagaccaaagcaagcaactgcaaagaaattttggcttattgtgcacaattcaatgatattttctatagtgctcactcatgcacatcccattgctgttccagaacgggttcttgcctttcatcctgtgagtttcctgtaa

SEQ ID NO: 51643 - DNA, 615 bp, Glycine max
  Peptide Sequence Number=SeqID_168421
atggaaaacaaagagaacattaacgagtggcaacaaatcgaacaattccccgaactctccgaatggaacatggtagtgatcaacgaaaactaccttgttggtgaccaagcttcttccactaataacgaactctcattgttacaaatcgttccaacaacggtgacggacccggaagtcgacggaacttcgtcgccgttaacggtgtcgagttcggagggtgagacggcgccgttagattggagggtgagggtggttagcgaagccaagaaggtgttgaaggtgcgattggagggtgtgagagagcgcgttgttggggtggcttctaaggttggtaattgggcaatgtgtgcgggggcgttttggtcatttacgcaggttgccggagctgcggcggccgcggcggtgttgctgtcgcttgtttacgtggggattcgacggcggcggaggagggttggtcggcggaacgtggtggtggatccttgggtttatcttcttaaagagaaagatgaggaaacacccactctaaacggacggtttacagacgactccttctccctcactgaaacccccgtcgctaaatttcacaatcagcttcaaaaaatcctaggtaggtaa

SEQ ID NO: 51644 - DNA, 276 bp, Glycine max
  Peptide Sequence Number=SeqID_168422
atgaagaaaactctgtgtgttgttaattgtggcatgtcaataaaagctggaaagttaaagaaaagaagagaaggcgttgaaatgttgctgaaggactcgctcagcgagccagattggctaagcgaggcttattcgcttagtgaggcagctagctcgctgagcaaatgcaaaaccctagagaattttgagccagagagcagcgcgtttagcgcgcagccagcccgcccaacgagaacgttgtctcttctcgtgcttagcatgttcaggcctgcttag

SEQ ID NO: 51645 - DNA, 336 bp, Glycine max
  Peptide Sequence Number=SeqID_168423
atgacatcatgcatgagcataaatgcattggtcctctatgccgtgaacaaaggccacacgatgaaaggcatgtcattcaccacgtgttttaaggaacacgaagcaatggagagtgcaacaagaaagggaaacgaagaaggaagcatgatgggttcaatgctggagagtaagagggagagtaagaaacagagtgcaagatggtttttacaagacagtatagggagagataaaaaattcgaacgtcagtcttctaagccggttttcgagaaaccttcttggaatgacaacaattctaagaggatttcctcgaaattttcgtggaatggtagtttctaa

SEQ ID NO: 51646 - DNA, 207 bp, Glycine max
  Peptide Sequence Number=SeqID_168424
atgaatgtaaaaataagagaagatatggttgttctacgtgtttccctacgcccacacccaatcgatgctccacgagttcagacagtgtttcttgaagaagaagatcatcgacgtgaggaaagagtcgcgaattcgagaatgagattttggaaactttcacgtggaagagaggatggaggttataaaggaaatacgcgaacgttttga

SEQ ID NO: 51647 - DNA, 1005 bp, Glycine max
  Peptide Sequence Number=SeqID_168425
atggcaaacaagagaaaaagatgggaaggtcaaggagatcaaggaaacagtgaagaagggaacattgaattggagcaactaagggaagaagcagcatcaatggctgctgatatactcgttgctagaagagctaagaaacgttacattggtgtacgccaaagaccctcagggagatgggtgtctgaaatcaaagacaccatacagaacattaggttatggttaggcacttatgacactgctgaagatgctgctagggcttatgatgaggccgcgcgcttgcttcgtggcgccaacactcgcacgaacttcttttcttcacaatcttctcctaattctgttcctgctcttcctctaaagattgccaaacttctccttcttaggctcaaagctagaaacatggcctcttcatgtgtggttaccccttttcctagtaaccactatgaacccgaacccgagtcacatttttatcatcaaatagaagaatcctattatgggaattctttagatatggtaggaaatgggattgttgaacaaaattattattgtgctagttatagttcttctgccataataactacttgtgactttagttgtggtactaatgaagaaaattctaacctagagggtagtagtagggaggattcaagattagggtatcattgtgatgacaatgtttatgatcaaaacaaccagattgtgagtggtaaagagtttgaagactgtgatgctgggattagagatcttcagtttttggacactgctggatcattgagttgctttttttctccttttgagatagcagaagagatggtgggatcaatagaggaagaagagaaatatcgtgttgatgattcaccattaggtagagaatctttcaggatgaagtatgaacgtaaattctcagcttgtctttacaccctaattggggtgtctgagtgtttgagcctacaagttggaccaggaaatggaaaggaattggaaaaaaaaattgaggatggaaaatag

SEQ ID NO: 51648 - DNA, 375 bp, Glycine max
  Peptide Sequence Number=SeqID_168426
gcgcttgatgatgctgtattcgccgccggcgctggggtgtgcggcgccgagttcggcatagcacagcgcgatggcggcggcgacgcaggcggcgatcagaaacgacagaaaggcgccgctgccggcgttggcgatcgccagcggggcgatgacgaagatcgaactggccggcgtcacgccggacgcggtgatcatcaccacgtcgaggacgctgagattgcctttgaaggtgtgttcaggggcggactctttcatgggataacgactccattaacgctgtacgcaggaatcaaatggagcgcgcggaaaatcccctgcgcctttcaagccgcagcgttgttggccgcagatcattcgcaccagtcacttacttaa

SEQ ID NO: 51649 - DNA, 1050 bp, Glycine max
  misc_feature (594)..(594): n is a, c, g, or t
  Peptide Sequence Number=SeqID_168427
atggtgccgctgtggatgtggccgatggcggtcgcctgcggcaacaccttcgtgctgaagccttccgagcgcgtgccttctgccgcgctgtatatcgcgcggctggcgacggaggccgggctgccgccgggggtgctcaacgtggtcaacggcgatcgcgaagcggtggagacgctgctgcatgacgggcgcgtgaaggcgatcagtttcgtcggttcgacgccggtggcggagcacatctatcacaccggctgcgcgcagaacaaacgggtgcaggcgttgggcggcgccaagaaccacgcggtggtgctgccggacgccgatatccctggtgcggtcggcgcgctgatgggcgcggccttcggctcctgcggccagcgctgcatggccatcccgctggtggtggcggtgggcgacggcaccgccgaagcgctgatcgccgggctgcggcaacagatggccgccatgcgcgtcggccccggcagcgacaaccgcaacgacatggggccgctggtgacccaacagcattatcagaaggtgaaaggctatatcgatcatggcgtggccgaaggcgccgagctgctggtggacggncgcgaactgcgcgtgaccggcgcggacggtcgccccagccagggctatttcctcggcccgacgctgttcgatcgcgtgacgcccgacatgcgcatttatcaggaggagatcttcggcccggtgctcggcgtggtgcgcgcggcgtcgctgccggaggcgatggccttgatcgacgcccacgaatacggcaacggcacctgtctgttcacccgcgacggcgaggcggcgcgctacttctccagccgcattcaggtcggcatggtggggatcaacgtggcgctgccagtgccggtggcctaccactcgttcggcggctggaagcgctcgctgttcggcgatcttcacgcctacggcccggacgccgtcaggttctacaccaaacgcaagaccgtgacccagcgctggccgtcctccggcgatgcccggcgcgccagcttcagcttcccatcgggataa

SEQ ID NO: 51650 - DNA, 270 bp, Glycine max
  Peptide Sequence Number=SeqID_168428
atgtctcctccacctctagaacctcacaatcactcacaaagcaggacaacttcctcttcaagctccgttctctgcagtgcaactctggaccgcttagcgcgcattagtgaatttcggcttagcgcgcgtcttctcgctcagcggatggactcaagcagtgcgcttagtgggatgagctctcgcttagcgaacatgcacaactcatccttctgccagattcttcctcgcgctcagccaagggaatggtgcgctcagcgaatggctcgctaa

SEQ ID NO: 51651 - DNA, 699 bp, Glycine max
  Peptide Sequence Number=SeqID_168429
atgtgttttgtacaagattctttgaaggagcaggcgtcacagggttcatttgttccccatggacgtcaggatctcctaactactgccattgggcgactaaaacaccctggccgtgtgcgtgctgctggagctggtgtcaccataaagcaatacttcggatcggctccacgaagctcccgcagttcttcctccatggctcccaaagaactcgagcagctgactcaacaaatcagggaccaactggaggagtcgatcacagaaaaaatccaaccacagggacttgcactacctccggaacctgaggttggtccctcagttgctcgtgtcagcataaaaggaagttgtgttgatccctcatcgaccaatccagacacgggtgactcagacaaatgcgggttgtatattgaagaaaatctttctcgcctaattgccctaggaagagtttatgagggatccacaacggttcacaacatccctttgttgcatggccaagtgaaggttggtgttgaggaggttaaagatgtagaggctctcgttcctgtacccactgatgagacagctgtgtctccagcaaaacctccagataggccggatcatgaggtcgaggatcccctatatttaatgacattaaccatccgacaacttttttttgaagcatctccaggttatgtgggatgctaccatgttcggggtgtttaa

SEQ ID NO: 51652 - DNA, 372 bp, Glycine max
  Peptide Sequence Number=SeqID_168430
atggacaagcagaaggtgaaggcaatagaagagtggggagtccccgtgaccgagctacgatcagttcttggccttttgaactcgtcgggcaagtgtcagcgagcctttgaggacttgaagagggccgtgacggaggaacctgtattgaggttgccagactatactgtacctttcgaagtgcacactgaagcatcagactatgccattggaagagtattggtccaggagggacacccagtagcatatgagagccggaagctcaacgagacagaaaggcgcggtcccagtcccagagaaagagataacagccatggtgcattgcctgaggacgtggaggcactacgagcctggatcggctcccggtttatatag

SEQ ID NO: 51653 - DNA, 3064 bp, Glycine max
  Peptide Sequence Number=SeqID_168431
ggactggcggatggcgtcaaagccggcgcggatccgatgaccgagcgcaacagcggcgtgtttgccatctcggtttcgctgaccgacaaaggtctggcgcagcgcgatcgcgtgctggctgcagtattcagctaccttgatatgctgcgcaaacaaggcatcgacaagcgctatttcgatgaagtcgcgcacgtgctggcgctggatttccgctatccgtcgattacccgcgatatggattacattgagtggctggtggataccatgctgcgcgtgccggtgacgcacacgctggatgcgccttatctggccgaccgctatgatgcggccgcgatcagcgcccgtctggctgagatgacgccgcagaacgcccgcatctggtacatcagtcccgctgagccgcacaacaaacaggcttactttgtgaatgcgccttatcaggtggataaaatcagcgccgcgcagtttagcgactggcagcagcaggcgcagcagattccgctgtcgctgccgaccctgaatccctacattccgtcggacttcgccctcatcccgtctgacggtaagcattacgatcatccggtggcgctgaccaatggcgacagcatgcgcatctactggatgccgagccagttctacgccagcgagccgaaggccgctattacgctcgcgctgcgtaacaaatccgcgatcagcgatgcgcgccagcaggtgttgtttggtctcaacgactacctctccagcctggcgctggatgagctgaattcgcaggcttcggtgggcggcatcagcttctctaccggtgaggacgacgggctggtattcaatgccagcggcttcacccagcgcctgccggagctgctgaaaaagctggttgaaggctacgccagcttccagccggatgcgcagcagctggagcaggcgaaatcctggtatctggatcggctggaagcagcggaaaagggcaaagcgtttgaacaggcgattcagccgatgcaaatgctgtcccagctgccttatacccagcgtgaggcgcgacgccagctggtgaaacagatcacgctgcaggaggtgatggattaccgcgatgcgctgatccagcatgccacgccggaaatgatggtggtcggcaacctgtcggccgatcgcgtaaaacagctgggcgaagagcttaaacagcagctgcacagcgcggggcacggttactggcacagcaattatgtggtggtggataagccgatcaaagccaacctgcagaaaaccggcagcagcaccgactcagcgctggcgacgctgtatgtgccgctcggctacagcgagtatcaaagtatggctaacagcaccatgctgagccagattgtgcagccgtggttctacaatcagctgcgcaccgaggagcagctgggctatgcggtgttcgcttatcagatgccgattggtcgccagtggggcattggcttcctgctgcaaagcaacagtaaagcgcccgcttatctgctgcagcgtttccaggcgttctatccgcaggcggaacagcgtctgcgcagcatgaaagcggaagatttcgcccagtatcagcaggcactgatcaacgatctgaaacagcgtccgcaaacgctggatgaagaagccaaccgttacagccgtgatttcaatcgccagaacttcgcgtttgatacgcgcgaaaaagccattgcgcaaattcagcagctgacaccggccagcctggctgactttttccatcaggccgtgctggcgcagcagggcatggcgatgatctcgcagattggcggcagtcacgatggcacccacgatgcggattacgcgccgctgccgggctttaccacctgggatgaagtcgcccggctgcagcagtcgctctccggtgagcgtctgattgaggcctccgccggcaccggtaagacctttaccattggtctgctctacctgcgtttgctattgggacttggcggaccgaatgcctatgcgcgcccgctgtcggtggaagagattctggtggtgacctttaccgaagccgccaccgccgaactgcgcggccgtatccgggaaaatattcatgagctgcggctggcctgtctgcgcggcgtcagcgcaaatccgatgctgatgcagctgctggccgacattgcccagcccgctgaggcggcctcgctgctgctggcggcggaacggcagatggacgaggcggcgattttcaccattcacggcttctgccagcgcatgctcaatctcaacgcgtttgagtccggcatgctgttcgagcagcagctgattgaagatgaacagcagctgttgcgtcaggcgacggcggatttctggcggcgccactgctatccgctgacgctggatattgcgcgcgtcatcgtttcggaatggagcgggccggaacagctgttgtcgacgctgcgccccgcagtggcgggcgctgggcgagaggtgctgacgctggtcgggcagtctgatgtcgataagcgcagttacagcagcaaaaacctgccgctgtgggtcagcaaagtcagcgcctgggcgcagagcgagaccgcggattaccagattcccgccgagctggcgcgtttcggtcagcaggtgctcaatgaaaaaaccaaaaagggcgcgccaccgcatcacccgttgtttgctgccattgatacgttcctggcgcagccgctgtcgctgcgcgatttggtgattgcacgcgcgctggtggaggtgcgtcacgcggtgcgtaaagagaaacgcctgcaggcgctgctggggtttgacgatctgctgagccagctggacgaggcgctgcaacagcccggcggcgagcagctggcgcaggcgattcgccagcgttttccggtggcgctgattgacgaattccaggataccgacccgctgcagtaccgtattttccgcacgctctatttacagcagccgcagcatgcgctgctgctgattggcgacccgaaacaggctatctatgccttccgcgagcgtcaatcagctgtttatgcgccagcccgcaccgtttctgtttgcggacatcccgtttctgccg

SEQ ID NO: 51654 - DNA, 1060 bp, Glycine max
  Peptide Sequence Number=SeqID_168432
atgcaggttctggatatcgatcaccagccgttcgggattgctcagcgtgaactgcttatagtgcagcgcgacgttggattccagcgtcacgcgcgagtaagtcgaggatggccagatgcgcacggccacaatgtgctgactggccgcaaaaccgctgcgcgtcacgctcagcaaccacagcgcacctgcgccctagggtttgccgtgaaggaacgcagtaccgaactggttcagggttttcgccataccgttccctatattaatgcccaccgtgacaagacgtttgtcatcatgctgggtggcgaggccatcgagcatgagaacttctccagcatcgttaacgatatcggcctgttgcatagtctcggcattcgcctggtggtggtttatggcgcgcggccgcagatcgatgccagcctcgcgcagcagcagctggagccgatttatcacaaacacacgcgcgtgactgatgcccaatcgctggagctggtgaagcaggcggccgggcgtttacagctcgatattacggcgcgtctgtcgatgagcctgaataatacgccgctgcagggcgcgcatattaatgtagtgagcggtaacttcatcatcgctcagccgctgggcgtggatgacggcgtcgattactgccacagcggccgcatccgccggattgacgaagaggcgatccatcgtcagctggataacaatgccattgtgctgctgggtccagtagcggtctcggtgaccggcgaaagctttaacctgacctcggaagaggtggcgacgcagctggcgattaagctgaaagccgagaagatgatcggtttctgctccgaacagggcgtaaccgaccgcgaaggcaccatcatttccgagctgttcccgaacgaggcgcagacgcgtattgatgaaatggagagcgacggtgattttctctccggtaccgtgcgcttcctgcgtggcgcggtcaaagcctgccgcagcggcgtgcgccgcagccatctgattagctatcaggaagatggcgcactgctgcaggaactgttctcgcgtgacggtatcg

SEQ ID NO: 51655 - DNA, 378 bp, Glycine max
  Peptide Sequence Number=SeqID_168433
aagtttcctctcttagaggagagttgctacaagtaagagatgagcgagaccggcaattatctcaagtacaaactttaagttctgaattagagaaagttaaagaatctaggaaacactcctccactaaattggatagcttgaccttaaaagctaatgatctggaggaaaaatgttctttgaaagataatcagataaaggcattggaagagcaactagcaactgcagagaagaaactgcaggagttaaaagggaacattcgtgtactctgtcaagtgaggcctttattagctgatgaaagttgtagcacagaaggaaagatttttagttatccaacatcaatggaaacttctggacgagccattgacctagcccagaatg

SEQ ID NO: 51656 - DNA, 549 bp, Glycine max
  Peptide Sequence Number=SeqID_168434
atgtctcttgcaactctttttggaaagcttcatgaacatgaaatggaacttatgagactccatcaacatgaaaaaaatgacaaaaagaataaaggaattgcactcaaagcctcatcatcttctattcaagaagaaagtgacaaagaggacttgaataaaatacaagaagatgatgatttcagattttttatgaagagattcaataattttttgagaaacaaaagaaatcaaagaaaatcaaacatcaatccaaagaagaaaggagaagattcctcattggccccaaaatgctatgaatgcgatcaacctgagcacatgagatttgattgtcttgtctttaagagaagaatggaaaaatccgacaaaagaaatgtcaaagaaaagaaagaaaagaaagcacacatcacttggaaagataatgacatggataattcaagtgatttagaaaatgaaatcataaatctgggtctcatggccaaagactatgaaagcgaagaagagatgcattcaatgatttgcataaagaatatgccaaacttgccaaattag

SEQ ID NO: 51657 - DNA, 1134 bp, Glycine max
  Peptide Sequence Number=SeqID_168435
gggaccatacctcttctcagggttctatccctcattagctagaacttctaagatagtccaaatctcggcgcaggaattagaccacagaaagcaagttgaaaatggggtggttggattaccgagaaaatatttggaggcaaaagcaagaatcttggcagcgatcgacgcttttctcgcctatcataaccacaaggaaagcccgattatcgctatgctagccgacatatatggcaccttcgaccgaagatgtaaggcatgcttgcccgctagaaagtcaccgctcatgcacagagaaaggaggcgcaaattgggagcaactcttagcaagcaaagaatgagcatctgtcaactggttccctcgatggaaggaagaaccggagttcttatttcatgcggaggatttccaaatgttcccttattggggacgaggggttgcatcagctacaatcccgttcttgctataagacaacttggctaccctatgagaggggcaccactagaggatgagctcgcgcctgtcatttcacgaggcttcaataagaccaacgtggagacacttcagaaaggtccgcaaggcatgggaggtgttgcaaaagaaggacaaggaactcaggggcaaaccactaaaagagaggaagttgaggcactgaaggaagacgaagaagtgcaggcccttagggcggaactcgagcaagcccaaacagttaaagaaagggctcgtagggaagaacacggtcggaacaagttccgaggggctctgtggggcagtaacaacgagcttaagctccagagagaggaaagggaccaatcgcgagtagacaatttgatcttgaaggatgagttgaaggcttgctcgaggtccaagaaaagtttgtctcagcggttatgcaagatagagaccaacatgttagccatcatcagcaagtaccaagaagaactaaatctagccacggcccacgagcatagagtggcggacgagtatgcccaagtgtacacggaaaaggaggctagaggaagggtgatcgactcgctacatcaagaggcaacgatgtggatggaccgattcgctcttaccttgaatgggagtcaagagcttccccgattactagccaaggctaaagcgatggcaaacac

SEQ ID NO: 51658 - DNA, 123 bp, Glycine max
  Peptide Sequence Number=SeqID_168436
atgtgggccatcatcgatgagtacaaggaaaagctatacctagcggcagctcacaggcaaaagctagaggatgagtatgccaaggtatcagtcttgcaagcggaaagggaagcaagggaaaag

SEQ ID NO: 51659 - DNA, 833 bp, Glycine max
  Peptide Sequence Number=SeqID_168437
atgaatacgctcaccccgattcttaatccgctgaccttaccgaaaggggcggtgctgaaaaaccgcctggtgatggccccgatgaccacctgtaccggctattacgacggcggcgtgaccagcgatctcgttgagtattatcgcgtgcgtgccggcagcatcggcaccgtgatcgtcgagtgcgcctttatcgataaccgcggtccggcgttcccgggcgctatcggcatcgacagcgacaacaaaattcctggcctggccagaatcgcgcacgccatcaagtctcagggttccaaagccattctgcagatttaccacggcggccgcatggttgagcccgcgctgatcggcgggaaaaccccggtcgcgcccagcgctatcgccgcgccgcgtgaaggtgccagcaccccgcaggcgctgacggcggaagaagtggaggtgatgatcaccaagtttggtgatgcggtgaaccgcgccatcaaagccggcttcgacggcgtggagatccacggcgctaacacctacctgattcagcagttctactcgccgaactctaaccagcgcgacgacaaatggggcggcagccgcgacaaccgcgcgcgcttcccgctggaagtgctggaaatcacccacaaaatggcggagcgcttcgccgcagcggatttcatcatcggctatcgcttctcaccggaagagctggaagtgcccggtatccgctgggacgacacgctgtacctgctggaaaaactggcggcgcgcgggctggattacgtgcacttctccgtcggccagctgctgcgtccgtcgattgtcgacacccaggatccgacgcc

SEQ ID NO: 51660 - DNA, 939 bp, Glycine max
  Peptide Sequence Number=SeqID_168438
atggcaccgcaggcgcagctggatgtgtttgaaatcagtcccgagctggtaaaagggttacgccgctggaacgatgcgcgcatgcaggtgcgcgcctgctccgcagagtatctgtccggggagactggggccgcgcggcgtgtttgtccagtttcagtacacctcgctgacccagcccagcctgtcacgctacttcacctggcagcgccagcgggtgctgaaaaatatgccacccgcgtgggtttatcgctgcacgcggcattacgcgccctgagcctgcgcctgcgggcgcgtttgctgccagaaacgctgcagcagctcgcgcgcccagtcttcgccagacagctgcgcgccatcatcgctgacgccggaaggcagacaggcgcgcctgcggcgaatagcgcaggatctggcaaccatccagcgctgaacgcgccagcacctgtgcctgcggcggcggtaccagcaccgactggcggtgcgacaaccacgccgggaaggcctccggcaactgtgccagccacggatcgcgccgttcgggttatcgcccactttaccgcccagcgcataggccatcagctgatggccatagcaaacgccgagcagcggcagttgcgcgtcgatggccgcacgaatccaggcggcggtgcgctcgctccagtcggcgtgatcggtcaccatcgcccacgaaccgctgaaaatcgcgccgctgatgccagagaaagccggcagctcttccccgagatgcggccgcacaatgacataatcatccggctagcaagggtggggattgctggagcttccgccactgtttctgacctggatgcgctttgtggtggtggctatcgtgctggtgccgttttgccgcatcacgcgcgcccagctaccgtggctgctgacgctggcgtttacctttggcttcatgcacttttcactgct

SEQ ID NO: 51661 - DNA, 1540 bp, Glycine max
  Peptide Sequence Number=SeqID_168439
atggagatcatctggtatcacccgtcactgaatccgcagccgtggctggacggcatgcgccagcgtctgccgtcggtgcgcatccgccagtggcagccgggcgacagtgcgcccgccgactacgccattgtgcgatcgccgccggtggagatgctggcgggacgggcgttgcgtggcgtattcgccatgggggccggcgtggacgaaattttgcggcagctgcgcacgcaccctgagatgctggctgacgcggtgccgctctaccggctggaagacaccggcatggctcgccagatgcaggagtatgcgaactggtgcgtgctgggctggttccgccgcttcgccgactatcaccagcagcagcgacaggcgctatggcagtcgctgccggaccgcgaacgtgctaattttaccattggcgtgctgggggccggcgtgctcggccgcagcgtgctggagagcctgcgccagtggggcttcccgctgcgctgctggagccgctcgccgaagcagattgccggtgtcaccacctttcacggccgcgaccagctaacggaattccttgccggcacgcagatactgattgatttgctgcccgccacgccggaaaccagcaacctgatcgatggcgcgtttcttagcgcgctaccgcgcggcgcctgtttcctcaacctcgcgcgcggtgcgcacgtggtagaggccgatctgctggcggcgctggagagcggtcagctggccgccgccgcgctggacgtattccaggtggagccgctgccagccgcgagtccgctgtggtctcatccgcgtgtcatgattaccccgcataatgccgccaccaccttgccgcatgaggcgatggactatatcgccggtgccatcacggcactggagcagggccaacagccgcgcgaggagaagaggatgtatcccgtcgatttacatatgcacaccgtggccagcacccatgcttacagcacgctgcacgattacgtcgctcaggcgaaacggaacggcctgaagctgttcgccattaccgatcacggtccggacatggccgatgcgccgcactactggcattttgtcaatatgcgcatctggccgcgcgtgattgacggcgtcggcgtgctgcgcggcattgaagccaacatcaaaaatcagcagggtgagattgattgcagcgggccgatgctggatgcgctggatctgatcgtcgccggcttccatgagccggtctatgcgccgcgcgacaaggctcaccacaccgaagcgatgatcgccaccatggccagcggactggtacacatcatcagccatccgggtaacccgaaattcccggtggatattcgcgccatcgcggaagccgccgcgcactacgatgtggcgctggagatcaacaactcgtcatttacccattcgcgtccgggcagtgaacctaactgccgcgcgattgcggaagcggtgcgtgacgccggtggacggctggcgtttggctccgattcgcacaccgcctttacgctcggcgatttcgaacactgcctgc

SEQ ID NO: 51662 - DNA, 1135 bp, Glycine max
  Peptide Sequence Number=SeqID_168440
atgataaaaaatgtagtgtttacgcctgcgcgtcttaccctgttgctcagcgcggcgctgctgagcgcgtctgctgtgcacgctgaggataacagccgcatgctcagcgcccagccgcagccgccggatgtgcgactcggcccactattcagtgccgtgcagcaggccagattttatccggaccagaaaacctttgccgatgcggtccccaaatatgacccggcgtcgattctcgccgactggcagatgcagaaaaatcagcgtaatttcgatctcaggcgcttcgtggataccaacttcaccctgcccaaagcgcaggataaatacgtgccgcccgccggccagagcctgcgcgcgcacatcaatggcctgtggccggtgctgacgcgcagcacgccaacagccagccagtacgattcgctgctgccactgccaaaaccgtacgtggtgccaggcgggcgtttccgcgaagtctattactgggacagctacttcaccatgctcgggctggcagagagcggccactgggatcgggtgcaggatatggtggacaacttcgccagcgagctggacaagtacggccacatccctaacggcaaccgcagctattatctcagccgctcgcagccgccgttcttcagcctgatggtggatttgctggccagccataagggagacgacgtctaccgtcagtatctgccacagctgcaaaaagagtatgactactggatggcggacagcgataaggtggctgccggccaggcgagcaagcgcgtggtgaagctgagcgacggcaccctgctcaatcgctactgggatgaccgtgacgtgccgcgcaccgaatcctggctggacgatgtcaacaccgcgaaaaaagcgcctgagcgcaataaacagcaggtgtatcgcgatctgcgcgcgggcgccgcctcgggctgggacttcagctcacgctggttcaccgatgcgcacaatctggcctcgattcgcaccacccagctggccccggtggacctcaacagcctgctgttccacctggagcagacgctggcgaaagccgcgaagctggcaaagcagaatgacaaagcgcagcagtttgcggcggatgcagagaagcgccaggcggcgatcaatc

SEQ ID NO: 51663 - DNA, 516 bp, Glycine max
  Peptide Sequence Number=SeqID_168441
atggagagaagtatgatagatgctgccagtggtggagcccttggagacatgacccctgctgaagccaaaaatttatttgagaagatggcttcaaactcccagcaatttagtgccaggagtgatgctattgtcattagaagagtgcatgaagtagccacaaattcatcctcatcaggcaagactaagaagcttgaaggtaaactagatgccttggttaacctggtaacccaactggccatgaataaaaaatttgcacctgtcgccagactctgtggtttatgctcctctgccgaccaccacacaaaccttttcccttctatgcaacaatctgaagcaattgaacaatgtgaagcttatgctgcaaacatctacaacagaccttctcaacctcagcagcaaaatcagccacaacaaaataattatgacctctctagcaacaggtacaatcccgaatggaggaatcatcccaaccttagatggtcgaatccttcacaacagcagcaacaacaacaatag

SEQ ID NO: 51664 - DNA, 270 bp, Glycine max
  Peptide Sequence Number=SeqID_168442
atgaagccacaccaagaagagacggaaattgtgaacttgggtgttggcgaagaaaggaaagaggtgaaaaagcagtttgacgctggttttttggccgtggctcaattccccaaatgggtagccaacattgtgccagtccctaagaaggatgggaagataaagatgacaccggaggacatggagaagactacattcgtcaccttgtggggaacgttctattataaggtgatgtcctttgggctcaagaacgtcgaggcaacctatcaatag

SEQ ID NO: 51665 - DNA, 156 bp, Glycine max
  Peptide Sequence Number=SeqID_168443
atgtctgatatgccttttagaggcttgaaaagtgcaagaaaacgagctgcgttttctggaaaacacgatgaactcgctaagcgagcatgctacgctaagcgttctctgaagaacttgctaagcgcgcttaccgtgctaagcgagttcatcttttga

SEQ ID NO: 51666 - DNA, 910 bp, Glycine max
  Peptide Sequence Number=SeqID_168444
acagtggaggaattgtcccaatgtctacttgattctaacttcagataattctgtcaaggagtgcttcagggacctagggttatttcctgaagaccaaagaattccttttacttctcttattgatatgtgggcagagttgtatggactagatgatgatggcatagaggcaatgtccatcatcaacaaattagactccatgaatctggctaatgtctcggtagaaagtgatctgccattcattatattcacaactgatgccatatgggttgcatttgcagatgaaaattgtacttcagattggcccctaatgatgcaactggctcaagttgaggcatttgaaaacaatcacatgctaattccaaacgcttttccgaatcttgaagagttaaacattgaccattgcaaagatatggtggcattgcctaaggggctctgtgatatcacctccttgaagaagctcagcattactaattgccacaaactctctgcactgccgcaagaaattggaaatttgatgaatttggaactcctaagcctcagttgctgtactgatttggaaggtataccagcttctattggaaggctttcaaatctacgacttatggacatctcaaattgcataagccttcctagtttaccggaggactttggtaatctgtctagtctgcaaaatctctacatgagaagctgtgcaaggtgtgaattaccattctcagttgctaatcttgagaatttaaaggtggtggtatgcgataaagagatagctgcttcatgggacgatttcaagcctatgcttcccaatctaaagatagatacttttgataatcttgagaatttaaaggtggtgataggcgatgaagagacagctgcttcatgcgaagatttcaagcctatgcttcccaatctaaag

SEQ ID NO: 51667 - DNA, 1656 bp, Glycine max
  Peptide Sequence Number=SeqID_168445
atggctacacgccctcgccttgcttttagaggacaacacatcatcgccatcagaggactacacgtcttcgtcttaagaggactacacgtccccgccttcagagggctacacaacctcgccttcagaggactacgcgtcctcgccttcacagggctacaagtcctcgccttcacaggaacacacttcctcgtcttcagaggactaaacgtcctcaccataagaggactacacgtcctcgcctttagaggactacatgtcctcgccttcaaagggctacacgccctcgccttcaaagggctacacgccctaaccatcagaaggctacccgccctcgccaagctttcagaggacaaaacatcgtcgccatcagaggactacacaggactacacgtcctcgtcatcagaggactacacgtcctcgccttcagaggactacacgtcctcgccttcagaggactacacgtcctggccttcagagggctacacgtccttgccttcagagggctacacgtcttcgccttcagaggactacacatcctcgccgtcataggactacacgtcctcgctttcagaggaatacacgttctcgccttcaaagggctatacgtcctcgccatcagaggactacacgtcctcgccttcagaggactacacatcctcgccttcagagggctacaggtcctcaccttcagaggactacacgtccttacctttaaaggactggacgtcctcgcctttggcgggctacacaccgtcgcctcgacttcaaaggactacacggccgcacatactcgccttcagaggactacacgtcctcgccttcataggactactcgtcctcgccttcaaaggactacacgtcctcaccttcagaggactacacgacgacacgtcctcgccttcagaggactaaacgtcctcgccttaagaggactaaacatcctcgccttcagaggactacacgtcgtcaccatcagaggactagacgtccttgcctttagaggactacacgcactatacatcctcgccttcagaggagtagacgtactcgccataaggggactacacgtcctcaccttcataggactacacgtcgtcgccttcagaggactacacgtctttgccttcataggactacacgtcctcgccattagagggctacacgtcctcgcattcagagggctacacgtcctcaccttcagaggactacacatccttgccgtcataggactacacgtcctcgctttcagaggaatgcacgtcctcgcctttagaggactacacgtcctcgccgtcagagggctacacgccctcgacttgacttcagaggactacacgtcctcgccttcagaggtctacacatcctcgccttcggaggggtatgtcgcaacatgcccttttgcgggcgagcgaaggcgaggctcacgggtgcgctttccaaaggaggaaagatgcgcggagttgccaccaacgtttatttgtgggaaacgtcggaaaaaccgaaggaaaccggtcgaaatgaaaattctaagttcgggagtagtatttacgtttgaggaaggtattagcacctcttatgtcgacaaaagcgggactcttgcttctatgtaccctccatcgaagaggaaatcagacctacgtagttctttcttaagg

SEQ ID NO: 51668 - DNA, 714 bp, Glycine max
  Peptide Sequence Number=SeqID_168446
atgtcctcgccttcagagggctacacgccctcgcctttagaagactacacgtcctcgcctttagaggactacacctccacgccttcaaagggctacaccttctcgcgttcagaggactacacatcctcgccattagaggagtacacatcctcgccttcagaggactccacgtcctcgccttcagaggtctacacgcccatacctttacaaggactacaggtcctcgccatcagagggctacttgcccttgcctttagaggactacatgtcctccccttcagaggactacacgtcctcgccatcagagtgctacacgcccttgctttgagagcactacacatcctcgcctttagagggctacatgccctagccttcagagggctacacgttgtcgccttcagagaactacacgtcctcgccttcagaggactacacgtcctcaccttcagaggactacacgtcctcgccatcagagggctacatgcccttgcctttagtggactacacgtcctcgccttcagaggactacacgtcctcaccttcataggactagacgtcctcgcctttagagggctacacgctctcacctttagagggctacatgccctcgccttcagagggctacacgttgtcgccctcagagaacttcacgtcctcgccttcagaggactacatgtcctcaccttcagaggactacacgtcctcgccatctga

SEQ ID NO: 51669 - DNA, 129 bp, Glycine max
  Peptide Sequence Number=SeqID_168447
atggtaaaggttgtgcacgtgaacgggtcctcgttgactgagctgatagttggatcaaacgggttggtccttgggttttcctccgttaaaactatgctacaagactgccatgagatggctttgatgtga

SEQ ID NO: 51670 - DNA, 381 bp, Glycine max
  Peptide Sequence Number=SeqID_168448
atggactcttcccaccaatggtgttattgtagtgatggccagaggagggagtcgaatgtgttgcttgagggaaacaggttctgttttcggcttccatgggtttctgatccacgaaaaggcccactggtcttaggggctaatggtggtgctgggttacacatcaatagaactgttgatataaatattgtgcttggttgctactgcccgcatttgcttattagggatgaaggcaagaagaaagggttcaaggtacaagctgagattgttgcaacaactgatgaagttgtggataacgttgccatagtcaatgaggtcctcattgatctcattaacactagtgcattgcaagacaatgaagaatcaacaaagtccaatgcataa

SEQ ID NO: 51671 - DNA, 297 bp, Glycine max
  Peptide Sequence Number=SeqID_168449
atggtattgggctttgccttgctggaagcactatcggtccacgtgacagtgataggaatctcccctgttagttttatttacatacaacatatagttaaggatgggggatatgctgtagaactatatttggtgggcatattgtttggttgtgaagtgcaggggatattagacatgagcatggattcaatgattcttattgaagcttctaagctacagatgcagatgaaagaagtgcctggaactcggtgcacagttaagaatcttgaaggagtcatctttgtagttactcttgagtag

SEQ ID NO: 51672 - DNA, 813 bp, Glycine max
  Peptide Sequence Number=SeqID_168450
atgatgagtgaatcaggtgttaaggtctgtgtcttcaacaatggcgacaccctttgtggtggagctgaaggtatcacatttaacagcgataacaagaagtgtattattgttcaattagacattaccatatctgaactgaagcacattgttgattcaatattttgcatcaaggatgatggatctcccttgggtggtcaattatccgctcacacatccaacatgaccttttgtgattcttcttcttctccttctactaccctcacccaaacccagaatccgagtgaccctcaaatcatagttcctaacagaaagcgtagggtgaaggcttcttctgatacccaattcaaagagaattggttggcttcactctcttacccttttccagaaaagacgcatcttttgagtggagagcatgaaccgacccaccaaaatgatggctctaaatgggtccttggaattgatccagatgtctctggcgctgttgcactcttgaaaacacacggttctgtttgttcagctcaggtaccgtgcttctttttgtctctgctggctaaagttctttccttttctgtcctttgttacattacatggtttggttgcggtttcattgtccttgatattgtgggaaattgtggtcaatctggctgcaattgtggtcgtggtgacccaaaaagcttgatactgcagctgaaattgcggaaattgccaaatgccaaccaattcggctgcaactgtggttgccaagaccctgaaaaccttgatgctgcacaagggtttttgtctggagatttgttggggttgggtgtggtttag

SEQ ID NO: 51673 - DNA, 300 bp, Glycine max
  Peptide Sequence Number=SeqID_168451
atgaacgatagtgaaaggaagaaaatctggtatgccgaatctttctcccatttttccgacgaatttgggatcaaggagttctggagaatatttgggaggtacggaagagtgaaggaggtgttcattgcagcaagaagaaaccaatggggtaggaggagtagttcaagacatagtaaagtaggcagcggaaaacttcctattcattgtcatttcaattgtgatgtcatccttactcggagtggattgtttgatataagttacggaattttggatgacgttcctttcaaagagggaatataa

SEQ ID NO: 51674 - DNA, 378 bp, Glycine max
  Peptide Sequence Number=SeqID_168452
atgaatagtgacaagcttgaccataggagaaaatgtctcatggaagtcaaagccatggacttgatgaaaaccttaagctaccagccttgctttaaacttgttgatggaaccgtcaacattttcctttactctaaaaatccgccttgctttaaacttgttgatggaaccgtcaacattttcctttactctaaaaattcacttgcacccaatagcttgtctgttggaagaatgagcaagaaacaaggaaggatgcaacctaagattgtgaattccagagttagaccttgtttgcataggatgattgttaatagggatggaatgaggtgctggaacaagctcagaagaagatcactaagggttatggactctgatgtttga

SEQ ID NO: 51675 - DNA, 111 bp, Glycine max
  Peptide Sequence Number=SeqID_168453
atgggtctacaaggcaagcagataaagaatgacttggaaggtgcaagaaaatctaggaggtgggaaagtcattggaaatatcttgcgtgggactggacagacaagagatga

SEQ ID NO: 51676 - DNA, 150 bp, Glycine max
  Peptide Sequence Number=SeqID_168454
atggaagatgatcgcatcgatgatcgtgttaatcctgagtatgaagcatgggaagttcaggaccaaacgcttcttcttgttgttggtgttggagttctggttcgtcatgaggagtatgttgacacacttgaaggactctcgtcagattag

SEQ ID NO: 51677 - DNA, 492 bp, Glycine max
  Peptide Sequence Number=SeqID_168455
atggcagtggtggtcagttttcctgattgcagtgtagaacgcaatggtggtaactccgacagagatcaaggtggtggtcgatttgccaatttttgctttaagtatggttacactccacacttcaaccaattcccaattccaagcaatggtggtggtggtcgtggtggttttcctgatcgcaatgttggacgcaatggtggtagctgcggtagagatcaaggtggtggccaatttgccaattttcaatgtcaattttgctttaagtatggtcacactgaaaatgatcatgctagctccatctggattccaaattctggtgctaacttccatgtactcactttctttgatcgagccacacttcaaccaatttcctactcctctggttctacacgaacctctaatacttgggttaatcccaattccaagcctgttggttccaacttcaaaccaacccagtgctatgcttaccaattcctcctcccatggaaatga

SEQ ID NO: 51678 - DNA, 1203 bp, Glycine max
  Peptide Sequence Number=SeqID_168456
atggatacaagaaaaattgaggcagtgcttcaatgcccgttacccaaatcagtcaagagtttgagaagatttttaaggaaagctcataagccttctgcaattaaagcgagcattaactacagttttgcagaagagggtcattgcttatttcaacctttatcagaagcatccttgaataagtcagtgtatgagaaagaattgatggctttggtgttagccaatccagcattggcggccttgcctgctggtgcaataaatcaagtagttgatgctctgtctgagaaggaaaatgataaagaaacacagaccttatccaaaccttattggcaagatatctctgagattgaccagaagcaagttagttctgcctaccaattcaagctggatccctcaactattcaaggaatttcactcttccttggtgtaggggccactcagggtaagtacctcacttcttcaccagctggtttatatttgccaaagaagtacctcacttcttcaccagctggtttattacaaccattgccaatccccaatgctcatccctatattgctagtagtgtgccggatatctttactaaggaagtaataaggctgcatgggattccttcttcaatagtgagtgacaaggatgcattgcttttgagggaagtcctacttgaggcaatgactcaagatcttatggaaacaattaatcagttgaagtttcatctaaacaaagctcataatcacatgacaaaatatgtcaataatcatcgcttaccttcgaagattaaggagggggattgggtgtgtctcaagataaggccgcatagacaagcttcaatgcctacaagattaaatcctaagctatcagccaaatactatggcccttatcgggtggttaaacaaattggagtagtggcatttcagttgcaattacctgacgctgctcaaatccaccttgttttttttcacgtttcccaattgaaacttgcagtgcaagaacatcaaattgaggggggtattgttaggcaagaggaatcatctactgcagctaagtcgttgctagagagaggaatacttggagaaattgaacaaaacaaggaaattgtgaaggagtctcctgcagagaaaagcagaagcacttcaatagttgatggaagagaaacaaaagccttggacatgttttggttcctcaagccttgcacactgtcaggctga

SEQ ID NO: 51679 - DNA, 213 bp, Glycine max
  Peptide Sequence Number=SeqID_168457
atggcctttgggaccacgatagctcgcccaggcgagctgatgcttcatcctgaagtaactggctcgcccaggggagttgcagctcgcccaagcaagctagtaagtaaagataaggtcactaatttcattcgagcgatcttgctatccgaccagcaactggtgaaaactaaggaagtgcaacctataaaaaagaataaacagatatcggcatga

SEQ ID NO: 51680 - DNA, 294 bp, Glycine max
  Peptide Sequence Number=SeqID_168458
atggctgaagagggtcaggttgtcggcgtccacaccgttgatgcgtggaaccagcaactgcagaatggaaaagactcccaaaaattggttagcatccaaacaaacctcaacttcttcactaatttgctttctgcacctccctactttctactcaactttgttttgaactcgagatctttcattttactgtccctttatgtccttaatccctgtggattgcaaaactatccagtcccttaccaacaaatcattagatggtccgaaaaaactgtggttcggttactatatttttaa

SEQ ID NO: 51681 - DNA, 174 bp, Glycine max
  Peptide Sequence Number=SeqID_168459
atgtcgcttcaccctccaccattcgtcgtcggatttgctggcgatgctagccacctttggacttcatcgccatcttcaatcttcgacgtggccacacatgtcaaaatcacacctcctgttgcagatgagattatcatactgagaatctcctcctcctcgtcatggcacttgtga

SEQ ID NO: 51682 - DNA, 2220 bp, Glycine max
  Peptide Sequence Number=SeqID_168460
atggaaaccaactcagtttccaagcttctgttgcttgtcttcagtgttctctttgttggttctgagttgatccattgcagtgtcacctatgataggaaggccattatcatcaatggccaaaggagaatcctcatctctggctccattcactaccccagaagcacccctgaaatgtgggaggatctaattcggaaggcaaaagacggaggccttgatgtcatcgacacttatgtcttttggaatgttcatgaaccatctcctggcaattacaattttgaagggaggaacgatctggtacggttcattaagacagtgcaaagggtggggctctatgtccatcttcgcattggaccttatgtgtgtgctgagtggaactttggaggatttcctgtttggttgaagtatgttcctggcatcagcttcagaacagataatggcccttttaaggctgcaatgcaaggttttactcagaaaatagtgcagatgatgaagaatgaaaagttatttcagtctcagggtggcccaatcattctctctcagattgagaatgagtatggaccagaaagcgggcaactgggagctgctggtcatgcatacacaaattgggctgcaaagatggccgttggattagccacaggtgtcccctgggtgatgtgcaagcaagatgatgccccagatccagtgataaatacatgtaatggattttattgtgattatttctctccaaataaaccatacaagcctagcctttggactgagtcttggagtggctggtttacagaatttggtggtccaatttatcagcgaccagttcaagatctagcatttgcagttgctcgtttcgttcaaaagggtggctcacttttcaattactatatgtaccatggaggaacaaattttggacgatcggctggagggccattcattactacaagctatgactatgatgctccaattgatgaatacggtttgatcagggaacctaagtatggtcatttgaaggaccttcataaagctattaagcaatgtgaacatgctttggtttcttcagatcccactgtcacatcattaggaacgtatgagcaggctcatgtgttctcttcaaaaaatggagcatgtgcagcttttctagcaaactaccattcgaattctgctgcaagagtgaagttcaataacaggaactatgacttgcctccttggtcaataagtatcctcccagattgtagaacagatgtatttaacactgcaagagtaagttttcaaacttcacagatacaaatgttgcctagcaattctaggttgttatcatgggagacctatgatgaagatgtatcttcgctagccgaaagttccaagattacagcttctggactattagaacagatcagcactaccagagacactagtgactatctatggtatataaccagtgctgacataagttcatcagaatcctttcttagaggaaggaacaagcccagcattactgtgcattctgcaggccatgctgttcatgtgtttgttaatggtcaattttcaggctccgcttttgggacaagtgaagacagaagttgcacatttaatggccctgtcaacctacgtgcaggaactaataaaatagcacttctcagtgttgctgttggattaccaaatgttggattccattttgaaacatggaaggctgggatcactggagttttgcttcatggtcttgaccatggacagaaagatttgacttggcagaagtggtcataccagattggcctaaaaggagaggctatgaatttggtgtctcccaatggagtctcatctgttgactgggtgagagactcactagctgtccgaagccagtcacagttgaaatggcacaaggcttatttcaatgcacctgatggagttgaaccattggccttggacctgagcagcatgggaaagggtcaagtatggatcaatggacaaagcatagggagatattggatggtttatgcaaagggtgcttgtggttcttgcaactatgctgggacataccggcctgcaaagtgccaacttggttgtggacaacctactcaacgatggtattacttttctattcagcttcaacattacatccttatcctttgtaaaattctactcaactgtgtgacaaaatcacacacctctatgcagatcacagagccattgtgtttgtgtggtgtgtcagacatgaccttatttgaataa

SEQ ID NO: 51683 - DNA, 291 bp, Glycine max
  Peptide Sequence Number=SeqID_168461
atggagagagagagaaatattgtggtggattttactgcttcctggtgtggtccatgccgttttattgccccagttctggcagagattgctaggcatactcctcaagtgatcttcctcaaggtggatgtggatgaagtgaggcctgttgctgaggaatattccattgaggccatgccaaccttcctcttcttgaaagatggcaagatcgtggataaggttgttggtgctaagaaggaggagctgcaactcaccatagccaagcatgtatctgctgctgctgcttcttcttga

SEQ ID NO: 51684 - DNA, 195 bp, Glycine max
  Peptide Sequence Number=SeqID_168462
atggcgaaggtaggaagggctcctatgaatgattgggcaacactagggatctgttgcaaaatttggtttgaggcaaaacagtgcttagttagaaagatagaagaatcgacgacccttggggaaatgaacaatcattttgcacggatgatagcattggaaggaacaccaaatcaacttgagataattattctgtga

SEQ ID NO: 51685 - DNA, 315 bp, Glycine max
  Peptide Sequence Number=SeqID_168463
atgttatgtgttgcactctcattcaagcaacagcaagaggtggcattcaggaactcatcctccagacatggaattgtgagactgcccgttgtaaaattcttagcagggaccaaatgtaaaattcgagtatatataaaacttcgtaccccattgtccaaaggctcttcgctatgcgaaggtatgggggagggatgttgtacgcagccttacccttgcatatgcaaagaggctgtttccagattcgaacccatgaccaataagtcaccaaggcacaactttaccgctgcactagggctcgccctcaagtatatataa

SEQ ID NO: 51686 - DNA, 1137 bp, Glycine max
  Peptide Sequence Number=SeqID_168464
atggaacatacaatcaccaaaatcaacaagctcttcaactcagttgcaatactagtcaccatgcatttcatcaaacttactcttctagcaatggtagctttttgcctctcagtgaaactctccctggctaaccctggcttccattttggctggggtggtcatcatcatggggaaatatcttttggtctttcacctcaattctatcagttctcatgccctcaagctaatgacattgtcatgtcagtgttggagaaggccattgctaaggacatgagaattgctgcttctctacttagacttcactttcacgattgctttgtgcagggctgtgatgcatcaattttgttggatgatagcgcaagaatagtgagtgaaaaaaattctggacctaacaaaaattctgtccgaggtttcgaagtgattgataagataaagtctaagttggaagaagcatgtcctcaaactgtgtcctgtgcagacattcttgcccttgctgccaggggctccaccgttcttagtggagggcctaattgggagctcccattagggagaagagactcaaaaacagcaagcctaagtggctcaaacaaaaacattcccccaccaaatgccacaattgaaaatctcgtgacatttttcaagcgtcaaggccttgatgaagtggaccttgttgctctctcaggtggaacttcaacttcgatctcatgccatgctatgcttaatggtgcacataccattggggtggcaagatgtgccacattcaagcagagactatacaaccaaaaaggaaacaaccaaccggatgagaatctagaaaagtccttttactttgatttaaagacaatgtgcccaaaatcaggtggtgacaacttcatttctcccttggactttggctccccaagaatgtttgataatacctatttcaaactcatacttagggggaaaggactgcttaattcagatgaagtgcttcttatgggaaatgttaaggaaactcgtgaattggtcaagaaatatgcacaagatgagagcctcttctttgagcaattttccatgtccatgatcaagatggggaacctccgtcctctcattggatttaatggagaagttaggaaaaattgtcgccgtgttaattaa

SEQ ID NO: 51687 - DNA, 720 bp, Glycine max
  Peptide Sequence Number=SeqID_168465
atggatatggctcgtaatgctgacctggtgattttgaatactgctgtggctgggaagtggctcgatgctgttcttaaagaaaaagtttcggaggttcttccaaaggttttgtggtggattcatgaaatgcgagggcattatttgaaagtggagattaaaatgcctgaaacctatgctgtgcatcttggaaatagtagggagcttatggaggttgcagaagatattgtggccaagagggttcttcgagagcatgtttggcaatctcttggaaaaagacgtagaagctacttcatggagcttcgaactaatgcgtgtctaaacttactcatgcatagccaaccacccagtgtttcacgtggtaaagggcaggatctatttcttcggtccttttatgaaagtttgctgctaatccaggagaagaaactacaagtgccatctttgcatgctatagttgtagggagtgatatgaatactcagacaaagtttgaaacggaattgcgtcagtttgtcatggagaaaaaaatccaggaccatgttcactttgttaacaaaaccctagttgtggctccttatctggcttctattgatgttcttgttcagaattgtcaggctgaagcagctgcagccgccgctctgaccagatcgaagcggcatttctacgacgaagacaatgactatgtggagcaggaagccagcgtcattcaggaggagtggtggtga

SEQ ID NO: 51688 - DNA, 1290 bp, Glycine max
  Peptide Sequence Number=SeqID_168466
atgacggatgcagctgaagacgctacacgacgccgtaatgcggtggccgagtaccgcaagaaacttcttcaacacaaggaattggaatccagagtacgatccgtcagagaaaatttgcgtgcctcgaagaaagagttcaacaaaactgaagatgatttgaagtctcttcaaagcgttggacagatcattggcgaagttcttaggcctctcgacaatgaacgcttgattgttaaggcaagcagcggacctaggtatgtggttggctgccgcagtaaagtagataaggaaaaactgaccgctggtacaagagtggttcttgatatgaccacgctaaccataatgcgagctcttccacgtgaagttgatccagtagtttacaatatgcttcatgaggatcctggtaatatcagttactctgctgttggtggtttatctgatcagataagggaattgagggaatcaattgaattacctctgatgaatcctgagctcttcattcgagttggaattaaacctcctaagggtgttctcctttatgggcctcctggtactggtaaaacattgttagctagggcaattgccagtaacatagaagctaacttcttgaaggttgtttcaagtgcaataattgataaatacattggagaaagtgccaggttaattcgagaaatgtttggctatgcacgtgatcaccagccttgcatcatttttatggatgagatcgatgccattggtggtcgtcgtttcagtgagggaacaagtgctgatcgtgagattcagagaacactaatggagttgcttaatcaacttgatgggtttgatcaacttgggaagaaacacctgctccctttcctaacaaatttgaaggttaaaatgataatggcaacaaaccgtcctgatgtactggatcctgctcttctgcgtcctggaagattagatagaaaaatagaaattccattgccaaatgaacaatcaaggatggaaattcttaagattcatgctgctgggattgctaagcacggtgaaatagattacgaagctgttgtgaaacttgctgagggctttaatggagctgatcttcgaaatgtgtgcacggaagctggaatggcagcaattcgtgcagaacgcgattatgtgatccatgaagattttatgaagggattactcctcgttgctcataggcacaacaatttgacttccttctttggttcccaggctgttagaaaactgaatgatgcaaagaaacttgaatccagtgctcactacagtgctgattttggcaaagactaa

SEQ ID NO: 51689 - DNA, 324 bp, Glycine max
  Peptide Sequence Number=SeqID_168467
atggccagaggtcagggatggacacaaactacaaataacagaagtaaagaatatgaccactgcgcctcaggggtacctagtagcaatggcaccctgaaagatgctgtgatatcatctggctattgcacagctgcaacagaagcttttcaaaaccacaatgctagttccataaagactaggagcagctccccaatgtcatctcactatagcatgctattgacaagtacggatactactactagcactgtcctaattagcaacagaactgtatcaggcaaaatggaggccttgacacatggcacacaaggcctagataaggcataa

SEQ ID NO: 51690 - DNA, 279 bp, Glycine max
  Peptide Sequence Number=SeqID_168468
atgggttttcgtttacctggtatcagaaggccatcatttgctgcaaacatagcatcttcaaaagctggggaggtgccaaagggctatatcgcagtctacgttggagagagaatgaagcggtttgtgatccctatatcatacttgtcgcaaccttcattccaagacttgttgagtctagtggaggaagagttcggatacgatcatcccatgggcggcctcacaattccttgtagcgaagatgtcttccaacatataacttcttctttaaatggacaataa

SEQ ID NO: 51691 - DNA, 1347 bp, Glycine max
  Peptide Sequence Number=SeqID_168469
gaattcaagaattggaatgatgcagtccatggtgtcaaacacaagcttctggagaagtggatcttctggtatttctcttttctggttgtacctttggtgcaatcaaacttctatgttactgaaagtgagcaagggaaacaagatatttactattatccaaaaccagtttgggaaaagttggctgctagcactgttgcttgctttaaagactggagatacagttgcctggatgatgtggctgtacgtaatattcttagaggtagaaaatttgggttttcaaaacttagacttcaaccaaaagaaaatggagtaaggatggtggccaatctgaaaggttcttcaaaaatgccactgcttatgtccactatgggagttcgaaattggaaaacaaaggggaagggatcagcatctatgcctaatttgttcattgttaagtctgatgtgatgaaagcatttgattctattaatcaggacaagcttcttgatataatgaaagattttctactgaaagatgtgtattttcttaagcagtatgatgaagttgtttgcacaaagaagtctctgtgggttcaaaagcaatttacgatgctggatgaaacaagaaacaatagcgatacacaattcacttcatttgcttcctttcattcccatcatggtgtctttgttaaccagggtaaggctgcgtacaacatccctcccccataccttcgcatagcgaagagcctctgggcaatggggtacgaagaatatttgagcatacatgaacgatggaacaccgtgaaaaagaaagctttgaatgcagatcttatgcagcatgtgaagcgcaatgtgttgcagtttaatggaaaattttacttgcaagatgttggtattccccagggaggggttttgtcatccttgctttgctccatgtattatggacatttggagagacatgtaatatttccgtttcttgaaaagactcttgaatgtggcagttgcacggagaataatgctgggcaaaccaattatgatgataaagtctcatcttacatgctaatgcgatttattgatgatttcctttttatatcaacctcaaagaagcaagcagctagctttttctccaggctagaaagaggttttcgtggttacaactgccacatgaataagaaaaagtttggtgcaaactttgatgtagaacatatatcagactgcccattgaacagggtttatgtgggggaagatggtgctacttcatttcttcaatggagtggtcttcttatcaattgttccactatggaaattcaggctgactacactaatttagaggttaagggggttagtggtttgagtgacttggtactgtga

SEQ ID NO: 51692 - DNA, 1397 bp, Glycine max
  Peptide Sequence Number=SeqID_168470
gtgcagtgagtcacagtcatagaaaagaagcagaggcaccattttcgttttccaacaacctctaccctaacgccgtcataacggaggaagtaagttattgtttcttgctggaaattgaggtggcttttgagttttctattgtgattttcggattgactgttatgtttggtgcagctatcatgggatcagcttgttgtgttgctgcaaaggatcctaatcttcctaacagaactggaggtgaaagtttgcatagagatgttgtgtgttcaccatcggggagctttcaatgggatagccgggggcgttttgctggtgaaattgagaatccttcttatcacacctcccatgtggacagtagaaatgtcagcatggagctaaaaggttcgttaagttctgaaagaggtaatttatcagatggtggaagcattgttgagaattctgtaacacctatttttctgaagtcccctgttgatgaggcattggttgcaaatctgatgacccccacttctgtcttctcaacgcctacagcagatcctttgcctaatcacaattatcaccatcttcccagctctaccccaacaagatgggcacatcgatctccagcacaccctctgttgagacagatttctgatagtcgaatcatggatctgaaattgccagacaactcaatttctgaaggtaggccatcatttgtactctcaacttgcagcaatgaaatgacagctggatccatatgcggatcatctgatggctggtcaatgcgcaccttctctgagctggtggcatcatcacaaagggaaaggtggtcttttgatagtgagtgtttcggatctggtcgtcacaagataagtggatccagtagcaggttctcgtattctccctccatggaactacaatcttgtggggcttgctcaaagctattgactgagagatcaacatggagcaaccagaagtttatttccaacagtgacctgtcagttgttgctgtactggtctgtggccattcatatcatgcagaatgtttagaggctatgacatcggaggcagataggtatgatccagcatgtccaatttgtatggttggagataagcacttgtcaaagttgttgtccagaaaaggtcttcgggctgaatcagacataaaggccaagaaccacaagatatccagaaaccgtgtagttgatagctaccttgatggtggttttgatgtttttgatcgtcaaaaaggcattgatttgagaggaaaagtgtcaaaaatggaacctagctccagtgcaaggagctcatttggaaagccattcttgaggcggcacttttcacttggatccaagtggagccgttccctgtccgagaatgattctgccaggaagaaaggcttttgggcaagatatcgttaa

SEQ ID NO: 51693 - DNA, 456 bp, Glycine max
  Peptide Sequence Number=SeqID_168471
atggcgcatgttcggcgcccgagcgcgaaccctctccagcaccatcatttccttgctccctccgccgtctccgccggcgctttgccactgccgcggccgcggttgcctcggctgcgccgtcgacgcggagaagtttcttctccgccccgaggatccctcggactaccgcgaactgctctcgaaatgcttcgtcgccgttccaagaaacgcgccttcgccgctcccgttcttctctccgctctcctcccgcttgtcccaatatatgggagtaaagtgaggatttatgatgagatccttgagtccaataattccagggataaggaaatattacagtttcagcagggaaaaagggtggccatgatggttgagggagagaggaatctgttagagagggagaggaggagtagagagagagagagggtggagaggaaattagtaattgagaattcggcttag

SEQ ID NO: 51694 - DNA, 129 bp, Glycine max
  Peptide Sequence Number=SeqID_168472
atggcagacatgggagagagtgtgaaggacgaaaatgccaatgaaaataataaaaaggctactgcttttcctgttgtatacggctgcggagggccttatgtatataggaagttcaggatgagaatttaa

SEQ ID NO: 51695 - DNA, 309 bp, Glycine max
  Peptide Sequence Number=SeqID_168473
atggaagctctcgagaaatcaaatggtcataacttttcactccggatgtccaattcaggcgcatcacatatcgagatgctagaaattgaacaatggaagctctcgagatattcaaatggtcataacttttcacacggaggtccgattcaggcgcataatacatcgagatgctcgaaattgaacaacggaagttctcaagaaattcaaatggtcgaaactattcactcggatgtccgattcaggcgcatcacatatcgagacgctcgaaatagaacaacggaagctctcgagaaattcaaatggtcataa

SEQ ID NO: 51696 - DNA, 318 bp, Glycine max
  misc_feature (254)..(254): n is a, c, g, or t
  Peptide Sequence Number=SeqID_168474
ctctccaagttaaagattatcaacgacgagaactttgaagctccggaagaggatgaagaaacatctggagagagtgtgccgggttacgagaagaaaatgcagctaccgcaagagccccttgaacaagaaaccaagagggctcgcaaggaagagcatggctgtgacaaatttcgtggagctttgtggggcagcaacaagaccaatatgctagccatcgtcagcaagtaccaagaagaactaaatctagccacggnccacgagcataaagtggcggacgagtatgcccaagtgtacgcggaaaaggaggctagaggaagg

SEQ ID NO: 51697 - DNA, 537 bp, Glycine max
  Peptide Sequence Number=SeqID_168475
atgctagtaaaagtccacgagggtttctttggcacaaatgccaatgggcatgctatggaccagaagattctgagggtggggtattactggctcaccatggagagcgattgttgcatccatgttaggaaatgccacaagtgccagacattcgcggacaatgtcaacgctccgcccattccttttaacgttttggcagcactgtggcccttctccatgtggggaatagatgtgatcgtggccattaagcccaaggctttgaatgggcatcgcttcatcttggttgcgatcgactacttcaccaaatgggttgaagccacctcatactctagcatcacaaagagcgtggtagtcaggaagattatcatagacaatgccaccaatctgaataacaagatgatgaaggaaatatgcgaggatttcaagatccaacaccacaattccacgccttacaggcccaagatgaatggggcaactgaggtggctaacaagaacatcaagaagattattcaaaagatgatcgtgtcatataaggattag

SEQ ID NO: 51698 - DNA, 423 bp, Glycine max
  Peptide Sequence Number=SeqID_168476
aacgccagggcaacctatcagcaggccatggtggcattattccatgacatgatgcataaggaaattgaagtctacgtggatgacatgattgcaaaatctagaacagaggaggaacacctcatcaacttattaggaaagctactcggtttcgttgtgagtcaaaaagggatagaagtggatcccgacaaggtgaaagccatccttgacatgcctgagccacgaatggagaaggcgtttcaactagatcgcaatgttcatatcacagctcaccgctacctgcgagctgctcttcaaactcttgcgcaagaattagtctattcgctggaacgacgtctgtcaagaggcatttggaaggatcaagcaatgccttatgaatcctcctatgcttatgcctcttatcctgtacatgacagtgttggatga

SEQ ID NO: 51699 - DNA, 129 bp, Glycine max
  Peptide Sequence Number=SeqID_168477
atggatgtcttgtgtcttgttggaacaagtgtgaaaccaaccaaacacagagggcggatctgccaagacagctaccaccggactttccttactatggcggtaggcaaggaaagcgtcgattgctgctag

SEQ ID NO: 51700 - DNA, 231 bp, Glycine max
  Peptide Sequence Number=SeqID_168478
atggggccaggtattaagaatgttgttttcttcaatgatgcgtcactagctaaatggagatgggcactttttgcacgtgaggagagcttatggagtgaaggagagatatgtttgagtgggaaagacaacaatatttggagcttcaacaatgcttggctgaagtacaactccaacttaacagaaagaatgcatggatgtggagtaaagaagcttcgggaatttctcgattaa

SEQ ID NO: 51701 - DNA, 483 bp, Glycine max
  Peptide Sequence Number=SeqID_168479
atgatggtgataactagcacattcgttcaagtgaagccacctagcaggccttgtcctcttctgatgtcgacctgttgttttcggttcttgaatcagactccatggaggatcctaatgggtgacatcgaaaatgccgatgagggggatgcctctgaaaggtctaacgatgatgaggttgttgctgatattgacaaagaatgtgccttgctaataatatactttaatgaagttcaagatgcctctgatgaagaagtgaggtctgagggtaatggagtagaagatgtcgagggaccaacgaggatgtccctgttgatgctaggtggtaacaatttggttgaagtggagacgtgtagtgcaaatgaaaggatttgtgagtcacctctagtagaagtgggtgagtttacttatatatatgaacttcttgttggtaaatttggagtccagtgttgtgttagctctgaccgggcacaagttagctcttag

SEQ ID NO: 51702 - DNA, 738 bp, Glycine max
  Peptide Sequence Number=SeqID_168480
atgagtatgttgtttaacaaaggtgtgaaggagtttgaggcaaagtggataggttgggccggtgtgaacgtgccagatgagattggacagaaggcacttactaaagccttggctgaaaagaggtgtattcctgtatttcttgatgaagagatcgttcatcaatattacaatggctattgcaacaacatattgtggccacttttccactaccttggacttccacaagaagaccgccttgccaccacacgcagttttcagtctcagtttgaggcgtatgagaaagcaaatcagatgtttgctgatgttgtgaaccggcactatgaagagggtgatgttgtttggtgtcatgattaccatcttatgttccttcccaaatgcttaaagacacataacaagaaaatgaaagttggatggtttctccacaccccttttccatcttctgaaattcacaggacactgccgtctcgttcggagctcctgcattccgttcttgccgccgatttagttggttttcacacctatgattatgcaagacattttgttagtgcttgtactcgcatccttggacttgaaggtacaccttacggggttgagtatcaagggaagctaactcgagttgctgcatttccaattgggatagactcagaacgatttatacgtgctcttgaccttcctccagtacaagatcacatcaaagaactacaagaaagatttaaaggcagaaaggtgcttctttaa

SEQ ID NO: 51703 - DNA, 543 bp, Glycine max
  Peptide Sequence Number=SeqID_168481
atgcgctatgcgagcacgagctcgccgcataacatgttcgaggaattgcttcacggagacccgttccacgtggaggcctatcacaacctcttaatgttgacttcgaagacgaacaagccaaccgaggaactattgaagagaatcgaagaggattgtggattgatatttgatataaaagaggtaggaagaggcgctgacaaagggtacaacggcaactccagcaacattccgacgagccgtttggagcggttgttgagggacagagagctgaggaagagtgggagggcgagcgagaacaatggagaagcgatggaggaggaggtggtgcggttgagagaagaagagagcgcggcggaggcggcgacgaagggggccggtggtggggaggagaggcaagaaacgaagccgtttcggcagaggctgctggtggtggctaacaggctgccggtgtcggcggtgcggaaaggagaggacgcgtggtcgttggagatgagtgccggtggcctcgtcagcgcgttgttaggtaagtggcggtcatcatga

SEQ ID NO: 51704 - DNA, 579 bp, Glycine max
  Peptide Sequence Number=SeqID_168482
atgggagcagacaaaatagatgttacagttacaccaccaaccacactcaagaaaaatgaagcacatcatgatcatgatgaccgccacttacctaacaacgcgctgacgaggccaccggcactcatctccaacgaccacgcgtcctctcctttccgcaccgccgacaccggcagcctgttagccaccaccagcagcctctgccgaaacggcttcgtttcttgcctctcctccccaccaccggcccccttcgtcgccgcctccgccgcgctctcttcttctctcaaccgcaccacctcctcctccatcgcttctccattgttctcgctcgccctcccactcttcctcagctctctgtccctcaacaaccgctccaaacggctcgtcggaatgttgctggagttgccgttgtacttgttcccaggcataagcacaaataataatgaccgtttagctaagtttgttaagcagatgtgtgagttgttttgtcttccgaattatatctgtttcaaagctgcattccaaaaacacgcctcaattcagcagttgccaataaaatcaagaaatgagattgataaatga

SEQ ID NO: 51705 - DNA, 333 bp, Glycine max
  Peptide Sequence Number=SeqID_168483
atgacggtgactggtgcaaccggtggacgtggagggttggaagctgcaatggggctaaggtttcaaaccaaaaacatgagacctgatgataataagctgataggatactgctgtgaagaagagcacagggttttagtatacgaatatttaccaacaggaagcttggagaatcaattatttagaagattctcggcatcactttcatggtcaatgagaatgaaaattgttgttggagctgtgaaaggtttagcatttcttcatgaagctgagaagccagtcatctatagagatttcaaagcttccaaaatcttgttaggctctgtgacatactaa

SEQ ID NO: 51706 - DNA, 957 bp, Glycine max
  Peptide Sequence Number=SeqID_168484
atggaactgaaggttcatccaaaattgagacaacctttgacagcactatgcagtgatccaaataccacagttgttgtgctcagtggaagcggtagacaagtcctagatgataacttcaaagaatacgacatgtggttggcagctgagaatggaatgtttttacatccttcaaagggtgagtggatgactacaatgccagagcatctgaatatggaatgggttgatagtgtgaagcatgtttttgagtacttcacagaaagaacacctcggtcacattttgtttttgaagaaagggaaacttcacttgtatggaattacaaatattcagatgttgagtttggaaaacttcaagcaagggacatgctgcagcatctctggacaggtccaatttctaatgcatcagttgaagttgttcaagggagccgatccgttgaggtgcgagctgttggtgttacaaagggagcagccattgaccgcatcttgggtgagatagtgcacagtaagtccatgacatcaccaattgattatgttctttgcataggacattttctggggaaggatgaggatctgtattcattttttgagccggatcttccctcaattggtgtgggtcttcctcgaagcaaggtaacaactgatggagttaagtttcctgttgagaggaaaccatctttgaatgttccagctactaagagtggaccaaaatcatttccaaataaggcacaacgatcagtgtcaaattctgagaagaaaacaaataaccatatatgcagtacaccacgaaggccagcgcccgaaaaggaatcatggaacgtgcttgaccttaagaaagagaattacttctcttgtgctattggacgaacaagaacaaatgctcggtatatactcgattcatcagacgatgtcgtttcgtttctgaaggaactagcagttgcttcttcccgcctttaccactga

SEQ ID NO: 51707 - DNA, 381 bp, Glycine max
  Peptide Sequence Number=SeqID_168485
atgtttgctggtgcagcacaatctcttggtgccggggcaattcttgtcaatccttggaacattacagaagttgctgctgcaattgctcgggctcttaatatgccatctgctgaaagagaaaagagacataagcataattttaatcatgtaatatctcatactgctcaagaatgggcaggaactttcgtaagtgaactaaatgatactgttattgaggcacaactaaggacaagacaagttccacctcggcttccaaccaagactgcaattgaaaaatatgtggctagtgctttggaagaacttgtagttttccaaagccaacaagaattacctcctgcgagaagacatgaatatgcaattcaactaaaggaggtagcttaa

SEQ ID NO: 51708 - DNA, 195 bp, Glycine max
  Peptide Sequence Number=SeqID_168486
atgggttcgatgaggaagccattgcccagctgttgtgcacaccttggcaggatttcgcctaaaccgctacagggaggcgggtatggcgcctaccaggcaccctctggacccagaaaagtccaacagggccctggggtttccggtgctgatcacgggcctctgccagttcttcggagttcccatcactcccagtaa

SEQ ID NO: 51709 - DNA, 360 bp, Glycine max
  Peptide Sequence Number=SeqID_168487
atgagaaatttttggtcgcccaagtgcttttacgatatcaaagacagtacaacccggtcccgatacaagaagacatgttatgttcctattgactatgaatccattgaccatgttgattgttgggtaattgaggaagaaacacctcctaaccttgatatagatgaatttaagaatgctttgtatcatgagagtgcaattccatttggtgaatcatcaataaatcatgaagatgatgataatcttgacactatggagtttcaagttgacactggtgatgttagtggttcaatggcttcaactaatgaagatgttattcctaacatgtctgaatttgaaggaattaaccttaacatattatag

SEQ ID NO: 51710 - DNA, 330 bp, Glycine max
  Peptide Sequence Number=SeqID_168488
atgtttgtagagagcaaagatccactccgtcggtggccaagccactgggcaacacccaaggacggaaggaacctaggttatgctttcttcaaaagcctcacactgaaaagatacaataaaaggcttggaagaggattgaaaaattggagcttcacgctcagcatgacaacctcgctcaacgcatcaggactacttagcccaagaagtcccgctttgtgcaagaagtcaccttggaagccagctatcatgtgcaagcgtgcacccaacgacttagtgcatggtcacttaagccagctaaacatgacatgcgcactcagcacgtgcatctga

SEQ ID NO: 51711 - DNA, 240 bp, Glycine max
  Peptide Sequence Number=SeqID_168489
atggaagtgcaacgacttatgtttaaggagggggtcttttctctgaatctaaacggctgcgtagagggaaaaagcagcgattcaaaggaagaagttgtgatgctcgtcaaacgtacgcaagaactgggtcgtggtgacggccgaggtaaagggagttggtgttggagaacttatgccgggattggagggaggagcggagggacggtggctcctaggttcagagtgaaggggcttatgtga

SEQ ID NO: 51712 - DNA, 774 bp, Glycine max
  Peptide Sequence Number=SeqID_168490
atgggtgaagtagacgaggtgcaagagcggataaaggccgacatagaggccctaaaagagaaaatggccacaatgatggagaccatgatgagcatgaaaaagatgatggaagttaatgcggctgcagttgtcgctaccaatgtcgttgctgaggagttgggaagtacaagcggccctcattttgtgcaagttcagaacaagcatgccttcccgccatatggcttgcctcccaactacacaccacccaatgtggtgcacactcccaatgagaatgtcaataactccaatcccatactcattgagagccaacaacctcaatctgatcatgcacatgtctctcaacccatgagggaggcacatgaaataccctaccacaatctagcagactttgagccttgcctcggatacgccattgaggggcaagcaattgatgttgtacccttgccaaacactttggaggaacctcagtttcgctcacaaccacaacccttgcattttgtggcggggagagtccctcctactatggcagaaaaagggaaattggatcatataaaggaaaggctcagggccattgaaggaggcggagatcatgcttttgctaacatggaagagttatacctagtgcctgacatcgtcatccctccgaagtttaaggtgtcggattttgataaatacaaggggaccacttaccccaagaatcacctgaaattgtactatcggaagatgggggcatacgcgaaagatgaaaaactgctgatgcatttctttcaatag

SEQ ID NO: 51713 - DNA, 429 bp, Glycine max
  Peptide Sequence Number=SeqID_168491
atggacgtggacggtggcaacaagcgcgtgtacaaccgccttggtggggacgcgaagcaccagaaagtgtgctaccactggcaagcggggaagtgcaaccgctacccgtgccccttcctgcacagcgaatcgcccgcgaattcgcaccacgccaatggcacctcctcgaagcggacgtacgacaattcgggcttctccggcccacgccgcagccccaatttcaacaacacgtggggccgcggcgggggccgcggtggtggtggtggtggtggtgccggtagaggtgtggtggtgaaggccgagaaagtttgtaattattggattcaggggagttgtagttatggagagaggtgcaagttccttcactcctggagtgtgggggatgggttttctttgctgacccagcttgaaggtcatcagaagggctaa

SEQ ID NO: 51714 - DNA, 417 bp, Glycine max
  Peptide Sequence Number=SeqID_168492
gacggatctatattggcatggaagtttaatgtagctaccaactgctttgagccggctgcatcacttaaaggtcattctcggggtgttgtttcattagttgttggtgctaatagactttactctggttcaatggacaatacaataaaagtatggaaccttgaaaccttgcagtgtttacagacactaacagagcacacatctgttgtgatgtctgttctctgctgggaccaattccttttgtcttgttcattggacaaaacagtgaaggtatggtatgctactgaaagcggaaacttggaagtgacatattctcacaatgaagaaaatacagcatttcctactttactaacttcaagaagctatacagctggaattaagtattccattacttggaatgcttctgataagtggggttaa

SEQ ID NO: 51715 - DNA, 222 bp, Glycine max
  Peptide Sequence Number=SeqID_168493
atgacgaaggatgtgatccacaatcacaactctgcaacactcaggctccaccttcccctttcttcttccttttggtgttcttcagaaaagagccaagaggtgcagaaaaattcgctcaggaaagctaaactcgttcaggcgaatttcatgcttagttctgaaggcactcactcacccaagcgagttgtagctcgcccaggtgagttggttacttatgcctga

SEQ ID NO: 51716 - DNA, 345 bp, Glycine max
  Peptide Sequence Number=SeqID_168494
atggcacgtaaagacaaatatggtcatctgccccttttgtcgaagactcaatgtctttcgatcgagactattacagtctccttttgccaaccagagacaagcgactccgttggcacgcggagacaaattatggtcatcctccaccttttttatccagagacaatcaagtccaatgcacgcaaagatagatatggtcatctactccctttgtcaaagactcaatgtctttcgaccgagactattgcattctcccttcgtcattcagagataatcaagtccaatggcacgcaaagacaaatatggccatctgctccctttgtcgaagactcaatgtctttcgactga

SEQ ID NO: 51717 - DNA, 1581 bp, Glycine max
  Peptide Sequence Number=SeqID_168495
atgaagaagttgcctgatatggcttcatataccccaaagaatatccttattactggggctgctggatttattgcgtctcatgttgccaaccggcttgtccggagctaccctgactacaaaattgtcgtgcttgacaaacttgattattgttctaatctaaagaatctccttccttcaaaatcatcccccaacttcaagtttgtgaagggggatattggtagtgctgatcttgttaactaccttctcatcactgagtccattgacactataatgcactttgctgcccaaacccatgttgacaactcgtttggaaatagctttgagttcaccaagaacaacatatatggaacccatgtcctattagaagcctgcaaggtaactggccagatcagaaggttcattcatgtgagcaccgatgaggtctatggagagacggaagaggatgctgttgttggaaaccatgaggcttctcaacttcttcccacaaacccatactctgccacaaaagctggggctgaaatgcttgtcatggcttatggtaggtcatatgggttacctgttattacaactcgtggaaacaatgtttatgggcccaaccagtttcctgagaagttgattccaaagttcatcctcctggctatgcagggaaagaatcttccaattcatggggatggttcaaatgtgaggagttatttatattgtgaagatgttgcagaggcttttgaagttgtccttcacaagggagaggttggtcatgtttacaatatcgggacaaagaaggaaaggagagttatcgatgtagccaaagatatatgcagacttttctctatggacccagaaatttgtataaaatttgtagagaacagaccatttaatgaccagagatactttcttgatgatcaaaagctgaaggacttgggttggtctgagaggaccacttgggaagaaggcttgaagaaaaccatggattggtatattaataaccctgattggtggggtgatgtcactggggcattgcttcctcatcctaggatgctgatgatgcctggcgggttggataggcattttgagggatctgaagaggaaaaacctgcatcttttggctcaagtaataccaggatggtggttccaccgtccaagaacaccagctctcaacataaacatccttttaagttcttgatctatggtagaacagggtggattgggggtttgcttgggaaattgtgtgaaaagcaaggaattccatacgaatatggaaagggtcgcctagaggaccgctcctcactcatggctgatcttcagaatgtgaagccgacacatgtttttaatgctgcaggagtgactggcagacccaatgttgattggtgtgaatcccataaaacagaaaccatccgcaccaatgttgttggcaccttaacaatggctgatgtctgcagagagcatgggatcttgatggttaattatgctactgggtgcatatttgagtataatgcaacacatcctgaaggctctggcattggttttaaggaggaagacaagcccaatttcattggctctttctattccaaaactaaagctatg

SEQ ID NO: 51718 - DNA, 249 bp, Glycine max
  Peptide Sequence Number=SeqID_168496
atgaatctatatccattacgaaacgttgaacaaaggcacgttggttgggttttctcctcccttaataactcccataatgaagagttgtttattccaactccaatgatgcaatcctaccccttaagggcattggatagaagactccaagaagattgggccagcgatgctgaagaaggccctagggttctcatgaatctcagggtttgtagagtaacctacaaattaatggcaccctaccttacaagttaa

SEQ ID NO: 51719 - DNA, 246 bp, Glycine max
  Peptide Sequence Number=SeqID_168497
atgagcggagtcgccaccaacgtttatttgaggaaaacgctagaaaaactaaaaagacgaaggtatgcggattttgaaaatgaaggttcaggagttgtttatgcatggggaagcctcccttcacgcctatttatagcaaaacaaggcattttggatgaaggtaactcgcccaggcaagctggttacttcaccatgaagttatttttttggtgtcccaggcgagccaggggtctgaaaaaagtgtaa

SEQ ID NO: 51720 - DNA, 402 bp, Glycine max
  Peptide Sequence Number=SeqID_168498
atggctgaaacagaaccagttcttgatgagctcatcctagatgatgttctagaagttgaaatacttgcagaagttatggatgacaaaacggctagtggtggggtgggtcaaaatgagctagaccagcccgttttgccatccctagcggaagctatctcgaatgaaggttttggtcatgctttatgcttagtaatgtgttttctggcagatagaccaatgcagacacatatcatgaaagagaagatgtctatcatttggagcccactccaaggagtctctattgacaaaataaacacatacaccttcctttttcaattctaccatcacgttgacatccataaagtccaaaggggaggaccatggatgatggaaacttgcttgagaagcttctatggaggctag

SEQ ID NO: 51721 - DNA, 453 bp, Glycine max
  Peptide Sequence Number=SeqID_168499
atgttgtgtgggctgttatttgaagctaagtgccttaaatgtaaaagacaagtaattgaagctggaataaaaaggaaaagagttgatctaaggatgaatgctctcttagaacttaagcttttgcatcctagaaaaaccatgaattgtttgcaacccagcctcattacaagcctagaaaatccttcagattcaaattgcgtgtttgtaattcttaataatcatgttcctatctttgaaattctgcatttttctatgagaagttgttggttgaaagcattgcttgccacttgtgttcttgtgattgaattctttggaacagacacaattttgaataaccactgtgaaaagatgaagaataagaaggttacagcagctggtgtctcgctaagtgaggcatatgcgcttagcgagcaatatccgctaagcgagacatcagctcgcttagcgagttag

SEQ ID NO: 51722 - DNA, 672 bp, Glycine max
  Peptide Sequence Number=SeqID_168500
atgataagtgctaacaatttaatcccaaaaacaactgaaatttggcacttatcaatgtcccccataccgatatttaggagaattatcaaaaatgggtcaacaaaaatgttctccgggttgccttatatttattctctcttgaactgcttgatctgcttgtggtatggcacacctcttatatcacctgataatctcttggtgacaactgttaattcaattggagcagcctttcagcttgtgtacatcctcttcttgatgtatgctgagaaagcaagaaaggtgagaatggttggattactgctaacagttttgggcatatttgtgatcatacttgttgggagcttgcaagttgatgacagtacaatgcgcgggatgtttgtcagattcttgagttgtgcttctctcatttcaacgtttgcctctccattgtttataattaaattggtgattcagacaaaaagtgttgagtttatgccgttttatctttcaatttccaccttcctgatgagcatctccttctttctttatggattcctcagtgatgatgccttcatttatgtaccgaatgggataggaactgttttaggaatgatacaattggtattatatttttattacaaaggttcaaccagtgaagagtgcagagaacccttgatagtgtcgtatgaatga

SEQ ID NO: 51723 - DNA, 345 bp, Glycine max
  Peptide Sequence Number=SeqID_168501
atggggtttgattttgatatagcgtacaagctaggatgtgagaacaaggcagttgatgcactgtctaaaagaatgacatattcagccatttctatgatcatattttctgataaggaagagtgggagtctaaagttttggctgacccaaaatcaaagaaaattatttcaacatataaccctcaaacggatgggcaaattgaggtggtcaatagaggagtaaaaacatacttaagatcaatgagagcaaaatggagatggaagaaagatgattggagatgccacttcaaggagaagatgagtcaagaacaagcttaccaccataggaagccatggataagagtttga

SEQ ID NO: 51724 - DNA, 762 bp, Glycine max
  Peptide Sequence Number=SeqID_168502
atggataagagcttgaagataggagaagatgagtggaaagagaaggagagaaggggtacaaaattttgtgcctcaaatgaggattgcatcagaatcaacaaccccaatctgatcatgcccatgcttttcaacccatgggggaaacacatgaagctccccaagaccacactctggccggctccaggccccaccctggatatgccactgaagggcatgcatttcctagagggcccagtacttgagaaggaaaggattgagcatatggaggagagactgaggtccattgaaagaggaggaaattatgcctttgctgacatagcggaattgtgcttggtacccgacgtggtcattcctccaaaattcaagatgccagattttgataagtacaagggaaccacttgcctaaagaatctcctgaaaaagtattataggaagatgaaggcatatgcgaaagatgaaaagttgttgatacatttcttccaagaaagtcttgctaggacagctattacttggtatactaacctggaaccttgctgggtccattcctggaaagacctaatggttgctttcattaggcagtatcagtataactctgatatggctccagatagaatgcaactacagaatatgtgcaagaaagactatgaatctttcaaagaatacgctcaaaggtggagagatttggcagctcaagtagcgcccctgatgatggagagagatgataacaatgatagtggatgcattgccggtgttttactatga

SEQ ID NO: 51725 - DNA, 579 bp, Glycine max
  Peptide Sequence Number=SeqID_168503
atggtggaccttcatgttcttcccctgtgtggggtcgatgtcgtcctcggggttcagtggctcaaatctttgggaccagtgttaactgactataacacattgtctatgaagtttgtctaccaaggcagcttaattgaacttaaaggcaattcagatagtttccttctcgccattactacacctcagctccgccgtttaacacagacacacagcgctgtcgaatacttccacataagggtctatgatcaggcttcatcatcttccatgccgcaccctgatatccatgccttaaccactcaattttcttccctatttcaaccacctaccactcttccactcttccaccttcccgcaacactaaccactttatccacctttcacccaactctctttcggttaatgttcgtccttatctgtatcctcattttcataaacaaaagattgaaactcaagttacccacatgcttcaacatggcattatctgacccagcaccagccccagccccttttcttctcctgtgttattggtcaaaaaacgagatggaacctggcccttctgcatggactacagagcactga

SEQ ID NO: 51726 - DNA, 324 bp, Glycine max
  Peptide Sequence Number=SeqID_168504
atgacgacaagctggtgcaagatccgacccgcgagtcgtaaggtttctggagcggtttgtcccgaaagggcatgtaggcttatttgggttggaagtggttcgcataaaccgcgctccctgcggttcgcaagttcctcgacagtgaggcgtcagacgggaagaggaggaggtttggccgaaaagggtaagaggggtaggttagggttgttggtggaaacaggggctggtaagggtggagcaaagggagttgtggaaggtggtggggcaaaggatggtcctgaagatgctaaggcaaaggtgggtcctggaggtggtgaggcaaag

SEQ ID NO: 51727 - DNA, 1362 bp, Glycine max
  Peptide Sequence Number=SeqID_168505
atggcgccgacggatgtgagcaaaacggcattcaaaactcatcatggacattatgagtttttggtcatgcccttcggcttatgtaatgccccttcgtcatttcaggctactatgaactctacctttgcaccttacttgcgtaaattcatcatcgtcttcttcgatgatatattaatttacaacaagtcgttttctaaccacttgatacacctgaagctcgcctttcagacccttcgcgctcacagcttcttcctgaaattctccaaatgctcctttgcgactccacaggtcgaatattttggccatatagtttcagaacgtggtgttgagcctgtccttgccaaagggtatgcatcattggcggcacccctcacagccttgttgactaaggaatcgtttctctggaccatagcggctaaccaagcttttctcaagttgaaggaggcactgtgcaaagctctagtcttgggtatcggcatgggggtgatcctttctcaacgacatcaccctatcgcctactttagcaagcctttttgctcgaagctgctccgggcatctacttatgtgcgtgaactggcggcaatcacgatagccgtaaagaaatggcaccagtaccttctgggtcaccacttcacgatcttaactgatcataggagtctgaaagagctcatggcgcaagcgattcaaactcatgacttgcacaaggagttagcaacacacaaggaatttccggaattccaacaaaagcttctgtcggaacctcacaagcatcctgattaccttcttcggcaggatttcatcttgcaacgagggcgtatttggctaccacagaatgctcgagtaataccactcattctcgtcgaattccattctacacccactggaggccacatgggcattatgaagactctcgcgcaagttaacgagaattttgtgtgggaaaacatgatgaaggacattcgtcaggcactccgtcattctggtagtagtggatcgcttttcaaatggcattcatctgggactcttaccacctcattatacggcctccagtgtcacgaagacattcatggacatttccgacagaatccatggtatgcctcagagtttggtctccgaccgagatcctctctttatcagccgcttctggcaggagttattcaagctcagtggtaccaagctctgtatgagctcggcttaccatcctcagaccgacggccagacggaggtcatgaaccgggtcatagagcagtacctccgatccttggtccatcagaagccagcaacatcggggcgttttctaatttgggcagagtggtcctacaacacctccgttcattatgctacgagaatgtcgccatatga

SEQ ID NO: 51728 - DNA, 291 bp, Glycine max
  Peptide Sequence Number=SeqID_168506
atgcaaatgatgaggatgatgcaacaggaacagagcatgcaacagaaaccagaaaaggagaagaaagaccaaaacaaggtagcaacaggccacgttacctggatgactacgtggccaagtgatgagctggcaacaatcttccaaaagcagaatctaccaattcttcagagtcgttgtgccgttatgggctgtctcacctcaacactgcatttccaaattcctccaaggcagaaaatgccaaaatccattagaaaattgtatctagaatttacggctgaaacatccatataa

SEQ ID NO: 51729 - DNA, 150 bp, Glycine max
  Peptide Sequence Number=SeqID_168507
atgaggaagaggaaatggaggaaggaatatgagtttcttgagtctcagaatgtcgttggcttcgacttgaagaaccctttcgcttctttgatggtttcgccatttgaagaggagcagggacgtgttgtaatcgattacagaatttggtaa

SEQ ID NO: 51730 - DNA, 384 bp, Glycine max
  Peptide Sequence Number=SeqID_168508
atgtcgcttaggctagatgccagaaccgaggttcaccgcaactgttataaggttgtcgtcgttgttgggtggtcaatctttcgttcatgttcctctcatcgccccatgtttcgtctcggctctgaagccaaaagaatctcaaacgggtcctggatggtgcgcatattgaggaccaagccctactccgccatggcatggccgttgatggagtggccattctcgtgcaccgccaccgtgaggttcggcgacgccaaaatccttattggcaacaccaatgggattgaattccttgacactggcttaaagcttaagcgctttggagaggctcgctacgtcgttgtcttgcctcgattcggcgtcgttttcgtgaacaaagtgttctag

SEQ ID NO: 51731 - DNA, 216 bp, Glycine max
  Peptide Sequence Number=SeqID_168509
atggtgggaattgtaacatgtggatgtggtggtggtgaagcaaagcaggtgacacttgtacaacagttgtctttctctttctcccaaacctatcactttccctacgcgaatccagcttatgcaacggaaaacaaccatatcaaccgtactttaataattcccacatttcactcagctgagttggctcctcctcgtacttacacacaattcccttag

SEQ ID NO: 51732 - DNA, 381 bp, Glycine max
  Peptide Sequence Number=SeqID_168510
atgccggttgagggtcagtttgcccggctgggcggtgaggagtttgccgcgttgcttcctggcgacagtgagcaggcgcagcgcatatgtgagcgtatccggctggcgacacagctgtcgctacccaacgacatcggttatacggtgagcattggctttgccactgccagccagcggcatcaggcgtttcccgccctgctggcgctggctgatgaagccttgtatcgcgctaaagccgccggacgtaaccgcgtcgaaggttatcagacgccgcaggcggcaatggcggaagccgcgtttgtcaccgtagtgacgcagccagtaatagcggtcttccaccctctcccgtccgctgacgcgtgcgccgaccagccacagtag

SEQ ID NO: 51733 - DNA, 877 bp, Glycine max
  Peptide Sequence Number=SeqID_168511
aggttgtgtggagcagtgtaagaaaactggatgtgtaggggatagatgctttcaacattgtaaattttcatcagatggaaaaccaattgatggtccatggtattactgtatgctagctagagaggaagaacgaacaaaacttggcgacaagcctgtcaagtatcatggaaaatggccattccgtcgtgtttatggaattcaggaacctgtggctgttgctctgtctgccgtcaatcttgctatgcagtttcatggttgggtatcttttttcattcttgtgtactataagttgactttgaggccagataagaagacttactatgagtacactggattgtggcatatttatgggattttatccatgaacgcatggctgtggagtgctgttttccatagtagagccgtggaattaacagagaagctggatttttcttctgctgtggcattacttggattcagcctcattctagcaatattgcgagcttttaacgtgagggatgaggctacgcgagtcatgatttctgctcccttgattgcttttgtgacaactcatatcatgtatctgaatttctatgaacttgcttatggtttgaacagaatagtttgcacgggaatggttgttgtccagcttcttatttgggccatttgggctggtgcttcgaaccacccggcgcgatggaaattatgggcagtagtggttggaggaggcttagctatggtgttggagacatatgactttccaccttacatgggatatgtggatgctcatgctctatggcatgcaacaagcattcctctcacatttttttggtggggttttataagggatgatgctgagtttagaaccacagctatgctcaagaaggcgtttatttga

SEQ ID NO: 51734 - DNA, 267 bp, Glycine max
  Peptide Sequence Number=SeqID_168512
atgttcctcacatttaatctgatgcaacggatcggcgtcgccgtcggtggcggcgagggggcggaggaggaagaatacggcggcgaagagcaacaaagggcgaaagggactcatcgcaatcgcaagaaagcaaaagtcaaagcccggaggggaaggaagagcgggagaaggttccggcgagaatcgacgccgaattttgcattgacggagaagggaggcgggggttgcagtggcggcggagcgcggaggcgtagcggtggcggttga

SEQ ID NO: 51735 - DNA, 1512 bp, Glycine max
  Peptide Sequence Number=SeqID_168513
atggttccatacctttcaagagagaacctcatttctttgttttgtcacttatattgtccttatggacctcatgtcattggaacaatattcatacttttttctttatccccacaactggcacccattctgggtgttctgatgctcgcagtttccatttcaattgctgtctacaagagatctactttgccggtttttaaagcacatgggatggtccaagcatctatatctgattgtgtaacagaaacattttctgctattcgaacagtaagatcatttgggggtgaaaagcgccagatgttcacatttgctaaccaggttctatctttccaatcaagtgggataaagcttggaactttcaaatctgtaaatgagtccttgactagagttgctgtttatatttctttaatagcattgtattgtcttggaggaagcaaggttaaggcgggtgagctctctgttggaaccatggcatcttttattggatatactttcactttaacattcgctgttcaaggattggttaacacttttggagatcttcgtggaacttttgctgctgttgagaggatcaactctgttttatctggagctcaagttgatgatgcccttgcctatggcttagaaagagaactgagacaaaaaacactggatgatgaaaactataaattgatcttatcaaatatttctactgagaataaccaaaaacattatttgcattacatgtcagctctcaaaacatcaagcaatttgtttagcttagcatggtctggagatatttgtcttgaagatgtatatttctcctatcctttaaggccagatgtggaaatcttgcgtggcttaaatttaagactaaaatttggaactgtaactgcactggtcggtcctagtggtgcaggcaaaagtactgtagtacagctattatctcgtttttatgagccaacaagtggctgtataacagttgcaggagaggatgtccgaacatttgataagagtgaatgggctcgggttgtatcgattgtaaatcaagagcctgttctgttttcggtttctgttggggaaaatattgcatatgggcttcctgatgaagatgtttctaaagaagatgtgattaaggcagcgaaagctgcaaatgctcatgactttataatttcacttccacagggctatgatacacttgttggtgagcgtggaggcctactgagtggaggacaaagacagagaattgctattgcccgggctctcctaaagaatgctcctatccttatacttgatgaggctaccagtgcccttgatgctgtcagtgagcgattggtccaggatgctctcaaccatctgatgaagggaaggacaacattagtaatagcacatcgattaagcacagtccaaaatgcatatcaaattgcactctgttctgaggggcggattgcagaactaggcacccattttgagttattggctaagaaaggccaatatgcttcactggttggcacacaaaggcttgcatttgaataa

SEQ ID NO: 51736 - DNA, 288 bp, Glycine max
  Peptide Sequence Number=SeqID_168514
atgggagaattagggttaccagatgttttctggaaaaccgtatttgatgagttcctcattttcgtacttgtcaaggctcatgaagttgatgaaatcgctggcttcagagcgcgctttgaagtagaacaccatcgtgtcgtagcgtctgcttctgacccttcgtgggattggggcttaaggtttccgctagtgaaagagatgattgttgaagaatgtgagtgggcgctaggggtggaaataggccaggccagaccaggctttaaaaggcctgagcctagcctacgatga

SEQ ID NO: 51737 - DNA, 717 bp, Glycine max
  Peptide Sequence Number=SeqID_168515
atgaattgcaaaataaactccttaagctcaccaattccatgcaaactttacaccaagaaaccaaggcttagaagaacaaacaccatcctattttccttttcctcaagtgaaaaacaacaaaaaaccatttccaccagcacaagcattgaggcttacactgttagcttcaagacagaaaagggttgcaagcttggcatttcaaggtatcctgactttgaatatgatgcggaagggggaataggaactggggttggtgcaaaggacacaaagaatgatccagccaacaatgaccttccagtttcatttgatcttgaaactttgtatattccaccactaacaagttctaccaccaagtttcttggtttgccattgccaccatttttgaagattgatatagttcctgaagcatttcaaggaaacattaaccaagaatctggcaaggttgatcttgagttcaaggccaagttcttgttttctgctgctagtctctacaaggctcctccattgatggtgaagacagtgttgacatctgaagaaacaaatggcacaatgaggagaggaagaggcaagagattggataaagaagggaagtgcagactggttggtgtggcaacagttgaccctattgatgatatctttatgaattccttccttggcctcccaactgagtgccttgctgagttaaatgctgtaatctccatttcttcctcatcttaa

SEQ ID NO: 51738 - DNA, 1155 bp, Glycine max
  misc_feature (42)..(42): n is a, c, g, or t
  Peptide Sequence Number=SeqID_168516
gtgatggatatccaagccgcatacagttgccttttgggtagnccatggatccatgaagctggggccgtgacatccaccttgcatcaaaagctgaagtttgtcagaaatgggaaattgatcactgtgaggggagaggaagccttgttggttagtcatttgtcagctttttcctttattggtgctgatgaaacagaaggaacctctttccaaggcctgactttagagggtaaaaagccggagaaaaatgaagtatcttttgctacttggaagagcgcacagaaagtggtgcaggaaggaacaggtgtaggatggggaaaagttgtgcagttgctggagagtaaaaaccgtgaagggctgggatttgcttcttctgcaggatccgcaacgaacagtgttggatcaagctccattactagcaccttttgtagcgccgggttcatcaacaactcgccagaagccaatgctgccttggaagatgctcctgaagagatagtgcttgcatttgtcacacctggaaaacttgttcgcaactgggacgcggttgacatcccttcagtggttcatgcatcaaaggctgttttgtttcaagcactactcttattaatggaaaatgtggtttatcccgatatctatgcttactgctctttctggaaaatgcccgttgaacataataaccctgcactctctcccaacttcgaatctcctgtctacgaggctgaagaggaggaggatgatgaaatcccggaggaacttgctcggttattggaatatgaaaagaaaaccattcggcctcatgaggaggtagtagaggtgattaacttgggaaccgaggaagataagaaggaagtcaagattggggcatcgcttgaggcagctgtcaaacgaagggtgattgaattactcaaagaatacgtcgatgtgttcgcatggtcgtaccaagatatgcccggcttggatccccgtattgtggagcaccgtttgcctttgaagcccgaatgcccaccagtcaaacagaaactgagaagaactcgccctgacatggctctcaagatcaaagaggaagtacagaagcaaatcgatgcaggttttcttgtcacatcagagtatccccaatggttagccaacatagtgcctgttccaaagagggacggcaag

SEQ ID NO: 51739 - DNA, 210 bp, Glycine max
  Peptide Sequence Number=SeqID_168517
atggtggacacaaaaagggcaggcggaatagtagggaagttacaacctacttctttcaaggtttctgaaagagtatttagtggaggaattatgaaaggaaaaggccatttggggcaagggaagctcacccaggcaagccaattacttatggctgaaggaattagctcgcccaggcgagttggagctcgcctaagtgagctggttgcttag

SEQ ID NO: 51740 - DNA, 243 bp, Glycine max
  Peptide Sequence Number=SeqID_168518
atgaaatcaagcacttattggcaggccgaaaagatgatttcacatagggaagagatcttttcccaccccaaaggaacctggtgcactcgacacaccaatgggaagccaaatatctattcttgtgagggagcaaccataagcggtttatactgtataaagctactacttatggggtcggtggatgatcaaattgacttcataatgggtgatttcttcctcttgacacataaattaaaggtttaa

SEQ ID NO: 51741 - DNA, 198 bp, Glycine max
  Peptide Sequence Number=SeqID_168519
atgcaacatcaccgcccttgctctgcacttgacgagattcagaacatagatggcaccagtaaagtacctagtgaggcctatgatggccagaaccaaccccgacggcggcagagtagagggggttccatggagttcaaagaagagaaagggaacctcgaatatgtggtttttttttcgcatagcatgtgcgacatttaa

SEQ ID NO: 51742 - DNA, 441 bp, Glycine max
  Peptide Sequence Number=SeqID_168520
atgccaccactgatcggagtggtcgcctccttgtcatggattttattagtggatggtgccgtgaatcgagcaagaaatggtacattcatatgtttaaaaggacctgatggcatcataatggagcaatctgtcgaattcaacttcaacccaagccacaatcaggcaaagtacatggcacttttagctctgatgggactcgctagagaaatgggtgtcaccaaactcatagtctgcatagactcaaagataggggcaactaagtgtatcaagattacagctcggtataccatcgtcgttgacaaaatttacaggaaaggtttcatcaatcctcttctcagatgccttagtcctcaacaagataatgttgtaataaaagaggctcacgagggtgtttgcaaaagccatattggcagtcgattattaggaaagaaaatcatatga

SEQ ID NO: 51743 - DNA, 267 bp, Glycine max
  Peptide Sequence Number=SeqID_168521
atgccgtggctaagggaaagcaatggtataagaatgcatcatttacgcatacttattagttgtttctttgccggttttgaaccattgattgctctaatgttaacgcatgatttctggcggcgtttgagacttttgggggggggtgttataatgggtgtgtgtgggggagattgctttctaatatctgccgttaggtacagttatacgcggtacaagtgctcagaggccgtgattttagtcacgggaaatataaattatctctcctaa

SEQ ID NO: 51744 - DNA, 1425 bp, Glycine max
  Peptide Sequence Number=SeqID_168522
atggaatcagtgaagccgtcggccgtgaccccgcgaaagaagttggcgcgcagttttgcgaaggttcttcatgtcaaagcacttattggaattgcttcagttgatggtctgaagaatgttatatctgatgcaaatctcaaggacgaaggaaaaatcgctaagagcaagactacactgaattggtccgagtcttttaatgaagatgatgatgaagagcttcaagagagagtggccaatgaagctcttttggcaaagctttttgctagcatttcaactgttaaagctgcatatgctgagttgcagcatgctcagtcaccttttgaccctgatggaattgaagctgctgatcaattgctagtgtctgagttgaagaacttgtctgagctaaagcaatgttacttgaagaaacagtttgatcctttgcccgagaaggagattcttgcagccgaatccaaggagctgcagggtgtgatcaaaacctatgagatcatggggaggaagttggagtcacaggtgaggctcaaggattctgagattattttccttagggagaagttagaggaagctaatatgcacaacaaggcaattgagaagagattgaatcaaagtggccagctatcagtgcttgataatcttcacataactggattaagtcctagccatttcatcatggtccttcgccatgcagtccggtccattcgcaactttgtgaggctggttgtggatgagatgagatctgcaggttgggacattgatgctgcagtcgacgccatcgaacagaatgtggtttatatggcagaagatcacaagtgtttcgcaatggaggcctttgtttgcagggaaatgtttgatgcattccacatccctaacttctccctttcaagtgagtctcctctagaaaaaaacaggagacaacagtggttctttgggaagttcaatgagctgaaatcaatgaaggcaaaggactacctagccgagaggccacgatcatcgttcgccaagtattgccgggtcaagtatttgggacttgttcatcccaagatggagtcatcgttttttggtaacctgagtcagaggaaccttgtgaatactggtggagggtttccagacactgcattcttcacctcattcgccgaaatggcgaagagggtgtggcttctgcactgcttggccttctcctatgagcctgaggcttcaatcttccaagtggagaaagggtgcagattctctgatgtgtacatggaaagtgtgaatgatgaaatcttcctctattcggaagtggaatcagatccacaagttgctttcacagtagttccagggtttaggattggtaaaactgttttacaatgccaagtgtacctcacatcacagcacaaacaacaaagcaaggttaaattttttttcacttcaacaaagcaaaggtga

SEQ ID NO: 51745 - DNA, 423 bp, Glycine max
  Peptide Sequence Number=SeqID_168523
ctgagaaagtccttgtggctgactcattggaaaaagtgaacagaaaattggacaagttctacatggtcctcatcttgagaagcttacattcagactttgatcatgtgcgtgatcaagtacttgctggggaccaggttccatcaatggattccctcatcactagacttctccgcgtgcctcatgtatcgaaggatgaaaatcctactgatggtgtggaaacgtcagccatggttgcatctcgtggtagaggaggcggccgcaacattagaagaggtcgcagtggaagggatggacgtcctcattgcacctattgcaagaggatggagaaagcagagtctagattctttgatgaggagtatcaggagtatttgaagcttaaatctgataaatctaacagccaagctcaatcctcatctgtaccat

SEQ ID NO: 51746 - DNA, 282 bp, Glycine max
  Peptide Sequence Number=SeqID_168524
gtgaaggagacatcctcaccacttgtgtttttgcagtctttcatcttgttcttctctttgttgtaaaggaggtttctggactatggaaagctaaatcctctgttggatcttccctgtcattcaacagtggaaactggtttgattctaaagtccctgatatcttggttgagtttagtcttacaagaggaatctgtggacgaggcttgatcaggactaggctaggttatcatgaggaatcggggtctaatagtccaggagacaacataggaacgcatgagcaag

SEQ ID NO: 51747 - DNA, 186 bp, Glycine max
  Peptide Sequence Number=SeqID_168525
atggcagaaatcaaccaaggtaagacgatgaccggtcacgattggtcgcatatcatttggctcttacttgcaggttcaagtgggcaaacgctaacccataaggaaagaggggacatggttaatgttcccctcaaaaaaaaaatgtggcaggttagctcgcctgggcgagcaacccctgcattctaa

SEQ ID NO: 51748 - DNA, 219 bp, Glycine max
  Peptide Sequence Number=SeqID_168526
atggttcaggccttccgcgctgacaagcacctccactgcgtgatagacagtgacgactactcccctgattggcgggtgcagttctacgtgttcccctacacccgcacccgatcgacgctctgcgaactcagaaggtatttcttgaagaagaggatcatcggcgtgagggaagagtcacgagttcgaaaacgggatttcggaaactttcgggtgaaataa

SEQ ID NO: 51749 - DNA, 393 bp, Glycine max
  Peptide Sequence Number=SeqID_168527
atgcatcttattaagctttgccgaattgcaggaatagctgatttgatacttgttaacagcaagttcactgcatctacttttgcgaatacttttaagtatctagatgctaaaggaattcgaccagctgttctatatccagctgttaatgtggatcagttcaatgaacccagttcctttaagctgaattttctttccatcaatcgctttgaaaggaagaagaatatacaattagctatttcagcttttgctatgcttaactcacccgaaggagttcttaagcataaagatattactaatgcttctttgactattgtaggtgagcatgttttatttatgcctgtgtttccgatgatagatattatgaatctgctcaatcttgcagtttgtgtgtaa

SEQ ID NO: 51750 - DNA, 225 bp, Glycine max
  Peptide Sequence Number=SeqID_168528
atggcgaaggtaacaagctcaaaactgaacattgcaataattcacccagatcttggcataggtggagctgaaagattgattgtggatgctgctgttgagcttgcatcccaaggccataaagttcatgtttttactgcacatcatgataaaaacagatgctttgaggaaactgttgctggtgaatctctctctatgcatatatgtgtgtgtgacagaatcaattga

SEQ ID NO: 51751 - DNA, 210 bp, Glycine max
  Peptide Sequence Number=SeqID_168529
atggaaattgatctttctccccaattggccaagaaggtgtacgaaagcaatggtgggtcttaccatgcatggtccccttctgagctccccatgttgcatgaagggaacattggtgctgccaaactagctcttcaaaaaaatggttttgcccttcctcaatactctgactcttccaaggttgcatatgttctccaaggtgaagttttgtaa

SEQ ID NO: 51752 - DNA, 1116 bp, Glycine max
  Peptide Sequence Number=SeqID_168530
atggaaattgatctttctccccaattggccaagaaggtgtacgaaagcaatggtgggtcttaccatgcatggtccccttctgagcttcccatgttgcatgaagggaacattggtgctgccaaactagctcttcagaaaaatggttttgcccttcctcaatactctgactcttccaaggttgcatatgttctccaaggaagtggagttgctggaattgtgctccctgaatcggaagagaaggttcttgctatcaagaagggtgatgctttggcactcccttttggtgtgataacctggtggtacaacaaggaggacactgagttggttgttctgttcttaggtgacacttcaaaagcccacaagactggtgaattcactgatttttacctaactggttccaatggaatcttcactggattctcaactgagtttgtgggaagggcttgggacttagaagagaaggatgtgaagacccttgttgggaaacaatcaggcaatggcattgtgaagcttgaagggaacatcaaccttcctgagcccaaagaggaacacagaaagggcatggcattgaactgtgaagaggctccattggatgttgacatcaagaatggaggaagggttgtggtgttgaacaccaagaaccttcctttggttggtgaggttggtctaggagcagaccttgtgaggcttgatggaaaggccatgtgttcccctggattctcctgtgattctgcttttcaggttacttatattgtgagagggagtggtcgtgctcaggttgttggtgctgatggtcgcagggttttggagaccacagtgaaggccggtaatttgttcattgtgccaaggttttttgttgtctcaaagattgctgactctgatggattggagtggttctctatcatcactacccccaaatattacttagaactaattggttctaatgattattataatgtcagtcctgtatttactcacctggctggaagtattggggcgtggaaggctctttcacccactgttctgcaggctgctttcaatgtagatgcaggacttgagcaactcttccgttcaaagaggaatgctgacgccattttcttccctcctccaaattaa

SEQ ID NO: 51753 - DNA, 345 bp, Glycine max
  Peptide Sequence Number=SeqID_168531
atgtatcaaaccgttaacttaaatatctctctctttcgctctcaatctcatttccctgctgctgctgcattcggttccttgacacgttccaatccacacgtgtacgccgctgtcacttccgactccaaggccgctactttgcttgacctaactcaacacgatctcgataatagcggcgacagtgccaacggtaacggcgacgacggtggaggtggaggagaaggaggaggtgataatagcaagggcgaggaaggatctgacggtgacaagaggaaaatgcctctattaatgtctcagaaattcactctagcttatgctgcactcgtcggaggggggttgagttag

SEQ ID NO: 51754 - DNA, 234 bp, Glycine max
  Peptide Sequence Number=SeqID_168532
atggcaccattgaagtcactggagaaagagtatccactcattgactctaattttcaaaccttctgcgcctcccacggcattttctctggttccgttcccctttctctagcaggccagggttacctaattcttggaattgaccagcttatctcaataatagacgctcttcatccaccattgctaaacggtttgcagctcttggaagatgctcagtgttttgtccactggatgtga

SEQ ID NO: 51755 - DNA, 1035 bp, Glycine max
  Peptide Sequence Number=SeqID_168533
atgatttctgagtccctgttactattcctcattgttttcatttctgcttcccttctcaaactcttgtttgagagaaaaaacaagcgtaagggccacttgaagaaccctcctagcccaccaacaataccaataataggtcatctccatctccttaaacccctcatccatcactcattccaagacctctctctccgatatgggcctctcataagccttcgaataggtcccgttaagttcatagttgcaagcaccccatcactcgccaaagagtttctcaagaacaacgagctcacatactcttctcgcaaaatgaacatggccatcaacatggttacctaccacaacgccactttcgcgtttgcgccttacgacacttactggaagttcatgaaaaaactaagcaccactgaactcttgggaaacaaaaccctagcacagttcctacctattaggacaagggaagttcatgacttcattcaaattttgttccataaatcaaagacccaggagagagtgaacctcactgaagctcttttgagtctttccaccaatgtgatatcgcagatgatgttgagcattaagagctccgaaacagacagccaggcagaacaggcacgggctttggttcgtgaagtgacgcagattttcggggagtataacatttcagatttcttaggtttctgcaagaacttggacttgcagggtttcaagaagagggcattggacatacataagaggtacgatgcgttgttagagaagatcatctctgataatggagatgagaaagtgaaggattttcttgacattttgttggatgtttctgagcagaaagaatgcgaggtcgagttaactcggaaccacgtcaaatcattgatcttgggcgagtgggggaaagcatgtgaagtgtttgatgaaatgcttcagaagagagtgcaaccgagtgttgtcagttataatagtctcattgggtttttgtgtaggaaggctgatttggacaaagcactggccttgcttgaggacatgggccagaaatga

SEQ ID NO: 51756 - DNA, 2949 bp, Glycine max
  Peptide Sequence Number=SeqID_168534
atgcaattcttccatcagggtcgtcttgttgaactcaaaggtgagaatgacaccaatctcaggcaattgtcttctccccaatttcgcaggttatgtcggacccagggcgatgggtttttcttccacattaccatgctgaccgacaatccctccacgactgagatcacctcgttgcaccctgctcttcagactctccttctccgatatgatgccttgttccagccaccacataccctaccgccggcacgaacaacagaccatcacatacatttaattcctcaagcaacccctgtgaacgtgcgcccttatcgctatcctcatttccaaaagcgggaaattgagtcacaggtggatctcatgctccaacgaggcctgattcagcccagcacgagtccactttcctccccggtactactcgccaagaagagtgatgggacatggcgattctgcgttgactaccgcgcactcaatgccgtcacggtcaaggaccgttttcctattccgaccacagacgagctcttagacgaattgggaggtgcctgctgcttttctaagttggatttattgcagggttatcaccagatccgaatgcatgatgccgatattcacaaaacatcttttcaaactcatcatggacactatgagttcaaagtcatgccttttgggctatgtaatgccctatcgtcgttccaggctacgatgaacttgttgtttggcccctatctacgccacttcattatcgtcttctttgacgatatcctggtgtatagctcctctttcgatgaacacttgcgacatcttgagaccacctttcaggcacaggttgagtacttaggacacgttgtttcgaccaaaggggtggaacccattgcttctaagattgatgcaatcaagcagtggcctattccacagtccacacgagctctccggagcttcctcggcctcgtcggtttctacagaaggttcattcgtaattatgctacaatggcagcccctctggtaaagcttaccaccctgccttctttccaatggtctacggacgctcagcttgcatttgatcaccttaaggaagctctctcctccactccggtattgaccctaccggacttcactacccctttcacactggaaactgatgcttccggggttggcatgggggcagtcctttcccagaagggtcaccctgtggcgttcttcagcaagcctttcacccccaagttgttgcgttcatctacatatgtacgagaattgtgtgctattaccacaacggtgcgtaaatggcgccaatacttgcttggccgccatttcactattatcactgaccatcgaagtttgaaggagcttttgacccaagtgattcagacactggagcagcaccagtacatggcaagactcatggggtacgactatgacattcaataccggtctgggtcccataatcaagcagctgatgccttgtctaggatttcagagcaacaaccaacccttacaatgatcctttcagttccctgtttatcatttatgaaagaattgcgagctcagtttgactctcatgatggttacgatcaactgcgacaagctatattggcagaaccttcccggcaccccggcttctctgtcattcacaacctcattatgcataagggttgcatttggattccttacgacttacccatcattcccactttgttgcatgaatatcacactactcccacaggtggtcatgccggaattcgaaagactttagctcgtttatcggagaattttatctggcagggactcagggaagatgtggctcgctttgtggccaattgtttggactgccaattgacgaaatatgaagctaagaagtccgcaggactgttatgtcctctccctgttcctcagagaccatgggaggacctctccatggattttattgtcggtctacctccttaccatggccacactacaatctttgtggttgttgacagattttcaaagggaattcacttggggactttacccacttcacatacaactcacatggttgcttcacttttcttgaacatcgttatcaagcttcatgggtttcctcagagcatagtctcagacagagacccacttttcattagccatttttggcaggatttatttcgattaagcggcactgtcctgcgaatgagctcggcttaccatccgcagactgatggtcaaactgaggtgctcaatcgcgtgattgaacagtacctgcgtgcgtttgtccatggaagaccaaggaattggggaagattcattccttgggtagagtggtctcataactcgtcttggactgtgggttcggggtctacaccttacgagattacatatggtaggaaaccttttgcatttcctgaatatctcttgggcacttcgagaattgatgctgtggaggaattcttggtggacagggatacgacttttcaatccattaggaagaagcttatcaaagcacaagaggctatgaagatttacgcgaacaagaacagaagggaagtcaactatgagatcaatgattgggtattggtcaaacttcgaccttatcgacagtccacggtgagaggatctccgacgagctccggtaagctgaccaaacgctactttggtccctttagggtcattgaacgaattgggatggctgcatatcgccttgaactacccgagggagctaagatacattctgtcttccattgctcgttgcttaagccttttcgaggatccccgacacaccctgactctacctctctacctccacagttcattgatggacatcctagcactactccccttgctatcctcagttctcgacaagtcaacaattcctgggaagtgcttgttcagtggcaggggatgtcccctgatgaagcatcttgggagaactggaccaccttatgccaagcttaccaccttgaggacaaggtggatttctag

SEQ ID NO: 51757 - DNA, 558 bp, Glycine max
  Peptide Sequence Number=SeqID_168535
atggagggtttgtgctctgtggagaagtatgaggaagctaagaagcttatgtttgatatggcgtatcatgggtctaaagctcagccggtgaattttggtgttttgatgaagaatcttgggaagagaggaaaggttgaagaggccaaggctttgcttcatgagatgaagaaaaggcggcttaaaccagatgttgtaacgtacaacatattgataaattatctttgcaaggaaggtaaggcaatggaagcttacaaagtcttacttgagatgcagattgggggatgtgtgccaaatgcagcaacatacaggatggtggttgatgagatggaaaagagaaaggtagaatttgatttggagagatgggaaactatcattaagtctgcctgtagtgaggataagggtgcaagtgaacaaattgttttcaatgggtggatatatgttggtgcttacctcagaggactggcaaagatgagagtagagcttagggagcacatatatgatatgaaacaacagaaatacgagaacaaggatgatagaaccgttaagataagaacttag

SEQ ID NO: 51758 - DNA, 150 bp, Glycine max
  Peptide Sequence Number=SeqID_168536
atggtggttttcctggcacataagttttcacttctcaaggcagtaaaaggactggcaaagatgagagtagagcttagggagcacatatatgatatgaaacaacagaaatacgagaacaaggatgatagaaccgttaagataagaacttag

SEQ ID NO: 51759 - DNA, 723 bp, Glycine max
  Peptide Sequence Number=SeqID_168537
atggcgccattggagtcactggagaaagagtatccactcattgactctaattttcaaagcttctgcgcctcccacggcattttctctggttcctgttgcgcacacgctcacgattccattatcttctcagttgaagattttcttctgcacgatctcgacgcattactttcctttacggataatcattccacttcacagaccctgaagcagggaattgaccagctgatctcaataatagacgctcttcatccaccattgctaaacggtttgcagctcttggaagatgctcagcgtaataaacatgttttgtccactggatgtgaagggattgatgcattgctcagaggtggattacgtgaagggcaattaactgaacttgttgggtcatcctcgtctggaaagacacaggcatgcctactgtctgcctcaactgttgttgcgaagcataagagttcagttatatacttagatacaggcaactccttttcacctcaacgtattgcacattttgttggtcagtcttctggccatatttttggcaatcagattgtgaaatcaaatcagcatgttcgattgcttattgttgattcaatctcttcactgattacccccatccttgggggcagtggtcctcaggaagcctatagtttacatgttacgggtgatttcaggacatgctttaatgatatctgctgggtttttactgaagaagttagcacatga

SEQ ID NO: 51760 - DNA, 537 bp, Glycine max
  Peptide Sequence Number=SeqID_168538
atgagacaagttgaaaccctgagagagtcacacgtaaacatgcacgcgccatcaccccaacctctctctgttctcttcatcaaccctcactcatacattaccattagcaacggacagaagagagcaacaatgaacaaccctagttctccctctccctgcgcggccttcgcggacttctacgagcaatggttcgaggagcttcagtccctgatgcagcaactcaggggtgagggcagaaaagaggaggtgatggagaaggtgatgtggcaccaccagaactactacgtggccaagtcggcggcggcggagaaggacccactcaacgtgttcctatctccctgggccaccacgctggagcgctccctccactggatcacagggtggcgccccaccaccgcgtttcacctcatctacaccgagtcctcgctcatgtttgagtcccacatcatcgatattctccagggactccgcaccggcgacctcggcgatttgtcaccctcccagttccgccgcgtcagcgacatccaatgcgacact

SEQ ID NO: 51761 - DNA, 768 bp, Glycine max
  Peptide Sequence Number=SeqID_168539
atgtctctttatgtctcctcttttctcctccacccattgccagcattcacagataaagggaagtttctgctagcagctaggagatataggtgtggtactcataccgagtatataatttcacttgatgctgatgatttatcccaaggaagcaatgcttatgttggaaagctaagctcggattttcttggcaccaacttcacaatttatgacagccagccaccccatagtggtgcaaaaccatcaagtggcagggccagccgtcggtttgccagcaagcagataagcccacaagttcctgcaggtaactttgaggtggggcaggtctcctacaagttcaaccttttgaaatcaagagggccaaggagaatggtttgctcattgaagtgtcccgtgactcctgtcgtctcaccatcggttgaaagttcagatagcacgccggtcaatggccataagattcccgataaagaacaagttgcatctggctacacaatcttgaagaataaagctccaaggtggcatgagcatttgcaatgttggtgcttgaatttccatggccgtgtgacagtggcctcggtgaagaactttcagctggttgcaacagtggaccaaagccaaccaggagggaaaggagatgaggaaacagttctcctccagtttggtaaagtaggggatgatacttttaccatggattatagacagcccttgtctgctttccaggcttttgccatttgcttaactagctttggcactaaacttgcttgtgagtaa

SEQ ID NO: 51762 - DNA, 186 bp, Glycine max
  Peptide Sequence Number=SeqID_168540
atgagagactctgcacctaccggcaatgtacttgagcctttaaatgctgccagagaagttgttggggatgttgattcaataaaggatgaacttgttttatggcttataaatgatgataatagaacttgcggtgtaacctgtgaacaatattggtttagatgcctgactttagccatgagagcatga

SEQ ID NO: 51763 - DNA, 375 bp, Glycine max
  Peptide Sequence Number=SeqID_168541
gttgcaccatctatggtgaggatcatgaaacaggccaatggtccctataatcaacaaggacagtggaggacacaccctggaaaccagttcaacaaagaccagaatgggccttcaaacaggccaatccaacaagggcctaacatattccagaggactactaagatggaggagaccttgactcagtttatgcagatagctaacaagtcatccaacatttttgtggcaaatacagaacaaaatcccaaggaggaatgcaaagctgtgatgacaaggagtaaaaggtttatggaggctgaggatgaggatagtgttgggcacaaggagaaagcggttgaaaagaaagctactcaagttgagaataatggtcaagaataa

SEQ ID NO: 51764 - DNA, 930 bp, Glycine max
  Peptide Sequence Number=SeqID_168542
gttatgacagagtcactgctgttgttattcatgatgctaatggtacacttgagaatgctatcagtcaaaatgatgagattaaagaatatgtggattgcagatatatttctccatgtgaagctacttggagaatttttggttttccaatacatgctagaaagcctgttgtggagagattacattttcatctgctaggacaacacagtgttttttatgaagatgatgatgatatagatgatatcctgtcaaagccaagtatttcagattcaaaattcttagcctggatgaatagcaataaatgttttttagagggtagaaatctgacttattcacaatttgtttccaaatttgtctacaaccaaaaggctagatcatggaaccttagaaagaaaggcaatacaattggcaggttaatatgggttccaccaaccactggtgaattgttttatctaagaatgatgcttactgcatgcaaaggagctacttcatttgaagatattagaacagttgaaaatgttctataccttacatatagagaagcatgctttgcaatgggttttttgcaagatgacagagaatttatggaagcaatcaaagaagctaaggactggggtgtcattactaaacctaaagaactttggagtcagacatggaattggttagctgaagacattgcatatcattataaaaaaacaactctgaacacaaaatcacacattgatgatgagcaacttaaaaatttaacattactggaaattgaaaaacttctacatccaaaccaaagatcactcagagactatcctacaatgccatatcctgagggtggaaatcctgcatcgtgtctaaagaatagcttgatattgtctgaacttaattacaacaatgatgaggctagatcagaattcaaaaatctttttctatcgatgacag

SEQ ID NO: 51765 - DNA, 165 bp, Glycine max
  Peptide Sequence Number=SeqID_168543
atggatgaacatcaacaaaactggaaggaaatgactaacataatgataaagattaacaaagaatcagatgaaatgttcaacaccattcatgttattgatcagctttacggtgaagtgagtaggtcatttgctataagatggaaggatgaactagagcctacgtga

SEQ ID NO: 51766 - DNA, 294 bp, Glycine max
  Peptide Sequence Number=SeqID_168544
atggatagtgctgtattgtttaactttcttctaaataaccgagaatgccctgttccttttccatggcaagcaattattgatattcagaagaaccttgtttactaccgcaacaatgagactggatttgtgatattcgattttaggcccctggtcgatcttggaggaggtgttttctttgaaaatactattggatcaagttggggtattgggccactaagtcagggtcgactaaaacctgcgtatgcacacgctgttgtgattcacgctggtttgttcgattctggatttgcttaa

SEQ ID NO: 51767 - DNA, 327 bp, Glycine max
  Peptide Sequence Number=SeqID_168545
atgataactcacttcaagtgtgtgtttgtgtttgggttaattgtcattttgtttcatggtagagggtgtcacacccttccccgcagcaacaacacttctcatcttcctacaacctccttgttgccattaaaggtaggtaagttcctttcatctcttttggcatggggtggggcttgggttctggttttggtggagggttggtggggtgttgggttctggttttggtggagggggttggtgaggggttgggttatggtagggaaggtctacaggtgcccagaatacgtgtttcagaaaacccattctgtaacaggcgttctagaatag

SEQ ID NO: 51768 - DNA, 807 bp, Glycine max
  Peptide Sequence Number=SeqID_168546
atggataggaaacgtcctagaaagttaaacttgaatgcaccccttttgtccacacggcgtctcggtagtccaaatgttgcagatacttcatgttcatcatattcagttggagcagtccaaaatacaagtgaaagggttccattttcttgggagaaagcaccaggcaagccaaaagaaactgagaggagtgataacacacaagacggtggcacgctgcgcctaagactaccacctcgccattggtttcttccgaaagaagcagtcgaagaagatgttgatcgtggtgatgatgcatttcatgatcagggagatggtagttgtgatggcgacgatgacaaggatgatttcttctcggatgctatggatgttttatctctatcagaggcattagattatgtccaaaagaaatcggagaatgctcatagtaacaccaatgatgggttgaggttaaagcttgcagagtctaatggataccaatctcctacttacatgatcaatcgctttcttcccgatgccactgctttggctgcatcatctgctttgcatttttctactaacttagaagagaaagattgtgatacttgtagctatccagggtgttacacaaggcattcatatgcttcttctccaaagggttgtggcttggaactactcttcccgtggcgtatgaagcataaactttgttctatagagagccctgtgttgccatgttctactaatctgcacaagcataagcgcaactccaaacagaagaaacaccgttcttcaacaacctacattccttgtacaaacatgaaagatatttga

SEQ ID NO: 51769 - DNA, 2865 bp, Glycine max
  Peptide Sequence Number=SeqID_168547
atgcaacacaacatcttcgcctcaatgcgtagcttgaagatcatggacggttgcaagggcactcaggtctacgccatcaacccctccagcgccaccggcggtggaattggcgagaagcttctccaacagcttcacgaccacatcaaaagccacacccttagaaccaaatcggttcggaacttacaacctccgaacatgacgacgccgtcggaggttttcgtctccgacgggtcgctccttccttacggcctccccatgacggacctcctagagcccaaaattgaaccctccttggtgtcggtggattttgtcgaaaccctcgccggagtctaccgccgcaccgaggaccgccaccagttcgaccgctccgaggtgtacctcgagcaatgcgcggtattccaggggctggccgacccgaagctcttccgccgcagcctccgcgccgcccggcagcacgccatcaacgtgcacgcgaaggtcgtgctttccgcatggcttcgctacgagcgccgcgaggatgagctcatcggctcgtccttgatggactgcagcgggaggaacctcgagtgcccccgcaccacgctggttccaggctacgacccggagttggtgtttgattcctgcgcgtgcacgggtgcacgcgcaggtaatggtgataacgataatgatgatgcaatggcaatagtggttgatgagcaatgctccacctcggaagaggaggaggaggatggtgacatgtctttttgtgttggtgatgatgagattaagtgtaataggttcaatatagcctcactttcaaggccctttaagataatgttgtatggtggattcattgagtcaacgagagagaagataaatttttcgcggaattgtttttctgttgaggcattgagggctgctgaggtgttcagtaggagaaagaggttgagtcatttggagcccaaggttattttggagttgctatctttggcaaaccggttttgttgcgaggagatgaagaatgcttgtgacgcgcatttggcatcgcttgtttgtgacatagacgatgccttgttgcttgttgagtatggactggaggagaccgcatacctgctggtggctgcctgcttgcaggtgtttctccgggagctccctggttcgatgcaaagtttgagtgttgtgaagatattttgtagtccggagggtagggataggcttgctctggcggggcacgcgtcgtttgtgttgtattattttttgagtcagattgcgatggaggaagagatgaggtcgaacaccactgtgatgctgttggagaggttagtggagtgcgcaaaggatggttgggagaagcaagttgcgtttcatctattgggtgttgttatgcttgagagaaaagaatacaaagatgcacaatattggtttcaggcagcggttgatgcagggcatgcttattctttggtgggagttgcaagggcaaaatataagcgtggtcacacatattcagcatataagttgatgaactcacttatttctgatcataaaccggttgggtggatgtatcaggaaaggtctttgtattgtgttgggaaggagaaattgatggacttgatgtctgcaactgagttagatccaactctttcctttccatataaattccgggctgtttctttcctggaggaaaacaagattggacctgccattgcagaaatcaataaaataattggcttcaaggtttctcctgattgccttgaattgagagcttggttcttgattgccatggaagattatgaaggagccctcagggatgtccgggcaattttgacattggatccaaattatatgatgttctatgggcatatgcacggtgatcagttggtagaacttctccaaccttttgttcagcagtggagtcaggctgattgctggattcagttgtatgaccgatggtcctctgttgatgatattggttctttggctgttgtacaccagatgttagcaaaagacccggggaaaagtcttttatgctttcggcaatctctccttcttctacggttgaattgtccaaagtctgccatgcgtagtttgcggctggctagaaatcattctacttctgatcatgaaaggcttgtgtatgaaggatggatactgtatgacactggttatcgtgaagaagcattagcaaaggctgaggaatctatttctattcgaagatcatttgaagcttactttctcaaagcttatgcgttagctgactcaaatcttgattcagagtcttcaaagtatgtgatctgtctcttggaggaagctcttagatgccctttagatggtcttcggaaaggacaagcactgaataatctagggagtgtctatgtagactgtgataaactggaccttgctgctgactgctacatgaatgcactcaacatcaagcatacacgagcacatcaggggttggcacgtgtatatcatcttaaaaatctccggaaagcagcatatgatgagatgacaaagctaatagaaaaggctcggagtaatgcatcagcttatgagaaacgttcagaatattgcgaccgtgacatggcaaagagtgatcttagtatggcatcacaattggatcctctaaggacttatccttaccgatatagggctgcagttttaatggatgatcataaggaagctgaggcaatagaagagctttcaagagccattgattttaagccagatctgcaactattacatcttcgagcggcattttatgattcaatgggtgattttgtctctgcagtccgggactgtgaagcagccctttgtcttgatcctaatcataatgagattcttgatctctgtaataaagcacgggagcatattcgagaaccaaagtga

SEQ ID NO: 51770 - DNA, 618 bp, Glycine max
  Peptide Sequence Number=SeqID_168548
atgaaggttgatatggaggccatgaaagaccagatgacaacgatgatggaaatgatgatgagcatgaacaagatgatgaaggagttgtatgaggatttcaagatccaacaccataatttgacaccttatcggcccaacatgaatgatgcagttgaggtcgccaataagaatatcaagaaaatcattcaaaagatgacagtgacatacaaagattggcccgagatgttgttgtttgcattgcatgatattccttctttaagggttcaatcgaaagcagagttggaggaagtagaattggcccaggcgcattctaacaagttggatcttattgagggaaagagatcgactgctatgagtcatggagggtacatctacttgggtttgactaagaacaagagagggtacatctcttgtggatcagttctagtggagggtacatccactaggttcaaggagaacaatggagggtacatcccttgtggatctttgcttgtaaaaggccactcgatccaacaaccttttgtggtgaagaaggctttctcaggtggaacactgatactcacaaacatggatcgggaagaattgcctttgcctataaattctgatgtcgtcaagtga

SEQ ID NO: 51771 - DNA, 528 bp, Glycine max
  Peptide Sequence Number=SeqID_168549
atggcctcctatggtgacttaactagaacaagaaaagtatctacaagctccgatgtgtatgcatttggggtcttactccttgaagtggttgctggcataagacctcttggctcatcaggtcagtttttgttggtggattgggttcttgagaattgccaacttggtcagattctaagagtggttgatcctaagctaggttcagtttatgatgaggaggaagtggagttagtgctgaaattgggtctcttgtgttcacaatacaaagttgactatagaccttctatgaaacaaatggctaggtacctacactttgatgaccctcttcttgatatctcttattggagatactgtgattcacaaagcagcacaacaagcttaagtttctcaaaagccatgtctacgagaaagattgcatcttcatacagtttatcttccattggcagtagaaatacaatgccaataaaaacagtcttgctaattaatggtacaaaagttttcataagaataaggagtaaaccctttgcatga

SEQ ID NO: 51772 - DNA, 360 bp, Glycine max
  Peptide Sequence Number=SeqID_168550
atgtccaataataaaaaagaaagtggggtgcaacaagcattgattagaggtgcaggaagcaacaatccacttaaacgtaccaggatcaatgggtcatcagacatgcgtgagctcgatggctcttgcttcttgcactctctttttgcctttcaaaatgatcaatctgaaagacaaaaaaaatacttcgaaaaaagtgcaggaatcaagttggaatgtgcaggaagcaacagcccagctcaactaatgagaaataaacctttttcccaaaaggtcttagtggcccaaaaaatcgctgttcaagatatgggccaagatttcgtataccccacaaatcttccgtcccccccttgtagattctga

SEQ ID NO: 51773 - DNA, 492 bp, Glycine max
  Peptide Sequence Number=SeqID_168551
atgagcctgctaattgaagtcagaggctttggtgctgagtacaaatgtgtgttgcctaacacaggaactgaggttgctatcaaaaggatcatgagaagtccaatgcaagggatgagggaatttgtagctaagattgaaagattagggagattgaggcacaagaatttgagattcaatattctcaaaggtgtagctacagggttattatatcttcatgaagagtgggagcaagtggtgatccatagagatgtgaaatcaagcaatattctaatagatggtgaattcaatgctcgtttgggtgattttggactagcaaggctttatagccatgaccaagtgctagacacaactagtgtagttggcaccattggatatattgttagacaggtgacctccgatatcttaagaaggggggttgaattaagatattacaaactatttccccaattaaaattctactttgattttaatgcaagttccaaattcccttaa

SEQ ID NO: 51774 - DNA, 1026 bp, Glycine max
  Peptide Sequence Number=SeqID_168552
atggcttctctgcctcaaccaaaaacctcccctctaaccttattcttcttctcgtccttcaccatcattgctcatgcaattgttcctcaaaacgaaaccttcaaatttgagaactcaggtgaacttggaccctacatcgttgagtacggtgttgattacagaatgataagcatcttcaactctccattccatgttgccaatagaggcaacccagttggagaaaacgcaactttttcactcggcactgatgggaaccttgtgttggcagaagctgatggaagaattgcatggcaaaccaacactgccaacaagggtgttgtggcctttaggcttcttccaaatggcaacatggtcctccttgatgcacaaggaaagttcctttggcagagttttgatcatccaacagatacccttttgaatgatcagtatcttagaccaaaagggccatctaaattgattagtaggctctcagagaaggaaaatgtcgatggaccttatagtttggttttggagcctaaaaggttggctttgtactataagagcaagaattctcctaaaccaattctgtattggtataagctcttcactcaacaaggcaccaatgaatttagaaccatggcgaccggattcggcaacattcccgttggagtgatgggaatgccagtgaacaacagcaccttgacatacctcaggcttggaattgatgggaacattaggctgcacacttacttcctaggggtgcgttctggtgtttggcaagtaacctacactctatttaatagagactctcatgatgagtttgagtgccaatggcctgagaacaacaattgcactgccaagcctgtgaaatcatgcaaggcacgtgatttccactgctacaaagttgaaggtgttaggcactacctgagcaaatacactgaggggggaaaagtgagagagagtacttgtggaaacaaatgtaccaaggattgcaagtgtgtgggatgtttctaccacggagaagtcaaggtgttggatagcttatga

SEQ ID NO: 51775 - DNA, 261 bp, Glycine max
  Peptide Sequence Number=SeqID_168553
atggagatgaaggggccaaaaatggaaagcttgagcgaagagaaagagaacaaccaacaaactactattcccactatcacctttgctattttaactaccagcattgttaaaaagacatcccaaccctctatctgtttatcctcacctccttcccttcccttcccctctatttgtttaaagactttcttcccactccaacttttcatttccattttctcacctaaacaactccaccactacaccacttttcttgccacttga

SEQ ID NO: 51776 - DNA, 321 bp, Glycine max
  Peptide Sequence Number=SeqID_168554
atgaaaatgcgtccttttcttcgttcttttcctcgttcattaatattcttctttggttgcttccttctccttccacttttgctcttgctcttggtggcaccttcttcttcaggtgctccaaatgaaaaggtaaccctctcactctactatgaaagtttatgcccctatcgtgctgatttcatagtgaaccatcttgtgaggctcttccaaacgggtctcatatccattttaaacctcagattggtcccttggggcaatgctaggattgcacctgatggcactgttgtttgtcagttatgggtcattttctgggatcagtaa

SEQ ID NO: 51777 - DNA, 270 bp, Glycine max
  Peptide Sequence Number=SeqID_168555
atggaacttcaacatctcaaccaaaatgaagagactgacaaaaggaaaagaagcatagcaatcaaagcctcctccttaataataatggagagaagccataacttcaacaatgggaagagatctcaagaagtttctccaacacttaaatgctataagtgtaatcaaacaggtcacataaaggcaaattgcccctcaaatgagtcatggcccgagaagaatgagaagaaaggctataaagaaataagatccaagaaggcgtatattgcttga

SEQ ID NO: 51778 - DNA, 357 bp, Glycine max
  Peptide Sequence Number=SeqID_168556
aggaggcgagcccgatgacatgcggagacaaattatggtcattccgcacaccatttgccatccagatgcgatcgtgtccgatggcacgcaaagacaaattatggtcattctgcgccttgtgtcaaacgagaggaacgaattcggcagtcccgctgacggggagattgtccggccgaatgggatcatctgtttgttgggatgcgaccctcgcttgaccactttgaggtacttgacacccatcgttaggcaatccgtgaagttccgctacatgtcgggagttgaaaggacgggtgtacaaatagcaatcaggcctacttgggcattccaggatcttccaacagaagacggtgccttctg

SEQ ID NO: 51779 - DNA, 267 bp, Glycine max
  Peptide Sequence Number=SeqID_168557
atgtggggcagtaacaacgaacttaaactccgaagagaggaaagggaccaatcgcaattagatggcataattctgaaggacgaattgaagacttgcctaaggaaagacgccattactaaacacgccccaaggcatcccaatcgcaccagatccaaatctaggacgatgggtgacctagaggaagtgcaggaacagatgaaagccgacatgtcggctttgaaagaacaaatggcttctatgatgaaggccatgctgggaatgaaatga

SEQ ID NO: 51780 - DNA, 1815 bp, Glycine max
  Peptide Sequence Number=SeqID_168558
atgtccctctccaccgtgaggcagcggcgctcggagccgtctgatccgtcgccatcagaaccgtacacgaagctggacaagcccgagaaagcggaggagaaagacgaagggttggggtgggttttcccgttcgtggctcttgggttattgaggtacatgagtgccacctccaacatcatccacgattgcgacgaggtcttcaattactgggagcctcttcatttccttctctacaaatctggattccagacatgggaatacaggttctgttctgtattgctcttcttcttcttcttttttgttggggttcagttttggggagatgatgggtcaagggagaagagagaaagttttgatttttattatttttggggtgtgtttggttcacagtttgctcttcggtcatatttgtaccttttatttcatgaaatagtgggtcgaccagcttcatggttgtttagtgaggacaaagtgagagtgttctatgctgtgagattctttctcggtcttctctctgttttgactgatactgttctcgtggtagctctttcgagaaagtatggaaaacgacttgctacgtatgcccttgctatgctgtgcttaaccagtggctgtttctttgctagcactagtttcttgccgagttcgttttctatgtatgcaatatctcttgcatcaggtttatttcttctggataaacctgctgcagcaatttctgttgctgttattggtgtaatacttggctggccattctcaatcttggctttccttccagtgacactatattctctatctagaaaattcaaacaggcatttattgctgcggctgtcacatcaattcttcttcttgcattgtcaatagttatggacttttactactatggaaaatggacttcatctgtcttgaatcttttaatatataatgtagctggaggcggtgaaagccatctgtatgggactgaagggcctctttattatctgaggaatggatttaacaatttcaacttttgttttgttcttgctctgctgttcttggggattttgcctattgcaaagaagaaatatgcaccagacctactgattgtgatatcacctatatatatttggctggggtttatgtctttgcagccacacaaagaagaaaggttcctgtatccagtatatccacttatttgtgttgctgcttcagctgttattgagagcttccctgatcttttccgtagcaaatataatccatatgatcgctctataatagtgacagttgccaaagttatgagaccagtggttcttagccttatactatatgcctctcatgcccgtacattttctctgatcaatggttactccgctcccttagaggtttacaagatcttggaacaccatgatgcagaaaacaattctgtactttgtgttggaagtgaatggcatcgctttccatcatcatttttcatcccagattatgtgggacaagttcgatggattgacgatggattccgaggtcttcttcccatcccatttaattctaccctaggggggactgcatcagcaccaccatatttcaacaataaaaacatggcatcagacaagcaatatctccatgatgttgatgcttgtactttccttgtcgagctgcagctagagcggccttacctgactcgtggaagtgacttgtcaacatgggagcctattgctgcattgccttatctggacagggagctttcaccggcactgtataggtcctttttcattccttacctttggcaagagaagaatgtttttggaatgtataagctgcttaaaagaagaaccacctga

SEQ ID NO: 51781 - DNA, 303 bp, Glycine max
  Peptide Sequence Number=SeqID_168559
atggtgaaatgggcatgtaaaagtagaatagcagttctatgcagaagtgaaaaagcagtggacttttatggaaaaattgaaactttatcagaacaaatgtctgttataaggaaaaagagaaaatgggtagctgcaggagatgatggaaacgtgattgaaagtagccatggctggttcagtgatttgagtgttccttccttccactgtctccctcctcagtgtggtaacctggtattgccggtgacaggtttttctttttatgacagtgactggaaagtgggacccatgggcgtagttgtgccc

SEQ ID NO: 51782 - DNA, 423 bp, Glycine max
  Peptide Sequence Number=SeqID_168560
atggtggatgccatgaagaaggtggcgaagctggacgttgagttgagtgtggaagagaggaacctgttctctgttgggtacaagaatgtggtggggtcacggagagcttcatggagaatcttgtcatcgatagagcagaaagaggattccaaagggaatgagttgcatgttaagcatatcagggattacaggaacaaggtggagttggagctgtccaacatttgcagtgacattatgataattttagatgagcatcttattccatccactaatattgcggagtccacagtgttttattataagatgaaaggagactattaccggtatttggcagaatttaaagctggcaatgaaaagaaagaggtggcagatcagtcacttaaagcatatcaggtatttgctggaggattaggtcttatgtag

SEQ ID NO: 51783 - DNA, 372 bp, Glycine max
  Peptide Sequence Number=SeqID_168561
atgaaaacctcaaatttccagctcagactaaactgctatgattatttacagacagcttctaccactgctgagagtgaactacaacctacacatcctattcgtttgggtctggctctaaatttctcagtgttttattatgagatattaaattcacctgaaagggcctgccatcttgcaaagcaagcctttgatgatgctgtctcggagctggataccctgaatgaggattcttacaaggacagtaccttgattatgcagctgttgagggataaccttactttatggacttctgatatccccgaagagggtgaggacctaaaaatggaaagcgcagccagggttgatcaaggagaagatgagttaggccgctaa

SEQ ID NO: 51784 - DNA, 354 bp, Glycine max
  Peptide Sequence Number=SeqID_168562
atggagctgacacgaggccttggagacaccagcagcaccagcgccttgcctttatgcttacgtggcgcattgaggaaggcgccagtcaaactggcgtgttgggtgcagcagagatgcacagagtgtagtgctacagcaggaagctgcagttgcagcaggaaacaggagcaggaagcgccattggaggctgcgggttgcggacaggtgggaggtgccatcacgaggagcgctttgctcctttatattcagttctcatccactgcattgctacccgttctcctcagccttcgactttcttcaatcttgcttcctttgcttctttcgtttctgctgcttgtaacttcttggttttaa

SEQ ID NO: 51785 - DNA, 252 bp, Glycine max
  Peptide Sequence Number=SeqID_168563
atggctatcacaaggggaattcagaaattggcttaccacacctattgtaaatgtgatgtctggtctggtgacaatgacataattaagtcttccaatggctcccccgtgatttggaagaagcttgacattgggatccatggaagtgtctctagggcgacaatcaagcacgtcagtctctctaagtatatccaaagcatatttccactaggaaatagcaacgacagtagaggattgatcaacttcaatgcctaa

SEQ ID NO: 51786 - DNA, 165 bp, Glycine max
  Peptide Sequence Number=SeqID_168564
atggccaaacaaaagcctaaacagcgcttgagcttcacacaccggggtggggcgatgagtgaggtggcagaaagggtcactgttggtgacattgggttctttggaggaaggtcagcagtgcgagcatcacaccgctatttggctattgatgtgaagaaacagtag

SEQ ID NO: 51787 - DNA, 1180 bp, Glycine max
  Peptide Sequence Number=SeqID_168565
gttgggacaagttgagaatgcaaggaagcacctttgttatcctgggatgcagccagatccgtctgatatgcagaggttgcaagtggtggaaaagcatatcagcaaatgtggggatgtacggagggttggggattggaagagtgttctcagggaagttgatgctgctgttgctgctggagcggattcttcttatcagctctttatgtgtagagcagaagcgtttttgaagctccaccagattgatgatgcggaatcaattttgttgcatattcccaaatcagagccgcacactaattcctcttctcaggcaaggttttttgggatgctatgtgaggcttattcctattttgtcagagctcagattgagatggcattgggaaggtttgagaatgcggttacagctgctgagaaagccagtcagaatgattcccggaatgttgaagttgctgttttgctcaacaatgtcaggatggtggcaagggctcgagtgcggggaaatgatctttttaaatctgaaaggtacactgaagcttgcttggcgtatggggaaggtttgagacttgacccttcaaattccgttctatattgcaatagagcagcttgttggtttaagcttgggcaatgggaaaggtcaattgaagactccaaccaagctttacatatccaaccaaattacaccaaggctcttcttcgaagagctgcatcaaacagcaagctagaaaggtgggaggaagcagtcaaagattatgagatcttgcggaaagaacttccaaatgacaatgaagttgctgaatctcttttccatgcacaagttgccctaaagaaatcacgtggagaagaagtaacaaatttaaaatttggtggtgaagtggaagaagtctcaggtcttgagcagtttagagctgcaatttctttaccaggtgtatctgttgtccattttgaagttgcatctaactcgcaatgcaaacaaatatcgccatttgtcaatacactatgtggtcgatatccatctattaacttcctcaaggtggacattcaacaaagcccaacagttgccactgcagagaacgttaggattgtaccgaccttcaagatatacaaaaatggctgccggctgaaggaaatcgtatgccctagtcacgacatgttggaacactctgtgaggcattacagcttttag

SEQ ID NO: 51788 - DNA, 840 bp, Glycine max
  Peptide Sequence Number=SeqID_168566
atgtcgcattcgtcggggaagccggtttccgaggtggtcggcatagacgccaccttctccgatcggttccgcgacgccctcacctgcgacgacaataacaacattaacaagcccgacttccgagaactcgatctgggctcgccggtctcgccattgcggaccacgcgcgggcctgctgccagtagcagctccagctcctccggttccttttcgggccgaaccggacccacccgaaagcccgaatcggcacaaaataatagcaacaccaacactcacattcacagcaataacaacaactccggtgaactttctggttcgagtgagaacagtcccactgcgcgcaagccgggtcacacgagatctgactccggatctgcgcccgttcccttgatatattccggtcagacagcgacctcgcctgtgatgaatgttcttcccacaggaaacatttgtccatccgggaagatcctgaagacggggatgactccgaatcggagtagcagaactagtagaagcgatgtgttggggtcggggatggggaactatggccacgggagcataatgcgcggcggagggaaggctgagccggcgagtactcgcggcagtggcggcgggaatgagatggtgaagagagggggacacgtgcagagtgtggatccggaagagttgaagaggttggggaatgagtgttacaaaaggggaaactttgttgatgcgttgagtctctatgatcgcgcgattgcgatgtcgccggcgagtgccgcttaccggagcaaccgtgcggcggcgttgacggggctcggaaggttgggtgaggctgtgagggaatgtgaggaggct

SEQ ID NO: 51789 - DNA, 255 bp, Glycine max
  Peptide Sequence Number=SeqID_168567
atgacgaagaagaaagtgataaggcaaagggtgcaggatctgtgcagcttcttgagaggttcactgtcacattcaaagcaaattgttgaaactaccaattactttagcataactgttagctttggtaataattgtacttatttacttcacttacaattacaagttcagtttgatttaaccatctctggtgataaaggagttcatgtagatcaaccatcttcaagttcttcttgtcttgggttcactactttgtaa

SEQ ID NO: 51790 - DNA, 279 bp, Glycine max
  Peptide Sequence Number=SeqID_168568
atgggtgtgaatgtcgacctgacccgaccacagcaagtttgggtccacgcactccttgttgttcatcgtgaacaccatcaccctctccttactgcaacacgtgctaatgatctcgtccacgaagctctagattctcgacgcggatccgaaggagaaagggaggtcgaggtcagcaccaagggcagagtcaatggcgtgattgacggtggtggtgttgggttggacgacactggtggcatgggattattttctttggaaaagggaaagaaggagaattga

SEQ ID NO: 51791 - DNA, 255 bp, Glycine max
  Peptide Sequence Number=SeqID_168569
atggtggtaatcaatttgttgtcactctcatatgcagaagtaacaaattcgggaagtcttactttagaaatagtccagcaggtaggggagattgatcattatgatctcctcctgagcatggatgaacagatatcaagatcaaaagaagaggcttctagcaggaaggctatcatggagaaagtggagaagtggaagttagcatgtgatgaggagcgctggctagaagaatatagcagggttagaattttcatttga

SEQ ID NO: 51792 - DNA, 231 bp, Glycine max
  Peptide Sequence Number=SeqID_168570
atgtgtccaaacattatgaagatcttcaagagaggaaaaaccgaattcatgattattcttgctaacattgatacctttcagagggtttgtgtgaaagattgttgttgcacaagaatgggagaggaagggggaaggggaggctccattagggtagcaaggaagccctatggacagattacaagatattccatggcagccaacaacaagagaggtttatcaaggaaaccctag

SEQ ID NO: 51793 - DNA, 231 bp, Glycine max
  Peptide Sequence Number=SeqID_168571
atggaggcccggaactggaagaagctccgggtgtgtgggaatggaggtttggatcatgggcatggcatggaacaaaggttaaaagggtgtgaaggtgaagatgagtgtgatagaaagaaagagagagacacaaagagaccatgcatgcgtaccctctgccctcttgtaggacaattaaagacgacaaaggtgcagtttttttttacacagtcaattaatcattttagataa

SEQ ID NO: 51794 - DNA, 138 bp, Glycine max
  Peptide Sequence Number=SeqID_168572
atgaggcacaaatggacaaggcctagtggtaagtgtggtagcattgttgggtttcccaaagctctttctacctctggtggtgaggaaatgaagcgaaggaagatggcaattcgtgctttccagctcagaaaatgttga

SEQ ID NO: 51795 - DNA, 1098 bp, Glycine max
  Peptide Sequence Number=SeqID_168573
atgcctcctttccccaaaaccttctacgctcgccctccacctcgcagaacctccttcctcgtcttctcatgcctcttcctctccctctccctcttcgttttcttcttcgcttttctcagacccctccgggaccctccctgccccaaccgcgtccccagatcggttaaagttctctgggatcaccgcctctccggcgacagcaacaacgctccggtcgaaacccgacacaaagttatggcctttgtgggaattcaaaccgggttcagatccgtggggaggcgccaatctctcaggaacacttggtttccttccgatcctcatggacttcaaggcttggaagaagccactgggttggcttttaggtttgtgattggtaaaacgagtgatagatcgaagatgtctgcacttcagaaggaagtggcacaatacgatgatttcattttactggatattgaagaggagtacagtaagctcccatacaaaacgctggctttcttcaaagctgcttatgccctttttgaagctgagttttatgtgaaagctgatgatgacatatatttaaggccagatcgtctttcattactactggcaaaagagagatctcaccctcagacttacataggatgcatgaaaaagggtcctgttttcactgatcccaaactcaaatggtatgagccactatctaatttgctcggaaaggaatattttcttcatgcttatggtcctatatacgctctttctgccgatgttgtatcaagcttggtagcacttaagaataacaggcaaatatgtccatgtcatttggcccttgagttcatagtttacacttgtaaaagagggcagagattttcatgccatacagtcctgagtttccggatgttcagcaatgaggatgttacaattggagcttggatgcttgcaatgaatgtcaaccatgaaaataatcttgaactttgtgctcgagagtgcacatccacgtcaattgctgtgtgggacattccaaagtgttcaggtctctgtaatccagaaaagagaatgttggaactgcatcaaaaggaaagttgtactcagagtccaactgtggactctgatgaatag

SEQ ID NO: 51796 - DNA, 573 bp, Glycine max
  Peptide Sequence Number=SeqID_168574
atgccgatctccccctgtggaagtatcagttggtctgtgtcgtcccgacatagggtcacgcccacaagacacccagtggacccggagaagtccaacagggccttggggtttccagctctggttacgggcctctatcagtcctacagggttcccgtaccccccggcaaggtcatgccatcgcgacatagggatcacgcccgcaagacacccagtggacccagagaagtccaacagggtcttagggtttccagctctgattacgggcctctgtcagttctacagctcgtcgcccccaacaaggccatcaggcccctattaacagggctttcatcgagaagtactgcgcccccaggtaggcgcagggcaaggcatcacggcagcgggcaacagacgcaccgccaccacctctggagttcacctcagctcatccacaaaaaggttagagcgttgcctgcgacacatggccgaccaataggcgaccaagtccaaagccaaaggcgtccagctcaagacgttaaagaagcgctactaggagacaacctagtaccttttaaatctctgcttgttatttga

SEQ ID NO: 51797 - DNA, 201 bp, Glycine max
  Peptide Sequence Number=SeqID_168575
atggatgcaaaggatatgtcattcattcacaagtgtagcacaggcatgcctgctggcaatccctgcggggtgctcaactctagcactggtgtacatactggtgattcctatggattggccttcgcaatcactggatctacctctggatcagtttatggtacaaatgactctgggggagtgacctctaaatcattctcctga

SEQ ID NO: 51798 - DNA, 709 bp, Glycine max
  Peptide Sequence Number=SeqID_168576
ggaagaacacactttacgacacccttaccgaacgcatgctagagctggagtaatggttgaagtaaatgaggtgcaagagcggatgaaggccgacatggaggccatgaaagaacagatggtcacaatgatggaggccatgatgagcatgaagaagataatggaggtcaatgcggctagacggttacacgtcctcgccttcagagggttgcacgccctcaacttcagaggacttcatgcccttacctttaaaggactgcacatcctcaccttcagagggctacatgcccttgccttcagagggctacatgcccttgccttcagaggactacacgtcctcgccttcagaggactacacgtcctagccttcagaggacaaaacgtcattaccttcagagggctacacatcctcaccttcagaggactacacgtcctcgccttcagaggacatcatgtcctcacctttagaggactacatgtcctcgcctttagaggactacatgtcctcgccttcagaggactgcacgtcctcgactacagagggcttcacgccctcgcctttagaaggttccacgccctcgacttcaaaggactacacgtcctcgcctttagaggactgcacgtcctcgcctatagaggactgcacaccctctccttcagagggctgcacgccctcgccttcagagggatatgtagaaacaaagcttcatga

SEQ ID NO: 51799 - DNA, 288 bp, Glycine max
  Peptide Sequence Number=SeqID_168577
atggggacaaaggaaacttccttctctgggatgcaacatgtatcaagctgtttggctggggatgatattatggtatttccaacgtgtattgatgaaatcctgttgaaaacttgggctgtcagatttaagtttcgttcacaattacgccaatcatctgtgttggatgtgagtgaagaactccatcatattcaatcattgatagccacccttgggttgaaggaacaatcaagtaagggaaaaggaatagctgttgagccagaaagttcaccaccaatttttgttcccacg

SEQ ID NO: 51800 - DNA, 249 bp, Glycine max
  Peptide Sequence Number=SeqID_168578
atgtgtccaccaccacctttcaacggctctgggagacctaactgggataaagaagcacttcagcagaaagcacgaaaattcgtttcctcccaaactagcatctctcacaatggagatgatgataccattccaacttcagcaagagtcaaatcttttcaagctgatgaagatccttcctttgtggagcttttgtttcaatatggtcaatatcttctaatctcttgtctgcaacttaggtggcaaacctaa

SEQ ID NO: 51801 - DNA, 963 bp, Glycine max
  Peptide Sequence Number=SeqID_168579
atgtcggtgctagcgatcccaatcccaatcctcgtcgccaccgtcaacgcggacgcgatcgttagtggcggcgttcccgagggactttcaataggaatcgactcgattggcgacctcagagaactggtgcagcacggagtaccagccgctgtgtttggcgccgacactgcggtcgtcggaggaggcagatgcaaggcagcggcagggggattgcaatgggaacaggaggagcgagggcgtccgttgcacggggaacggaacgacaagcttctgtgtcgggaaggtgagcgttggtgcagaaatggaagaagaagccatgagagagagaatgaaagaatggatatgcgtgttgttgaagaagaaggagattgggaacatactgtgagctatgaagcaaatggttgggttgcacatcatgtttctgacatatggggtaaaacatcaccaggtcaaggtcaggctatatggccaatgggtggagcttggctttgtacccatttatgggagcattatacgtatacattggacaagggttgtggtggattattggaaactaacccatcaacttcaccggagcacatgttcactgtgctagatagaaaaactgctagtgtgagctactcatcaaccatggacatttcaatcataaaagaagttttctctatgatcatttttgctattgaggcacgagggtcatctgtgagtgactttagccaccagcctcatttaattgacagcgcatacgacgatggtggttgtgccaaaacgttgtcgtttgacacaaggaagttgtctctgttgtctcttcttctcgcaccgggttttgattgcgatagagaagatgagtatgacgaagagaatggcatccagagaatgccttccaaacttattcttcaagtgacacccatcaagtcctattatgggtctgcaagcatgcttaaaggccaatttaatggcttctag

SEQ ID NO: 51802 - DNA, 372 bp, Glycine max
  Peptide Sequence Number=SeqID_168580
atggccaaaccctcaacacaattggtagcttttcctttcagcaatgagtatcggttcgatacagaacaaggaacaacgtgcaaagaagtatacattagaagtaatcaaatggaagaaatgcaagagaacataccttcaagtaacactcacaaaaggaaaagcttaagtgcccttgagaccgcgaaaacggaggagagggtgcgcggggtaagaagtaaagtaagagttcttcctcagctagctagggtgtttgacagttttcccaaggtgtgggaacctaagacaacattcatccaagaagctagagacttaaagaatctttcctgggatgaattgttggaaattctcaaagtccatgaagttcatctttag

SEQ ID NO: 51803 - DNA, 102 bp, Glycine max
  Peptide Sequence Number=SeqID_168581
atgagaggaagtgctagaagatcgactatggcaccgatggcggttcgtgctgttctggagagagctacaggaggagttgagaaggctttacttggcgtttga

SEQ ID NO: 51804 - DNA, 417 bp, Glycine max
  Peptide Sequence Number=SeqID_168582
atggcccagagtaagacccacaccaacggaaattcgtcgttctttgctttatctttcagcaccttttccgtggatggcaggggtttggaaattatgatcttggagtgcctaaaaattggatatgaacctgacacgagttttgttctccatgaagtagaggagtatcacaagaaaaattttctattccatcacagtgctaaactggcagcaacttatgggatgctgatgaccaagcctggaaaacccattcggattattggaactccaatctacattccttccagagagttcattgatattggtcgcgttgcctccattgagaataaccatctacctgttgattatgcaaggaaggggcagaaagtagccattaagattgaagaggctaaggttgctggccttctaggatcggcatga

SEQ ID NO: 51805 - DNA, 531 bp, Glycine max
  Peptide Sequence Number=SeqID_168583
atgttggaacctacagaacttaagtcgtatccaaatttcagtgattccaaacacaatctcttgtgctctgaacttaagcagttatatgtggctataactcgtacaagacaaagattatggatatgtgagaatacagaggagtactctagacctatgtttgattattggagaaagaaaggtcttgtgcaatttaaagaactggatgattcacttgctcaagcaatgaaagttgcaagtagtcttgaagaatggaggtcgcgtggcaaaaagctatactatcaaaataactatgagatggcaacaatgtgttttgaaagagcaggagactcttactgggagagaaagtctaaggtttctggtcttagggcaaatgcaaactgtttgcgtgatttgaatcctgaggattcaaatgcaatgcttagggaagctgctgaaatttttgaaggcataggaatggtagaatctgctgcccagtgtttttctgatttaggggattataaaagagctggttgcagatcagaacctgcttaa

SEQ ID NO: 51806 - DNA, 534 bp, Glycine max
  Peptide Sequence Number=SeqID_168584
atgatacatacaacagcaaggagtgagactcaattgagcgtaaaccacttcaacgatttcgtagtgcaaatggaacgaaggaggaggaagggttttacagggaaacgtggtagaccagcacagctggtcgcgcctggcaggccatcacttcctaaccctgtcccacctcccctgccacctagtcacgtcatgccacgtgtcgctattacagggaacgcgcccagcgaagaagcgcattgtagtaaaaaaatagatccccgaagtatgtgcttgagagataaccatggtaattttatcaaagatgagacctgtactgctagtggaatcccttctccatctgaggcagaagtttgggcccttcattcggctattgtatggataaaaggccttggtttttcaaatgtaattattgaaactgattgcaaagtttcttccgattgtttctacagcggcatcaaagtttcatcagattttcatgtcattttgaataaatataaagatgttctttctctgattccaaactttaaaggatga

SEQ ID NO: 51807 - DNA, 114 bp, Glycine max
  Peptide Sequence Number=SeqID_168585
atggagatggagatcctctccaaattaagaaatccatttattgtggagtataaagattcatgggtagaaaaggttattgtgaggctggagacatgtgaaccatattcttcatag

SEQ ID NO: 51808 - DNA, 1983 bp, Glycine max
  Peptide Sequence Number=SeqID_168586
atggtgtggaaactaacaggcaaatatctagatgttataatatttcaaggtttgcagctagaaggagaagctacgaagctaaaggttgaaaaaggtattgtggccatattccttgatacaaagtatgagctacacaccacaagaagtccaatattccttggtcttgaaccagcaaaaagcactaacatgtggtcagagaagctagctagccatgatgttatagtaggagtgttagacactgggatttggccagagagtgaaagcttcaaagatgtaggcatgagaccagtacctgcttattgggaaggtgcatgtgagattggaacaagcttcacaaaaagtcactgcaataaaaaggttgtgggggtaagagtgttctaccatggatatgaagcagtagttggtagaattaatgagcaaaaagagtataagtcaccaagagatcaagataggcatggcactcatgcagtagctacggttggaggctctcctatgcatggggctaaccttctaggttatgctaatggcataaccagaggaatggcaccgggtgaaaggattgcagcctacaaagtgtgttgggttggtggctacttcaactcagatattgtgtcagctattgataaagttgtggctgatggagtgaatgttctttacacctctttgggtggtggagtctcctcttattacagagatagtttatcaatgattgcatttgaagcaatggagaggtgtgtttttgtttcatgttctgctggaaatgcaggacctgaccctgccagcctcaccaatgtgtcaccatggatcaccatagttggaggaaacacaatggatagggattttctagtggatgttaggcttgggaatggcaaaaaaatgattggagtttcactctataaatggaaaaatgtgctatcaattgagaaacaatacccttgggtgtacatggtgagcaattctagtagggttgatccaagatctatatgcttggaagggaccttggatcctaaagtgctgtcaggaaagatagtaatttgtgatagaagccttagtcctagagtgcaaaagggtgatgtggtgagaagtttaggaggggtgggaatgattctcacaaacacggaagccaatggagaagaattggttgcagattctcacctccttctagtagttgaaataggagagaaagaaggaaaaaagctcaaaagttatctcctatcaagtaaaagttctactgcaactctagcttttaaaggcacaaggttgggaatcaaaccatctcctgtagtagcagcattttcatcaagaaggcctaattttctcacccttgaaattctaaagcctaacttagtggctcctgcggtgaacattcttgttgcttggagtgaggccattcgtccatcaagcttgaaaataaacaacagaaaagtgaagttcaatatagtctctggcacctcaatgtcatgccctcatgtgagtggcatagcaactttggtcaagtctaggcaccctgagtggagtcctactactgtaaaacctgctttgatgacaacaacttatgttcttgataacaccaagaaaactctcagagatgcctcaattgctaaaccattcagtccttatgatcatggtctaagacacattgaccctattagagctcttgaccctagtttgccacatcatcagtgtttacctaaaaacacccatttcattcctagtcctgtgattgttcacaaaactatcaccaatgttggccctcctgattccaaataccatgttatggtctcaccattcaaaggtgcttctatgaaagttgagccaaaaaccttgaattttatcgaaaaacaccagaagttgtcttgtaagattaccttcaagccaaagattcaacaaacctctcctgaattcggtagtatggaatggaaggatggcttgcacactatgagaagccctattgtgataacatggatgccaccaccaatgtga

SEQ ID NO: 51809 - DNA, 477 bp, Glycine max
  Peptide Sequence Number=SeqID_168587
ggtggtggtggtggtggtggtggaggaggaggaggaggaggaggagggtttgtgtttaacgctccttcgactttgccggggccggcgacggtggcgtcgccgacggtggtgtttggtcatggttatggtcaaggccagtatttttctcagaggggaccccttcagtccagtaacagcccttccgttcgtgcgtggattgacgcgccatcgttcgtcgctgctgccgccgatcatcggcatcatcactatctgtctcccgcggcagcggcagcggcgttggtgtatcagtctgctcctcccacggcggcatttacggcggcgcccggtggcttctcgggattccgcgtgccggcacgaattcagggtgaggaggagcacgacggcggcatggatggaggagacgaagttggacttggaatggttcggttcggttcagtggactattatgcttgtggaatgaagaaaatctggggttga

SEQ ID NO: 51810 - DNA, 834 bp, Glycine max
  Peptide Sequence Number=SeqID_168588
atggcatctgcaaaaacgattgtaatcaccggcgtcagcagtggctttggccaggcgctggcgcgggaagccctcgccgtagggcatcgggttgtaggaacggtgcgcaacagcgaagcactgcaggctttcgccgcgctcgatacgcagcacgcttttggctatctgcttgatgtcacggacgatgaacgtattgatgaggtggttggagagatagagtccgccgtcggcccgatagatgtgctggtgaacaatgccggttacggccatgaaggcattctggaagaatccccgcttgcagagctgcgccgccagtttgacgtcaatgtgtttggcgcggtggcgatgatcaaagccgtgctaccgggcatgcgccagcgccgtcgcggccacattatcaatgtcacctcaatgggcagtttcattaccttgcccggtatcagctattactgcggcagcaaatttgcactggaagggatatcagaaactttaagtaaagagcttgccccgttcaacctacacgtgaccgccgtggcgccgggctcgtttcggacggactgggccgggcgttcaatggtacgcagccctcgctgtctccctgactatgacgcgttatttgaacctgttcgtcaggcgcgtcaggaaaaaagcggtaagcaactcggcgatcccgtgaaggcggctcacgccatgctggcattgatcgagagccggaatccacccacgcatctgttgttaggcagtgacgcattaagtttggtgcggcaaaagctcgaggcgttaggcaaggaaattgaacagtgggagaaacttacccgttcaacggatggctga

SEQ ID NO: 51811 - DNA, 1566 bp, Glycine max
  Peptide Sequence Number=SeqID_168589
atgaaagaacggccgattcttttttccgaacagcgggtgcgcgccctgctggttggccagcaaactcagacccggcgcattatgaaaactcaggcgtttggcccgggacaggatcatcatgaaggcgtgcacgcgtttgatgtcagcgctaatcatctgcatggctataagctgatgtcgatggcggacattggcgcccagtgcccgtttggccaggtcggcgatcgcctgtgggtacgtgaaacctggcggggtccgattgtgcctgaggcgcagctggcggaatacgagcgcgatccgctgccgttccgcaatccggcattttgccagtatcgcgccgacagccatgaacttggacaacaggaagaaaatcagcaggtcgccgagcagtttggctggcagaccgccatccatatgccgcgctgggccagccgcatcgatctggaaatcacggcggtacgcgcggagaaaattcaggacatcagcgaagacgacatcatggcggaaggcgtgcagaccgattcgcacttcctcaataatttcttcacgatgaacatgaattccgaatcgccgaaagaagcttaccgcaaggcgtggcagaagcacgtgtggagcgtgaaggctaagcgtttgccctcttccgcacagaagagggcgtcatcttttgcgcgattcagtgaatcaccagcccttgccccctcgccggcggcacagcgcgcccctttcccaccttgccagtttgcaatccctgtcacagacaaatccgccgctaacagagtgagtgacgcaatgatcaaatggccgtggcgtgcacaaaaagatgctgccgtgactgccctgccctggcaacaggcgctggggcagccgatcttttctctgctgaacagcgacgagcagcaggcgctggtggcgctggcgcaacgcttcctgctgcagaaaaaaatcactccgctgcaggggctggaacttagcgaactgcgcctggctcgcctgtcgttgctgttttgcctgccgatattgaagctgggtctggaatggctcgacggcttccacgaagtgctgatctacccggagccgttcagcgttgacgatcgctgggaggacgacagcggcctggtgcaccacgcgccggccgtgcatgccggccagagctggacgcagggaccggtggtgctgaacgcgctggacatccaggactcgtacgatctctctggttacaacctggtgatccacgaagtggcgcacaagctcgacgcgcgcggcagcggttacaccagcggcatcccggccatcgcgctgcgcgatgtggccagctgggagaaagatttactgcaggcgatggccgagattgaagcggaagtggatctggtgggtgaacaggccgcgaccctcgatccttatgccgccagcgatccggcggaatgttttgccgtgctgtcggagtactttttcagcgcccccgacctgctcgccagccgttttccggctatgtatcgccacctgcagcagttttaccatcaggatccgctggcgcgtctggcgcagcaggcaccggaatctgcttaa

SEQ ID NO: 51812 - DNA, 285 bp, Glycine max
  Peptide Sequence Number=SeqID_168590
atgaagggcaccgtgcatgagcctcaagtgaacataggggccgatcaaaagtttcctacatctaatatccagtcgtgtggatttgggatgaccggccctctcgatgagtcgatctcttgctttctcataagggtggacccttgggtacttgtacctatcacctttagaggactacatgtcctcacaatcagagggctgcacgccctcacctccagaggactacatgtcctcgccttgagagggctacacgccctcaccgtgggtactagttaccctcaccgttga

SEQ ID NO: 51813 - DNA, 369 bp, Glycine max
  Peptide Sequence Number=SeqID_168591
atgggagaaccacaacaccctcaccagcaccatcaacaagcagcagcaacaccgtcgagagcggcgatgagaggcggcggcggcggcgagattgtggaggtgcaaggcggccacattgtccgctccaccggacggaaggaccgccacagcaaggtctgcactgccaaaggcccccgagaccgccgcgtgcgcctggcggcgcacaccgccatccagttctacgacgtccaggaccgccttggctacgaccgtcccagcaaggcggtcgactggctcatcaagaaagccaaggcagccatcgaccaactcgcggagctcccgccatggaaccccaccgccacgccaatgcaaccgccttcccaagaaatt

SEQ ID NO: 51814 - DNA, 214 bp, Glycine max
  Peptide Sequence Number=SeqID_168592
tgaaagaagagtgaaaaagaggaagattgggctttacgggacgtgtcttggtgaagatttgagtaagatacgaaggtttgaagatttagggatggaggaggcacgaggagaggccttggctgcgcagcaactctggtttcgtgggagtaataagccttctggtaatcgattacaggatgttgtaatcgattacaggctgcctgttcttgtgtaa

SEQ ID NO: 51815 - DNA, 390 bp, Glycine max
  Peptide Sequence Number=SeqID_168593
atggtgattcgactatggttttatcaaaaccgttgtcgttttgaagctaaggcatcacatccatctattaatttcgaaagagaaaaagaaattgagagaaaaattggggaagcgaaaaagagcgaaagtcaaagaaggaacggttcatggtggccaagtcaaatacttggccttgatcacctttctacttctcatctttcttctcctcgtttaggaactcccgttaagcttctcaaaaaggaagattccaacaaggcggagtccacccagggtatgctattaaacaaaaaagagaaatatacaactagagaagatgccattcttcatgctcttcaactcgagaggcaaatgttaaagaagcaagaaaaaataggtgatgcttctgactag

SEQ ID NO: 51816 - DNA, 999 bp, Glycine max
  Peptide Sequence Number=SeqID_168594
atggcggttatggaggcgccctacgagcctgcgaccttaagggatccatacagtgacccatttggtccgacaaccctttctgtccgacttccctctgctccagccatccttagctccgacggccctctgtgctggataatgtttgggacagggacaagcactgcttcctcaaatactactatcggtcactttttgaatccggagtttttctatgacaacccttcgatggaatttgatggtgagcttataaggggattgtatgaggtcatcaatttagagggagatcaagagatggagaagatcatcatgggggagttgttattttataaaatgggggctgctcaatggtggcaaatgtatggttcagatactctccatttacaacaaatagctacaaggatcttaaacttgacttgtagtgcttccggttgtgaatgcaattggagtgtctttgagaaaattcatagtaagagaaggaataggcttgagcataaaagattgcatgacttagtctatgtcaagtataatcaagcaccccaccgaagatacaaccttagggataaaattgatccaattagtctcaatgaaattgatgaatgtgatgaatggctgcttggagagatggatggggatggggatggtgaagatagggtttttgaggaggaagatgatgaccttaattggagacatgtctataatgctttggatcttggcaagcctatatatagtaggcgtaaaaggaagcaacgtacaagaggagcggggcaagagggaacatctcaaagatcttctaaaagatgcaaagggggagcttcttcaactaggaagggaaaaatggttcaagttgaggaagcattggaagataattctagtgaggaggaggaattagaggcagatttgtcagaagaagaagctgcaggatttgcaccattagagaatgtggagattgattatgttggcttagaggagggggatgaagatgagaatgatgattattag

SEQ ID NO: 51817 - DNA, 300 bp, Glycine max
  Peptide Sequence Number=SeqID_168595
atgaagagaaaaattggggaagcgaaaaagagcgaaagtgaaagaatgaacggttcattgtggccaagtcaaatacttggccttgatcacctttctacttctaatcttacttctcctcgttcaggaactcccgttaagcttctcagaaaggaagattccaacaaggcggagtccacccagggtatgctgttaaagaaaaaagagaaatatacacatagagaagatgccattcttcatgctcttcaactcgagaggcaaatgttaaagaagcaagaaaaaataggtgatgcttttgtctag

SEQ ID NO: 51818 - DNA, 663 bp, Glycine max
  Peptide Sequence Number=SeqID_168596
atgcaaaccgccagctccattggcgcatttgctgtggctgtgacacgtggcgaatacgccattgccactagcgggtttcatggtgtcgccagcctcattggcgatttcgccatgcaagggggagtagtcagtcaaactggtgagttccaagcacagggcgcaggcttctcagccttttcaggcttttcagttggcaggcattttcagttggcaggggcaggggtacagtctaaagggaagtacatcatgagttcggttataacagtgttgtatttcgatggaaggagcaatttacatggtgatgaagatgatgatgatgatgatgattatcttgtgtctaactcatacgttgaagagtctttagaaaaagatgataatattgacggtatatctaatacagacgatgacgatgaagtcaccgacatgattcaaccagtaagaattgttcacccagtagaaggtgtacaaggaattcaaaatccattttggaatgatgctttgcattataacaatatcaactggagtcatcctgatgaagaggacatttgtggtttggagatgccatcgagttttaatgttggccaaaaattatatgttggcatggattttgatagtaatgatgcggtcaaaaatgtagtcaaacaatatgttatgaaggcatga

SEQ ID NO: 51819 - DNA, 231 bp, Glycine max
  Peptide Sequence Number=SeqID_168597
atggaggttgaattgagaagaacgaaggaagagaatgaggaaattgaggtgatacagtacctagaaatgggaatgggaattcggagcgttgaaaagtggagcattgaagggattttgtgtgggagaagaagaaagggatttcgtgattacccaattctgtgtcccatgcacagtgacagaggaaaaggatgcaagtgcaacttagaattcagatttgcattctttctctag

SEQ ID NO: 51820 - DNA, 555 bp, Glycine max
  Peptide Sequence Number=SeqID_168598
atggtggaagagaaaaaagtgataagtaactgtatgaatatggttggtatgaaaaggcaaacgccataccctttctccccggattttcctcatgtccctgctttcaattgtatatcgtccccctttgctgaagtaggaactaatgcaaaaactccgtgcggtaatggaagcggatttaactttggcaattcaacttccagagaagtatcatcatcctgtttagcttccaactctgagccaaagtcaaagaaaagaagagaagagaatgagaatttcaatggagattttctcacgttggctcctccctctcctacttcatatccaccttcaaagtccaaattgtctttaactttccaggcatttcacaaccaaggaaatgtagaagatcaaatccctgccgccccaccagtgttcaggctgttcaatcaacaaaagcaaccattttatggcttcttccttccagaaccaaaggaggaacaaattggagaaacagcagccaggattcagaatggtcatgaagtgggagaaagtgttgatcttaacttgaaactatga

SEQ ID NO: 51821 - DNA, 990 bp, Glycine max
  Peptide Sequence Number=SeqID_168599
atggtgcagattttccagccctggatacaaaggaggaaacttgaatttatcaaacacaagcatgttatcttaggacttttgacacatttgaagaagcgtgcattgggaaggcttctgaaagaaaatggtgaacctgacaaagaagtcattagaaaattgtttcaaaccattgacgaaaatcaagatgacaatcttactcataatgaattgagagcactggttattggaattcagtttgaggagattgacctggatcatgatgatgctgtaaaaagaatcatggacgactttgatacttctggtaatgaacgtgttgatcgagaagaatttgttaatggtgtcagtagatggcttcaaagggcccagcgtgctcgagttgcatctggtgatgctggtccacacacaatgaagtttttaagtgattttcacacggaaacaaagagggaacatgatctgctggatgtgggaggtcaggttaatgaagaggctgagggcattgagaatgctaaatggatttccatcaaagcagttctgcttctgctattgggtactattattgctgctgcgtttgctgatcctctggttgatgcagtggataacttttctgaggctacaagtattcctgctttcttcatttccttcatttttctgcccttagcaaccaattcaagtgaagcagtgtcagctataatttttgctagtcgtgataagaggcaaactgcctcattaactttctctgagctatatggagcagtgacaatgaataatgtgctttgcctatcagttttcttggcccttgtctatgcgaggggattgacatgggacttctcttcagaagtgttggtaattctcgtcgtttgcattgtcgttggcgtctttgccagcttccgcactgtcttccctctatggacagctattctggccatcctactctatcccttctctttggcattggtgtacgttcttgattatgtatttggttggtcgtag

SEQ ID NO: 51822 - DNA, 846 bp, Glycine max
  Peptide Sequence Number=SeqID_168600
atgcctcaagatgatcaaggaaattgtgatggaactagaggcattggggttcttggaagatcttctaagaagtcaaagctgaaaaaggtgccacagaggggacttggtgtggcacagcttgaaaagataagactagaagaacaacaaaagagagatgttgctgcaattttaccatctcctagtgctttatcatcaaccacaccatcccatctgcctctcccagttaagaattttcatgactccaacgtatccccttctacacctcttttaccttgtgagccaccgtctgaatttaggtcccctttgtctctgcaacaacaacaccaccaacaacaacacatggatgttaaagttccaagcactgttccattggcaaacagtggtgattttgaggctggctggcctgttgttcctggacatgggaatgttcccaagtggtggagctccttccagtttgattctgagaagaacaactttggagtggagctgggatcgccgattctgccgagtgtgccttttgaatccagccccatttggcctctgcctaatttggtgcagagaacaccacagtatcagcatcagcatcaaacttcttcaccaatggcaagtgtctcatcaggaactttatcaacatatatgcctcatttcacaatagagcccccttcaaaccaaaacaacaattgcagcagtgtgcctgtgaagtcaatggagaagttgaatgtggtatattctgttgtggttgctaatggatggtgtggcggtggtggcctcctgaaaggacacattaatgggggtggccgggaaaatgttgaatgtgcaccccaaatttggggtgaaatggtgtag

SEQ ID NO: 51823 - DNA, 171 bp, Glycine max
  Peptide Sequence Number=SeqID_168601
atgactatggaagagggcagggtcgagaacgaggactacacacaagatggaactgtcaacattaaagggaaacctattcttagatccaaaagtggtggttggaaagcttgctcctttgttgttgctgggcagcgaagtgatgttgtaccaacactttcagttcttccataa

SEQ ID NO: 51824 - DNA, 1413 bp, Glycine max
  Peptide Sequence Number=SeqID_168602
atgatgctgtctagagaggaatctgaaaggatgccactaacatctttgtgcgataagcttctttctaagttacttaaggcaggtccagatagtaaacttattataacaacaagagataggcatttgcttagaagaagagttggggacagacatgtctatgaggtcaaggcatggagctttgccgaatctctggagctttttagtttacatgccttcaaggaaagacatcctcaaaagggatacaaggttctctcaaaaagggcagtgaactgtgcaaagggagttccattagctttaaaagttctgggttctaatctttattccagaagtacagaattctgggatgatgaattgagcaaactcgagaactatccgaatgacagtattcaagatgtgttacaaggaagtgatttaattgaagggataaaactagatttatcatccattgaggatttacacttgaatactgacacactcaacatgatgactaatttaagagttcttagattatacgtcccttcaggtaagagatcaagaaatgtgcaccattctggtgtcttagtgaattgtctgggtgttgtaaatttagtgcgaattgacttacgtgaatgcaagcactggaagaatctcccagatttgtctaaggcatcaaaacttaattgggtgaatctttctggttgtgaaagtttgcgtgatattcatccatctattttttcttttgacacacttgaaactttgatgctggatggctgcaaaaagcttaagggtcttaaaagtgggaaacatttaacatctttgaggaagatcagtgtcaatggctgcactagtctcaaggaattctccttgtcatcggattcaatcagaagcttggatttaagcagcacaagaattggaatgatagactctagatttgagcgtctaacaagtcttgagtcactcaatgtacacggtttgagatatgagaattgtagggagcttgggagtctatcaaagcttccaccatttgttacagagtttaatgccgttaactgctggtcattgatttcagtgtcctctttaaactcttctgcattgaacttgaaagggaagggaaaattcatttcattcaagaattgtggttggctggatgaaccttctctccactgcattatgaaggatgaagccaacaccaaaaattgtaataataaatctgtgaaggtctgtttcccgggaagcaaagtcccgagccagttcaaatgtcaatcaacagactcctcaatcactgttaatcttccttcttaccttaatgaatatatgggattaactttgtgtgtggttctttcacgctcccgggttgctgctaaaatccggtgccagtgtacttggtttggagttgaaatcaccacatggtgcaaccttaatgaagctgaataa

SEQ ID NO: 51825 - DNA, 1102 bp, Glycine max
  Peptide Sequence Number=SeqID_168603
gatcttcaccaagaatgggactccaaatgtgagtgccataagggaaatagatcaagatgggagcagtggtatatcagcttctgaagtgaaagaccttctgctaaaaaacaaagtaactgaaacaaattttgatgaggagaaagaaataaaagaggtgttaaaagtttttgacctggatggtgacaagaaaataaacaaggaggaatttgtcagtggcttcacaaaatggcttgatcaaacaaagcatgctttaaagaaacagtatttttcaaggaaatcactcaaagacatttatcaggcttttggaccatggattgaaaacaaaagaaaagaacgtgaaggaaagaaacagcttatatttgaaatcttaaggcatgttcagagtgatgtggttggtagccttctcacagaagatggcaaacctgatcaacatgctatcagagggctgtttgagaaaattgatcgcaatagagataacttcatttcccagtctgagttgaaagaactaatcatgaatatcaaatttgttaaagcatcaatggaagtggaagaagcagttgctttagtcattgaagaacttgacattgacaaagaccgcacaattaatgagaaggaatttgttgctgggtttgagaaatggcttagctcaacttcagctcctgctcctgtgtcagattctgagtctcaagaagatatgtttcagacctgggaagaggctgacatcgtagtggaagagaggcaaaacaatgcagtagttgataaatcaatatgggcatggattaaggccataacatatgttatgctaggaattgctatgctatcaattttggcagagccactgacagaaagtgtccacaacttctctaacagtgcaggattccatccattcttcatgtcatttattctagctcccttggccacaaatgctagagaagcaacttcagcaatcaaagaagccagccataagaagcctagaactacctctcttgccatttctgagatttatggaggggtgttcatgaataacattctcggtttctttgcaatctcggttctgatctttgtgcgagaagtcacttggcaattctcagctgaattgctg

SEQ ID NO: 51826 - DNA, 486 bp, Glycine max
  Peptide Sequence Number=SeqID_168604
atgctggaaataactaggcaaggaaaggaaaattctgacagaatcgaaaggctggaagtaaatcaacaagggagaaaaattgcagaatgtaaaggagcagcacatatccttctgctcgagaaagcccgagcggctcaacgtgaagtcgagcgtctcaccaaagaggcgaaagaaggatcttctgagatcaaagcctgtgatgataatatctcctcctgggaggcaactattacaaatttgctgtctcaggtcgatgatctaaggcagaaaattgtaacagagcaggctaaacgcaaagaactccaggagaaggccgctgattcgattcagaagctggttgccgaaaaagggagggaaggcctgaaggcctttagtgcatctcaagcggtagcagatgaggcgagagctatggagagtgctgaccaggttttaagcaaagagatggccaccttgaagaagctatatgaggatttgatcatgacttag

SEQ ID NO: 51827 - DNA, 261 bp, Glycine max
  Peptide Sequence Number=SeqID_168605
atgataagaattcaaccagtgacagcttcatatgataccacgcggtcaaaggttcggagcgtattacagagcaagagtctggccaggacctgctcgaatcgaaaagagaggagagtctttaagaaggaattcccaggttcaaaggagtatttacgaagtacaaagctaagacaagaaagaggacttcgagttattgggcaattcgaactggtgtatggacgagtcgaagtcgaggcagcaagagttctggacttagcataa

SEQ ID NO: 51828 - DNA, 270 bp, Glycine max
  Peptide Sequence Number=SeqID_168606
atggaggtaataaggagggcaattactaaggtcacgcttctaagcccagaagagaattggaataaatttgggatttgcatgattgcaagtgagttagaagtgggagaatcatgctcaaattcttggctgccagcaatgacacagcttccccaaactacagtgagaagcaagatggatgatccagccaataagccaaccccgctgaaggcatattcttgtgctatctccctattgctgacaagtccagaaactgatgatgatcgaaattaa

SEQ ID NO: 51829 - DNA, 210 bp, Glycine max
  Peptide Sequence Number=SeqID_168607
atgtcccagtgcaaaggtaagaggtcatggcctgagctggttggagtgaaaggaacggtggcagaggctacaattgagagagagaattctttggtgaatgctatcgttgtgcctcaaggatcaggcgtcaccgctgatttccgctgtgatagggtttgggtttgggtcaatgaaaatggatttgttttccaggttccaacaattggataa

SEQ ID NO: 51830 - DNA, 525 bp, Glycine max
  Peptide Sequence Number=SeqID_168608
atgaattcagagaagtcagtgagtcttgatatttcaagtgaagaaaatgatcatcatgatcaagatgatgacactggtggaaccaaacggtcttatgagtgcacattctgcaaaagaggcttcacaaatgctcaggctttaggggggcatatgaatatccataggaaggacagggccaaggccaagcaattcacaattgatgcttcaccttcagttaacaaattcaacaacgatgattccacggcccttccttttgtctcagaaattatgaatcaacccacaaagcctaattactactcccttttggagtctcagatgaactttcaaccaccacatgccttttattatgagttttgtaactcaaggtctcagcctttgagtttgaaccaagggcttcatggtgccaatttgagtctccaaattggtccgagtcatgttgatgataacattcatcaattcaggagaggaaatcagaaaacgagtgaagtggacttggagctcagacttggccatgatccatactga

SEQ ID NO: 51831 - DNA, 400 bp, Glycine max
  Peptide Sequence Number=SeqID_168609
atgatcagaaacgtttccaaaactccatactttatctttctccttgtattagtaacagttgaggttcaaggtcgctatctgccagagcgtgccaccgaactagtttcagatggcgttcataataaccttcaacacaacgaaacttcttacttagttctcaaaggaattgatgatgaatcctttgaggaaccctgcaagcaaatgtacggcttcttgccatgcacaaacaatatttttggccatctctttcttattttggtgtatgaatatttgttgttccatggagaatcatatttggctaaagggggtgagcaaattttcaagattcttggtcctggtatctttggtgctagtgcttttcagatccttggtgcccttccagaatccttaattctacttg

SEQ ID NO: 51832 - DNA, 729 bp, Glycine max
  Peptide Sequence Number=SeqID_168610
atggaggaggaaacagagaggttctcctgctccaagcttctcattccaaaaggagaacccattttcgtgaaggccacttggtttcccacccactttcacctcgccgtcaccgacggcatcaccgcctggcactgccacctgaagcagcgtgctgctcagtgggacctcccagtttcagagtacctgaacttgtctgaacgctatttggggcttcaacaacctggctctgtctatgcatttgatgatgctggtgatagccataagaggttgtcatggacgtttgagaaggaaggaatgactctgctttggagatggaaatgcttgctgtctcctgattctaagaaaagtaatgtcgaaatattggactttctcatgggttcaaacataaatctaagtgacaaagttgtcacagaaaatgaattgtttgagaagatgaaagtggaagctgagaagtgcttaacccagagtgaaagaattgccaatgagaggctggaatttgaatctgaaatctatgcaaagtcaaaactgagagtgcttcgagataagctgtcaaagcaagagaattctgagaaatctcctgaagaggaagacacagacaaaactgagagttttgacgaagaaaatgattttgaaagaagtgatgaagatcctcaaaaggatattactagttcttcaaaggaagttatggcaaataagccttctcatccaaaaagaattagacacaaatga

SEQ ID NO: 51833 - DNA, 1185 bp, Glycine max
  Peptide Sequence Number=SeqID_168611
atgggagtagaagatacagatatttgtatcatcaaggagccagatcatgttgtagtctattcagatggcatttcccatgattcaggtcatgaagctggaagtgatcatcacaatattacagagtcttatgaacaaatcaatgagactactgaacatcatagttcagaggagagtgcaaaggaatatgaggtgaaggaatgtacaacagaaatttctgttaaggtctctgatgtctctaatgttaaaaaatgtgaggataagttaacctcagattctgagggtgtcctcagtgagaaaagttttaaatctcacaaaacaaggtgtaaacataagccacgagataccgggaagaatggatcaagacctcctgttacaggcagtgcccaaatcaggcccacagttccacaaccgttttccctagcaactgagaagcgtgcttcgatcgcaactcgtcctgcttttgaagaagacaacaagggcagtaacgagagaaaatctttgaacaaaaaaaatgtgctatctcccaatctgtttaaacagaatcagttgaaatctcctgtagtttcaagaatgccattgcaacctgataacaagaagcatcctgatgatgatgattcttgttcagttgcttcaatgtatcctcttaaaaatgttgcagtgaagagtgtcaaattctcatcttctgtgagatcaatcaagtccaggacaactgttgcttctgctcccgtgtttcggtctactcaacgtgcagaaaaacggaaggaggaaaagcagcaagcaatggaagctgagaagaatcaaagtgaagctaggaccaaggaagagatggaggaagctatcaagcagctaaggaagagtctaacttttaaagcaagccctatgccaagcttttaccatgaagggcctcctcctaaggttgaattgaagaagcttccagccacgcgagcaaaatctccaaagctgggtcggcgaaagagcaacaatggtgcagttaatttatctgaaggtgacaaggagaaaggagctggaatcaggagaaagcatcacacaccgaagaccaacaactatggtgataagagtgatgtaaatggcttatctgaccccaaaaacaagaccaagcatattgaaggaattaatgcaaccgaggtaactggacaagcaaacttggagattggcagccagtga

SEQ ID NO: 51834 - DNA, 981 bp, Glycine max
  Peptide Sequence Number=SeqID_168612
atggcgataggggcaatattggcagtaacaatgaaccaagaccgtgttaacaatgtcatagtaaaaatcactgtaactcactggcataaggagcgtcacgctcactcccttttctcgtgcccctcttctaattcttctctcaaaaggactgaacgaaaaaaccttaggagaaattcaaccgttctcgccattgccgaagctccaactcctcgcatttccaactcttcacccaaaaccctttttgttggaacagagtttcagagagagacccttcacaacatggcaaaaacgaggccaggcagaaaagacttggattcctacaccatcagaggcaccaacaagatcgtaagagctggggactgtgtgctgatgcgcccctctgatacgagcaagccaccgtacgtggcgcgcgtggagaagatcgaacaggatagtaggaacaacgtgaaggtgcgtgtgaggtggtattataggcctgaagagtctattggaggacgcaggcagttccatggagcaaaggaactgtttttgtctgaccattatgatgttcagagtgctcacacaattgaagggaagtgtattgtgcactctttcaagaattataccaagcttgagaatgtaggtgctgaggattactattgtaggtttgagtacaaagctgccactggggctttcacgcctgaccgtgttgctgtgtattgcaagtgcgagatgccttataacccagatgacctcatggtgcagtgtgaggggtgcaaggattggtaccatcctgcttgcgtgggcatgactattgaagaagcaaagaaattggaacattttgtttgttcagaatgttcatctgatgatgacatgaagaaaccccatgctacattttctgtatcaccaggatctgatgtcaaggtgagactacctgcatccagtcacgaacaatttgagttgagatgcacttctacttatgttccttttcagtttccctga

SEQ ID NO: 51835 - DNA, 183 bp, Glycine max
  Peptide Sequence Number=SeqID_168613
atggagcatcttgcgtgcatgtatgatcataaaagtatgtatgaaatggccccaaaaaagctttccatgaagaggtctagaagagacgccgcagcggaagggtacagtgccacccccgagattgatagtcaccgtttccaaagcgccgagcaccagcagcgcttcgaggccatcaaaggatag

SEQ ID NO: 51836 - DNA, 372 bp, Glycine max
  Peptide Sequence Number=SeqID_168614
atgcagctacaagatggttctgttggtaaagtcattaataacctctcacaagttctggcaagggtggtgggagaccagagcatctttccccacctacacaaaaaagatcactctgcccatgttattgagaagttctctcactatgttggtaggcaaatgggattcttagagagcgaggttccagcagagctgtgtagattggcagatgagtatttgataaaacccaaggagtgtgtagaaagcatccttgaatatcttgctcatcagaaggatcctaccactttatgccagaaattgattgatgagtttgaccgatgcatcctcagttatttcgcatttaattggaaccaagcttcttatatgattagtcag

SEQ ID NO: 51837 - DNA, 312 bp, Glycine max
  Peptide Sequence Number=SeqID_168615
atggcaaataataaagtatgggatcttgttgagttgcctaatggaataaagcctattggatgtaaatgggttttcaaaaccaagaaggattcattaggtcacattgagagacacaaggcccgatttgttgccaaaggattcactcaaagggaaggagttgaatacagagaaaccttttctcttgtatccatgaaacattccttgtgcatcataatggcattagttgctcattttgacttggaattacatcaaatggatgtgaaaacggcttttctaaatggtgacttagaagaagaaatttatatgacataa

SEQ ID NO: 51838 - DNA, 324 bp, Glycine max
  Peptide Sequence Number=SeqID_168616
atgattttcaaacggtacctagagaaattcatgacaataggaaaaaagaaaaaagcacgaagttttggtgatttgcattgtgatgaagtgctttgtggtgagaggctatgtgatgaagcgcaaagaaggagcagaaggaatccatttacgaagggtagaagaaagcttcacttttggccatggaggaacaagagagagaaagcttcacccactgggttgagtttggaagggaagagagagagagagagaacaaaaataacagctgcttctgacttgggcctagctacaaagcccacttcaaaactgtgcttgcatccgttttaa

SEQ ID NO: 51839 - DNA, 183 bp, Glycine max
  Peptide Sequence Number=SeqID_168617
atggtaatgatactaatagtggtagcagtgttggtgttagcaaccaatgatgatagtggtaaagatattgatggtgatgatggtaaatgtgatattagtggtgataattacaatggtgttagtgatagtgacattggcgatatcaatgatgatgacaatggtaatcaacacagtggctattaa

SEQ ID NO: 51840 - DNA, 258 bp, Glycine max
  Peptide Sequence Number=SeqID_168618
atggagagagtagtgttagagaactgcagtgactctgtgatgataacaacagatgcagcaaccatcacaaaccatgaaaaatcggttctagaaggaggagatgatgatgatgacctttcctttttggacacttacacggagcctgataactttggagccacaatgatttttacacgcaggaatattgcgagggtttcttctattgatcagaatattctaggctcttatagctactctttgtcttttgaaaatgcttag

SEQ ID NO: 51841 - DNA, 756 bp, Glycine max
  Peptide Sequence Number=SeqID_168619
atggtgaaaaacacttactctgataaaagtggacataggaaaggaacatggacaccagaggaagacaagaaattgattgcttatattaccagatatggtcactggaattggaacctactccccaagtttgctggtcttgagaggtgtggaaaaagttgcaggctaaggtggctgaattacttaaggcctaatatcaaaagagggaactacactcaagaagaagatgaaactattatcaagatggtccaacgtctcggtaacagatggtctctcattgctgctcagctgccaggaagaacagacaatgaaataaaaaactactggcacaccaatctcaagaagaaatatcatcaacagaatgttaatgctgaaactgaagtttccaagtcaaaagatcatcaatctccagatgaagcactaccaaagccaaacaatgtagatgatgttcctttccaaaaccttccacccacttctcaatccaccgattcatgcacgacgtcatcaataataatatccccaacccaattctctataaccaccacaggtcgtagctctgatgatagcaaagaaaagtttgatattccttatgaggatgagtttgcttttgcagatgttatgaacgaaagcttctggttggaaccatatgttgttgacatttcgtgctatcctagtgatgtattggtggctgaaccggattgctttagccctgtgcctgacgtagaactttggagtcatgatcatgaatactttgcgtga

SEQ ID NO: 51842 - DNA, 963 bp, Glycine max
  Peptide Sequence Number=SeqID_168620
atggcacaattacctcctaaaataccaaccataccccagaattggccatctttccctcaccaaagggtaccctcaatggccaacttcaaccccacaacctccactaccaccgccactacgactcccccgccgccttcatgggtcgacgagtttctcgacttctcgtcggcccggcggggggcccaccggcgatccgccagcgactccatcacattcctcgaggcgccttttctcgatgaatgtcgagccggattcgaccggctcgacgaggaccagctgatttccatgttctccgacgacattgctgcggcgtcgctgccgccgccgccgccgctgtcgtcggcgtccaacccctcctcgccggcctccgaccaaaacagcagcgaggagaagccgatggaaatggcgctggacgtgaagccgaaggcggaaacccttgaagaggaaagctcgtacaaggatgaggaggcggcgccgcaaccctccgccatcgccacctgcactgaaaccgttgttgatcccaagagggtcaaaagaattttggctaacaggcaatcagctcagaggtcaagggtaagaaagctgcaatacatttctgagcttgaaaggagcgtaacaactttgcagacggaggtatcagcattgtcacctcgagttgcattcctggaccatcaacgtttgattcttaatgtcgacaatagtgccttgaagcaacgcattgctgctttggcccaagacaagattttcaaagacgctcaccaagaagcattaaagaaggaaatagagagactaaggcaaatctatcaccaacagaacctacaaaagatgaacagcaatcttcaacaaaccacaccaacatcacagccacaacaacaaccaatgcaacttcatcatcatcagcagccgatagcagtgtctcaaccattgggatgcaaggacaacaaggagcagctcctcagttga

SEQ ID NO: 51843 - DNA, 1875 bp, Glycine max
  Peptide Sequence Number=SeqID_168621
atgggcagcatgcatatgtttgttcctctcctatgttttatgagcatgctaaaatttgcattaagaaatgtagcagctgatgatggcacgcatgtgatgggcacaaacacaataggagttattacagacaacaaatctcgcaacggtaaagaggagatagtggcaattaagatggcattggaggatttctatcaatatagcaatcaaaactttggtctagatcttcagataaggaactcacatggggatccccttcaggctgctcttgcagctagagatcttattgatacaaagcacgtggaagcaataataggaccccaaacatgggaagagacaactttggtggctgacatttgcagccaaaacatgacaccggttctatctctagctgatgcaactccaaactggtcaactttgaagtggccattccttgtgcaagcctcacctaatcactttaagcagatgaaagcagtagcagctattgttcattcctttggatggtacgatgttaacatagtttatgatgatagggattcttcatccacaagaatgttatctcatctctatagagctctaagcaaagcatgtgtgcaaataagcaatcttttgcccatcccattaatttcctcttcattgtcccaagaacttgagaagcttagagaaggtcattgcaaagtctttgttgttaatttgtccctttctttggccataaacctgtttgaaactgcaaaaaaattgaacatgatggagaaaggctatgtgtggatcatcactgatccttttacaagtcttgtccattccttgaaagcatccactatatcctccatgcaagggataattggagttaagagctacttcccagaaataggggttcaatatgaagatttctaccttagatttcgccgaaagtttagctcagagaaccctcaagaatttaacaatgagcctgggatatttgcagcacgtgcttatgatgctgcatggactcttgctctagccatgacccaaaccgacaataaaggtggtcaaattttgctagacaacattctgcttaacaactttactggcttaagtggaaaaattcagttcactgaccagaagttagatccttcgaatacttttcagatcaccaatgtgatagggaaaggttacaaggaagtgggattctggtcagatggactaggtttctcaaataatataggccaaaatgctactactttcaattcttcaatgaaagaactaggacaagttttatggccaggaagaccttggggaaatccaagaggatggaccccgccaacaagtgataaaccactaagaattggtgtccccgttttggccacattgaaacaatttataaatgtgattcaagaccaaactgaaaatactagcaccttccaaggattcactattgatctttttagatcaactatggagttgttgccctatcatttgccatacaaattctaccctttcaatgacacatatgataatttggtgaagcaagtctatttgaagaatttcgatgcagtaattgatgtgacaataatctcatatcgatatcagtacgcagaattcactcagccatacactgatccgggagtggtgatggtagtcccacttaaatcaaaattagcacatagaacttggttatttatgaaaccttatacaaagactatgtgggctctaatattggccatgattatctacaatggctttattctatggatgttggaaagacgccacaatcctgaaattagaggttccatgttgaatcaaactgggagcatggcttggttggcattgacccctctaatcaagttagatggtaatttgagacttcggtcctgtttagataagtttctccctaagtaa

SEQ ID NO: 51844 - DNA, 291 bp, Glycine max
  Peptide Sequence Number=SeqID_168622
atggaaggatccttgttggtcatgccttgtccaatgatcttaagccggtcaagtagcagaagagcactgcggcatcttgctgccgaacatcttggtgttaacatccaaacaggagagcactgtccagtagaagatgctcgtgctgccatgctgctttaccaaagaaatagaaaagaatgggagaagaacataaaagatcaatttcggttgaaacagaagcaaaggaaatcaaagcaaaaaaagaaacagaagaatgaagacgtttcaaatgccaaccatgttgaaatttga

SEQ ID NO: 51845 - DNA, 225 bp, Glycine max
  Peptide Sequence Number=SeqID_168623
atggcaaactctataaaggaagattggaaaggacaaaacgcattaaatgatgatggagaacactcaaaagaagtgagaaaggaaaaggtaggtatcttggctacttcaagtcattcagacttaggctttccatcaaagaaggaagctaatggcaaatacaaagacaagaggaacaaaaaagaagaaagaccaacattgggagaagacagaagaggaatggcgtag

SEQ ID NO: 51846 - DNA, 394 bp, Glycine max
  Peptide Sequence Number=SeqID_168624
atggtgagaaataaatttgatgttataagccaatctttctccactatactcaaaactagtacgtcaattggaaggaaagctaatataagggataggatgcagatggcaattggtggaaatatcatggaacacgaaatagaagatgaagggattgttaactgcaataagttgcttctggaatacatgaagaaattgctcattggagtcagaaccatagcgatgtacagcatgaggaacccatggatctgcatctctcttctcaccctctttttctctttgttcacccacaattcccttgcagctctcccaaccgtttcttcaaaccaaactctcactggggatcaaactctcctctctaaaggtggaatctttgaattgggtttcttcaagccag

SEQ ID NO: 51847 - DNA, 876 bp, Glycine max
  Peptide Sequence Number=SeqID_168625
atgcgtgctggctacgggcgttccattttcgagcggctgttgcctatcattttggggcgtgacgtcagcggcgaggttgcggcggtcggagataaggtgaggttggtgagtgtgggagagcaggttttcggggctctgcatcccactgccgtgagaggcacttacgcagattacgcgattctctccgaagaggaggttactccgaaaccagattcacttactcatgtggaagcaagtgccattccttttgctgcattgacagcttggcgtgctctaaaaagtactgctagaataagcgagggacaaaggatattggtagtaggaggtggaggagcagtagggttgtctgcagttcagtttgcagtagctgctggttgctctgttgtaactacttgtggaagtcaaagtgtagacagattgttagctgctggtgcagagcaggctgttgattatattgctgaggtggatgttgaattggctataaagggaaagtttgatgctgttttggacactattggtatgccagagacagaacggatgggcattaattttctaaaacggggtggacactacatgacacttcagggtgaggcagcatcattgtctgatagatatggactgattattgggcttccagcagctacagctgttttattgaaaaagcagcttctataccgattttctcatggaatagaatactcatggacatacatgagggatgacttagagggtttaactgagattcgaaaactatgtgaagctgggaagatgaagatacctgtgtataaaacgtttcccatagcacaagtaaaagaagctcacgaggcaaaagacaagaagctcattccaggtaaagtagtactggaaattgattga

SEQ ID NO: 51848 - DNA, 1101 bp, Glycine max
  Peptide Sequence Number=SeqID_168626
atgccatggccacccacgccactcaatgcaaccaagttgcatccccaactctgtgttcgattaactccagctgcagctgcccttgcttctgaggaatttaatcttcaatcttccgtttccaacatgttggcaaccaaactccaaaagcttcttatgctatcttcgcaccaccggttgcttctgtcgaaattggttcactttgcccctgatcttggtctccctccgaattttcgatcccggttgtgcaacgaccatccggacaggttcaagattgttgacacgtcctatggccgcacacttgagcttgcatcttgggatgtcaacttggcaaagcctttggtgcctcctgcatcatcatccaattctcttggtttcatagttgaccgtcctttgaagttcaagcaattgagccttcgaaaggggcttaatttgaagagacgtcaccaggatttcttgctgaaatttgaagaaatgccacaagtgtgcccctataggaatcctgctgagtctttgaccaaggagtcattggaggcagagaagagatcttgtgcactagtaagggaggttcttgcaatgacggttgagaagcggactttaatagaccacttgacccatttcagaaaggagtttggcctccctaacaagctgagagggatgattataaggcacccagaattattttatgtgagtttgaaaggggaacgggactcagttttcttggtggaggggtttggtgagaagggtgacttattggagaaggatggggctttattcatacaagatagatggatggatttggcaagggaatccaagagaatgagacgagagagaaggaagaataggattgacaaagatgttggcagcttgaatggtactgatcaaaatagttatgacagtgatgatgataatattgagatggacaattttaaagatggttatgatgatggttttgaggatatttttgaagagttggattttgaggctgaggatgatgatcatagaaacgggtttttttcccaaaacagcaatggagaattttggattgcaggaccttttcctattcaacatggtttggatgaagtgcagacgcaaccttggtag

SEQ ID NO: 51849 - DNA, 2319 bp, Glycine max
  Peptide Sequence Number=SeqID_168627
atggaaacagatagagagagaccccatcgcagcacaagcgagttgtttgtttgcttcacttcccgtttgtcctcttcatccatgaagctctcatccaagtccattctcagcccaagccgcagcagagaccctcctcagatttccctctcttcctccctcagcaggaggctcaagagcaatggcagcatcaagggtggtggaggtggtcaagcctctccaatgttcccaaccggtggtggtggcaagagaagaggctgtggctttgagaatcctgaaccttcttctcccaaagtcacttgcattggccaggtgagggtgaaaaccaagaagcaagggaagaagatgagggcaaggtccaagagacgaggtgaagctagcttcaggaagggtgaacaacaagttggtgttaattctaatgctaatattggtagtgcaaatctgaatccagatctcactagacagaacagccaagggtttcagcatcaccagaactgtttgaagcataggaataaccaaagatgggtgcatcttcctttgactatatgtgaggctttgagggagtttagttgtttttttccttgtaggtcttcttgcatgtcaactgaaaaggaggagaaaggtggtggagtggaaggaggaggacatgggatgatgatgagagagggttcatgtgggattaataataataataataacaataataataacaatgttggaaggtggttggtggctttgcaagatggggatgggaaggggagggggattgagcttgtgatggaggaggagatggaggtgagtgggagagagaggagtgtgaggagtcatagtcagaggaggcatgtgtttgaggacattgatgttgatttggtggtgggagaggagcaagagaagaagcatgaggagttggttggagaggaggaagagcaggctagagttagcatatgtattcctcccaagaatgctcttttgttgatgaggtgcagatctgatccggtcaaaatggctgctttggctaaccggttttgggaatctcctgttcacaaagacaaatgtcaagaagaacaacaagatgatgaagaagaaagtggagatgaggaggaagagcaagaggatgacaaagagcaacaccacaaaatgaaagatgaacaacaagaagaagcactagagcaagttgaaagagaagccatagaagatagcatttgtgagagagaaacagaaactgctgttgtagccactgaaaatgatgaagaagaacaagatgggaaagaaagctatgaaattgtaagcagagaaaatctagaaagccaagtatttactgaagtagtaaaagaggaagaaaaggttgatgaagaagaagcagcaaatggaggaaatgccattgaagaaggtgaaactttaactcacccagaagcttattcagatctagagaaccttaaaaccgaagaaaaagaggctaatctcgaagagggtaaagaagagagagaaaacaacgatagctcggaactttcttccaccccagaaaccttcgcagcttcagaaaaagaaaacgacggagcagaggcagaaacagaaccagtaacggtggaaacttcagaagggtcaacggaggaggaagaagagaaagtgatcgaaccgaaggaacaacctcagcaaccaggcccgacccgagaaccaaactcggatccggagtcaatggagcgagaaaacgggtcaaagcgcgaagagagagacagagaagcgttgccggagtgtttgttgctgatgatgtgcgagccgaagctgtcgatggaggtttctaaggaaacgtgggtgtgcagcaccgacttcatacggtggctgccggagagaaccgccgcaggcggcggcaacagggtcgccgcagaaacgcttgcaaagtccaagccaaaaccgaagccgatgatgcagccaccgcggtcgtcgtgctcgttcccggcggcgagaggcggcgccggggtgtcgatggcggcgatgattgagcagaagctgatggggtccaaatcgggtaacgggtacgagccgtttgtgctcacgcgctgcaagtcggagccgatgcggtcctcggctaagctcgcgccggaggcttgtttctggaacaacaggaagctcgagccgcacccacccgcggcacagcttggagtcggcgcgccggctggtattggattattatcgctaaactttgggcagctttgtcattataaagtcttcatgagcggttacagtttggtggttagaagccggaggaaagtatgcgtaaagggcaatgaggaattgagatataggttgagaattgaaacttag

SEQ ID NO: 51850 - DNA, 297 bp, Glycine max
  Peptide Sequence Number=SeqID_168628
atgacaacagaacagatgttcaagttcttgatgctttgtaattgtatgcttttcaggacaatagtgaatggcttgacctaccttgcaacatttgtttttggcctgaattcccttggtttattcctttattctggccagcttgccctcaaattcatcatgggaaattcaactgaaaaggaaactgaaagtaaaagcaccgatcagccaaatttatcaaattcatccattgagagttccacagataagactgaattgagcagcaggaaggaagaacaaagttcaaatgatgcacaatag

SEQ ID NO: 51851 - DNA, 891 bp, Glycine max
  Peptide Sequence Number=SeqID_168629
atgaggaacccatggttctgcatctctcttctcaccctctttttctctttgctcacccacaattcccttgcagctctcacgaacgtttcttcaaaccaaactctcactggggatcaaactctcctctctaaaggtgaaatctttgaattgggtttcttcaagccaggtaacacctctaactactacataggcatatggtacaaaaaggtcaccatacaaacaatagtttgggtagcaaatagggacaaccctgtctctgataagaacactgccacgttaacaatttcaggtggcaatttagttctcttagatggatcttcaaatcaagtttggtcaacaaacataacttctcccaggtcagattctgttgtagtagctgttctccgagattctgggaatcttgtgttaacaaataggcctaatgatgcttctgcttcagattcagattctctgtggcagagttttgatcacccaaccgacacgtggcttccgggcggcaaaattaaactcgacaacaaaactaaaaaacctcagtacctcacttcatggaagaacaacgaagatcctgccacgggtcttttttctctagaactagaccccaaaggaagcacctcttatttgatcctttggaacaagtctgaagagtattggacaagtggtgcttggaatggacacattttcagcttggttcccgagatgagggcgaattatatctacaatttctcgtttgtgacgaacgagaacgagagctatttcacatactccatgtataactcgtccatcatatcgcggttcgtgatggatgtctcggggcaggtcaagcaattcacgtggttggaaaatgctcagcagtggaacttgttttggtcgcagccgagacaacagtgtgag

SEQ ID NO: 51852 - DNA, 564 bp, Glycine max
  Peptide Sequence Number=SeqID_168630
atggggaaattcgcttttgacaccaaaagccaaacaaactcgagaaggtatcttagtcttagtggtagcataaacagcaacaacagaagcaccattatcatccctgaagctgggaacagcactcctcaaaataatcaaatcactgccatatactatatatcagatgttgcactctcagtgccaccaccaccaccttctcttcccattcacactcacacaccacaaaccattcctccatggctcgcacaactcgccgatgcagcagcagacattgactttgagacagaaggagagggccctgttgaacttccattctcttccactccttccattttcgccaccgccgacgacccttctcccatccaagtcgcttccagtgttctcctcaccggcgccgtctccgtcttcctcttccgctccctccgccgcagggctcaacgtgtcaaacaatcacaattcaggtcttcaggagagaagtcaataaaggaagaagcattggatagcttgaaagctatggggtcgggttcagtgaaggctaaggaggattcagcttcacctggttag

SEQ ID NO: 51853 - DNA, 1005 bp, Glycine max
  Peptide Sequence Number=SeqID_168631
atggagcctattggaaactcttatgagtcttctttttccaaagatgaaaaagtggaagctgcagatcttcttctggaggagtgctggttctttgataacttattaaagataacaccaaggatgacaaggtgtcactctgagccttacccttcttccactggcctaatcagccccccagattttttggtgaaggactcaaactcaaactcatcatcaccaagtaaaccactaaacaatggtgctattgtccatccaaagatccagagagcaccatacatgccaccattgagactgagagaagaagaagaagaccaaaaaggaagcagttctacaagaagcaaattggtgcaccaaccaacagatcctgttgtgtctcatgcagcaagtaaacctcattgtgcacaaatgaaaggacgtcataacagtgattgcgttagaaggaaaagcaaacttcttagaacaccatctttgcctccatccatagggagagatgaaaagttgcaagtatatgatactagacctggcagattccacaagcaaccatcaacacctacgcaaattgacattctgccccccaggcaaacctctaagtcttgtagcattccaagatgtagaccagccagaaagactgaggttgaaagcttcaacaaagagggtattatggagatgaggcgcaggtacttgaatcagaaaacaatgagaagaagcctaagtgatcttgaatttgaagaagttcaggggttcaaggatttggggttctcatttgagaaagaaaccttaagtccaagtttagctagcatactgcctggtttgcaagagaaaaaaagagatgagacagaggaagataaggcagcaaggagaccatacttatcagaggcatggttggtacaaagttgtgctcctgcaattccaaattggacttctcacaagtcttcaggtgacatgaaagtgcaaatcaagttttgggctagagcagtggcttcaaacgtacacctgaaatgctga

SEQ ID NO: 51854 - DNA, 423 bp, Glycine max
  Peptide Sequence Number=SeqID_168632
atgtcccaattgcagttcactaattttaatacgttgtttgaggatgagctttccaggtttaaggccaaccaatcttcagatgttcctaaaaatcctgtagtacgccaatttaaggaagctgtgtggaatgttcatcatgcggggcagccaatgccaggcgaagagcaggaggatattgtaatgaccagtatccagtccaacattttgaatattacctgtccattgagtggaaaacctgttactgagcttgcagaaccagttcgcagcaccaatttttcagaaaattcttgctggaatgataaattcaagcatgccaagccaactttctgggtggattatggggtggatgtgaatgggttggcttggttgaaggctgaagacacatgcaaatcaatgagaaagatgcctgtatctgtcttgtaa

SEQ ID NO: 51855 - DNA, 5619 bp, Glycine max
  Peptide Sequence Number=SeqID_168633
atgcgatcatcgccgtcttcattgggttcgtcgtctcgatcaggttcgcggcttcggaagaagcacaagaggttggatgcaatatgtgaggaagagtacagtcgaaaccatggtgagttgaatgaggataatggggatttgaaccctgatgctggggttcgtcgaagctcccgggttcgccgtgccccaatgctgctcgacgcttctccagctccgccgaagaaaaggaggaaagtggggaagggtggaattggtcgtattgtggagggtgctaggagattagggcgggaaaataaaggttctggtggggcttggagttctaggttgagatcaagagttggcaatgtaggtgttagggtgaaggaggagagggaatcgcctcgtgggaagaggaagctttttgagggtgtggttggaaggaggggtgttgaggaggttggtgggaaagaggagttgggaggtttgatgccgaaagtggttaagtcgaagagaccggggaggattaaagccacaaaacatgaggaagggcatgaagaggatgtgtctgatgggagtttggaggagagtaagagtcaggaagtggagattatgttgagcagtggtgaggagagtgattctgatccggaaaccaaattgtctggaggggattgcatggatgattcagatggaaatgcctctcctgtgatagggaatgaggaggggaatccaatggatgattcggatggagatgtcgctcctatgatagggaatgaggagggggatcagatggatgattttgatggaaatgaccctctgatggtagggaacaagaagaacttatgcaacgatttgcaaatagatgaatgtgatggcaacgctgaatcgtctccaatggagcatgtagttaaagtggatgatcagttagagagtgtgaaggaaagcaaaaatgtaggtgatgtagctgaacaggtagataatgaaggatctgttggtaaggaggttgacgtcaatgaaaatgtcttgaaagatgcaaatgatggtaaggaggatgatgctgatgaaaatgtcttgaaaggtgcaaatgttgggaggtcggatgagttgaaacatgcttcaattgacaagcgtggtcaccagcgtatcaaagagggaaggcggtgtggtttgtgtggtggagggagcgatggtaagcctccgaaaaggttagctcaggataatggtgaaagtgagaatgaagcttatagcgggtcatcatcttcagaggagactaattatgatatctgggatggttttgatgatgaacctggttggcttgggcgtctcttgggtcctattaatgatcactgtggtattgctagaatatgggttcatctgcactgtgctgtatggagtccagaggtttattttgctaactttggatgcttaaaaaatgcgagagctgcacttttccgaggaagagcattgaagtgcacgcgttgtgggaggcgaggggcaaccactggttgtcgcgttgatcgttgtccaagaacttatcacttgccttgtgcaagagcaagtggttgcatctttgatcatcgcaaatttcttatagcttgcacagatcatcggcatctcttccaaccacgtggcaataaatatttagcccggataaagaagttgaaggctaggaaaataatgtgggagataaggaagcgatcaaatgaagcttgcagaaaagatattggagatgaagagagatggttggaaaattgtggagaggatgaagaatttttgaaacgtgagaacaagaggcttcatcgtgatttattgagaatagccccagtgtacattgggggttcagattctgccagtgaaaattcatttcagggatgggaatctgttgctgggcttaaagatgtcatccgttgtatgaaagaagttgttattttacctctcctatatcctgacctctttgataatttagggcttacacctccaagaggtgttcttttgcatgggcatcctggaacggggaaaactttggtggtccgggcattgataggtgcatgttcccgtggtgataagcggattgcatattttgcccgtaaaggtgcagattgcttggggaagtatgttggtgatgctgagcgtcaactaagactattatttcaggttgctgagaaatgtcaaccttctataatattctttgatgaaatagatgggttggcaccccgccgcactaggcagcaagatcagacacacagttctgttgtgtcaacattgcttgctcttatggatggtttgaaatcaaggggttcagttgtggtaataggtgcaacaaaccgtcctgaagctgttgacccagcacttaggcgccccggtagatttgatcgagaaatttattttccattaccaacaattgaggacagagcttccattctctcacttcacacccagaagtggccaaaaccaattaccgggtccttgcttgagtggattgcaagaaaaacacctggatttgctggtgctgatctccaggctctttgtacccaagcggcgatgaatgcgttgaagaggaatttccctttgcaagaagtcctgtctttagctgctgaagaaaaacattctggttctaagcacattcctcttccatcctttgcagtggaggagagggattggttagaggcttttttttcttccccactaccttgctcccggagagatgctggaaatgctgctaatgatgcagtatgctcccctcttcccatccaacttattccttgtttattgcagccattatgcactcttcttgtatctctttatcttgatgaacgattatggttaccactttccatactgaaagctgcaacagtgataaaggatgtcatgatttctgctctagacaaaaagcaaaagccttctgatcgctggtggttgcacatggatgattttcttcaagaaacaaacattgtttatgagttaaagagaaagcttacttgttctggcattttatctgccaacgacggcaatgctggttcttgtgaaactgaggatgatgccaataataacagcttgaagttagaatcctccacaaggaaccatcctggcatgcgtagtggtttatttgcattgaccaacaaatcaggatttcggatattaatatctggaaattcacgatctggcccgaggcatcttgcttcttgccttcttcactgctttattggtaatattgaaatacagaagattgatatggcaactattttacaagaagggcatggagaagtggtgcaagggattggtcagatactaatgaaatgtgctagcaggcaatcttgcatagtattcttgccaagaattgatttatgggctgtggaaaaacatttccaaattgctgaaaggactgattcgtgtttaatgatgggcaagtcgtgtttcacacgaaaccaagttgttgagaaggaaaatgagattagtactgagaagaactcaactgagatgatcaaaggccaagccaacacaaaggcttcctatgcctggatgtcatttattgagcaggtggaatccattgatgtatccacatccttgatgattctggctacttcagaagttccctatacagaacttccgcacaaagtaagggaattctttaagagttatcaatctaaagatggccggtcaactcctttggagcagacaattcctcgattctctgtgcagattgatgagaattttgatcatgacatggtgatcaatctatccgcactagagctattgagaaatgtagttgagcagctggttcaattgattcatcagagatctcatgttcatatgggttcccaaaagggcagaagttatgaatcaattgaagtttctaaagataaggtatgtcaaagaaaagaagatggaccagctaatgataagaagagtgaaatccaacttgaatcctttacaaaagttccaccaacacccaacagcaagtcactgaagggaaagtcgaccctgttgttagcaatatccacatttggctatcaaattcttttatacccacattttgctgaactttgttgggtcacttcaaaactcgatgaaggtccttgtgctgatgtaagtggaccttggaggggctggcctttcaattcttgtatagttcgtcctaataattcacaagacaaggtggcagtatcttgtagttctggtggcaccaaaagtagggaagcatctggtctagtcagaggcttgattgctgttggtttatcagcttacagaggtgtttataaatcagttagggaagtttcccttgatgtaaggaaggttctcgagatcttaattgagaaaatcaataccaaaattcaagtggggaaagatagatatcaatattttcgtattttgtcacaagtggcttatttagaagacatggtcaacaactgggcttattcattgctaagtaattctttccattttagtctggagcaggattcccctgagcataaaacaaaggttataccagaaagtggtgggccattaaacagtcatctcacgtgggaaaatcaccaaactgaagatgaggactgtcatttagttgttcctgtggatggtaatgatttggagacattggagggaagtcacaaggaaattccttctgaaacaactggatatcttgcctctgatgacaacaatgataatgtagagattattgattgtgatgatggaaatgctagttctgaaggatctctacagaaccattcctttccagataataagaatatcaacaacactactgctgcaagccaaccactttatccatccacaagtctggagaatgggacattatttggacaatctgaacctgtaactgctggaaataatgaagagatggatggagaactagagatttcagaagacttgaagaaatccacgtgcactcaccctgtggtcccttttcaaaatggacttcacactgcttgtgatccagagacacagaatgtcgagattggtaacttaattaccatctctgatcagccttttagcttgtccgcggtagagactgctactaaatcaagtgatggtaaatctgataaacaggagaatgctacagataacaatgtctcttcaagtaatggcagtggccctgctgaatctggggttatttgcttgtatcaatgttgccctgcatgcctccacagtctccatcacttgacaaagaaaatacttgttgaaaaatggggtttaaacagtgagcagtggacggcagaagatgtccatgatgctgttgcatcattatctgtggatcttatttcagcagttagaaaatgctctatgcctcaagatttcattgattcatcaaataaaacctcaagaaatgaaaagcatggaacatctctcgactgtttgaagctgagaacgtgtaataatggaaaccaaggcaaggatgttgtgccagctgaatgtttttctcacgcagcaagccaacatgcaactgcaatggaagatatggcactgaatgaagaatcgacgaagcttgatcttaaatttgttttcagagatggtgtactagttcatatggacccagataaggatgtcaaagttcactgtaaatttgagaatttgtgcctttgttctttaagagagttgatagtaatgaaaaagcgcccttttgattag

SEQ ID NO: 51856 - DNA, 1149 bp, Glycine max
  Peptide Sequence Number=SeqID_168634
atgacacagggtagttttgttccccatggtcgagatgacatcttgaatatggccattggaaaaccggaacatctaggtcgagttcgtgcagcgggatctggtatgacccttactcaattttatggtagggcaacacgtacgtcgagtagttcctcagcaacactaatgcagcaacagtgggttgacattattggaaacataaaggaacaagtaaggaatgaatatgaagaacaacacaagaggagtttggaggaatttaagaaggagttgtccagtcagatcttcattcagttgagtcagatgggatcacaatactctccccttattgaggtggatttacaggcattggctgcacgtcttagcactaaaggaagtaatgtagaaactgctgatgttgacccatcaggcgacaaaaatgtgagcttaaaacccactatggggttatatgtgcaacgacaacatactacagtgttggtggccttggggaaaatatgtgaggggggatctgccattcacaatgtcactgatgctgatgatgttgtaagggtgagtgttgacaaagttatagaaggtgacgccaaagtgcccttcccgacatcagagattcaatatgagtctgatactagtccaaagaaacttcctgaaacaaatgaaagggggacgaatgattttgaccatgatccgttgcatcaactgattaagagcctatatttcatgtacgacacacctgttgagttgaagtgggatggcagcaaatttgagctttcaaatgttgatgcttcattcttcttgacattctctgatgtaaatgaaatagtagctggatacaaatgtttgaacatatctatactacagttatggatgtttatcaatttttatgtatattttatcaaagcagatttttggatgagtggagctcaactttgggtcatgcttccgtgtatggattccttgagccacaatcgatacacaatgcaaaggatcaacgtgttgaatgtgagcattacttacaagcatgactcaaggaatcgcaacgagaggggccattggcaactggtagtactgtgtcctgcgaccaatgttgttgcatggttttgttcgttacgtaagaagcctgatactcatatcaaaactgcaattaacaagtaa

SEQ ID NO: 51857 - DNA, 258 bp, Glycine max
  Peptide Sequence Number=SeqID_168635
atgggtacaactgatattggacttgtctaccatggagacacgtcttgtgctcttgctgaggaagcttcaatgaaggaagagaatgagagagatagagtgatgcaatcctaccccttaagggcattggatagaagactccaagaagattggcccagagatgcaagagaaggccctccggttctcatgagccttaaggtcgatttcaggcccatgacatgggctaagtatgaactcacttatctttgtatattagattaa

SEQ ID NO: 51858 - DNA, 330 bp, Glycine max
  Peptide Sequence Number=SeqID_168636
atgttattgcctaatgctgttcatgtgtcctccaccttcgagtttggagctatgtttcatgattgcctaagtgcggaccctcaaggcaatcctccattctccccctttttcggagccccaggaatgtcattgtctagcgctgttcatgtgtcctccattatcaagcgcggagcctctggtgactgggaaatatgttcttctgttgttttccggatcggttccttcgccaaacatcaaaaaagaaggagtagagacgagaatcgtcatcacggaaagggcaggatggacgaaatccatgtcttatctttgcttccctcttatctccgatga

SEQ ID NO: 51859 - DNA, 183 bp, Glycine max
  Peptide Sequence Number=SeqID_168637
atgacagaggtctccacggaggccattgcctccctcgtccaatattatgaccagactttgaggaattggaccgcgggaagcaagtcgaaaatgcggtggttggagtaccaaggaaatgtttggaagcataggcgagagtcttggcaagtcaagacgaatgggccccgttcatggacatcctag

SEQ ID NO: 51860 - DNA, 1185 bp, Glycine max
  Peptide Sequence Number=SeqID_168638
ggtggtggtcttgcccgagccggtcgggccggtgaccagcacgatgccgtgcggtcgctcgaccagcgcattccagccggcggcctcctgcgggctgaaaccgagctggtcgatgctcttgaaggcggcatcggggtcgaagatgcgcatcacgcacttctcgccgaaggcggtgggcatggtcgacaggcgcatctcgacctcgcggccgcccggcgagcgggtcttgatgcggccgtcctgcgggcgccggcgctcggccaggtccatgcggccgagcaccttgatgcggctgaccacggcggtcatcactgccggcgggacctcgaacaccttgtgcagcacgccgtcgatgcggaagcgcatgcgccccatttcgcggcgtggctccaagtggatgtccgaggcgcgctgttcgtaggcgtactgcagcagccagtcgacgatgtgcacgatgtgctggtcgtcggcattgacgtcgccggtgcggcccagctccaccagctgctcgaagctgggcagggtggtgttggcctcgccgcgcacgtcgccacgggcgccgcgcaccgagcgggtcaccccgtagaactccatggtgtagcggtgcaggtccagcggattgaccaccgccagttcgatgcggcggcgggtcaggtgctgcaggtcgcggcgccattcctgcaccagcggctcgctggtggccaccagcacgcgctcggcatccaccgccaacggcaggaaacggtggcggcgcgcgtaggcgtgcgacaccagcgcggtcaccgcagcgacgtcgacccgggttggatcgatgcgcaggtagcggctgccggtgcgctgcgccagccactcggtgaggcgctccagggtcagttcgccgccgccggtggcggccagcttgaggttggacagcagtaccagcggatgcacttcactggcgttgcgtgcgccatgcgcggaaaaccgcatgcgctcgcggtcctgctcggccaccaggtcatcggcgaccagggccgcggcaatctgctcgaaatgcagccgtccccagggcagcgggacgccgcccgcctcgccgggcgtgcctgccggcagccgatgttccatctgcctgctcctcccgggtacggaatgccccgcaggtcggccgatatactagcgcacccccttgccggccaagactcgtaa

SEQ ID NO: 51861 - DNA, 840 bp, Glycine max
  Peptide Sequence Number=SeqID_168639
atggacatcctgacacttttgatcttcggggtggtcctctttccaaatgtggatgggttggtggaccgagcagcgattgatgcttttctcgccttttacgaccgcaaggaaagcccagttgtcgctatcttagccgatctatatgacacatttgaccaaagatgtgagaagaaaaatgcaaggatcgtttgctatacatcggctctctacatatggggttgcatcaattacaatcccgtcctcgctataagacaacttggttaccctatgagaggggtgccattagaggaaggcctcataccttttattacacgaggtttcgatagcaccaacgcgggggtgcttcagaaggtccacaaggcatgggaaatgtcgcaaaggaaggacaaggaacttaagtggagtagcaatgggcccatcggcgattaccataggtggttgaaagcctacgcacaagatctagattggctcttgagtttgaggaccactaaggggatggaggttgaaactctggaagaagatgaagaggtgcaggccctcaagacagaacttgagaaagcccaaatagtcaaagaaaagttcaagtcagcagctgttaggatccgaaaggagaacgccaaactgagaggcgtcaatatagccaccaccaaggccttggagcaagagaccaagagggcccgtaaggaagaacatggccgaaacaaattccgaggggctctgtggggcagtaacagtgagcttaagctccgaagagaagaaagggaccaatcgcgagtagacagtttgattctgaaggatgaattgagggtttgcctaaggtccaagaggagtttgtcttag

SEQ ID NO: 51862 - DNA, 336 bp, Glycine max
  Peptide Sequence Number=SeqID_168640
atgggtgcaaatagaaataaagatagtaaacagtgggtgcggttagcaaagttgggtccagacagtggtagtttgttggtaagggaatattgccccgtcataagtcattcaattgccttatttgtggctttaacgtacaatgactgttcgatgcacactgtcacctacaagacaaagaatcttaacaaagcattccaactcatgaaagccacaaaagacaccgacatcagatacttcactgttaacggagttttcgatcaagacaggaattctgtgaagcaattggccaaaacatacccttgtgctattccttgcttcggtctccatcctcggtaa

SEQ ID NO: 51863 - DNA, 537 bp, Glycine max
  Peptide Sequence Number=SeqID_168641
atggatcgcgcccacaagacgcccagtggacccgaagaagtccaacaagaccctggggtttccagctctggttacgggcctctatcagtcctacagggtgcccgtcccccccagcgagggatcgcgctcgtaagacacccagtggacaaaaaggagtcccatagggtgcccgttccccccagcaagggattgtgcccacaagacacccagtggacccggaggagcccaacaaggccctggggtttccagctctggttacgggcctctgtcagacctacagggcgcccgtcccccccagcaagttcatgtcatcgtgacataggtaaggattgtgcccacaagacacccagtggacccgaagaagtccaacagggtcttggagttgccagctctgattacgggcctctgtcatcaggccccctactaatcgagctttcatcaagaagtactgcgcccccaggcaagcgcagggtgaaactccacagcagcctagggatggccggtagcgggcaacaaacgcactaccaccacctctag

SEQ ID NO: 51864 - DNA, 369 bp, Glycine max
  Peptide Sequence Number=SeqID_168642
atgggtcttggaaatatttttcaagaagaagagatcaatgtcaaggagctgaaatctgtcaacaaaacatggcaaccaaaggtcatagctatttctatatcaaaagaccttgccaccatgacacatgctaaattgtttgggaagttgagggaatatgacatggacttgacaagaatggctgaagaagaagctatagataagaaaaacaaagggaatgtagacgagttggttgttgaaaatctgaacttgtttgtgagaaggttcaacaagttcctcaagaaaaagaagaactatggaagcatcacctttcagcctaagaagaatttcatgaaagagaactatcttcctccaatggattcacttgcttaa

SEQ ID NO: 51865 - DNA, 1185 bp, Glycine max
  Peptide Sequence Number=SeqID_168643
atggcttgtttaatgagtaatgatgatctctctttgctttggcataggaaaatagctcatatccacatggataaactaaataagctagtctctaaggaatttgttagaggtcttccaaagctcaaatttgagaaggatgaattatgtaatacatgtcaaaagggaaagcaaactagagtatctttcaaatctaaaaatgcagtttctaccactagagtacttgaacttttacatttagatctttttggtccttctagaaccatgatcattggagggaattactatgctttggcagatgaagatctattattgggttattctacaaatggcaaagcatatcaagtctttaacaaacatacactaagaatagaaaagtctatgcatgtagtttttgatgaatctaacccccaaagattgggaaaattacctctttatgatgatgatgatgatgttggaagtcctaaaaaatcccctcctacaagcgaaaaggtagtgaacaataatcgtcttgaaggacactcactacaacacaacaatcttcctaagggagtttctactcgacactcactcaatctgttttgggaattttatgcatttgtgtctatgatagaaccttcaactattgaagatgcgcttgttgatgaacattgggctttggctatgaatgatgaactaaacgagtttaaaagaaatgaagtttgggaactagtacctaggactagtaagacaaacattatagatacaaaatgggttttcaaaaagaagttagatgaacatggcttgatagctatgaacaaagcaaggctagtagccataggttataaccaacaagagggtatagactttggtgaaacctatgcttcagtagctagattagaaatgcaaggggaaatagaaatgtctatgattggagagctgaactatttcctcggtctacaagcaaagcaaatgaaccatggaatgtttctccatcacacaaagtattgcaaggcacttctcaagaagtttgatatggagaaaagcaaggaggctgcaactcctatggctacaaattgctaccttagtgcggataaaaaagcgaaactcgttgaccaaacaaagtacaaagctatcattgttaagagagttatgaagtaccttatacgaaccttagatgtcggcttatggtaccctaaaggtgtttag

SEQ ID NO: 51866 - DNA, 372 bp, Glycine max
  Peptide Sequence Number=SeqID_168644
atttatgtgtccagtattttcgggccagatgtcctggacatcgtatccgacatcgtggatcctgcagcttcacttcttcacttgacttttatcttgccttgtgccttgtgcagcaactccagtattttcgggcaggatgtcctggacattgttcgagcagttattcaagtgggatcagcaactttcattatcagagtaatcaagcacagcggtatctgtagtggtgacagcaaaaattctgcaagttgcaaatctacaagtcttttccaggatgtcaagacatctcacgtgacatcagctttctgctccccctgtctccatgctcctactgctgtgaagcaattcactgcagcatcttctatcagctactag

SEQ ID NO: 51867 - DNA, 210 bp, Glycine max
  Peptide Sequence Number=SeqID_168645
atgcacaacctacgcaagacaaacatactccctctcctctgcctcaacgagatgactcctcagccctcatgcatgaagttcttttggagttacgcgacctccgcacctatgttggtgagcgctttgattccttggatggtcgtatcgatgccattgatgctcgctttggaggcatggatactctcatcactcagcttgaggaggatataa

SEQ ID NO: 51868 - DNA, 747 bp, Glycine max
  Peptide Sequence Number=SeqID_168646
atggaaattgcgacagtaacttctgtttccaaccaaattgaacatgtggttccttatcttctgaagtttcttgataaccttacaaatatttatgtaaggttcaaccgtaagagacttaaaggtcgttccggggaagaagacggcaggatagcaccatcaactctttacaatgtgcttttgttatcatgtaaggtgatggctccttttacacctttcttcactgaggagctctatcaaaatatgcgaaaagtttgtagtggatcagaggaaagcatacactatttcagttttcctacggaagaaggaaatcttctgctggtccaggatgggaaactctatggtcggtatcctatgttttctatgatcactagagtcgttggattacctgaagtcacagagaatcatgacattcagaaaaataaatttatggtgcaactaggacaggtggacatgcgcttcaatgttaaaaatgcatattggttgaatgacaggatcagggacaagattttgcaaacggagaaaaaccgtattaacaaggatagggagcttgtgatttcttcaaccaagactagaacacagaagtttgtgtctccccttttgtactatttgttttctcttcccttgggtagcattgaggatgctttgacaaagcttcagttatcattgcttggtacatttggaaatgattatatttctctcttttcttcttacctaaaacacagtgaaaagaaagtgatacttttgtga

SEQ ID NO: 51869 - DNA, 954 bp, Glycine max
  Peptide Sequence Number=SeqID_168647
atgtttgcaggaatagtgtttgccctcgcggcggggctgatgtggggcatgatttttgtcgggccgctgctgatacccgattatccgggcacgttgcaatcagcgggtcgctatgttgcctttggtctggtggtgctgccgctggcgtggctcagccggcgccggctaaaacagctgacgcgcccggactggacggaggcggtgaagctgtcgctggtgggcaatctgctctattacgcctgccttgccagcgcgattcagcgcaccggcgcaccggtctccaccatgatcatcggtacgctgccggtggtgatcaccgtcaccgctaacctctgttacggccatctcgaagggcgcctgccatggcgccggctgatgcccgcactggtcatcattgctgtcggtctgggctgcgtcaacgcggcggaactgcacgggcaggggtcggcatttgatctctggggctacctgagtggcctgctgctggcggtgctggcagtggtgtgctggacctggtatccgctgcgcaatgcgcgctggctgcgcgaacatcctcagcacaaaccgtcgagctgggccaccgcgcaggggctggtgacattgccgctggcgctggtgttttatgggctggtgagcctgcagattcactggcagcagcccgatttcgctttgccgttcggcccgcagccggcgcgttttatttggctgatgctggcgattggtttgttctgctcatggctggcggcgttgtgctggaatgccgccagtcagcgtttgccaacggtggtgatggggccgctcatcgtattcgaaacgctctctggcctgctgtggaccttcatttaccgccagagctggccaccgctgctcaccagcatcggcatcggctgtctgatcgttggcgtgatctatgccatgcgcattaaaccgcagcggctgagcgcgcttccttaa

SEQ ID NO: 51870 - DNA, 222 bp, Glycine max
  Peptide Sequence Number=SeqID_168648
atgaacgaagatcaatggatgtatgacaatataatgtttgaagaagttgatatggattatcaaaatgaacaagaatatggtgtaaatgaatcacatgttgattgttcggatgcttttaatacttctcaggtctttaatactcgagatgatgttttgcagtgtgctcgatcagttgctcatgaaaacgaatttgttgcagtcattatgaggtctgacatatag

SEQ ID NO: 51871 - DNA, 537 bp, Glycine max
  Peptide Sequence Number=SeqID_168649
atggctacaccacccagctctcctcctcttcctcctcctattgctgaatttgatgtccctgaagcatctgatttgaggacacaaaagaaaatacttcagactgtgggggagcggtggagacaattcaagtatgatttgacgtcgaaatgggcacttgcagttgacaaggaaagtgtcgacgacactgtatgcgagaagtatgacattagcaaggagaagtgggcccaattttgtcagacccacaaagaccctttgtgggaggcacaagccatccagaagaaaaacactgcccctcacgtgttgtcttatgggggttatcaatatttagaaaacaagttgatggatgagaagagaaagaaaaaattggaggaagttgctcaatctggaatcactgacaccatgattgatccttcatctcccatcagacgacatgtgaaatggaagatggcccgcaccaagaaaattgggcaaatgatgtctgaggcagcaaaggaaattgctgacaagattgattcgttggaggaccaggcctcatag

SEQ ID NO: 51872 - DNA, 627 bp, Glycine max
  Peptide Sequence Number=SeqID_168650
atgacccacaccaagaaaactggccagataacgtctgaggcagcaaaggaaattgttaagaagattgattcaatggaggagcaggcatcacatggttcctttgtcgcccatggacgtcaggatgttctgattgttgccattgggcgaccagaacaccctggtcatgtgcgtgttgttggatccggtgtgacaatcaagcaatactttggactggctccaagtacctcccacacgtattcctccatggctctcaaagacctagagcagttgacgcaacaaatcagggaccagttggaggagccgatcatagaaaaaatgcaatcacagggactagcactgcctcctgagcctgaggttggtccttcagctgctcgtgttagcacaaaggagagttgtgttgatacctcagggaatgatccagacacgagtaactcggacaaatacgggttgtactttgaagaaaatcctccccgcctggttagagatgcaaatgctctcattcctgtacccactgaagaggttaagttagtggggcagacacttaacaccttccttgcttggccgacacatccggtcaagcgtttattagaacagggaagctatgagaccggcaaaacctgcagatag

SEQ ID NO: 51873 - DNA, 375 bp, Glycine max
  Peptide Sequence Number=SeqID_168651
atgaggggagcaccgacggaagagagcctctctcctttccttgtgagagatttcggtgcgcaaagtttcaagattgtacaaagagtccgcaaggcgtgggaaagcccgttaaggaaagataaagaacttaggggcatccgtaatggcatcatcggtgattggctctccaagttcaaagttatcaacgaggagaacttcgaagctccggaagaggatgaagaagtccaagctctaaaaacagagctaggaaaggcaagactcgccaaagcaaaggccatggccgaagtgtgttcagccccagaggaaattcacgggctaatcaattactgtcaacacatggtggatttgatggcccatataattagaaaccattag

SEQ ID NO: 51874 - DNA, 276 bp, Glycine max
  Peptide Sequence Number=SeqID_168652
atgcgttttcagccgaactcgctaagcacgcctaccacgctaagcgagttcatcttttggggaagaacattcatcttcctgaggagatacctgtggctaagcggggctgatttgctaagcccagaagcagaatgcctcaccaacttggctgatgggactattgatgttgctttggtgaatgaattttacgctaatctctatagccctgaggatccttcaccaaagcaagccagagttagagcagatggttcaaggaaatttgccctaaagttatag

SEQ ID NO: 51875 - DNA, 366 bp, Glycine max
  Peptide Sequence Number=SeqID_168653
atggggtttactttggttgactttcaaaagattggttacaaggacgagcctttcatcatggtagcacaagccagacatgtgttttatgtcgaagatctgagtgactcaatatggtcagttgttctacagggaaaaacaagtgctcaaaagtcaataacacttcatgataacaaagatgatgatctcaagaatcaaagaatgagttcaagaattgaatcaagtacacttcaaggatcaagaggaaagttgaattcaagaatcaagaatcaagaatcaagtttcaagattcaagtttcaagaatcaagatcaagatcaagattcaagactcaagattcaagaatcaagataagactcaatcaagataa

SEQ ID NO: 51876 - DNA, 243 bp, Glycine max
  Peptide Sequence Number=SeqID_168654
atgcattctgaagctgaagcactagaacatatgaagaaaagagatagaggccatcaaagtgtgtcatttgagaataagacaggagattcaactatggtcaagatgagtgagaaaaataataatgctgatgccggcgactgcatgattcttgatgaccataaaggagaagagcattgttgtggcaaaggaacaaatgcgaggagtgtttcttttttgccaagagaagataggagattcggctaa

SEQ ID NO: 51877 - DNA, 386 bp, Glycine max
  Peptide Sequence Number=SeqID_168655
atgattgtttgggcatcgctggcgcacgcggatgacagcatgccgtttcccctgacgccgccggccattgatgccgcatcctgggtgctgatggacgccaccaccgggcagatcctcaccgcaggctacccggacgcggagcgcaacccggccagcctgaccaaactgatgaccggttatgtcgtcgaccgcgcggtcgatcagaagaaaatcacccgcgacgatgtggtcacggtgggtaaagacgcgtgggccgccggcaatccggtgtttaaaggctcgtcgctgatgtttcttaagccgggcgataaagtcaccgtgcgcgatctgatgcgcggagtgatcattgattccggcaacgacgcctgcgtggcgctggcagatat

SEQ ID NO: 51878 - DNA, 366 bp, Glycine max
  Peptide Sequence Number=SeqID_168656
atgttatgtgtgcctaagtgttccataagagatttgttgctaaaagaggcacatgagggtggaaaaatcaaaagtgaagccacatggttttatcatcccctacctgttcttgattttcctcgggtggacatatctatggactttgttttgggatttcctagaacaaagagtggcaaggattctgtttttgtggttgttgacaagttttcaaaaatgacacattttataccttgcaaaaaagttgatgatgcttgtcatgtagctgacttattcttcaaggaagtggtgagactccatggaccgcccaggagcatagtaagtgatagggataccaagttcctaagtcatttttggagaacattgtag

SEQ ID NO: 51879 - DNA, 747 bp, Glycine max
  Peptide Sequence Number=SeqID_168657
gcggcgagcccgatgacatgcgcagacaaattatggtcattccgcacaccttttcgccattctgaggcgatcgtgtccgatggcgcccagagacaaattatggtcattctgcgcctttccatccaagttcgatcgtgtccgatggcacacagagacaaattatggtcattctgcgcccttttgtcatccagaggcgatcctgcccgatggcacacggagacaaattatggtcatccacgcacttttgctatttgtaagactcgaagcgtgataaacgcgcagagacaaattatggtcattctgtgccctttgtcgttcaggagcagcgagtcgagtgataaatgcgcagagacaaattatggttattatgcaccctttgtcattcaggagcagcgagtcgaaggcgatcctgcccgatggcacacggagacaaattatggtcatccacgcacttttgctatttgtaagactcgaagcgtgataaacgcgcagagacaaattatggtcattctgtgccctttgtcgttcaggagcagcgagtcgagtgataaatgcgcagagacaaattatggagcagcaagtcgagtgataaacgcgcagagacaaattatggtcattttgcgccctttgtcattgaggagcagcaagtcgagtgataaacgcgcagagacaaattatggtcattttgctccctttgtcattcaggagcagcaagtcgacgtgataaacgcacagagacaaattaag

SEQ ID NO: 51880 - DNA, 246 bp, Glycine max
  Peptide Sequence Number=SeqID_168658
atgtggtaccattcgtcaggaaatttcctaagcatgtccacacgacactttcacttaggaaaactaggcagcaagtttcgaggtcaccctatcgtgcacaagcaactcccgctccatggtgatcaacctgagtctcaagggagttccaaatcgagtgacatgccctcagacatcccattagtcaaaaacattgtttttctagaaaaccagcatgcaacagggacaggcatacatccccatagttag

SEQ ID NO: 51881 - DNA, 240 bp, Glycine max
  Peptide Sequence Number=SeqID_168659
atggaagtgctaaaggatcttatggaaaaggtagaagctctcttatttgaggaaatagtggggaaaacttggaacaggcatccaaaaacaagaccaaggaaatccttgaagcaactcctgatgcaatcctaccccgcaagggcattggctagaagactccaagtagattgggctagagatccaaggaaaggccctagggttctcatgagccttagggtagatttcgagcccatgggctaa

SEQ ID NO: 51882 - DNA, 183 bp, Glycine max
  Peptide Sequence Number=SeqID_168660
atgtggcaagcggcggtggctcgtggcgataacaagtggtcatgggtggtgaaggagaagttagtcattaaggctgctaagattgagcagttcatgaatgggaaggatcaaagaaaatcacagaggctggagaaatccttaaaccatatccatggtattggaggaggacgaggaagactttga

SEQ ID NO: 51883 - DNA, 789 bp, Glycine max
  Peptide Sequence Number=SeqID_168661
atgttttcagtagtcattacaacaaaaaacagattggattttttacgaagagcagttgaaagcattgtcaaatcgtcattgctgccagacgagattattattgtcaatgatggcggggaaaaaccagaactgaccgatatttcttttggtaagattaatgtggtcatagagaataatccttcgagtttaggagcgaattattcccgtaatcgtggtattgaactgacttcaacggaaaatatctttcttctggatgacgatgatgccgtagaggttgattcatttcaaaaacgattggatattttgttagcggatgatgaggttggtcttgtttttactgggataaaaattgtcctgagcaccgagctcaatagggttcgcagaacagtctatccgcgtgaatatcctgactttactgaggctttatttaccaaaggtaaatttgatgaggcattatcctgtatgcaggattatgatctctggatcagaatgtcgcaactttgtaagattcagcatgacagcagtgcaactgttatttacacagtgcatagcaataaaaaccaaattagctccaatttcaggaagtatcttgaaacggggcagattttgctcaataagtacagccgcttaataaataatgatgcgcgcagacattttatggcgaatctctatttccgcgttgcgttatcttccgcatcaacctcttttgtgcatcgtatgcgctatgcttttctctcgctggcttccgtattttcactaaaagggctcatattgctattgactccttaa

SEQ ID NO: 51884 - DNA, 129 bp, Glycine max
  Peptide Sequence Number=SeqID_168662
atggccgaccagcgggctaccaagtccaaagccaaaggtaagcaaagtactaggacgcacctagttgctcatgatcctggggatttaaataaaacaagcgcaagctcggaaggtagagagataccttag

SEQ ID NO: 51885 - DNA, 450 bp, Glycine max
  Peptide Sequence Number=SeqID_168663
atggtaggggcatccgttaattggttccctcgatggaaggaaggaagagttggggttctatcctcgtgtgagggattctcaaacgtccccttgatgggaatgaggggttgtatcaattataatcccgtccttgccataagacaacttggctaccccatgaaaggagtgtcattagaagaaagtaccatgcccttcatttcatggggttttaaagaccccaatgcaaggatatttcaaagggtccgaaaggcatggagcgcggcgcaaagaaaggatatggaacttaggggaagcagcaatgggatcatcggcatgcctcaagtaaggaagaggctgaaaccccggaggagagtgaggagccgaggcattagaacgggaaacaaagagggcccgaaaggaagaatggggtcgaaagaagttttgaggggcgttgtggggcagcaacaatga

SEQ ID NO: 51886 - DNA, 729 bp, Glycine max
  Peptide Sequence Number=SeqID_168664
atggataggcacattgatgtggccctggtcaaggagttttactcaaacctatatgatccagaagataaatcaccaaaacaggttcgagtccgagggcggctgattaagtttgatgcggcatcactgaatgcctttctggagacgccaccggtcattcagccaggggagcagtacctctcatattctattttttgcaagtcacacacagatcctcaggagcttgcctccaagctttgtattccagggcgaggatttgttcttaatgctgaaggagcaccctggaagctcctgaggaaggatctgatgaccttggcccagacttggagtgtgttatcatactccaacctcgcccccacctctcacacgtctgatcttaatatggacagggcgaggttagtctatgggttggttatgaagatggacatggacttgggcttcctcatttcgcaccagatctcacagatggcccagtccaactcctctaggcttggaacccgcgaggcacgggctagaggatctgagggtccatcttcggatgctcctcctgctcttgcttcctctgcacctgctccttctcggctccaaccccttctacttcagcaccaccacttcctcctactcattctcattcaccagctccctctgctccatcatcatcattctagtgccaatgctctgtggtcaccattcctatgttgcagagcatccactgtggcttatgcctggtga

SEQ ID NO: 51887 - DNA, 457 bp, Glycine max
  Peptide Sequence Number=SeqID_168665
aggcggcgagcccgatgacatgcgaagacaaattatggtcattccggacactttttcgccattcagacacgatcgtgtccgatggcacgcaaagatggtcattctgcgccttttgtcatccagaggcggtgagcccgatgacatgcggagacaaattatggtcattccggacaccttttcgccattcagacacgatcgtgttagatggcacgcagagacaaattatggtcattatgcgcccttttgtcatccagaggtggtgagcccgatgacatgcggagacaaattatggtcattctgcaccttttgccatccagatacgatcgtgtccgatggcacacagagacaaattatggtcattctgcgcctgtcataccctaatttcgtccggggacctttgctcgatgacgtgcgaccattctttggtcctcgtgaggtgcttggcacccatcattag

SEQ ID NO: 51888 - DNA, 246 bp, Glycine max
  Peptide Sequence Number=SeqID_168666
atgagtaggagggcgcggcggtcgctgcaaaacccagggcgcgagcccgggcggagcggtcgtcggtgcagatcttggtgcctgcccaccctggaaacggctcagccggaggtagggtccagcggctggaagagcaccgcacgtcgcgtggtgtccggtgcgcccccggcggcccttgaaaatccggaggaccgagtgcctcccacgcccggtcgtactcataaccgcatcaggtctccaaggtga

SEQ ID NO: 51889 - DNA, 885 bp, Glycine max
  Peptide Sequence Number=SeqID_168667
atgcgtcgttcggcgttccggccggcggacctgcggctggtgcgcaacggcgtggatacccggcgctttcgtcccgcgtcgccgcatgaggcggccctggcgcgcgagcagttgttgccggcggcgctgagggaccggctggtggtgggaagccaggcgggcaccgccgcctacaagaattggctggatatggtcgcggccgtggcaatgctgcccgaggcgcagcggcgccagatcgccgtcctgattgccggccagccgcccagcgcggccgacctgcagcgggtcgacgagatgggcatgcgcgacgcggtggtcttcacggacgatctcgtttgcctgccgcgaaatgatggcggccggcaagcccgtcatcgtcagcgacacgggcgggctggccgagaatgtcgtcaacggcagcagcggctggatcgttccggccggcgcggtggcgcgcgtggcggagatactggccgatgtcctggaaaaccggattctgctggactggatggcggcggcggcgcggcgcaaggcggtcagggatttctcgctggagaccttcgtgcgtggcaccgagctggtctacgcagaaagcgggcgcgccgcgctgccgcgccaggacctggcccccgcttggagggggccaggcccgcaggctcattcgctgtaggtcttggtgctgtagaggtcgatcggcagcaggttcagcaccggcaggccggacacggggtccttggcctgcttgtcgatgtaggcctgcagcacgtcggcatccagcacgccgatgtcctggcgccgcgccgccggcacgttggcgagagtcttgtagccgtcgccgccggtggcgttgaagctcaggacgaacagcttgtaggtgcggttcag

SEQ ID NO: 51890 - DNA, 684 bp, Glycine max
  Peptide Sequence Number=SeqID_168668
atgccggtggcggcggcgcagccagcggccagcccacgcgcgccgacggcgccggcgggcgaatgcgaactgccggactcgacgcgcgaggcatacgccgcgcgccaggcgcggggcgaggtcacgcgcgcccaggtgcgggcgcaggtcgaggtgtggcgcgcatccggcatggcgcagctgtctcgcgcgcggccgttgcccgacgtctacagcgaacgctatcgccagcactatgcggcctatgcgcggatgcgaaacggtccggcctacgcgcaggcgttgtgccaggagctgggcaatgaccggcccctggccaaggggttgcggatgctctatcgccacacgcggccaccggcccagcgccacaacgccgtgctgtggccctttgtgcgggtgcaacgcgatccggccggccgcctgtcgggctgcgcgttgcggggcgcgaccggcccgggcctgttgccgctggccatggtggcgcggcgtatcacggccgcggcgcacctgatcctcagcggcccgtcggtggcccgcatcgactacgaccaatgcgtgctggagacggtgatgggcgtgaatggctcgatcgcgctgcgccagaggcaccccggcttgcgcttcgactactacgccatgctggatgcgggattcgtgcgtcgccgccgtgatctggtggcgcag

SEQ ID NO: 51891 - DNA, 402 bp, Glycine max
  Peptide Sequence Number=SeqID_168669
gtcgactctagaggatcccaccggatcctaggcggtgttgtccttgctgaggtgttgttggctgattcacgattcactcgaccggatatgggttttcacccaacaaaactcaatttcgtgcctagcgatgcggatgaggcgccactcgatgtttccatttgcctgcatgcctttggtattgtggggtgtggttcgtttagtggtgtcaagtcttgcgaacgtgaggacccattccatccaggcctctttgttggggacgctggaggatttcaaagtcccacacgtgaaccactgaacgtgggtggtctagtgcccccacattgttccttaaaatcggttgtctcggatgacgcttgccctggcgcttgctttgttcaacgcgatgctactactcttagttag

SEQ ID NO: 51892 - DNA, 387 bp, Glycine max
  Peptide Sequence Number=SeqID_168670
atgggtattgcttctaacattggtggcttcaggactaaccatcatccttacaaacttacatttcagtttaacaccaaggtcatattgttagatgatggtgcaatcccaaacattgtgcatgatttggtgtctatttctacaatcatggatggtggtcttgattttgattttttagtggagagagaacggaaggatggcaagaagaccaagatgaatgtgattcaacttgcgaatgaaagggtgagaatagagtatactctatttgggaaatatgagttgaatgcctttcttacttatggagaagacaaaatccatattcagaattgcatgatatgcacaaagtcgatttttaattcacaatatgagctagccatggaactaacatag

SEQ ID NO: 51893 - DNA, 588 bp, Glycine max
  Peptide Sequence Number=SeqID_168671
atgagagcagtgcttcagcttcaggctttgacagctcggctttcactttccccctccaacttcgttcgccgcaaaagcttatggttcgatgcaaatagggataactcccaagtgagaaggatatggccttccactcctgtttgtatgggtcgccgttccatcaaaattgccgggagaaagggagcccaagatgcaaagaaaacaaaactatactcaaggatcggaaaggaagtcgtgtctgctgtaaagagaggtggtccaaatgtaacatccgattcagttttggctgctgtacttgggaaagccaaggagcttgatctccctaaagatattgttgaccgcaatatcaagagagctaatgagaaaggacaagaggcttatatcgagaaagcctacaaggttggtagaggtatttttggggaaacagataggtatgggacagaatttcaagatggtgcttgcaccgtagaacttcgtcctgggcagtgggcatatttggatcatctcctttttctgaagaacatgactctcattgttttgagagagaagcataaatattcttgtgtagatacacatctttacaagtag

SEQ ID NO: 51894 - DNA, 804 bp, Glycine max
  Peptide Sequence Number=SeqID_168672
atgaggatgttgcgatggatgtgtggtaagactcgacaggataaaattagaaacgaagctattagagagagggttggagtagcgcctattgtagagaagatggtggaaaatagacttaggtggtttgggcatgtagagagaagaccggtagactctgtagtgaggagagtagaccagatggagagaagacaaacaattcgagacagaggaagacccaaaaagactataagagaggttatcaaaaaggatctcgaaattaatggtttggatagaactactaaaaagccgtctaggttcctagatggggttgaacttggcccagccgtgtgggaatgggtttatggttatggaggagttagtatggtagttgaggtatcaactgataaggtacatcgttcagtgacaaagattagagaagtgataagggactatggaggaaagatggcagattctggatctgtgacgtttaagtttaaacgtgttcggttagtaaatattaaagccactaatgctgataaagatcagctgcttgccattgctttagatgctggagctgaggatgtaattgaacctccaacttatgaagatgacactgaagaggataggtcagaaaggtattataaaattgtaggttcttcagagaacttttcatttataccatctaagctgcgtgataatagttctgagcttcttccaaataccctggttgtggtagatgatgaggctatggacttgaacaaggaacttatgagcaaactacttgagcttgatgatgttgatgctgtttatacagatcagaaatag

SEQ ID NO: 51895 - DNA, 1605 bp, Glycine max
  Peptide Sequence Number=SeqID_168673
atgcttgttcctgacatgcctcataacaatatttctcttcgaaataaaggcttcatctacaaagggcaacacggtattaatctccgagacttcaccaaggcaaatgttgcaagtccatcattacctgtgattgccccaccaacaccggaggaacggaaagaaaccaccgccgacgaccgccatcaccaccaccaccacgttgcatggactagtatcccgcaagagaggtgggaaggagagttacaagttcaaggaaaaattccattatggctggactacaacttccggcacctcttcgatggttacgccacgctggtgaggctcggtttccagaacgggcggttagtcgccgggcaccggcagattgagtcggaggcgtaccgggcggcgaagaagaacaagaaaatatgttaccgagagttctccgaggtgcctaaggcggcgaatttcctggcctacgtgggggagctggcgagcctgttctccggcgcgtcgttgaccgacaacgcgaacaccggcgtggtgaagctcggtgacggcagggtggtttgcctgacggagactcagaaagggtccatagtgataaaccctgagacgctggagacagtggggaagtttgagtacagtgactcattggggggtcttattcactctgcacaccccattgtgacggataacgagtttttgacgttgttgcctgatttggtgagagcagggtaccttgtggtgaggatggagcctggcaccaatgagagaagggtcattggaagggtcaactgtaggggtggtcctgcacctggttgggtccattcttttcctgttactgaacactatgttattgtgcctgaaatgccgttgaggtattgtgctcagaatttgctcaaggctgagcctactcccttgtacaagtttgagtggcaccctgagtccaaagcttttatgcatgccatgtgcaagactagtgggaaaattgtggcaagtgtggaagtgcctctgtttgttactttccatttcataaatgcgtatgaggagcaagatgaagatgggagggtgacggcgattattgccgactgttgtgagcataattccgatactaccattcttgataggcttaggttacagaaccttcgttcatttaatggtgaagatgttctacctgatgctagggttggtcggttcagaataccactggatggaagtccatatggaacactagaggcagcattggagccaaatgaacatgggagaggcatggacatgtgcagcataaaccctaattatttagggaagaaatatagatacgcatatgcttgtggagcacagcgaccttgtaactttcccaacaccctcaccaagcttgattttgaattgaagaaggctaagaactggcatgaagaaggtgctgtgccctcagaacccttctttgtggcacgaccaggagcaacagaggaagatgatggcgtggtaatctcaattgtcagtgagaaaaatggagaaggatatgcgttgctgttagatggttccacctttgaagagattgctagggccaaattcccctatggacttccatatgggttgcatggatgctgggttccaaaagagtag

SEQ ID NO: 51896 - DNA, 422 bp, Glycine max
  Peptide Sequence Number=SeqID_168674
ggatcgcgcccataagacgcccagtggacccggagaagtccaacagggccctggggtttccagctctggttacgggcctctgtagtcctacagggagcccagtggacccggagaagtccaacagggccctggggtttccagctctggttacgagcctctgtaggatcgcgcctgcaagacacccagtggacccgaagaagtccaacagggtcttggagttgtcaagctctaattacgggtctctgtcagttctacggaggcgaaacaccacagtagcctggggatggccggcagcggccaacagatgcaccgccatcacctctagagttcacctcatctcatccacaaaaaaggtctgtgagcgacaagccatcaagcgtccagctcaagacgttaaagaagcgctactagaaggcaaccta

SEQ ID NO: 51897 - DNA, 750 bp, Glycine max
  Peptide Sequence Number=SeqID_168675
atgtatgcaaatgtgtcatcaagtgttggaaacatgtccagcatgtggacatggtaccaaacttatgggctttctgcagagttgggttgtttgactgctgggtacccagctactgtgctgaacatatcagcgagtttatgttttcgtggtcaaagaatatttttacacaatgcaagtggctggtttggtagtgttcctttagaagcatcaggagactttggcattcatccagaagaaggagagtttcatcttatgtgtcagagtttttttgttcgtttgaggagcggtgactggatctggacagatcaacccaagacacacctgatccggtggtcgtttgccggaaaagttgttagagttacgactgcagtggcagctgggaaagtcgccggaaaaggagaaagggccatcagaggaagggcaatgagcagaaatgtccactggaatgtgaaaacaggttgccggaaaacgggcgacaagcataaaggagttggcgctgtgttaatgcaagggggaaggcctattgcctattttagtatggcattagctaattacaactcagctaaatcagtttatgaaaaagagctcatggctttggtgttgtcaatacagcattggaggcattatcttattggcagaacttttacagttttcacagaccagagtagcctcaaaagcttacttcaacagagggtggctagttgtgaccagcaatgctggattttgaagcttttaaggctatcattttga

SEQ ID NO: 51898 - DNA, 858 bp, Glycine max
  Peptide Sequence Number=SeqID_168676
atgacaccatttgaggtggtgaatggaaagaagccgcgttcagtaatacaattcattcatgttgaaatgaaggtagaggctgtggctcaagaattacaggatagagatgaagctttgttgcaattgaagtacaatttagctaaggctcaggaacagatgaagagatatgctgataaaaggagaaaaatgcagaatttaaacattggggatcgtgtttttcttaagttacgaccacataggcaacagtcagtggtgctggggaagttgggtgaggtggcctacaagttacaattgcctccatcctctaaggttcacccggtgtttcatgtgttgcagctgaagaaggctattggggaatatactacagaagccatattgccagctgacctggaagaggaacatgctgatattgttgaaccagaaaaggttttggctaatagaatcattatgaagaatagcttccaagtcaatcagtttttgttgcaatggaaagtaatgcctatggagagtgctacttgggaggatgaacccaatttacgcagtcagtttcctcacttcagccttgaggacaagactgttctttcaggagtgggaagcgatagagttctgaaccaagatgtgggcctggaccatgatatgggcttggattcaaagtccaaaggctggaagacgctccaccactggatacagtgtatgtattggtggaaatttcatcttttggaagagcaagaaacagttgctcggtgtagtgctgaagctgaatgtagggcgatggctttagccacttgtgagcttatatggatcaaacaacttctccaagagttaaagttttgtgaaatccagcaaatgaggctataa

SEQ ID NO: 51899 - DNA, 450 bp, Glycine max
  Peptide Sequence Number=SeqID_168677
atgattttagcagagacaaagtggatattactcttttcagaagagaagttggaaaaaatcattatagttcaaatttatgttgatgatatcatttttggagctactaatgcatctctatgcaaggatttctctgatctgatgaagagtgagttcaaaataagcatgatgggagaacttgtgttctttctagggcttcaaatcaagcaagacagtaaaggacttttctcaaacagatatcagtttgttggaaagatgattcttgtcgcaacctacgctatgacgggacgacgaaggcaaaatagaaaagccaaagcgtccatctccaagggagaaaacgaacggagtcaccaccaacgttattcgaggaaaacattagaaaaaccaaaaatgaggtctacgaattttgaaaataagggttcaggagttgtttatgcatggggaaagtattag

SEQ ID NO: 51900 - DNA, 666 bp, Glycine max
  Peptide Sequence Number=SeqID_168678
atgacgtcttcttgggagggtgggccttgtggcagtagtatggtttttggtttttgccttgagatcaagttgtggaaaccagaaacagcctctttgttcatggagtttagtatattggtcaagagctgggacatagacctctttcagcaacttgctaagaactttttcccgaacaaagaacagatcaagttccatgtgtttggttcttgcatgaagaacatggttgtgagcaagagacacagtgctcatgttgtcccaatgaataacaggaacaacatagctcagaaagaagagattgaagccaggatacttcagcaatttggtccaaagaagacacaagcacctgatgtggatcttctatcatttgggtcagcagcagcccaatcagcatcacaaaaggctgtgatggagaaaggagccgaagctggcaagggatataactcaacggtagagtgtcaccttgatgtggtggaagttatcagttcgagcttgattatccctaaacccaatgagctaactccggtcaaatatgaagtgcctggatacaagttttgccttggaatggaggataattccgaatcagctttgtctacaaacaaggaagctataagtaatgcaactaggaatctcatggagagttcgatcctggctcagaatgaacattga

SEQ ID NO: 51901 - DNA, 192 bp, Glycine max
  Peptide Sequence Number=SeqID_168679
atgacattggatagaagactccaagaagattgggccaaagatgcaagagaagaatctaagtcgatagatgaaacattgattaatgatgactggatcattgcaatggaagaagaacttcaccagttcaccaaaaatgatcattgcacacttgttttcaagccagggaacaaaagaaacattggaataagatag

SEQ ID NO: 51902 - DNA, 828 bp, Glycine max
  Peptide Sequence Number=SeqID_168680
atgtggcttcaagaggccgtgcgagttcacattgtcaacatttactcgccctgcgatattcagaataaaagattgttgtgggatagttttaagcagctgaaaagccccacatctgggggtctttggtgcatagtaggtgatttcaatagcattaggcagccaacagagagaatgggtgtatgccacagagctgtggaagacggtacctctagggagttcaatgattggattgcggagttggaggtagaggaagcaccatgggtaggcagaaaatttacatggttcagaccaaatggtacagccaaaagcaagcttgatagattcttgttatcccctgaatggttttctaaatggtcggggaccgcccaatacacgctagacaggaatttttctgatcattgccctttattacttagatccaaatgcgtcgattggggacctaaaccttttaggatccttgattgttggctcacagattcatccttcagggagatcgttcatcaaagctggtcttccaatcagcaaagtggttggggaggatttatactaaaggagaaaattaaaagactcaaagctaacatcaagaattggaaccgagatcattttggtgacacgctcaataagtataagaagatagaggaagacttaaacaaattggacgaggacaccattgatagacctctagagcctcaagaagtagtgtctagaaagaagcttcaggaagagttatgggtggcagctcaatcgcatgaatccttactaagacagaaagcgagatccaggtggattagaaagggtgttgtaattccagatacttccacttgttga

SEQ ID NO: 51903 - DNA, 246 bp, Glycine max
  Peptide Sequence Number=SeqID_168681
atgggcagcgagggcgtgccgtcgatggtggtggaggtcatgtcgatggccaccgtcgagctcactgacgcctccagctggtggcacgaaattgatgactctccagcgtggcaagatcgtatttcctacactctcgttgtactctacggtatcgtggccaccgtagctttggttcaactggcttggatacaattgagagtggtctttcaccttatcaatattttggtgaatggggtaactgcttaa

SEQ ID NO: 51904 - DNA, 372 bp, Glycine max
  Peptide Sequence Number=SeqID_168682
atgggttgctccataagagagtgttgtgtcttatttttggttttgttggtgtcatgtgctagaggggaagacccttatagattctacacttggaatgttacatatggagacatttatccacttggtgttaaacaacaggggattttgataaactggcaattcccagggccacaaattgaagctgtgaccaatgacaacttgattatcaatgtttacaacagcttggatgaacctttcctcttatcttggttagtttctttctctgatttccttcttgttcagttcactctcaaagaatggagttctgcagaggagaaactcatggcaggatggagtgtatggtaccaattgtccaattctaccagggcataa

SEQ ID NO: 51905 - DNA, 467 bp, Glycine max
  Peptide Sequence Number=SeqID_168683
ccttgtggggcaggaacagtgagctcaagcttcgaagggaagagagagaccaatcacgagcacatagcatggtcttgaaagaagagttagccgcttgctcaaggtacaaaaggaacttgtctcagcgtttatgcaagacagagaccaacatgttagctattgtcagcaaataccaagaagagctaaatctagccatggcccacgagcataaagtggcagacgagtatgcccaagtgtacgcggaaaaggaggctagaggaagggtgattgactcgttacatcaagaggcaacaatatggatggaccggtttgctcttaccttgaacgagagtcaagaacttccccgattgctagccaaggccaaagcaatggcggacacctactccacccccgaggagatccacggacttctcagctattgtcagcatatgatagacttaatggcccttataattagaaaccgctag

SEQ ID NO: 51906 - DNA, 873 bp, Glycine max
  Peptide Sequence Number=SeqID_168684
atgggtgacaacgagaaacaacatccacaaccccatgtagagttaccaatagatgtttcactcactaaaactcaatcaaattgcaagcctcaaatccaaatccaatgtttgtcctgtattctgacacaattccatgcagggtacttcaggattagtttgtccctctcaagccaagcctttctattgaagatcctcattgagccaatccaagatgcatttgctcttagacgtttattttcatccataccctcttctgtccacaccctcctatggttccttgccttgttcacgctagcttcactctcttttctctacattctaaaatgtctctttcactttgacatgattaaggaagagttcttaaaccatgttggagtaaattacctatttatcccttggatttcttggctccttttgctagaatcatcaccattcctctccccagcaacactttattacaaagtactttggtgggtgtttgttgctcctttggtgatgcttgatgtggagatttatggccagtggtttaccaaagggaaggggtttttgtcaattggagcaaatccaacaagtcaattgtctgtgattgggaacttggtgggtgcacaagctgctgcacaaatggggtggaaggagagtgcactatgcatgttttgtttgggtagtacacattatttggtgctttttgtgacactctatcagagattggcagggaacaatagtgtcccttcgatgctgcgtcctgtgttcttgtcttttgcagcaccaagcatggcaagcttggcttggaactccatttgtggcaggtttgacaccacatgcaagatgctgttcttcctctcgctcttccttttcatgtccctggtaatttaa

SEQ ID NO: 51907 - DNA, 192 bp, Glycine max
  Peptide Sequence Number=SeqID_168685
atgaaaaattatataaaggatgaaaatgatgaatggaaagagtgggtcatcattgtcttcgaagatgcaagagggggcgaagtgagtgaggttatcgaaggagaagtaaaagttggtgaagtcgcaggtttcgccacagacggtgacgatgatggagaatcatgcaacgaagatgaggacaacaaaggataa

SEQ ID NO: 51908 - DNA, 1082 bp, Glycine max
  Peptide Sequence Number=SeqID_168686
tgtttcaagaacctgactttgcaagacctagattggatgggagtaccttcaagactatacacagcctccaaaatgatatgctagtgggtcgatttcaggaagatgaggtgaaaaagggttccaatgcatccttcattgctctcattcccaaagtggcagacccactcatgttgaaagattatagacccatttcattgattggttgcatgtataaaatagtggctaagattctcgctaacagactgaaaaaggttctgcataaccttattgatgaaagccaatcagcatttatagagggaagacatatgctgcacagtgtggtaaccgcaaatgaggtggttgatgaagccaaaaggaaaaacaagccatgtattgtgttcaaggttgattatgagaaggcgtatgattcggtgtcttgggatttcctgctatatatgcttaggcgtatgggtttctgctccagatggatacattggatagaggagtgtctaaaatccacatctgtctcggtccttgtaaacgggtcttttaatgatgctcgaggagatatcataatctcacatgattatattactgtgaattctgcttcagctgcatttgatctgtatatgagagttcaaacatcttatcctgatgattttcatcataaaacaaaagattataatattgcgagagccattccgtttactattgatggagttgagttggatttacgtatgcgtgggtttgaattcttcagtttggtttctgcatacgcgatggattccctgaggcctttgcttttgaaagcatctggaaggatcaagtttcagggaaaggttttaaaacctaatggcattattagcgaacagaattttgagatgaccaggcagcatgtgcaaatgttggagaaaggaattgcagatagtctctttggcgaggtttcaatctctggtctcaaactgaatcaactgatgcttgcacctcagttgtctgggttgttgagactttctcctggacgtattaagaatgtggctaactgggcatactgctttccgtatttatggaccatgcttccctttgagacatttgctgacaattga

SEQ ID NO: 51909 - DNA, 483 bp, Glycine max
  Peptide Sequence Number=SeqID_168687
atggggtataaagagagattgagagaatgtaatagagcgtgggtgggaaagggaccaagtcacaaacagatgggaaatggagtccaggatgtgaagctccttgaccaacagctagccgacttggtcattggcggccttaaatttcaccttaacatcctgaagcatggaaggtgcaatgtaaggagggcacgaacaagagaaaaacagtgtggacggtcaggaacacaccagaaacgacgcgatactcagcacagaggatgtaggaatggtgaaccaaatgcccagagagtttcaggggcacaagcatcagacatcaacaacatcccactcgtcactgtagctaaacatacccacggaacagctgaaacgcttcagtaccacctggtttggggggctgaggaactcgtctgctttcgacaaattagaagacgagttcatctgggaagcatgacaggagttgaagacaaagtaccttggggatga

SEQ ID NO: 51910 - DNA, 895 bp, Glycine max
  Peptide Sequence Number=SeqID_168688
gagaaagagccttggtgaggttatcagcgtattggttgagggctggaacataaaccacctgcagcagcttgctgagcaatttctctctgacaaagaacaaatcaagttccatgtgtttgtcctagcatggagagtaggagagcaggattgtgagcaagagatacagtgctcatggagaggtagacagagagaagaggtgagaacgagagtggatcccagaacgaactacgtcaatactaggcttggacaacatcaaaggtatcaacatgcaaattggagggagagagctgacatcacaaccttctacttcacgagattccccgaacacacaacagagaaggatctttggacccagttcaagaaatggggagatgtgagggagatcttcatctccaaacataggaacaaaggtggcaggagatatgattttgtaaggttcaaaggggtgtccgacaagcgcagattagaaagacagcttaataatatcatagtcggtggcctcaagatgtacgtcaatgtcccaaagtacgggagaggaaaggagaggcatgaagagcataatgtcaaacccaggacccaagcggatggttataacactgaagtggaagcttcgggacaaacgataaagcatcacagggctgcttccatgacatgcgaaagcgatcccgacgggggagaggaaatggtacacaaatgcatggaccgtctaaagaaaccggggatattcgaaagagtcaaagacgaacatccctgggagataggaacaaacgtcgtgccgaaatacattggggatgacatgatacttctccttggtctctcggataccaaagcggaagagctcatcactaaagaaaccaaacatgacacatctccgttccatttgttagagaagtag

SEQ ID NO: 51911 - DNA, 669 bp, Glycine max
  Peptide Sequence Number=SeqID_168689
atgcataaggcattatgggccaatgcacctcttccatatcctcaattggtcaccctttttctccgtcattttcaaattcctcttgatgatgaaccttttgttcaagtcaagcgatcctttgctataggtgctggtgcagtcacttcatttggttaccgtaaggatcgtaatggtcaatggctgaagaaagatgcgctacctccacaagacgagcgtactccctctcctcctcctcaacgagatgattccttcacccttctgactgaagttctttcaaagttacgaggcctctgcacctatgttggtgaacgattcgattctttggatggttgctttgaaggcatggatacccgcatcacccaacttgaagaggatgaattaaattgttatcatcaaaaagggggagattgtagaagcaaagactttgcctttgatgttttgatgatgccatatgatcgtgaagttttgatgccttataaaaatgcgtttctcaagtttaattcaagacaaaaatccaagaatacaagatacaacatcaagaagatctctagtgttttaggaagggaattccaaattcaaactgcaaaaggtttggccaagaaatttaagcaaaaatgtctttttcaagagatttactctctagtaatcgattaccagtggccaaaatga

SEQ ID NO: 51912 - DNA, 447 bp, Glycine max
  Peptide Sequence Number=SeqID_168690
atgttgtacgcagccttacccttgcatatgcaaagaggctgtttccggattcgaacccatgaccaacaagtcaccaaggcacaactttaccgccgcaccagggctcgccctcgtgttttacagcacacctgcattcccaaatcttccaaacaccataattcactcatttcttcaccagatcgactcccacaacttccaatcctcttctttttcgattctctattgattccaccgattgaaattctcaaaaacaaaacagcatggcagaatcgtccaagaaacgaaagggatcttcctcctccgctgcggcaacaagaactcaacgtcgcagagccaccgaagcaccctcggcaccaattccaccctccttgtcatcttcaacattattctcttctgacgaacagcgtcaccggtactcctctccttttcatctcgacaaattcttga

SEQ ID NO: 51913 - DNA, 591 bp, Glycine max
  Peptide Sequence Number=SeqID_168691
atggttggagcattctcgcaaaacatcgtgaccctgactggtctccctatgatcttacttagtgagagtgacctgacaaacccattgtgtgatgtgtcttgttatgtactcctaagcgccccagggtggtttttcactgacatgagggtgtcacataagacattgcggtccaatgctcctctgccctatcctcagtgggtcactttatttcttcgtcatttcaatgttcctcttgagtctgaaccctttattcaagtgaaacattcctacgctattggtgttggcgtggtcacctcttttggctactgtcgagacaaagatggtcaatggttgaagaaagatgcacaaccacagcaagaagaatgcactccctcacctctgcctcagagggatgactcatctgcactcatgcatgaagttctctcagaattacgtggtctttgcacctatgttggtgagcgcttcgattccttagatagtcgcctcaatgccatcgatgctcgttttgctgggatggacaatcgcatcacgcaacttgaagacgacatgagcttcatccgacgattctttgatcctcttgcagattcgtag

SEQ ID NO: 51914 - DNA, 729 bp, Glycine max
  Peptide Sequence Number=SeqID_168692
atggaaattgatgtcttctccgtaagagaaaagattctggccaagcagctttccattgtgcatattccaactctggatcagtgggcagatgtactgacaaagtttctttctgcaacaagatttgaagttctcagagacaaactcaatgtgaagaggtcattagcttttgctaacaacacctctctagtgttagatagcagattatgtgctttgtacgggctgttagctttgctaattgtacctcactgtagtgtggttgcactgaaaaacctcgatggcagccaacgaaggcccgtagttgcgacgaaaggaggcagttccaatgtgatgctcaccggagatgcatcacgcgccatgtgtgtgaacctctctcgttggaaaagggccctgcgtggggccattgtggcgatgtgtagagttggctgcgactgtggacggcacggtgttcttgaaaggtcattgaagcaaaccgacaagagggcggtgaactggcttccaaacaggcccaatagtgggcgtgggtactgttcacctggaaagaaagttgcacatagacaagtgagtgtcaccggagaagtgacggtggtcgacagtggccggaaaaggagaaaggttcatcagaaagcagaagcaagtcgtcaggataagtgcaatgaccataaaggtccattgagaaaagtaggtccttggtgggggacaatttttgtaattccctcaaccttgttctga

SEQ ID NO: 51915 - DNA, 174 bp, Glycine max
  Peptide Sequence Number=SeqID_168693
atgttgatggttccatcaacaggttcagagcaagataggtctctagtttgcaagctcaacaaagctctctatggcttgaaacaggctccaagacaatggtttgacaggctgaaatctactctgttgcagtttggatttgttgggagcaagtgtgattcttcccttttcatctaa

SEQ ID NO: 51916 - DNA, 1533 bp, Glycine max
  Peptide Sequence Number=SeqID_168694
atgggtgtcaaagttgatagaatgacacctctgatcactattgaaaaaacggttttgcaacaaaactacagttgttatgaacttcaaggtgaatatgtgttgcctggcaccagagatcgtaatcctgttgacaaagaaggtggccttataaaaaggcttatgtctggtcatattggtaatgctatatcctcaatgggcaggtggagaatgaaacttgaagttcgtagagcagaggttgctgagatgcttccccttgctcggcttctttctcgaagtatggatccagctgttcggtcaagatctaaggttgtatcactatcattatttatgtcttgggagcctaccttctacaaccctcctttggctccatacaacaaatcgccccaccccaatgctctgctgtcaggttggaagacagtgagggggcttcatgctccatcaaatgatgttgttcttgacgatttaagtctgcctggtttatctgaactcaaaggtcactggcatggatctcttgatgctagtggtgggggaaatggagacacgctggcagaatttgactttcatggggaggactgggagtggggagactacaaaactcagcatgtgttggcagttggtgcttatagtaatgatgacggtatgcacctggagagaatttttatccagaaggataatgccaccatccatgcagatggaacattgctagggcctaaaaccaacctccattttgcggtattaaattttcctgttagtctggtcccaactgtagttcagatcattgaatctacagcaatggatgttgtccattctctgcgacagttgttggcacccattaagggtatattgcatatggaaggagatcttagaggaagtttagcaaaaccagaatgtgatgtgcaagtaaggctcctggatggttccattggtggtgttgatcttggaagagccgaagttgttgcttctctaacctcaaccagtcgttttctattcaatgcaaaatttgaacctataacccaaaatggtcatgtactcattcaaggtagcattcctgttgcgtttgtgcaaaataacacattacaggaagatgtagaattagataagagtcaagttacttgggttcctgattgggtcaaggagaagaatagagggaccgtcgatgatgccagcgacaaaaaagtttctagagatagaaatgaagaaggttggaatactcagttagcagaaagccttaaaggtttaaattggcaaattttagatgttggagaagtcaggattgatgctgatataaaagatgggggaatgacattggttacggctttgtctcctcatgcaaattggcttcatggcaacgcagatttgaagcttgaggtgagaggtacagttgatcaaccagtacttaatggacacgcatctttccacagggcatctatttcttcaccagtgctccgaaaaccactaaccaactttggtggaaatgttcacgtgcaatcaaacaggttatgcatcacctcactggagagtaggatttcataa

SEQ ID NO: 51917 - DNA, 204 bp, Glycine max
  Peptide Sequence Number=SeqID_168695
atgcagagggagtcccaatttgaaccttttgatgtagaaatgggagattgcttagaggatatgatttgtgatcttggacaagagtcttttcagcaagcacatggccctatgtatgatacattgcaaagtgattcgaagaaccctttgtatccgaggtgtaagaagtcattgatgttgttgtcagtggatgctaagtctagttaa

SEQ ID NO: 51918 - DNA, 774 bp, Glycine max
  Peptide Sequence Number=SeqID_168696
atgagggcgagccctggtgcagcggctgcgtacaacatccctcccccataccttcgcatagcgaagagcctctgggcaatggggaatagagtgagaaaaactgagagacagagtgggtttccacaaggatctgcgattgacacacgccgaaaacaaggaggagctgtgagtgacgtgcataagctagctagacagttggaccagattgttattggaggtctaaaattgtacgttaacatccccaaatatgggagagatacgacaaggatggaaatggcattacctgaaccaactaggcatgatgttaaacggcagcacaccgcacgacattggggacaacataatggactcaacagtttgatatcgtatgcagaagtggtggctcgagacaagcacaccggcggccaagcgaagggaatagttaatgagaatcacaatcgtcctgcatcacactcgtcgctaaccattgacattcctttgaatgacaagaaatggtttagcgaagcttgggtagggcgcatgaagaacttgatatggtttgacaaactcgaagaagaccctctgtgggacttcggagcagacataactccgaagtacctgggggacgacatggtgttattacttgggctctcagatgacagggctgaaagaatgatgcaagaggtagaggctaacctgggtccaatgctggggcattccacttatagcatgggagaagaaatatttccagcagatcgtggcggcaatgggggatgtggtggatgtagacaatga

SEQ ID NO: 51919 - DNA, 336 bp, Glycine max
  Peptide Sequence Number=SeqID_168697
atgatgcaaggtaatatatggatatctccgaacacccttggtttggtgcaaggcatgacacttctcaagtttcagataagaccatctcttgaaaaatccatatttgcacctaaagattattcgagttcacagttcagaggccttaaggttgtgttagccaaggatgatggtataaacaggaccgtgaccaagaagctacttgagaagcttggttttcatgtaattgttgtttcatcaggatttgagtgcctgagtgctatcagtggtgctggtaactcattcagaattatcttgttggatcttcatgtgacaccctttaccccgacatatatataa

SEQ ID NO: 51920 - DNA, 795 bp, Glycine max
  Peptide Sequence Number=SeqID_168698
atggagcaaatacagattaaaccaaatgttgaaatccgtctcaatgatttgaagcttgtgcttggaccagagttgaagatagtttatcctttgattcttaattttggtgtaagtggagagcttgagttaaatggtcaggcccatcccaaatggataaaacctagaggcatactgtcatttgagaacggtgaagttgatctagttgcaacacaggtgaggttaaaacgagaacatttaaatattgcaaagtttgagcctgagtgtggactagatccaatgcttgatttagctttggttggatctgagtggcaattcagaattcaaggtagagctagcaattggctgggcaaacttgagatgacctcaacacgttctgtggaacaggatgcactttcacctgctgaggctgcccaaagatttgagagtcaattggctgagtccattttgaaagacaatggtcagcttgcttttgaaaagcttgcaactgctactctagaaaaattgatgccacgaatagaagggaagggagagtttggccaggctaggtggaggctagtgtatgcacctcagattcctagtttagtttctgttgatcctacagcagatcctctcaagtcacttgccagtaatatatcttttggtacagaagttgaagttcagcttgggaaacgtcttcaggaatcgcatgaagatagtccaaatggaggcttcaatcccttctacgtttctctgacgtttgggaactctatcggagcagtcggaggagaaactgaaggaatcttagggaaccgctag

SEQ ID NO: 51921 - DNA, 276 bp, Glycine max
  Peptide Sequence Number=SeqID_168699
atgtgggagggatattgtacgcagccttacccttgcatatgcaaagaggctgtttccggattcgaacccatgaccaacaagtcaccaaggcaccaagtgcacgtgtacataacaaggcaagcaagagttgcaagacccatttccagactcctattaactgaaaatgaagttgcacaagttaatttgatgcaagtcaatcctgggatgtggcagaatattcaaaaagaaggcgtttggatggagcagattgtaggagcactcgcaaacgacttgtaa

SEQ ID NO: 51922 - DNA, 1617 bp, Glycine max
  Peptide Sequence Number=SeqID_168700
atggaaaaaggaatcaatattgattacaagatcaatcaattactgattaatagagcgggtcgttcctgctcagcctactgtccgctgtcgcccgttgtctctggccactgtcgccggtcaccaccattttttccggtgatcgctggatttggtgcgtctcaccaagcatggcccagcccagaagaatcggaactcaggcacgacaccatggttagggttgttggcctcttccagtccagtttcagtcttcagatcatcatttcgttgctgtttaaaaatcaaggtccatggataatcgattcaggtgcttcagatcatatttctggcaatgcttctttgtttagttctatgtcttccccaaagtttcctcgtctcataaccttagccaatggtgctaaggtagcttctaaagttgttggtcaaatttcattgtctccttctccaaacttggaatctgttgtctttgttcctaattgtccctttaatttgattcctttaagtcagttaagcaagactctactacctagaaaccaattcttctgtgtcctgaagaaactctttgctgaggttcctgctaggtctcagtctacaggaactacttctacacatgaggtttcatctacttcagggactaattccaccaatgaagtttcatcttctgcaagtagtcctgaaccagcagcaactacactccctacttcagtgcaatccattgcagaatctcctcctttgctggtcagacctgataatactcactcaatgtgtacaagaaaaaaagctggtattgttaaacaaaggctgcaaccaactttgcttctcactcatgttgcacctaagtccaccaaatcagctctatctaatcctacatggcatgcagctaagaaggctgaatatgatgctcttcttcttaacaacacttggacactagttgatctcctttcctcaaggtctactattgaattcttgactcttactgttactaacaaatggaaacttcagcaactagatgtcaacaatgcctttctaaatggcattcttgaagaggaagtctacatgactcaacctcctggatttgaggactctaacaaacatctagtttgcaaactaaacaaagcccctaggtttgacactactactgtggagtatatgctggtctatgtagatgatattattatcagaggcaataatcacacctttatcaaatctctggtttctaaactcaattctgagttttctctcaaagatttgggtgatcttgactattttctgggaattgaagtcagctctcaacctaatggatctcttctactcactcagtccaagtacattagagatttattggcaaagattactatggatgagcctaatttttctgtctctctcactattctgttcatgcctattgtgatgttgactgggcatcagatcctgatgatagaaggtccacatcagaccacagatgaagtaacatggattcaatctcttttggctgagctcaaagttcctcatgctcctcctgttattggaaaacatattcaagtggttcatgtccgtgctgctgatcaaagagcagatatcctcactatagctctcacaccctccaacttcactgcttaa

SEQ ID NO: 51923 - DNA, 486 bp, Glycine max
  Peptide Sequence Number=SeqID_168701
atggcttctactccttcgaatttcatttctcagttgttcccaaactctatcgctgagaaacttgatgacttaaactatctccattggcgtcaacatgtagaaccagttatcaagttgcacaagttgcagcgttttgtcatcaatccgattgttttgcctcgttatctcatggaggatgatcgaattgctgatcgcgtgaatcctgagtatgaagcttgggaggttcaggatcaaacgctccttgtttggcttcaatctactctctcgaaatcagttttgtttttgggagaagttcatgagtactttagtcttcatacgaagtcccgtgctcgacagtttcgcactatgatgcgcgcggttacacttgatggaaaatcaatcaatgagtatttgcgtaaaatcaaaggatatgttgatgaactcgctggcgttggagttcctgttcgtcacgaggagtatgtcgatgcacttctcgaaggactatag

SEQ ID NO: 51924 - DNA, 300 bp, Glycine max
  Peptide Sequence Number=SeqID_168702
atggtgctaaccatttcccttgcgtgttgccacgtggcatcaaaggtgatgagaacgaggctggaggaggggcctagggaggagatgtggagagcggaggcggaggtggatgaagagaagaggaagaaggcctatagaaagcaattgaggaggggggataggccgttgcggaggtggttggcggatttgggtggtggtttggattggaggaagtggaagtgtgtggcagagacaaatgcgattgggacggtcgcagttggagcagatgaagcaacgctggtgaaaaggctcctccaatga

SEQ ID NO: 51925 - DNA, 243 bp, Glycine max
  Peptide Sequence Number=SeqID_168703
atgaacaaggacaaaacccgagtccgaaccatagatattgttgtttctgtaatcaaagcttcagagaaatcaaagaagaagatgaaatgcgattccaacaaaggaaaagaccttaatgtgggttcagaagcgattgggaagaggaaaagcgatgaagttgagaaagattgggaagaggaatgtttggtaaaatgtgtgagcctaatcatgctgaaaaacgagtcaagcacaggcaaggtttaa

SEQ ID NO: 51926 - DNA, 336 bp, Glycine max
  Peptide Sequence Number=SeqID_168704
atggagtggttttataagatatctcacccacttatgagtctgccacaacttggggagcctcctagacatcaacccatggtgcatgatgatacatatattatagtagatccacttgtgttgcccgttcacacaacaactatgccacaaccacctgcacttgcagctattgatgcaaatatgcctcaacatgcaatggctgcttaccaaaagatggcaaaaagcttggaacacatgataaatatgaggatagttactattggaactgatgcatacactttgactgagcactatttaggattagccatctattggcgacatgagacaaccatctcttag

SEQ ID NO: 51927 - DNA, 426 bp, Glycine max
  Peptide Sequence Number=SeqID_168705
atgaatagccacaaagcataccttgttctgatggctttagagttaacttgtattggaataaagtatggagtctccgacaacaccaatcccttccagcattcaactccaaccatcttgctttttctcactgctatgatttcccatgtccttgcatccacggccgacatgacccaccaaactacaaccctaaccttccacgtgtcaggggtagttgggtgtcagacactactgtggattatcgtggctcaggtcatgtggtactacgtaatcaacctccttcttttacttgtagcctccttccgcttcttcaactatgtcactcagctgctatctgctacaccttcgaatgctaatgatctcatgtccaacacggaactgcagtcgcaagaagctcaggattccggtttacactccttgtggcagtaa

SEQ ID NO: 51928 - DNA, 264 bp, Glycine max
  Peptide Sequence Number=SeqID_168706
atggttggagcattctcgcaaaacatcgtgaccctgactggtctccctatgatcttacttagtgagagtgacttgacaaacccatggtgtgatgtgtcttgctatgtactcctaagcaccccagggaatgtgataactcactccctgtgtgttgttgtctttgaatcctgtgatgatcttgaacttgtgttcgggggagcagatgaatatgtggatgactatgaagaacctcatgctagaggacacgggaacacaacgctctga

SEQ ID NO: 51929 - DNA, 282 bp, Glycine max
  Peptide Sequence Number=SeqID_168707
atggtgaaagcggtaaagactaggtgcggtgatagtgacgataacaacggtgaaatggtggtggtaatgatgataacgatggtaggattggataatgataaaagtagtgaaaacaatgatggaggcaacaaatgtggggcaacaacaacggtgtgtgatggtagtggcagtagcgatggtgagggcagtgtggtgacaacaacagaggtagtgatgagagtaggtgtagatgtggtagtggtggtggtggtgacaatggtagttttggaatgtattttttaa

SEQ ID NO: 51930 - DNA, 192 bp, Glycine max
  Peptide Sequence Number=SeqID_168708
atgaccaatattgccattaaagacagtatgaatgatgacttgggattcactatagctggacaaactgctcctcttaattgttgctgcaacagtactaatgagaggacccctccaactaggccaagtagcaaaaggattaatcaaggtgaccagaagccaattaaaggtgctggcaagacgtgcaatctctaa

SEQ ID NO: 51931 - DNA, 513 bp, Glycine max
  Peptide Sequence Number=SeqID_168709
atgtctcttgctactttgtttggaaagttacaggaacatgaaatggaattgataagattaaatcaacatgaggagaatgataagaaaaagaaaggaattgctcttaaagcttcatcatcaacccaagaaggaagtgataaagaggactcaattgaactagacaaagatgatgatcttagtctatgtgtaaaaagatttaacaaattttttagagtaagaggaaatcaaagaagatcaaattttaaatcaaagaaaaggacagaagattcatcctctactccaagatgttatgaatgcaatcaacctggacatttgagggtcgattgtccaatgttcaagaaaagaatagagaaatctgaaaaaaaaaaaaaagtcctcaatgaaaagaaggcctatattacatgggatgacaatgatatagactcttctgaggaatcagaaaacgaagctgtaaacctgagtctaatggctaagaactatgaaagcgatgaagagaagaaatcaaagatttaa

SEQ ID NO: 51932 - DNA, 408 bp, Glycine max
  Peptide Sequence Number=SeqID_168710
atgcacccagcaatattgctggggcacccagcaaatagtgaatggacaattttacccttctgcgaaggctgtttccggaagacgtcactccgaaaaacttccggaaaaaccttcttccgaaagaagaatgtgagattccggaagaactccagaatatgttccggaaggacgtgctccggaatttttccgaaagaagggtcttccggaagaccaccttcttcttccggaagaagttactgcgctgctttttcgttttacacacttccatttcaccttcatccccgtcttcttgctattgctatccttttccgtaaaaagcttttctggtggtctcgtgaagtagttgttccgtatttgaagatttggtggtcccgtgaagcagttgttccgtatttgaagttgtgttag

SEQ ID NO: 51933 - DNA, 1851 bp, Glycine max
  Peptide Sequence Number=SeqID_168711
atggattcagatccaattgggagcttcttcctccataagccaattgttctcaactctttctcagctgaagacacaaacaaccacaaccccgagtggaaaaaactcagtcttcacaacaacaacatggatgccacagttaccacaaaagactacaccatccccttccgaatcaaccttagctgttcttctgcagacaatcatgatgatgtctcttcaccaacatctctccgtagcagaaccgagatggacttcttctccaacaagaacagtaccaaagatgatgacaacaacatcgttgctgcggctggttctgcctctctccccgacaatgatcatcattccatctctccacccacgttggatttaaaagtaaacacttgtctgaatcttcttactaccaatgctagtagcgatcaatctatggtggaagatgagatatcacccaattcagaagacaaagaaactaagaaagagatggctgatcttcaaggtgatcttgagagaatcaaaagggagaatcaaaagttgagggacacgcttgatgaggttaacaccaactacaacgcgcttcagatgcactttatgaatatgatgcaggagcggaagggcgaggaaggtgaagatcagcaagaagtgtctgatggcaaggttaaagagaagaagcagggtcagagtggtggtggggtattggtgtcaaggcagtttatggatcttgggttggctagcgctgatattgaaccctcatcttcatcagggggaataagaagtcaagatagatcaggatcacccaacatagatgtggcttccaagggattagggactagtaacaatgatgggaataatagtgttaatgatgaagaagagaaggagtatgatagagggattgagagcgaagatagtccttcagggcatgctgataaagttccaaggttcagtagtccttcaaagaataataatgttgatcaggctgaggctgaggctactatgaggaaggcaagagtttctgttagagctcgatccgaagcacccatgctgatggagaagttttttactttggctcagattactgatgggtgtcaatggagaaagtacgggcagaagatggccaaaggaaacccatgtcctagagcttattatagatgtaccatggctgctggttgcccagttagaaaacaggtacaaaggtgtgctgaagaccgaacagtccttatcacaacctatgaaggaaatcacaaccatcctttgcctccaacagcaatggcaatggcacaaaccacatcctcagcagcaagaatgttgctttctggatccatgtcaagtgctgacagcataatgaatgcagacttcctcacaaggacactccttccttgctcttcaagcatggccactatctcagcatctgctccattcccaacagttacattagacctaactcattctccaaaccctctacagttcccaaggcagcagcatccaaaccagttgcaaattggtgtccctcagaattttgcaaactccccatcatctttaatgcctcagatattcggacaagcactttacaaccaatcaaagttttctggcctacaaatgtcatcacatgatacagcagacccttcttcacaatttggttaccaacctcatcaagttccaccacaccttgctgacacagttggtgctgccattgctactgatcccaatttcacttcagcattggcagctgctatcacttccatcattggtggtgctcagcaacaacacagcaacattaataataatagtaacaataatgtcaacatgacagccaacatcaacaatggcaatggcaacagcaatggcaacggaaagcaataa

SEQ ID NO: 51934 - DNA, 942 bp, Glycine max
  Peptide Sequence Number=SeqID_168712
atggtagcttccttctaccttgatggtcctgcactcagctggtttcagtggatgttcaggaacggagttatcacttcgtggccagctctcctccaagcaatcgaatctcgcttcgccccctcgatctacgatgacccacacggagctttgttcaagttgattcaacaagctcttgctcgtcttcaggaagacaaaattaacgatcaccggaaacacatccggtccttatttggccacccaccaccaaataaccccaccccctctaaccctcacactacccagacagctcgaccgaaaccccctttcctccaaagaacccaagaagacatggcctacaggcgcgaaataggcctgtgttataattgtgatgaaaaatggagctcatcccatcgttgtaaagggcgagttctcttctttatcacagagtccgatgagtctccaccatcggagatgatcacagtagaaccctcaaacccttccgtgaccgaacccgacccaatcatagatgatcccagccagcttttcgacccaacttcgcttcaaccttatataagtctccatgccatggctggcgtgccggccacggacaccttcagattatatggtcttatcaacaacactcgcgtcaccatactagtggacagtggcagcactcataaatttgttcatcccggtgttgcgaagttcctcaatctacccatgcaagatatgatgcctctcagagtgatggtaggcaatggctccattttggactgtcggcaactgtgccctgataccaagatactcatccaagatcacaccttcgtcgtcaccttgcgcgtcttgccattaagtggagccgacgtcgttttgggtgtggaatggttacgtatgttaggcccagtcgttactgactacaccgcttttactatgcagttcaccttttttggtaggccaatttaa

SEQ ID NO: 51935 - DNA, 1191 bp, Glycine max
  Peptide Sequence Number=SeqID_168713
atggagacttatataaggttgaagcgaagttgggtcgaaaagctggctgggatcatctatgattgggtcgggttcggtcacggaagggcctatttcgcgcctgtaggccatgtcttcttgggttctttggaggaaagggggtttcggtcgagctgtctgggtagtgtgagggttagagggggtggggtactccgttactgtaccttgttgaatcaacttgaacaaagctccgtgtgggtcatcgtagatcgagggggcgaagcgagattcgattgcttggaggagagctggccacgaagtgataactccgttcctgaacatccactgaaaccagctgagtgcaggaccatcaaggtagaaggaagctaccatgatacgatcctcttctggagttccttggtagtcgaaagactgggagattttgaagatccatccaagcgggtcatgaccgtcaaaacgcgaaacgtcaagcttgactggtggccgagggacctaaggaggtggtggcgtagtggaagacatgtgagagagacgctcgcacatggcctcaaacttgttggccaagtcagaatgtttctcggtgagggaagcaatggcctcctcgaggcgatctgtggtggtgcagcgggttccatgctctgccatggaaaagggcaggtcagaccagttgttgagagcaaaccctttatatacaattgtgctcgtactgctatggtatttgggttgtgtggtattcctctttggcctttctttatgtgtttcttctggtgccaacgcgatgtcttccatgttctctccactgttggtgctatcagaattgttgtgattcaggagtggtggggtgtggactttgaaattaaaaatcatgctgtgatgatttctcaacttggtcgtggatataaagctcttattccagatctctacaaaggaaaggttggtctggatgttgcagaagcacaacatttgtttgatggtcttgattggcaaggtgctgttggtgttactggattttgtatggggggtgctctctctgttgcaagctcagtcttggttccaaatgttgatgctgctgtagctttttatggagctccttcttctgagcttgcagaccctgcccaagccaaggctcctattcaggcccactttggagagctggataattttgttggattttcagatgttacagtatga

SEQ ID NO: 51936 - DNA, 366 bp, Glycine max
  Peptide Sequence Number=SeqID_168714
atgacaaatgttctatggtgggaatctatgagatgggttcgggtagttggtcccctttccattaacccaattcatcatttataccaattctgtgaggggtttggatcgaatgtgaattatagttcaagatgtgggtggtggatagccttaaccatttctatatggcagcataggaatcaattgattttccaaggaaaaccttttgatccctgtaaagtcatggatcatgctatttacttagcttggtcatgggtagcactctggtgccttgtaattctgctctttggtacctctggtgatcttatgatggctcaggtagggggtcccaacatagttgtgatgtcctacctcgctgccattctttag

SEQ ID NO: 51937 - DNA, 309 bp, Glycine max
  Peptide Sequence Number=SeqID_168715
atggaatctattccaaacatatataccatggttccttacctcgacagggtacaaatatctaaatttcatatttttagagtcttgcccaactggttctttccattccctgaagtgattgcaacaacttatgatcattataattctaggcaaacttgtggtcgtgaccgtggtcatagtcgtgatcatggtggaggacatgacggtgattatggtcatatggagactactcaccttgatgttgttgatttctttgttgaaccagatggaaacattgatcaccttattggtgatgggagtgtcaataaataa

SEQ ID NO: 51938 - DNA, 261 bp, Glycine max
  Peptide Sequence Number=SeqID_168716
atgacatcagaatgctgttgtcgacaggtttgctgcatctgcctggcaaagtatgagaataatgatgagctgagagaattgccttgttctcatcttttccacaaagactgcgtcgataaatggttgaagataaatgcattatgccctctttgcaagagtgatgttggtgagaacttaacaggatcggtctctggagaagatgccagccaacaacagggtgagagcagggttgagaatggcctcacgaatacctcagtctag

SEQ ID NO: 51939 - DNA, 2679 bp, Glycine max
  Peptide Sequence Number=SeqID_168717
gtggactcaaccagctctgagttcagttggatctgcatcccactcatcggtgcacctgagtatacttgtatactaaaacacatggctaaacaggacatgggtgggaagattgaggaagctcacattactaatgctgcacaaatagcggtggaagtaaacgcacaacgctcggcaatattctactccctggaaaagtggtcacctcaactaaagactggacaccgtctggtggatgacgacatggatgaactccacaggctggacagggggaggatattggttaagacatcacgaccaccattaatccaacataaggtcggactatggattaacggagtagagtacaacgaaataacttccgtcgatagtgatagcgaagcagggacacaaatgacgagtggagatgtgttttctgatacagaaatgtcgtcagaggatcatcggccaagaatggtgggatgcgagaaggaccaaggagacacgatgatacaacagactgaaggacaacaccagcctgttagtccgcaggtcaataaccagcggtcactgttgactacaaatgagtgggccatactacagacctgcaatggtcaaagaggaactgatcgaagcaaccttaggtctgataaaagcaaaataattcaggcacaaggaactgctgaggtgtcaaatcgtacccctaacagccagctagggaaggaggataaggcaaatgaagacaaaaaggaggaggaggtgcttaaggaaggaggaatggtggcagcagaaattccagaaagagaactttcacgggaatcacaaaactgcaaggaggacaatgggaaaaaggataagacaaatgaagacaaaaaggaggaggagatgcttaaggaaggaggaaagatggcagcagaaattccagaaacagaactttcatgggaatcacaaaattgcaaggaggacagtgggaaaaagggggtgcagaaagaaatatccataatgaacagacaggctgaagacatgtgggaaaggtgtactcaagaagtaaagggtgtagaaagaaactggaccaaggaaaaggctgtgttaacaacaccagaccaagcgcagcctgcaactcaggctccattgcaaaaagatagtcatcagacatgtgatcagctaatggaagcatcaacacaatgggagatgacacaaaacttgggagttacatgcgaaggaagagatgcaacaataatcaccaaatttatgaagatggaggtgagggacaaggaggacgctgacaagttgggtagcaggaggtttaaagaaattggacagcagcacattgttaggctgttggggccattcactgaaaaagaaattaaggatgcgatttgggagtgtggaagtgataagactcctggtccatatggtataaactttagatttattaaggaattctgggaagttctcaaggttgacgtgctgcggttcatggacgagttctatgtacatggatctttcccgaaggggtgtaatgcattcttcataacccttgtccctaaggtcaaggacccgcagaaccttcataaattcagacctatttctcttataggttgcatatataaaatggtgtccaaggtgctagcaaggaggtgggtaacttggattgaaggctgcctaaagtctgcttccatatccatattggttaacggaagtcctacacctgagtttattccccaaagaggcctaagacaaggagaccctctatccccgttcctgtttaacattcttgtggaaggaccaaacgcgctggtgaaagaagcaatggataaaaacctgtttcaaggtttcaatgtgggcagaaatgaagtcaaagtcagcatattgcagtatgcagacgacacacttttccttgggaaagtatccatggaaaatgtgaaagccattaaggtgatcttgagaagctttgaactagcttcaggcttcaaaattaacttttcaaagagtagatttggggtgatcgggatgtcagatagttgggaggcgtctactgctagttatctaaattgtgagcttgtggacataccttttctctatctgggtatcccgattggttcatacccaaggggctcagagctgtgggatcctattgtcaaaaaatgggcagagcataagaagatagcgtgggtgaaatgcgagtcggtatgtttaccaaaggataaaggaggaatcggtattaaggatcttaggaagtttaatcatgctctgcttggaaagtggaaatggaacctgttccataatcaaggagatttgtgggctagaatactaaattcaaaatacggtgtttgtggtaacttggagggggtacgtcgaggtggtagagtatcagcttggtggaaggatataaacaacatactctttgatgacatagggtgggaatgggatttcaaatggagacgccaattttttgacaccgagttagatttggctgtgaggttcctagaagacctagaaggtaccaacattcattcggaacgactagacaagtggatttggaaggaggatggctcgggattatacacggctaggaacaggtataggctgctcctgtcagaccagattaatgacaatcaggatggtgcatttatagagctgtggaaggtcaaggtccccatgctggtggattttcctgacatggagtacttggcaacatag

SEQ ID NO: 51940 - DNA, 414 bp, Glycine max
  Peptide Sequence Number=SeqID_168718
atgttgaggagcttcgagctggtgtcgggactgaagataaactttgccaaaagcagatttggtgcgattggggcaactgagcaatgcatacttgatgctgctacggtgccgaagaaagtggtggataggctggtggggctgcagaggagaaagggggcttgggtatcagggatttgggaaagtttaactttgctttactcgggaaatggcgctggaacctatttcaccatcacggggagttgggggcacaagttctggaatcaaagtataggagttggaggaatttggatgcgacaaggaggtccatcaaagaatctctctggtggcgggatcttagttttgtttggaatttgtctgaggaggggagctggcttaaagaatcaaattttggctagttgggtacctagcggttag

SEQ ID NO: 51941 - DNA, 333 bp, Glycine max
  Peptide Sequence Number=SeqID_168719
atgtcacaaaacagaggggcaacttctgaatctattaatgctttgccgatttacaagttcaagatgaagaaaaataaaagaaatggcaatggcaactcagctgctgccgaaggtggagttgtggctgcaggaactgaaaaagagcatgtgatatctggagaagatgcggaggactcgcacgatttgatggcgttcgacagaggtaaggtggatcttgacgaagaggaagagtcactgtgtagacgaacattctcaccacttccagagagacctacatggacggagatggggatgatgaaagaaagtgagggagagagagaaagagggcagtaa

SEQ ID NO: 51942 - DNA, 774 bp, Glycine max
  Peptide Sequence Number=SeqID_168720
atggatgttattgttgtctcactcaatctatgtcttgaaggttcgagcggcactttgccattgttgatggagcggtccgggagcttaaacagcagtcagcatgttatagaaatagctgggagcgccgatgcttccacatcgtctgcatcacatcatgatagacattttaatggcacaaatgtgacgcagcatgaagaaagaattagcggtgcaaggatgcctctttctcagccttcagtttcagcaactagtgtatctaatgggtcaaatagtcgaaactcatcgttcataagacgaggggatactcggcggaataggagtcctgtgcattcagggttatggatatctattgagctggtcctactcctgagccagattgttgcatctataattgttttgtctttgtcaaggcatgaacatccgcgtaccccgttgtttcaatggatcattggttatgcttctggatgtgctgctaccctccctctactttattggcggtattatcatcataaccatatgcaagagcaagagtcatctcaatctaggcagacttctcctcggattaatgatccttcagggacacttcttttcagttctagaactaatggtggagaagatggtcagtctgccgttgcatcttccagaagcaatcaaccttcattattgatgaatagaagttctgttgtgaattcctcacaggagcttaatatttctttaactgttgttgaaaattggtttcaaagcctagggtgtaaccagaaatttgaaaattga

SEQ ID NO: 51943 - DNA, 255 bp, Glycine max
  Peptide Sequence Number=SeqID_168721
atgggtatggccagaaatgcgatattaggagaaactggagggatgcatcatgcatctgacataatctcgttctatttcacaagatttcctgaagacatgaatgaaactgagctgtggtacgtatttaaaaaatggggggatgttcgagaagtattcatcgcaagaaatcgtaataagtggggaaagagatatggctttgttcggtttaagggggtgaaggatgccacgacattggagagaaatctggacagcttg

SEQ ID NO: 51944 - DNA, 249 bp, Glycine max
  Peptide Sequence Number=SeqID_168722
atggtcacttaccaggggttgagggacaccgagtatgcattgagttatttcaatagtccagatgtgttgcctcgatgtaagagaaaaaagattgataggaagaaatcaacttttatagagagggcacaagatgtggcttactatactttaggtagtggacgatgtgctgctcattttgttgatgctctaaaggtgaaggtatggcgaaaggaaagtgaaatgaagtttgcagggaaacgtagggtatag

SEQ ID NO: 51945 - DNA, 171 bp, Glycine max
  Peptide Sequence Number=SeqID_168723
atgacaatgatgcttacaccaacaaaggtgacgctcaagccaacaccgataacgaatgatatggccaagagagatgcctctgatgtcgtattggtcagattagcgcatgtgatggaggttcacgatccgggtactagatggttaagcatacaccccaaagaaatcaaataa

SEQ ID NO: 51946 - DNA, 1086 bp, Glycine max
  Peptide Sequence Number=SeqID_168724
atggcaaaagaagatcaagatgttgatgataatgccaacttagtgtacccatgtggtcctcatgaagagctcaacaacatgaagattcaagaatttcttaataatagtgttagtatcgcctgctacaattttgatcatcctatgtatcaagctgacgagggtgatgatgatttagaaactccgctcgagttgaagaggttggaagtcaaagttggcattgtcataaaagaggatataaaggaccaattgctcaaactcttgtctagctatattgacatctttgcatggtcatatcaagatatgcctaggctagatcctagcatagttgaacaaagacttcctttgaagccagagtgcccaccagtcaagcaaaagttgagacgaatgaagccagaggtgtccttaaaggtcaaggaggaggttaagaagcaacttgatgtaggattcctcgaagtggaaaatatagtacatgttccaaagaaagatgaaaaggtcagaatgtgtgttgattattgtgatctgaataaagttagcctcatggatgatttcccattgcctcacatagatatgttgttgtttgatcatttaagaaaatacaagcttcaattgaattctgctaagtgcaccttcggcgtaaagtcaagcaaactgttgggtctcaaagtcagtgagaaagacatagaggttgatcctgataaagtgcaagcaatcttggagatgccaacccctagtatagaaaagaaagttcatgggttcttgggaaggttgaaatacattgttaggttcatatcccatttaactgctacttggtttgctcgtaggctcaagcaatatatgttgtctcacaccacttggtctccaaaatggattcaatcaaaagaagacataatggcattatttgaatacggagaacctggggatggagaaaaatggattatgttatttgatggaattccaatgaactgggaatataaagcttgtgtgatgggggttagagctactattgaattcaaagctaggattttggaggtgtttggagacttaacctcagttattcatcaactcaaaggtgaatgggaggtttga

SEQ ID NO: 51947 - DNA, 429 bp, Glycine max
  Peptide Sequence Number=SeqID_168725
atgactaaggagcccacaacacctgctcttgaggagactcagccatcatcagtactggatcttaatgaagaccagccacaggaggagcaggacgagagtatcatccacagaagatggttcaaggcgaatttgtaccaaatttgggggaggtattatcaaggtatgaaagctaagtacctaagaaaaaaaggcaagtatggggaaggaatgaatgaaaaagtgaaggttattctatggatgaatgctctcctagaacctaagcttttgaatcctagaaaaaccatgaattgttggcagcctaaccccattacaagcctagaaagttcatcggattcatttttatgtgttcatttctgtatgataggagatgaaatgcaaaggttggaacttgtgttggttgtttatgatggaataagcctaaacacttga

SEQ ID NO: 51948 - DNA, 300 bp, Glycine max
  Peptide Sequence Number=SeqID_168726
atggaggaaggagtttggtgtcgacaccatcacggagattttggattcaaagaaattgatgaagtcttgcaatattatccccaaggacatcatagagtggacaaagatggaagaccaatgtacatagagagattaggcctccttgtggagtctcttcgtggagtcaaagacatcttagtgatagtccctacaagaacagtcagtgtggtccatgatgttctcttgatttctaagtcacaaataggtgacttttataccattttctctgcactttcctttggttcaaacaaaaattggtga

SEQ ID NO: 51949 - DNA, 252 bp, Glycine max
  Peptide Sequence Number=SeqID_168727
atgtcaagaataacacccatgaatgctggcttttgtgcatttcttagtgtcctacttaagttgttaagaatatttgaaactgtgtttgacataataaagaaagatttacccccagctgaggatgttggagatgataaggatgctggaaggcactaccattttgttgttgcaactgacaacaatgtttatcaagttattagggttgcaaccagcagtgccaactccgagtgggaatggaagtggactaggtga

SEQ ID NO: 51950 - DNA, 441 bp, Glycine max
  Peptide Sequence Number=SeqID_168728
atggttctctggaagaacttcttccggaatgttaagtttcttcttccgaagaaccatccggaagaacttgttccggaaaccaaaccgttacaggaggggaggggaggggagatactaaccttgaggaagaaatgcatcaacaacaccacaaaaagcttcgaagacgaacggaaatggcagctagagggaagagacgcacacggaggaagaaggaagagaagaaaagcaagaaggcggaaagtgttggatgcacctagcatgtcccaaaaggttggagatcagaattctgtatatcaagcccaattgccttcacaggtttcgctccaggaattggcccaacttcaatggcccaacaaaagagatgggccacaggattgcttgagatcttctgttgcaagcattgccctattattagcacactttttcgtaagcttactttaa

SEQ ID NO: 51951 - DNA, 543 bp, Glycine max
  Peptide Sequence Number=SeqID_168729
atggtgtcgacaccaaactccttcctccatttgagcatttcagaggaggctttgagaggagagatgagaggagcctttgagcttcttggagaggccaccagcggcggcggaatcattaggaacctcctcgacaaggtagacgtagatgtaggtgtcgccgctctctgcctcgcctgcaaccgcgatatccactccgccaaccccctcgccagccgccacgagcgcatccctgtcacgtcgttcttcgagtccataaactcagtcaaggtctccgacgccaacgctgacgctcacgttagcaccgaggaggccgagaccgcgtcctggctgctacctaatccgaagacagatctaaattcgtctcagtacttgttctccgaaatcgaaccagttccttacatagatctagattacgcgaccatggatccaaagtcggagcagaaaagttccgccaccgctgacgacatcgttccggtgcagagcaacttcgagtcgttcacctacaagcaccaaacttctttcgaactagaacctttggagtga

SEQ ID NO: 51952 - DNA, 1059 bp, Glycine max
  Peptide Sequence Number=SeqID_168730
atggccaaccaaaactctctgcccctctatgagaaattctggtacaagcacaattacaaaagggtaacggaaagcttgctttcagtcctcctcttatggttgcttggttaccgtgttatctctatcaacaactactctttcccttggtttgttgcctttttatgtgagtcgtggttcaccatctcttggtttttagccctaaccactcaatggagtccagcagtaaccaaaacctacccagatcgtctcttgcaaagtgtgcaagagcttccgccagtggacttgtttgtgacaacagcagatcctgaacttgaaccaccgattatcacagtgaacactgtgttatctctgttggcacttgattacccagctcacaagctagcttgttatgtttctgatgatggttgctcccctcttaccttctacgctcttcaggaagcctctaaatttgcaaaattttgggtacctttttgtaagaagtacgaagtccaagttagagctccactcagatatttctttgacaaacctgaggtctctacagccaacaacacgccaaagttcaaacaagaatggttaaaaatgaaggatatgtatgatcaacttagccgcaaaatagacttggattcttttacaaaatcaaatccatgtcttggagaatttgcgactttctcaaacactgagaggacaaaccatccgtccataattcaggttatatgggagaacaatgaaagccttgcagatggattgcctcatttaatctacatatctagagagaagaggccaaaacagccccatcatttcaaagccggtgccatgaatgtgttgacaagagtttctgggttgataaccaacgctccctttatgttgaacgtggattgtgacatgattgtaagtaatccaaagattgttctgcatgcgttgagcattttgcttgatcccaagggagaaaaagaagttgcgtttgttcaatgtccccaacaattctatgctacattgaaggacgatccttttgggaaccagatgacaattttgttcaaggtgatcgttattaaacattaa

SEQ ID NO: 51953 - DNA, 1094 bp, Glycine max
  Peptide Sequence Number=SeqID_168731
gaagcggcatatcagacgaggaattcaaagaaaaatttggggcttcaaaggattttctgaaatcagctgcttttgctttgaaagggaggatatattcgcctaatgatattaatatttcgaatgttgttgacgtagcaagccaagttgccggttgtggatatgaatatggcacaggatggggcaaacaggtgggttggatatatggatcaataacagaagacgtactcaccgggctgaccatacatgagaaaggttggagatcagaattgtgtacaccaagcccaattcccttcactggttttgctccaggaggtggcccaacttcaatggcccagcaaaagagatgggccacaggaatgcttgaaatcttcatatgcaagcattgtcctattatttcttcccttttccgtaagcttactttgaggcagtgcttagcatatatgtggattatcaattggggtctgcaaccagtctttgaagtatgttatgcatgtctccttgcatattgcatcatcaccaactccaatttcttgccccaggacctaggaatacgtatccctattgcattttttgcaatttacaaggtatatactgtatgcgaatatttggcagcagggttatcagttcgagagtggtggaacaatcaaaggatgtcaagaataacatccatgaatgctggtttttgtgcatttcttagtgtcctactcaagttgttaagaatatctgaaactgtgtttgacgtaacaaagaaagacttacccccaacaggaaatgttctagatgataaggatgctggaaggtacaccttcgatgagtccgtagttttcttgccaggcactaccattttgttgttgcaattgacagcaatggttatcaagttattagggttgcaaccaccagtgccaactccgagtaggaatggaagtggactaggtgagattttctgtagtgtttatttgatgatttgctattggccatttctgagaggattatttgagacaggaaagtataggattcccatgtccacaatatgcaaagcagctatattgacatgtctctttgtacacctatgtagaaggatcattactagttga

SEQ ID NO: 51954 - DNA, 735 bp, Glycine max
  Peptide Sequence Number=SeqID_168732
atgagactgaatgcctatgaatcgtccagaatttacaaggaaagaacaaagacatatcatgataagaaattacagaggagagaattccagccaggacagcaggtacagacagcaaaaggaggggtgctaagagcagaagtccagtgggctgcacgaagtcacgcgcttagtgcccgacgtcgcgctaagcgcctaggtatcatcacgctaagccttgcgcataggcttagcgggagcaaaccaagtgaagaacaacacgaggagcgcgctcagccgctgcaagacacaggagctaccacgaagcgctcgcttagccgcactgtcgcgctaagcgcgctcaactgtatcagtgaacgcgctaagcgagtgcgagtggcgctaagcgcgtgccagcagcagctgcagggaggcgcgccaagcgcggggctgggcctcgggatggcttctcgcaagcgccgtgccgtgcccacaccaggggaagcgtccaactgggacacttcccgcttcacatctgagattgcttggcacaggtaccaagacaacattcagctccggaacatccttccggagaggaatgttgaactgggacccgggatgtttgacgagttcctccaggaactcaggaggcgcagatgggaccaggtgctgactcaccttccggagaagcggattgacgtggctctggtgaaagagttctattcgaacctttatgatccagaggaccacagtccatga

SEQ ID NO: 51955 - DNA, 139 bp, Glycine max
  Peptide Sequence Number=SeqID_168733
atgcggaaaggaccactggaagaaggaggaactaaggccattgatagcgttgaaacactcagaacttgggcgctcagcgcgcaccaggcgctaagcgtgcagctaactgcaggcgctgagcgtggcgttaagcacgaag

SEQ ID NO: 51956 - DNA, 680 bp, Glycine max
  Peptide Sequence Number=SeqID_168734
atggcgttaagcgagccttcgaggtcagaaagccctttaaaggctgaagttggaaaaatcaagggggagatatccaagagcatagagagcaaaacagaggcgcaaaaacagagcaaggaagccaaaaacctcaactttcaagaggattttaggattaggatacacttgctgataaatttcgtagttgtaaacagattgcctcctgtcaggggagaaagggagaaatttgatcatatagaggaaaggttgagggctattgaaggaggcggggattatgcctttcctgacgtgccaaatttcgataagtacaaggggactacttgccccaagaattacctgaagatgtacagcagaaaaatgggggcatacgcgaaagatgaaaaattgttgatgtatttcttccaggaaagtattactggggcagcctataattctgatatggctccggataggatgcagccgcagaacatgtgtaaaaaagagtatgaatctttcaaagaatacgcccaaaggtggagggatctggcagctcaagtagcacccccaatgacggagaaggagatgataacaatgatagtggacacgataccagtgttctactatgagaagatggaagcctgggcaaatggagaaaatgagaagaagggacgaacccatgctgtcactgtcgctcctacatg

SEQ ID NO: 51957 - DNA, 279 bp, Glycine max
  Peptide Sequence Number=SeqID_168735
atggaacagaattacattacaagagtttggtctaaggtagcttacttttcatgtagacttcacgttgagcatgcactcctgggcttagagggaatggtgatttatcacgcgtttagcgcggtgttcgcactaagcgcgaccttgggctttctcatgggccttcttcacgctaagtgtgtgttggtcgctaagcaagcatgcgcgctgagctggctgtccaattcttccaacttttgttcaagtctttttcttccaatttttgcatcaatttccttctaa

SEQ ID NO: 51958 - DNA, 285 bp, Glycine max
  Peptide Sequence Number=SeqID_168736
atgacgaacaaagaacgaatgaagaacgatgtagaagtcgattacggtcgcaattcgaaaaacaagacatttgggacaaaggcagctcgcccaggcgagctgttgcttcactttgaagtaaccttgctcgtcaggcgagctggttacttcaccatgaagttatttggtggcccagccaagccagaggctagcctgagcgagctagggactaaaaatctccctgaaatgacccatttgcccctcccctttggtatctttcacaaacttgatcaaaacattgaatga

SEQ ID NO: 51959 - DNA, 1737 bp, Glycine max
  Peptide Sequence Number=SeqID_168737
atggcacaagaagcaagctgcactcttgaggctggagtcaaaatttattcattaagggtggattcagtgcattctgaggcatataaagttcttggtgggatgaatagagcaggccaagaagctgaggaagccatgatgtcagatactaccctgaatggtgttaatattgaaagtggacaagtagaaagcaggaaagaaacgagcaaaaagttgtcacctttgtcaacattggaatcatcttttgaggcacttaatgtaaagaagttcgatggtgatctcaaatcctattttatttctgttacttgtttgctgaggcgttgtgttgaggttgtgctgaaaatggctgcatttgtcgtggatcctctctatcgccaaacaacagcaaaattcgatgaaggtggagccaagggtcttttaatgaataatctcggtgtatatggtgactgtagggtgctctttgattcacaagaagttcctgctaagtgtatggcaagccaaaatcaatctgatatttcagatactattgatctttcctttgccaaagattgtattgatcaaatggtgttggacatgcgtgtaaaggatgaaatttctccaagtctcaggactatagtaaaccaatttgatgaaagtaacagaagacccgctgatattcaacttcaaggccagaattcagctgaagatcttgacaatgctgataataatgaaaatggtttttacagagaagaatatgagaactgcatggcctggagtgatgatcgtgatgaccaaacagttgttgccgatccaggttataatgatgcagatccaagttttcccagttaccctcaggacaatgatgagccatttccttccccagaaattgatatggatggcagatttgaaaatgttgacgggtatttatttttgagtctgggttttagttcaaaacaaaatgcatgggcagggcctgatcattggaagtatcgaaaatccaaagaggttcatcctacttctgaagatgggtcgaccctaaaaagtagacagccaaagagtaagagacaaactgaagttgatttaaatttcacaaattctcttgagaaaaaaatgctagatacattttctcctcccaagaatcccaaattgttactgcttcctgaaagcagattaccttgcaatacaaaacttcctgaggattgtcactatcagccagaagatcttgtcaagttatttcttctgtctaatgtaaagtgtctcgggaggaaggcaaacaggttctcagatggatctagagaacaatccgatgaatatgaatcattcccttcgtgggataatggaagtgtttgtggggatgacgctggtgactacggaggtgatcttcatggtgacatggaggacaccgacactcttgttactcagcctcgtcaggtcagtaaaattgaagtccagtatgacaagacttccaaacaagtcgatgttcatgcactaaaaattactctttgggaccatgttcaagaatctgttaaacttcctttagagggtcaaaaagataccttatctttcaggaatatattagccaactttcctagcgaatgcaatgctgctgcaacaattagtgacatctctcctcatctgtgcttcatatgtctattgcatttggcaaacgagaaaggattgagcattcaaaactcccctaatttggatgatcttgccatacggtttccacaagttgctgattctatgaggggaacagtttag

SEQ ID NO: 51960 - DNA, 874 bp, Glycine max
  Peptide Sequence Number=SeqID_168738
gctcaacaaccggatcgagcgtcgtgaagcatttctgcgcaaggcgctgacgctttatcatgccatgggtggtgcgatggaggatgtggaagcggccgtcaaggacgccgtgtcatcacctgcaccgaccatcgacgtggccgttggcgacgtgatgtacaagctggccgccatcggccatcaagggcaagaagctgctgcaaaaacagcgcgatcagaaactggctgcggcaacgccggggaagtgaaccgcccgcccggggcggttgccgtatcaggccacttgcggcgacaggatttcctgccaggcatcgtaggcggacagcaccgtttccatttgcgcggtgtggccggtgatgaaatccgtgccatagatggtttcgtcgggatattcggtgatcagcgtcatcggcacggtgtggcggtcatcgatggacgacaggcacggaaagccgttgatgatgcggaaaccggtttcgccggcgtggatttcataaagcgcgatctggcggttattgtagtcgagcaggccgggaatggcgccgagatggcgggttaccttgtccagcagggcttccgctcggctttcccagtccgcatggctggcgccgctcatttcctgcgccttgaagcggatttccttctcgttcagatgcgcagccgaattttccggcgtgcgatattcgaggtcatcgccaagggcggtgtaccgcgccgcatgatgcatgtggcgcggattatcgacgcgcagacgctgatgcagggcgtaaccgtcaggattttccagcggcgagatggtgaaatgcgcgcccttgcgatcagcgagtttgcgggcgccgcggatggcgccgacgatgcccgtcgtctcgttggg

SEQ ID NO: 51961 - DNA, 401 bp, Glycine max
  Peptide Sequence Number=SeqID_168739
atagaaataacaatgttcttcctcttgcatttcccattgtggaaggtgcaaccaacccgtctaatgatcctttacatgggattgaaggtcctatgacaaagtccaagaccaagaggatgaaacaagcattatgctttgaggccaacttgaaaaatcactttgggaagcccaatttacaagacaagaagcatccatgggctgagttgataaatttaggtagactattgtcataccctaatttcgtccggggacctttgcttgatgacatgcgacctttctttggtccttgtgaggcgcttccgaatcgtttccgtaacgttttccgtgaagaatttcgcgaaggtttcgaccgttcttcgacgttcttcattcattcttcatcgttcttcgatcttcaacgg

SEQ ID NO: 51962 - DNA, 273 bp, Glycine max
  Peptide Sequence Number=SeqID_168740
atgggtgccaagcacctcacaaggaccaaagaaaggtcgcatgccatcaagcaaaggtacccggacgaaactagagtcgcgggaacaaaaggtgcagaagactatgtcagtctctgcatgtcatcgggcccaccacctctggatgacacaagggtgcggataaccgtaaggtatctccgcgtgtcatcgggcccgccgcctttggatgacacaaggttgcagaatgaccaaattttgtctctgcgtgtcatcgggcctgccgcctctggatga

SEQ ID NO: 51963 - DNA, 393 bp, Glycine max
  Peptide Sequence Number=SeqID_168741
catattccaaatgagaagagaaataatctggaagacaagagtgagttaatgatacttgttgggtatcattcagcagggtcatacaggttgtacaatcctgtaaattataaaataataattagcaggcatgtttttgttgatgagaagagtagctgggattggaaggtccaatcctatgttccaatggaacttggagaggatcacatagatgaagaacaaaggagtgaaaaatgtgttccacaatctgagaatcacataaatgaagaacaaaggagtgaagaatgtgatcctcaaccaaagaatttgaggtctcaaagaaataggaggctgccattaaaactcaatgattgtcaaatgattcctgataatatgatcacaattgatgggaaattg

SEQ ID NO: 51964 - DNA, 321 bp, Glycine max
  Peptide Sequence Number=SeqID_168742
atgtcaggatttacacgcgattctcctcaaatttcagccagcccgcatcaattagaccttgcaccttacgcttcagagccctacaatgctcaatggaacgccccggggcttctccgtgacaagcacacgttgcgttcgagtcgtattttcggagaaatggaggtttatgaaccttggctggggttatggctaccattgaactatcaaatagatatgggagcaaggattgcctttgtggataactgggcggtgggtaaggagaaggaatggcagtcacagcatgggcttctccctcattctcaccctcttcatttgccctag

SEQ ID NO: 51965 - DNA, 396 bp, Glycine max
  Peptide Sequence Number=SeqID_168743
atggctcctgaagacctagatcagttgacacacaaaatccaagaccagctggaggagtggatcacacaaagagtgactcaacaattaatgttttccttcagccagatgcaatcgcagggacttgcactgcctcctaaggttgaggttggtccttctgcttcttgtgtcggcacaaaggaaagttgtatcgatccctcaaggttgtatgtcgatgacaatcctccccgtctagttgctcttggaagagtttatgaggggtggacgatcgtccccaatgttcctgtcgcaacctacccttcgacaggagggcgacgcagggctcacgggtgcatcttccaagggaggcgcaaccaacgtttatttgaggaaaacgtcagaaaaatcggaaaggtgtag

SEQ ID NO: 51966 - DNA, 603 bp, Glycine max
  Peptide Sequence Number=SeqID_168744
atggctacaccacccaactcccctcctcttcatgagtcagtagcactttcaccatctacgtcaaagaagacaagaaatgcaacacaactcagatcattggctactagaccagttagggaagagggaccagtggttcatgtcgatcctgccactgggaaagtcgatggtccctacaaaaagaacttaagaacatatttggagattgtaactcataataagctcaaaagtgatgcaatcctccctaggaagggactagtcactagagccataagcaagaggctccaagaggattgggctagagctactgaagaaggccctaaggatagatttctaagcgcatgggacaagcttagctattggagaggtgtgttcccatggggtgagcttagctattggaggggtgtaacacttgcttcccaaggaagcttctcaaggaagctttcttccatcatgtattttggcatgggggttaagtcaaatttgacctccaaatgggctgtggcaaatgacaaggagggcaaggatgacaaaggaaactttgttgcccatggacgtcaagatggactgattgactgctgccattgggtgaccagagcaccctag

SEQ ID NO: 51967 - DNA, 180 bp, Glycine max
  Peptide Sequence Number=SeqID_168745
atggacacccgtctccgtgtgattggtgatcccatgaatgaagttcaacggcaaatacctcttaatgaatccgatgacaattattgtaggagtgggtgtcacaacccactctttgaggattcacctagtgagtgtggtggtggggccgccactgtgagatatgggctaatctctaagtga

SEQ ID NO: 51968 - DNA, 450 bp, Glycine max
  Peptide Sequence Number=SeqID_168746
atggcagagaggattgttgggcatggatcatttggggttgtcttccaagctaaatgcttggagactggtgaaactgtggctatcaaaaaagttcttcaagacaagaggtataaaaaccgggagctgcaaacaatgcgccttcttgaccacccaaatgttgtctgtttgaagcattgtttcttttcaaccactgaaaaggatgaactataccttaatttggtacttgagtatgttcctgaaacagttaatcgtgtgatcaaacattacaacaagttgaaccaacggatgcctctgatatatgtaaaactctatacataccagccctctgagttattgctcaaattttggagcatgcacttaaacggcaagataaatattgaaccatgctgttgttgctcaagtggtgttaattctctttgccaagagttgctgctttatgccattggttga

SEQ ID NO: 51969 - DNA, 1107 bp, Glycine max
  Peptide Sequence Number=SeqID_168747
atgatgcggtgcctaaaccggtttagcaaaaaaaatacatctgatgatagccttgcctcagggatgcaaacagtgaaaaaaagcataatcgcgataacccttagtaccgtattaggctcaggctcagcctgggcggcagacgacatgagcagtattgaagcgcgcctggcggcgatggaaaaacggctggccgcggctgaacagcgtgccagcgtggcggagcagcgcgcgcaggcagcggaacagcaggtgcaaaagctggctgcggtgcagcagcagaacccgacgccggttgccgtggcacagaccgaaccgcaggccgctcagcctgttgcgcccgccgccagcagcgagtcagagggctttgagtttcatggctacgcacgctctggcctgttgatgaacagttccgctgcgaaaactcagggcgggcccaccgtcacgccagccggtgagaccggcggtcacgtcgggcggctcggcaatgagccggatacctacgttgaacttaacctcgaacataaacaaacgctggccaacggtgccaccacgcgcttcaaggcgatgctggccgacggacagcgcacctacaacgactggactgccgccagcagcgatctcaacctgcgtcaggcgtttgtcgaactggggcagctaccgaccttcaccggcgcgttcaaagactccacggtgtgggccggtaagcgtttcgaccgcgataacttcgacatccactggatcgattccgatgtggtgttcctcgccggaaccggggccggtatttacgacatgaagtggggcgatgacgcccgcagcaacctgtcgatttatggccgcaccttcggagacatcgaaaataacgacaacaccgcgcaaaactacattctgtcgctgaataactttgtcgggccactgcagctgatggtgagcggcatgcgcgcgaaagataacgatcagcgcaccgatattgacggcaaccgcgtgaaaagtgatgccgccagtgacggtgtgcacgccctggtcggattgcacaacgacagcttctacggcctgggtgaaggttcagcgaaaaccgcgctgctgtacggtcatggcctcggtgcagaa

SEQ ID NO: 51970 - DNA, 231 bp, Glycine max
  Peptide Sequence Number=SeqID_168748
atgttacggaaactcacggattgcataacaatacttccctttgatttccggcatgttacggaatttcacggattgcgtaacaatgcttcctttttgatttccggcatgtctcgaaacttcacgtattgtgcaacaaagggtgccaagtacctcgcaacggtcaaccaaaggagaattataagcaattgggcttggatccagaattgggctgaaccgtcggcttggacttga

SEQ ID NO: 51971 - DNA, 674 bp, Glycine max
  Peptide Sequence Number=SeqID_168749
cgatcgacgcttttctcgcctatcatgaccacaaggaaagcccagttgtcgctatgctagctgacctatatgacaccttcgaccaaaggtgtgagaagagaagtacgaggattgtttgctgtactctagttctttatgtatggttggttttgcacctttttcgccaagaggtgaggcatgcttgcccgctagaaagccaccgttcatgcacagagaaaggaggggcaaattgggaccaactcttagcaaacaaagaaggagcgtctgtcaactggttccctcgatggaaagaaggaagaaccggagttcttatttcgtgcggaggatttccaaatgttcccttgatagggacgaggggttgcatcagttacaatcccgttcttgctataaggcaacttggctaccctatgaaaggggcaccattagaggaagagatcgcgcctatcatttcacgaggttttaataggaacaacatggagacacttcagaaggtccgcaaggcatggaaggtggtgcgaaagaaggacaaagaactcaggggcagtaacaatgggcccatcggtggctaccgtaagtggtcgaaagcccacgtgcaaagtttggattggctcctgagtttgagaaccgctaaaagggaggaagttgaggcaccggaggaagacgaagaggtatag

SEQ ID NO: 51972 - DNA, 512 bp, Glycine max
  Peptide Sequence Number=SeqID_168750
ggtacatcctttgtggtacaagtaaagcgtacatctacttgggttgtaatactgagaacaagagagggtacatctgttgtggatcagttcaagtggagcgtacatccatttggttgttcaaagagaacaagggagggtacatcccttgtggatctttgcttgtaaaggattttacaaggttattggaaatctcaagaaccggtggttgcttggggactggatgccacttgatccaacacattttgctttcacgatcctcaaaccttgctcaagcctttgaggaggacttgattctgatgtgggcttttcaaactggtcgtcagatcgactgggcccatttagttcggtaccaaatgcataaggtagtacgggccaatgctcttctcccttatccttaccttgtcactctttttcttcatcatttcaatattgctttggatgatgaaccatttgtcaaggtcaagcgatctttctctattggtgctggtgcaattacctcctttggttactga

SEQ ID NO: 51973 - DNA, 225 bp, Glycine max
  Peptide Sequence Number=SeqID_168751
atggcggttcctgggaggcgcaacggcatcaacgacgacgaagaggagttagacgacaatgcccttttcgaagaacaaggtgtcgtcgaagacgacaccgatacccctcctcacctccgcgacctctccgccgccgctcaaatcggcgacgcccacgccctccgtctcgctcttggtctctctctctctctctctcttcaatttactgtaataatggatcactga

SEQ ID NO: 51974 - DNA, 414 bp, Glycine max
  Peptide Sequence Number=SeqID_168752
atggcgcctactatgcaccctttggatccagagaagtccaataaggccctaggagttcatgtcacccccagcaaggtaatccgaccgccgatcacccgagccttcatcgagaagtactacacgcctaggcaggcgccaagtgatgcacatcaggacgcgggcgcaccgccaccacctcggcaggccgatttggctgggtcactaagcatggagcagtatctacaacatttggttcgccagaaggcagccaaccaccgtggacagtttggggctgaggtcgcatggcctggagactggcctgatgcccagacaggggaggagcctgcagaatccctcgatgagacggatgaaccccatatggacgaggatatgactgacttgctcgggttcttgcgagggagcggagccacatga

SEQ ID NO: 51975 - DNA, 258 bp, Glycine max
  Peptide Sequence Number=SeqID_168753
atgggtgccaagtacctcgaagtggtcaaacgagggtcgcatcctaacaacggatggtccccaaacgaaattaggacgcagaatgaccataatttgtctctgcgttttgttggaaacgatcgagcctgggcggcgagatacaaaatgaccataatttgtctctgcatgccaccggacacgatcgcccattttctgaatgacaaagggcgcaaaatttgtctctgcgcgttcatcacccaacttgcgaaatctgaatga

SEQ ID NO: 51976 - DNA, 660 bp, Glycine max
  Peptide Sequence Number=SeqID_168754
atgcctacagaccaacaagcaaaaatttataaccaaattattcaggctgtcaataaaaatgaaggtggaatgtttttcttatatggatatgaaggaacaggaaaaacatttatttggaagacacttgcagcctcattgagagctgacaataaaatagttattatgactgcttctagcagcatagcttctttgttattgcctagaggaaaaatagcacattcaaaattaaaaattcctgttccgatatttgaagactcgacatgcaatattcatcaaggatcacaattggctgaattattgaatgaagcaagtcttatcagctgggatgaagcccccatggctcacaaattctgttttgaagcacttgatcgaagtctaagagatgttattaaggcgaaatcaagttctgataaaatctttggtggtaaagttatggtatttggtggagatttctggcagattctgccagtcattcctaggcgtagccgctctgatattgttaatgcaactattaattcatcttacctatggaatcatttccatgttttgacactgtcaaaaaacatgcgtttagaagccaatacagatgcaacagacagagaagaaactgcagcttttgcagagtggatccttaatattggtgatggaattgctggctag

SEQ ID NO: 51977 - DNA, 2256 bp, Glycine max
  Peptide Sequence Number=SeqID_168755
atgttattttctgacacctctgcttccagttcacatccggttttatcaccccctgtggttatctttgccgaacgcggctggtacaacgatccgcaaaaacgctggcagggaacggtgcaaacgccggacgccgttgaagtcatcgtgacggttaacggtggcaatccgctacgcgtgccggtgatcaatggtcacttcgagtggatgccgccgcagccgatggccgatggtgaataccagctcaccttcaccgccgtggatgccgccggcaatcacagcgcacctacgcgtgttgattacaatatcgatacccatccgcccgccagaccgatcattgaagcgattgaagaccacgttgccggcggcgtggaggacggtaacagcatcagacgtaacggctataccaacgatgatcagccggtggtacgcgggcaggccgaagccaacgcgctggtttatctctataatggaaaacaacttctcgcctctgtccgtgccgatgcgcagggcaactggcaggcgcagctcgatctgccgcaggacggaacctataacctgacggcgcaggccgaggaccgcgccgacaaccgcagtcagccgtcgccgaagtggacctttcatctcgatacgcttaccccggaaacgccgacgttcagccattacgacgacaatcgcgggctgtatcagggccagtttggccgcggcaaacccaccgatgatgtccggccggaactgcacggcgaagccgagcctggcagcgtggtgcgcattcagtatgccgcaccaggcggtaagtggattgtcggcggtacggccaccgtcgacagcagcggccactggcactggacgccgccgcaggatctgctgccggacggcgactggcgttttcgcagccgcagcagcgataaggccggcaacgtcagtcaatggagcgacagctggacgctgaccatcgacacccgtatcaacacgcccgccatcctgcaggctatcgatgacgtcggcaccatccagccggtgctgccgggccagaccaccgacgataagcggctcgatttttccggacaggctgagccttacagtcaggtgacgctgtaccagaacggcttggcagccggcagcgcgacggtgggggccgatggccgctggcagattaccccggaccgcgacatgcagccgggtagcaacaactttacggtaaaagcagtcgatctggcgggtaacatcagcaactatgcgcccaactggatgattaactatgactctggcgtgaagcacagttctggcgaagagaactggaactgtcgcgccaataccagctggcaaaccggccgggtgtatcagtacggcgggttgaaagtcaccgaactgaaacatggcaccagcaacaactgtttctataccggcatcatgaaccggccggatggctatgaaagcaaagcgattgagatgctggatcattcggtcgtgcagtttgattttggcgccaccaattacgtcgagttcaattatggctatctccacaattgcgatacctacgtagatatcttctcccccagcggcgagctgctggggcgcgaatacctgcagcccggcggcgccagccggtctgagcaggggttgaacacctttagctggcaggctccggcgggccagcagattggttatattgacgtccattcgggcgaagatccggatacctataaaaaagtgctgtgctggaacgtgctggtgaagcgcgatgtcggctggattattgatactgtgcgctggggcaaagacgagagcctggtacagcaccatacgctgccggaaacgctggaacaggagggcgcgcagctgcatctgaatgatgtgcagcagtggctggcggcgcacagcggacaactgccgcagggcttctctgcgctggtgctggaaggagaacatcagcagcttgattatcagcagctgacgcagcatatcagcggcctgcagcatatcgatctcaccggctcaggggacaatctgctgcagctggatgcgcagcagctgttacagcaggcgcaccaggatgtgctgctgccagagcgtacgcgcagctggctgattgatggtgatgccggcgacgtggtgcagctcaacgatagcacgcaattttatcagcagtggcagcagcaggggacgcaccagagcggtggcaaagtgtggcaggtgtttgagagtcccgaccacagcgcgacgctgttaatcaataatgaggtgatggtcgcctga

SEQ ID NO: 51978 - DNA, 960 bp, Glycine max
  Peptide Sequence Number=SeqID_168756
atggggcagtttgccgctaacatcgagaatatctggggaatcaatgaggttctgatcgccggacccaaggactacgtcaaatacagcgataactattacacccgcagtcacatcaacttcgacagcggtagcatcaccattgagaccatttccggcaccgatccgatggccagcctgcgtcaggccatcatcaccacgctgttgattggtgacgatccgggcaacgtcgatctctactccgacgccaacgatattcagatcagtaaagagccgctgctttacggccaggtgctggataacaccggtcagccgatccgctggcagggacgcgccggtaactttgctgattacctgatccagaacaaactgcagaaacgcacctccgggctgcacgttatctggtcggtgaccattccgatggtgcctaaccacctcgacaaacgtgcgcataaatatctgccgctggtgcgtaaagccgccgaacagtatggcgttgatgcctcgctgattctggcgatcatgcagaccgaatcgagctttaacccctatgcggtaagcaacgccgatgcgctgggtctgatgcaggtggtacagcatactgccggggtcgatgtgttccgcatgaagggcaaatggggtaaaccgagccgcagctatctgctcgatccggccaataacattgatgccggtaccgcatatctgtcgctgctgcagaagagctatctcggcgggattcaggatccgctatcgcgccgttacgcagtgatcaccgcttataacggcggggctggcagcgtgctgcgcgtgttctccagcgataaagaccgcgctttcgccaccatcaacggcatgtcaccgagccaggtgtatcagacgctgaccaccaatcatccgtcggccgagtcacgccgctatctgtacaaagtgagccaggcacagcgcagctaccaccgttattaa

SEQ ID NO: 51979 - DNA, 744 bp, Glycine max
  Peptide Sequence Number=SeqID_168757
atggtgttctcttcgaaccccttatccctgagcgtccccgaacccgccttcgagtcatggctccgcgacaccggcttcctcgaagtcctcgaccaccgcacctcctcctccgccgcagccgcctcccccgctccctcctccgccgcctccaccctcttctcccgcctcttgaccttcctctccctcttcaccctcaacgccttcgccaagctcgccgccgatgacttcgccgccgacaccccctcctggtcccgctccttcttcgccttctccgattcctactccttcccttcctccccctcacaggcgcgattgagagttcaggaaaacgtgaaacgctacgcccgcaactacgcctatttgttcattgttttcttcgcctgcactctgtataagatgccagttgctcttgtcgggttggtattgtgtttggcattgtgggatttcttcaagttttgtagccacagatggggattggagcagtatcccttgacgcgccagattttgattcgtgttgtgcaatgtgcaactgcggttattctaatcttttccaatgttcaaatggctctcttttgtgccatatgcgtcagctatgtaggaatgatacttcatgctggatttcgaaagttgacccctgtaaagcaaccttcagtgagcagaggtatgtgtaaacccctaatcatcaaggagaggatagtcattctcacattgcctattgtttccctatttcctaactatgattga

SEQ ID NO: 51980 - DNA, 348 bp, Glycine max
  Peptide Sequence Number=SeqID_168758
atgactttcactggaagtttcacaaggccaacggcgcaattggcaagccctgagaaacagatgcaacaagggcacaagcagctcaacatagacctgtcaacatggggaggaagggaaggagtaggaatcggagaaggcgaagaaggagcgggaccaggagggggtgtcggcggcgaagtcatcggcggcgagcttggcgaaggcgttgagggtgaagagggagaggaaggtcaagaggcgggagaagagggtggaggcggcggaggagggagcgggggaggcggctgcggcggaggaggaggtgcggtggtcgaggacttcgaggaagccggtgtcgcggagccatga

SEQ ID NO: 51981 - DNA, 627 bp, Glycine max
  Peptide Sequence Number=SeqID_168759
atggccgaacccaacaatgatcgtgttgaggctgccttagcccgactcacttcacgcatcgaggaccttctacaacatgttaccccctctgcttcccctccctttccacctcgtagcccgatacctgtacattcacatagaatcaagttagatgtaccgcgttttgatggtacggatcctcttgggtggatttttaaaatcacccagttctttgagtaccacggtaccccggagcatgaccgcatcaccattgcagcattttacatggagggaagagcccttgcttggttccagtggatgtcaagcaacggacaattcacttcatggcccgtatttctacaggcactgcaaactcattttgccccaagtcagtatgaggacccctcagggtctttgttcaaactcacacagcggacaacggtgacggaatacttatctgaatttgaggaattggccaatagggtggttggccttccggctccattcctgctcagctgcttcgtatctggactcgcgtcggagattcgtcgcgaagtgatggtgaaccaacccctcaccgtggccgaggcggcggggctggcccgtctccacgaggagaagctccgcgaccttcgttttgacttctga

SEQ ID NO: 51982 - DNA, 2670 bp, Glycine max
  Peptide Sequence Number=SeqID_168760
atgcagtttttccatgatggcaggatagtccagctccaaggtgatccggtggctcaacgggacttgcttttctcccctcaattccgacgtgtctgccgcaatcaacccaacagcatttgcttccacatcacggtgctccctgaagattccgaaccagtgatgcccagtccaattgacccgcaagtccagcatctcctccaacagtttttcgttctctttcaggatccgacacagctccctccggcacgtgatactgatcaccaaattcacttgcgtcccgatgccacccctgtcaatgttcgaccatacaaatatccttattatcaaaagcgcgagatcgagacccaggttgagacaatgctccaacgcggcatcattcagcccagcaagagtcctttctcttcgccggtgctgttggtgaagaaatccgacaatacctggagattctgcgtggactaccgagcattgaacgccttaacgatcaaggatcgtttcccaattcccaccattgacgagctcttggatgagctcggcggcgcgagttgcttctccaaactggatttgctgcaagggtatcaccagatacgcatgcaatcggaggacatccccaaaactgctttccggacacaccacggtcattttgaatttaaggttatgccctttggcctttgcaacgcgccctcttcgtttcaggcgacaatgaacacactcttccggccgtaccttcgccgctttatcatcgtcttctttgacgatattctcatctacagcgtctccctcagcgaccacttgcgtcacctccaaactacctttcaggtgctatatgacaatcacttcgttctgaagctctccaagtgccttttcgctcaacctcaggtggagtatttgggtcacctcgtctcgcaccgcggcgtccaaccggtggcttcaaagatagccgccattgcacagtggcctaatccacgctccgttcgtgctctacgaagtttcttgggacttgccggattttatcgctggttcatccgtggctacgccactatcgcggccccattggtcaaagccaccaccattgagcccctccactggactccggccacacaaaccgcctttgacaccttgaaggaagctctaacatctgccccggtcctcgcccttcccgacttcaaactaccattcacagttgagactgatgcatcggcaattggaatgggcgcctacctcctcggacacagcttcactatcctcactaatcaccaaagcctgaaagaactcatgacccaggtcgtgcaaactccagaacagcatacctatctcgcgcgtgtaatgggctacgattatcatatccagtatcgctcagggagccataatcaggccgcagatgccttatccaggttaccggaaggagcttctcaagcctttctcattctctccgtcccttgcctcacttttctagatgagctccatgaccagctacgcaccaattcgacctttcagcaaaagctgcttgatgttcagaatcatcccgatcaccatcctgagttctccattgctgacaaactgctgttgtataaaggccgtatctggttgccttccgatatacccatcatcaccacccttctgacagagtatcatgccacccctaccggtggccacgccggcgtcgccaaaaccgtggctcgcctcatgaccaatttttattggcccggccttcgagatgacgtctctcgttttgttgctcagtgtgttgactgccaagtcaccaagtacgaaactaaggaacttgcagggcttctctgtcctctccctgttcccagtcaaccctggtatgacttatccttggacttcattaccagcttaccggtgtatcgtggcaacaccgtgatccttgttgtagtggaccgcttttctaagggaattcatttaggcatgctgccgccgagccactccgccctcacggtggccaaactattcttggacatagtggtgaaaatccacggcatgcccagaagcctggtttcggatcgtgatcctctcttcgtcagtcaactttggcaggagctattcaaggccaatggaactcagctccggatgagttcggcctaccacccacaaagtgatgggcaaaccgaggtcatgaacagggtcgtagagcaatatttgcgcgcgttcgtccaccgacgacccaagaattggggccggttacttccatgggtggagtggtcccataacacctcctggatggcaaatactggcactactccttatgaaatcacttttggtcgccggccattcaactttccggactatcttgcaggttcctcgaaggtcgatgctgttctggttcgtcttcgtccttaccgccagtcctccgccaaagggggttcctcgaccaatgtaaaattggcccatcgctattacggcccatttcaggtcacggctaaaataggacccgtagcatatcgtgtgaactttccggcaggtgtacgcattcacccggggctctcaccggaggagacctcgtgggaggactgggaccagctccgtcaggactatcaccttgaggacaaggtgatcctgcaaggacccagggatgatacgggtatagggtatgaagaagaagatgctgaggaagaagaagatcagagctcagctcaagagaagaaaaagggg

SEQ ID NO: 51983 - DNA, 177 bp, Glycine max
  Peptide Sequence Number=SeqID_168761
atggggagaatctttgtggtggagcttgagggcaggtcttatagatgcaagttctgcagaactcacttggcccttgcagatgatctcatctccagggtagttgaacaccacttgccacattcaacggtagccataggttttgccttggctaaagatggaaccaaggatcgtaattga

SEQ ID NO: 51984 - DNA, 210 bp, Glycine max
  Peptide Sequence Number=SeqID_168762
atggtagaggctttatataccatcatgattcatgatcgctttgaaaaagtgaatggtgtcagagagctcaggatggagaaacttgtaaattccatgagcattgagttgaagggagagagcaccaaaactaggaaaaatctaagaggagtgaggtcttacaatgttggtccaattgtaaacagattgacaatgtttccttcaactatgtag

SEQ ID NO: 51985 - DNA, 249 bp, Glycine max
  Peptide Sequence Number=SeqID_168763
atgagagggtgtcctcgtgattcgcgttgcggcgcggatctcaatggctatgagtgcgagtggaagggacgcattcattcgtttgttattttggttcactattcttgtgcttcgtggaggcgcaggcggcaccgacggcgaaaacgctgcgtagaaagggagagcgaatcagaagcgggggagtggggcccacgtggggcattctgtgttgactatgtggctgtcggagttcatgttgtcttcacgtga

SEQ ID NO: 51986 - DNA, 372 bp, Glycine max
  Peptide Sequence Number=SeqID_168764
atgctgaaaatacattggctaaaacagaaacttctggaaatctttgacccacttcagctttctcaatcttcttccaagagtccaaagcaagcatcaaaacttaatcatcaagcgaaatcaacaacaagaccatttggcagaagcaaactgaaagaatctgtatctgatccattccacgacatattttcaaattcaaggtcatcatcttccttattaccagtgggtgcttcaatcacgctaagaacatacctttgtagcttcacttcaataccatttgtaagaaccagccaatgctatccacctagcattttccaattctccaacaaagccatgaaagaattcagcacaaagtacattaacaagctgaattga

SEQ ID NO: 51987 - DNA, 1746 bp, Glycine max
  Peptide Sequence Number=SeqID_168765
atgcttcagagtggcataattcgtccgagcactagtccattctcttcccccgtattattggtcaaaaaacgtgatggatcatggcacttttgcgttgattacagggctttaaacgccattatagtcaagtacaaattttcgataccaaccatcgatgaattattagatgaattaggtggagcctgctggttttcgaagcttgacctcttacaggggtaccatcaaatcttgatgaaggctaaagatatatgtaaaacggcattttgcacacaccatggccactatgagttctgcgtgatgccgtttggcctgtgcaatgcaccatcatcttttcaggcaaccatgaatagcatttttgggtcgtatctgtgtaggttcattatcgtcttcttcaatgatatattaatctacaacaaaaccttcatgatcatctggagcatctcaccaaagcttttacggtgtttctccaaggacgcttcttcctcaaactcacgaagtgctcatttgcccaataacatgtggaatacctgggccatattgtttcccgacgaggcgttgaacctgttcccaccaaactatgcttctatcgtagcgcctttgactcgcctcttggtcaaagatcagtttcagtggtcgtcggaggcccagctagccttcgaaactctcaaagaagcaatttgcacaacttcggttatgggtttgccggacttctctcaaccatttgtagttgagacggacgctttcggcgtcggcatgggatctatcctcactcaacaacatcatcccatcgctttcttcagcaagcctttctgccccaaactccttcgctcgtccacatatgttcgagaactagcggcaatcacggcggccgtgaaaaagagcctgaaagagcttatgtcgcaagtcatacaaacaccggaacaacagatttacttggcatgcctcctcggttatgattattccattcaataccgatcgggaaaagccaactcaattgttgatgccttgtctcggatacatgaaacctctgcggctcaattattgacgttgattgttcctaattttatgttcttgcaggaccttaaaacgaagttacagaaccatgctggttatcaggaactatggcagagcatcatggacaatcctcaagctcacccgacatatgaagaagatctgtcactgaactttatcgaaggacttctagtttccagaggttacacggtcatcttggtagtggttgaccgtttctcgaaaggggtacacttgggtatgcttcgacccaattacatggcttccgcaatagcaaacctttttatggagatcgtggggaagctccatggcatgtcacgaagcttggtttccaatcgtgatcctttattcgtaagtcatttctggcaagagttgttcaaactctccgagaccaagctacgaatgagcttcgcgtatcatccacagtcagacggacaaattgaagtcatgaacagggtcatagaacaatacctcaggtccttcgtgcaccatcacccatcctcttggggcaaattcatcatttgggctgagtggtcatacaacacctctgtccatgcggccattgggctcactccatttgaaataaccttcggcaagaaacctctgagcattccgtcctacctcgctggcacctccaatatagatgtcgtggatgatttcctcgtcaatcgcgatgcagtatttgtcatgttaaggaagaagctgcttaaggcataa

SEQ ID NO: 51988 - DNA, 210 bp, Glycine max
  Peptide Sequence Number=SeqID_168766
atggaggatgcaggcgtcaccgaaacggaggatgcaggcgtcgcaagtgtgcagagcagcaacggcggcgctaggcggtgtgaaaaaccgctccagaatccgccccgctccgccgcgatagcagccgtgacccaaaaccgctccgctacagaggtgcccgtcgcggatcggggccgctccgctccgccccgccgctatggccgctattga

SEQ ID NO: 51989 - DNA, 231 bp, Glycine max
  Peptide Sequence Number=SeqID_168767
atggtgggacttgagaagtatgttatgacaaagttatttgctcgtgtatttgcttcacttccagatgatgtaaaatttgatgaccaactttctgagaagatggctttgattcaacaatttattcgacctgaaaatttggatatcaagccagtatttcagaatgaatcatcatggttgcatagttgtcaataccggcgtagcggccgaccccaaaagtgggatagcggatag

SEQ ID NO: 51990 - DNA, 216 bp, Glycine max
  Peptide Sequence Number=SeqID_168768
atgccacatgtcatctccccgttgaattgtgcccctacctttgacacaatgcaaatagaaacagacccgataaatagtttgcaaaagaaacctacagtgataaaacagccgagacactcaaccctggaaaaacaatcctgttgctgtcgccatttctctccgaaaggtaaaggtaaacacggggcaaggatcaaaattttcactcctcagtgctaa

SEQ ID NO: 51991 - DNA, 1059 bp, Glycine max
  Peptide Sequence Number=SeqID_168769
atggacaactcttcctaccaccacttggaccacactgaagctcacttgccacctggttttcggttccaccctacagatgaggagctcataacttactaccttctcaagaaggttcttgacagcaccttcactggtagagccatagctgaagttgacctcaacaagagtgagccatgggagcttcctgagaaagctaagatgggagagaaagagtggtacttcttcagcttacgtgacaggaagtacccaactgggttaagaaccaatagggctactgaagctggttactggaaagcgactgggaaagatagagagatttatagctcaaaaacttgttctttggtggggatgaagaaaaccttagttttctaccgtggtagagctccaaagggagagaaaagcaactgggtcatgcatgagtatcgccttgaaggcaaatttgcttaccactacctttctcgcaactccaaagatgagtgggtcatatcacgtgtgtttcagaagagtaacaccgccaccaacaatggaggctccgtcatgtctgcttctagtaactccaagaagacaagaatgaacagcaccacctctcttatccatgaaccaagttcaccctcctcagttttccttccacctcttctagacacttcaccctacaccaacacagctaacttcaccgaccgtcacaatggttcctatgacagcatcaccaaaaaggagcacgtgtcctgtttctccacaatagctgcagcaacaactgctgttgtctcccccaacaacttcaacaatgcaggctttgacctttcaccttctcagcctcttgcaaccgacccttttgccaggtttcagaggaacgttgatttttctgcttttccaagtttgaggtcactacaagacaaccttcagttccctttcgtcttttccacggctgcaccgcccttctccggcggcggttccggcgactttctcagttggccggtgccggaggagcagaggctgatagatggtgtttccaacatgccactgggagtgtcggagcttgattgcatgtggagctactaa

SEQ ID NO: 51992 - DNA, 258 bp, Glycine max
  Peptide Sequence Number=SeqID_168770
atggaagaatggaatatcttggaagctcagatacatatcactaagggcaagaagccgtggaagaggcagcaaggtggtggtcacgcttttgttttggcctcttctttcctcaaattcttcctcgagctactgaaatactatagtattggttctgttggtttttccaaaaagaagaaggaactggtggaatggaatgatgaggctgcttgtactaatgtgtttcgtaatcttctaccatacattgaatcagtcttttga

SEQ ID NO: 51993 - DNA, 1407 bp, Glycine max
  Peptide Sequence Number=SeqID_168771
atgcctcgccaaccgccgccgtcaccgccgtcgcagccgggcgttctggaccccgaaatctggcgagtctgctctggaaccactgtggagatccccacgctgcattctagggtttactacttcccgcagggacacttcgacgtgtatctttccgccgctgaacttcccggcggacccgccggtgcagaacctcctcgtcaccgacgtgcacggcttcgtctgggagttccgccacatctaccgcgggacgccgcggcggcacctgctgaccaccggctggagcacgttcgtgaacaacaagaagctcgtcgccggcgacgccgtggttttcatgaagaactccaggggaggggtggcgatgtcggaacgaggatcaaggtggatgaggaggaggaagaggaagaggaggtgagagaggttttctcgagggacgggagggggaagctgtcggcgaaggtggttgcggaggcggcggaactggcggcgaggagcatgccgttcgaggttgtttattatccgaaaggtgggtggtcggagtttgtggtgaagactgaggctgtgaatgaagcaatgagtgttgagtggagccacggaatgaaagtgaagatcgctacggagacagatgattcgtccagggtgtcgtggtgtcagggtacggagatgaatgccaatgtcaaagaggctccacagatgaggattcttacttgtgaaagtagctgtacagggacaaatgatgatgaagataaaaaacaagtacctagtttaatgatcctccttgaagcatacaaggaagccttttttaatggcgaccaaaataccgtagctcagattgaagaggggatatattcaatagcaaataggaaaaataaattgattcagaaattatcaagtttatcggcagacaaagctgcttccaagaagagttatcttcgtttacaagctgattttgataattttaggaaaaggactgacaaagagagacttaacatccaatccgatgcccagcaacaagtcattgaaaagcttttgttgatggtcgacaattttgagagaacccaacagcaaattaaagcagcaacagagaaagagaagaaaattggtgttagctatcaaggtatttacaaacaatttgtagaggttctgaggaatcataatgtttcagtggtagcaacagtgggcaagccgtttaatcccttgcaacatgaagccgttgcacgtgaggagtccacagagttcaaaaaagggattataattaaagaatcccgacgtggtttcttgctcagagatcgagttctaaggccagcccttgtcaaggtttccttaggtcctggaaataagaaatctcccgtgtctcctgacaagtctgtggagcaaccttcaacagctgctggaatagatgaaagatag

SEQ ID NO: 51994 - DNA, 1647 bp, Glycine max
  Peptide Sequence Number=SeqID_168772
atggactcccaaccgggtctctctctcgggttaagcgccactctctcatcacccgcggctccactcagtgacaccacctctgttccgtggcgtttattcaacgaaagacaccccaaaaaggaagagcaacaagaagaagaaaaagaagacgaagacggtggtgaaacgattaacttcatggaccagcgcgtgaagaggaagatagagggacaccaacaacaaccctgtttcccttcaaagcgcgtggccgtggattcctcagtggggtggtggaaccagccactgggcgttgcagaccccgagattttcgatatcatgcagaaggaaaaacgaagacaattcaagggaattgagttaattgcttccgaaaacttcgtgtgcagagcagtgatggaagctttgggaagccatttaagcaacaaatactccgagggaatgcctggtgctaagtactacactggtaatcaatacattgatgaaatcgagtttctatgttgccagcgtgcgttgttggcttttgatcttcaccccaacaattggggcgttaatgttcaaccttattcttgtacttctgctaatttcgctgtgtacaccgggattttgcaccctggggataggatcatgggtcttgattcgccttctggggggcatttgagtcatggttattatactcttggtgggaagaaggtttctgctgcttctattttcttcgagactttgccttataaggttaacccgcagagtggttacatagactatgataagcttgaggagaaagcgatggattttaggcccaaaatacttatctgtggtgggagttcgtatcccagagaatgggattacgcgaggttcagacaggctgctgataagtgtggcgcggtgttgatgtgtgacatggctcatatcagtggtcttgtggcggctaaggaagtagctagtccatttgattactgtgatattgttacctcaaccactcacaaaagtctccgaggtccaaggggaggtatcatcttttatagaaggggaataaaactaaggaagcaaggttttgttcataatcatggagatgatagtaattatgattttgaggagaaaataaactttgctttgtatccatcattacaaggaggcccccacaataatcatattgctgctcttgccatagctttaaaacaagttgcaactccagagtacaaagcatacatgcagcaggtgaagagaaatgcacaggcattagcatctgccttgttgagaagaaatttcaaattggtgactgatgggaccgacaatcatcttttgctgtgggatctaacagcacttggcttaattgacagaaactatgaaaaggtctgtgaggcgtgtcacatcactctcaataaatgtgccatttatggttcgatttctcctggaggagtgagaattggtactcctgcaatgacatctagaggctgtttagaggaagattttgaaaccatagctgattttcttcttagggcagctcagattaccagcattgtgcaaagggagcatgggaagtcatgcaaagatttcctcaagggtcttcagaataacaaagatatttctgaactcagaaatcgggttgagacattcagttctcagtttgcaatgccaggattcgatatttga

SEQ ID NO: 51995 - DNA, 1065 bp, Glycine max
  Peptide Sequence Number=SeqID_168773
atggatccctcgtccgtaaacggcttctactcgttcctgacgcgaggaatcgacgatctagagagcgtgttcctcagcacaaacttcatgtcaattcaattcctccaaagagcactctctcttctaagatcattccacacccaattgactctcctggttcagaaactccacctccccgtcggcgacaaatggctcgacgagtacatggacgaaagctccaaactctgggacgcctgccacgtcatcaagtccggcatttccagcatcgacacctactactccgccgccctcaacatcacctcctccctcgactcccaccgccccatcaccccccaactctctcgccaggtcaccaatttttcgttctctctatttgttttaacgtgtatcctccttcgaaacaaaacaaaaaaagattcttttgagaaagattgccttccaaacaaggtaataagggcgatagcagggtgtcgtcgggaggcggtgggattggaggaagagaacagaggattaatggaggcgaggattcagcccttgtcgcttcgatttgaggagagagtgtcgatcgagtccaagttgaacgggttcaacgggttcagaggggtgctgtacgcaatgaggaacgtgagttcgttgctgcttatggtacttctgtacggactcgtctactgctatggtgactcctcggacttcgtgctgggagggtgcgggtacgagggctgcctgttcctgggatcggcgttcatgatgtcgactgcgaggctgcagcagcgggtggcggcggagatcgggcacatgggcggcgcgcaggggatgctgctgcacgagtttcggaggtcgaaggtggctatggaagagctgagaggggagttagagagaagagggtctcaggggggagtggagtgggagagtgaggttgctattagagagagagtggagaatctcagagcctgttttggggttctcagatctggggcagacaacattgttgctcagcttgatgatttctttgacgagattgtcgaaggaaggaagaggcttttggacttttgcagtcataggtga

SEQ ID NO: 51996 - DNA, 255 bp, Glycine max
  Peptide Sequence Number=SeqID_168774
atggctggtgtgattccaacgagaagaatattgatgcagcatgaaaaatcgcaagagaaccgtgacacaacggcgtacaccaccacacccaatcacaacattcagtcaacggcgcaaggcatgactcagaccctcagcgccggcaagcacctccgccgcgtgatggataacgacgactgctcccgtgactggacgaactcgcgtttcttgttaatggttgatcggaaatggaatcttggcaagaaattgctttaa

SEQ ID NO: 51997 - DNA, 1605 bp, Glycine max
  Peptide Sequence Number=SeqID_168775
acatttgtaggaacaccattctggatggcacctgaggttattcagaatactgatggatataatgagaaggcagatatctggtctctgggaatcactgcaattgagatggcaaagggggagcctccacttgctgatcttcacccaatgagagtgcttttcattataccccgagagaatcctccacagaggccaagtgctaaggaacttctcaaggaccgttttattcggaatgctaggaagagttcaaagctttcagaaagaataagggagcgtccaaagtaccaaataaaggaagatgaggagacacccagaaatggtccaagtgggatgggggaggcatcaggtactgtaaaggtggcaagagattcaagaggtgaagaaaataatcgacccagtgatcagggtaaaaccctgaaaagtgctggatgggacttcagcattggtggatcacagggtactggaaccttccgtaatgtttctcgaccaccgcagtttagagataagaaaactgaagtttcacataatcagcttacccaacgaaaagctccagagaggggctatcaaggggtatctgtcaatagaagtgcacttaatgagtcacttgaaagttcctttggaagagatcttagagttccccaccatgatgagcatctggataatcatcttgaagatgatgaattatctgggaatggatcaggaactgttgttattcgatctccaaaaggatcaaggtcatctgcatttcgtgaccagagctctctgtctagcagcagctatgcttcttttgaagatgcttcttcaagtggaactgttgtcttacgtggccagcatgatgagtctgattctccacagacaccaaggtctcgattgggacttaatgacagaaattcaaatgcctcaatggaagatagtgcagcaaatcttgctgaggcaaaggctgctatcctgaggaaatcgaatgctcgagagagacttgcccggggaaaaatcaacaatgatagacaggaaagcaaaagagatcaaaaggctagtagctctgattcttcaagaccgcatggtgaatatgatgcacacaagagcatgttaagatcacatcatgctagtgatggcgaagaaagtgctaaaataatgtcatcgtcggtgccgttatctgttttacttattccttcattaaaagaggccattgctgatgatccagaactcatgagggcagttatcaattctttaataaacatggagggtacaaaacctaaatcctgtgatgtttttgtcaaaaagttgcttcagcgattggcaagttcaaaggaagattcattgaaggacatgcagggactggcaggccaactattcagcaagaacaagtcagctgaagaaacccaaaatgcggaggctgataacaggaagaaacaacaaaacaaggaacataattcaaatagcaatttaagcccactagcaagatttcttctctcaaggtttatggaagttatcattttcccaatggcagggccaaacctcacgggatctaaacccatcttgagcagagaagatatggaggttataaaagctaggaagagttcaacttttgaaatggctgactttgggtag

SEQ ID NO: 51998 - DNA, 336 bp, Glycine max
  Peptide Sequence Number=SeqID_168776
atggggtcacttagtgtatgcgggactagttttgcctgtgtgcttgagaacgcgtgtgagacacaagagaagcaaaagggaatggaactcgttaagggtcaacgaattagcatattacttgttaagaaacaaggaggcctttttatgtgggcagccacaggcgagagggtgttggaactaccttttttcatgattgtgaatctgatatgtgattttaccttcaacttcctttacctcaccgtgatgagaagatgccacatgtcgccaagcttgtcaccgaatgctgatgaagcacgagcttctgacttgtcacttgcggagcggggtcaactttga

SEQ ID NO: 51999 - DNA, 241 bp, Glycine max
  Peptide Sequence Number=SeqID_168777
tgtcatagtaggcttcgcggacgacggagtcagcatccttgaggcagcaaatgatgatcttggtgagatgggccatcgcggtgacgaagtgcacgacgcagaggcaaagtgcgtcccacttgatggcatgcttgggatcgatggcagcttcagagtgtgcggtgaggaggagagcacgttccacttgacaatgggcttgagaattagggcgacgaggttgtgtggtggcgcggtggcatga

SEQ ID NO: 52000 - DNA, 609 bp, Glycine max
  Peptide Sequence Number=SeqID_168778
atgacgagtctagttccaagagagctacaccttgctggcagatataggtggtcaagcatatttgacagggagctcaacaaactagtcgccatcaaagtaattgacttagaagaatcagaggatgaaattgacgatatccagaaggaaatttctgttctgtcccaatgtcgatgtccatacattactgaatattatggttcctatctcaatcaaactaaactttggataataatggaatacatggctggtggttcggttgctgatctagtagaacattatattttgattttgagggcgagccctggtgcagcggtaaagttgtgccttggtgacttgttggtcatgggttcgaatccggaaacagcctctttgcatatgcaaggatccaatcgggtcctccccttgatgaaatgtcaattgcttgcattctacgtgacttgctgcatgctgttgattatctacatagtgaaggaaaaattcatagagacattaaagcatttacatgttaattatacagctgcaaacattttattgtctgagaatggtgatgtaaaggttgcagattttggtgtttctgctcaattgacaaggactatatcaaggagaaag

SEQ ID NO: 52001 - DNA, 537 bp, Glycine max
  Peptide Sequence Number=SeqID_168779
atgaatataacctctcaagacatattaactctgtttactcttcaagtctatgatggcagaggaacccttgaagaaggtgaaacagcagaagctagattcatcaaaattcaatctgcttatgaattgcttatagatagggagaggcgaagacagtatgatatggatagccgggtcaaccccatgaaggcatctcaggcatggatggagtggcttataaaaaagcgaaaagctttcgatcagcggggtgatatggcaattgctgcttgggctgagcagcaacagcgcgagttaaatcttcgtgtgcgtcgactttctcgttcaaagattgatccagatgaagcaaggaggattctggcaagagaaaagaaggcttcagctgaatattactcgaatacccttaaaaggcacacccttatactgaagaaaagagatttgatgcgaagaaagtctgaggaagaaaagaagaagactatcaaccggctcttggcagcagaaggtcttgagcttgatgattcggatagtgatgacgcactgtag

SEQ ID NO: 52002 - DNA, 2238 bp, Glycine max
  Peptide Sequence Number=SeqID_168780
atggaaaatcaacagttagtggagacaaatggagcaggttttcaagctgttgagaatctgcgagtagatgatttggaacttgatcaggataaacaatcgaaggaggcaaaggctgagaaaattggtcacgaagacgataaattggatgatatatcagaccagataaatgacggggaagatgcaaggtctaatacaaaagatgagagtgggaatttgcaatctggaactcaaccagaaaacttagagaccaaatctgaaactgaagtcagtactgataagcgagagtattccggtgataagatgggtgcaggtggagatttggagcctaaaaatcaagaaacaaatatagataataattctggacagattgacttggctaaagaagtggctgatagggaatcaacgcagatatttgataagtcagatgaaattcctagcgaggaccacaatttggagcctgtatttgatggaacagaagttccagggatggaagctaaccggagtatgtcaggccgtaggttgaatgatcaggattctccaggtgtggttgagaaggctgtggctctcaagaattttgttaaggagaagagtgcagtggcagtctccaccatgatgcgccgcctttctggaaaaagagatgaaggtaccgaggataatgctgatgatgaaggtaaggatgtttcagacatcccaaaagtcggtgaaaccaaagtggtgtctgacaaggcagtggagaaatttgactggaatcccttacattacatcaagaagtcatctgatgttggtgtggaaaacaaaactgagcagggggactcaatagccatgaaaggaaggattatactgtacacaaaactagggtgccaagaatctaaagcaattaggctatttttgcgtatgaaaaggcttagatatgttgaaatcaacatagatgtgttccccggtagaaaggtggagctggaaaagatttctggatctgcttctgtacccaaggtttttttcaatgaaatactaattggaggctggaatgagctaaaaaacctggatgagtctggtaaacttgatgagaaggttgactttcttattactgaagcaccattatttgaagccccatcaccacctctctctggagaggatgatgtgtccagtagtggaccacttgatgaattggcaattattgtccgtaaaatgaaagaatctattgctgtgaaggatcggctgtataaaatgcgcaggttcactaactcttttctcagctcagaagctatcgacttcttatcagaagatcaatatttggaaaggccagaggctgttgagtttgcacaaaagcttgctgacaaacttttctttcaaaatgttcttgatgaggatatatttgaagatggaaatcacttgtatcggtttttggatgatgacccaactgtggtatcacaatgtcacaacattactaggggcataattaccttgaagctcaagcctttagcagaaattgcatcaagattgaggtttctgtctcgtgctatgtttgaagcctatgtttatgaagatggacgtcgtattgattatacaagtatacatggaagtgaggagttcgcaaggtatctgagaatagttgaagagcttcaaagagtggaaatatcggattcgtctagagaagagaagcttgcgttctttattaatctttataatatgatggccatccatgcaatcttagtattgggccatccagatggagcactggaaagaaggaaattatttggagagttcaaatatgttattggtgggtcaacctactcactttcagctattcaaaatggcatattgaggggaaaccaacgaccaccatataaccttaagaagccatttggtgtaaaagataaacggttgacggtggcacttccttaccctgagcctcttattcattttgctttggtatatggtacccgatctgggcctgcacttcggtgctactctcctggaaatattgatgaagagttattggatgcagcccgtaattttctgagaaatggaggcattgcagttgatttgactgcaaaggctgtaaatgccagtaagatcctaaaatggtatagtatagattttggcaagaacgaggtagaggtgataaagcatgtttcaaactacttagattcagctgactcagaagtattgttggacctacttgctacttccgagttgaaggtgacatatcagccttatgactggggcttgaactgctag

SEQ ID NO: 52003 - DNA, 174 bp, Glycine max
  Peptide Sequence Number=SeqID_168781
atggaagttatttatatactggaggaggactctaaagtatcaaagttaccaagaacagttgagggtgtggttcaacctggtgccctaataactcttccttcaccgttggaagtggcaaggcctgaggttcaaagaaattctttgccagcagggaacctcaatgaggaagaatga

SEQ ID NO: 52004 - DNA, 156 bp, Glycine max
  Peptide Sequence Number=SeqID_168782
atggatatcttgtgggaaactattgataactctctgaaaggctgcaaatggattgccatggaaaattcacatgggcataccaatgtggtagagaggactgaggaaggtgtgaattttgttagtgaaaatcattacaaggagagagggggagggtag

SEQ ID NO: 52005 - DNA, 363 bp, Glycine max
  Peptide Sequence Number=SeqID_168783
atggattcaaaggattcaccattccaaccaaaatcaaaccctaggagagatagaagagacagagacagttcaaggttgtgtgaaagaggaaaaccagagaattcaaaaattctcacatctattacaatgatggtgtctatgggtgcaaacatgcaaatgtgtgaactcttgagtgatcaagtaaggatcgtggagcttctccttcaaaaggctgtgggcttgggtgcactaattgacctgatccaaagtgaaggtgattcaagaagggttattgggggagaaattgaatttcaaattcttgggagacaattcggaagaggtggcagttgtaaagttgttagccatggtggatctctggcctag

SEQ ID NO: 52006 - DNA, 189 bp, Glycine max
  Peptide Sequence Number=SeqID_168784
atgggtagtgccattagcaaagttggtaatgccaatagtagctcccctactaaaaattttgcatacaaaacatcattggagagtgcctccgttggccatcatgttgttgctggttattcgtctggtcattgtcttgttgctgctactggtcttgatgttgctggtgaggttgttgatgttgatgaataa

SEQ ID NO: 52007 - DNA, 441 bp, Glycine max
  Peptide Sequence Number=SeqID_168785
atgtgcacttttgagtatgtcctaccaaggctttgtggtctttgttgtttgaggttgttggaattgcctgtgacggtaaagagcttattgttaccaaatttcctttgtattggacacaatatcatcaccgagatgaagttggtgcttatcgagttggagatgatgattggtctaaagaagaaattgattcttaagattaagaacattctcgagactcgggagaagtggggccataagaacatttccatgtccgttaaggaaaagttagaggtagtcaaccttgatgttgggcatgttgatgttagtaatgttgcatcttctatcaggaattgtgacattaaaaatccttcgttaaagaagaaaaagtgggttttgttgcctagcgatagcaacatacctactaacagacccagaaggatcatcaagaggctttgtttgtga

SEQ ID NO: 52008 - DNA, 234 bp, Glycine max
  Peptide Sequence Number=SeqID_168786
atggtggcgaagaagagttgcacgcatagagccttagaggttgaggtcgtgcgtatctggggtagagatggtatggtggttatgggttggggtggcggcacaataagggtgttgcgtgcgacacgatatgactggagatgcatgcacgacgcaatgatgcttggaggaggacaacagtgctacttggttcacggggttagggaaatgggaagtcgtagggggaaggggtgttag

SEQ ID NO: 52009 - DNA, 123 bp, Glycine max
  Peptide Sequence Number=SeqID_168787
atgacgaaggaaaaaaagccatttagtgcaaagaaattcgcccaagcgagctgtagctcgctcaggcgagtttgtgacttagtgctgaaggcaccaattcgcccaggcgagttgcttgcttag

SEQ ID NO: 52010 - DNA, 186 bp, Glycine max
  Peptide Sequence Number=SeqID_168788
atgacaattggtacgcttgccaaaagtcctaacagaatcccatttccagttcagctgggaaagtggcttgatgactgggtggttgtcggaaatggcgggagggagagttgctggagaatcgggcaagggactgtggtgaggcttcaacaaagaaacatggaaaacaagccagtgttgaagatttga

SEQ ID NO: 52011 - DNA, 498 bp, Glycine max
  Peptide Sequence Number=SeqID_168789
atggcctcaagaaagagagcaagagctgaagacatcccttcatcatccaacccacctcctccgacagcaaccatggaaccagatgcccaacatgcaccacccataattcctatgttgcagagcttattcagggggcagctggtgattgtatacaaccaacaacagttagctcacaataggccaatagtatccatggaaaaatttctggacaaggtggccaggcctgaagcccagcttcctttgggaagagcccccgaggttgttcctcccagtcctataccaacaaggacaaagcctgcactagctgagtcacaacctccagtagtagagccacctgcttctctggaggttgagatactatctccttcaccaactccacgggcaccacctttgatactcattcctgatgactcagatgctgaagctgctgctcctcctgactcgccagcctactacctagaggatggttcggacttttctgactggatggactattga

SEQ ID NO: 52012 - DNA, 210 bp, Glycine max
  Peptide Sequence Number=SeqID_168790
aacaagctcaagaggttgctcaagaggttggcattaacagatccacttaaactgttacaagaatacaataagggtaagggaaacttcactaaggagaagaagcacagagttgtcacgatggtcgagttaaatatgagataccctagccatgagaagaagcacagacttgtgacgatgctcgagtgcgacgaacacgatgctcgaccttag

SEQ ID NO: 52013 - DNA, 1587 bp, Glycine max
  Peptide Sequence Number=SeqID_168791
atgaagggtggtggtgggaagagaaaggcttctacctcggaggctccgaacgatgttgttgttgttgttgctgctgcttctgctccttctgatgatgctgatttgggtgttggagatgtcgggggtgtgaaagttcaaaactttgagggaaacgagggtacccagttgcggaatactgaagaacaggaagaagaaccccaccacgtggagggtgatgaaggaggagaagacgaagaagattatgccgagggagaggaagaatatgaagaagaaaatggtggtgctgttgctgggggacaacaaggttttcctgctcttggtgaaaatttctttgaagttgaagccatacgtcgtaagaggttgcgcaaggaatgggtggcccgagacagccaacacttgggagcctctggaaaatctagaagcttgaagtccggaaaacatcgtaagcgcaaacgcaagcatgtagtgcatcatactcaacccaagaagcggctggagcgttcgacaactccttacagccttcggcgtttttcaactagtacagctgagaaccatacacagtctgctcctcctcttaatgatcctagccttccagatattcccgccttccctcacactgtgctgttttctgatgatgtgggaaatggtgctgaaggcagcagtcttagaaaagccacacccagtaatgctaacaggtctgcaaatggttcagaacaaaatattaaaaggaatgaggaaaatgattatgatcctgtgcttagtgagcttaaagctatgacttctaatgggaatgatgcagacaggcttgcaatacggattccagaagctaagggttctgggccttctggcagtaatggtcaaatggatgctaaatcaaagggggcttgcatggaaacaagtgaaagtgaccgctgccggggatccaaaaggagaaaatgtggttccgtaaagaggttcaagaaagaactatatgctaatgagcctgctaatgcggaaaatccagttagcatgcctgttggtacagctgagccagaacgaacaagagatgctggtagtggtggcaatactaatcatgccagacctgctagcaatattgtaaacattgtaaagccagtaggctattcagcttcagtagccagtggaatgcaggatgttttagtaacctttgtggcttcaaaaaagtcaagcctatccatcttgggttcactattgctcatgacttgtattgtagttagcttgattgagaattggtttgatgaaggaaataacctagtattaggaggaagaaagaataggtgtagcaaagaaagcaaatcggagttagagagaaagggtaggctgaatctgaaaagtactctatggaggcaatgggcaatcagcaaaagccaggcctgtatgatcctaagccccttgtacatagatgaattgattgattcatcagatcctaggtcgagattgaaggggctcgaactcgcgactttaccagtaaaagtgtccaataagcttaccacgaaactagtgtgttgcttttgtcagagtatggagttacgctcattcgacttgccacttagcattttcaaggtttag

SEQ ID NO: 52014 - DNA, 951 bp, Glycine max
  Peptide Sequence Number=SeqID_168792
atgggcgacaccaacactttgcgtcgcctcaaagaccaatttttctgggataacatgagccgcgacgtccaccaactgatttcggaatgtagagtatgccaacagacgaagactgaatgccgtaaaccagcaggtttgcttcaacccctccctatcccgacgggcatctgggaggatttgtctatggattttgtcactgggctgcctccattccacgggttcaccacaattttagtggtcgttgaccgattctccaggggcactcatctcggcgccttaccccctaaatactccgcacataaggtcgccggactcttcatcgacatcgtctgcaaactccatggatttcctcgcagcctcgtctccgatatagatctgttatttctcaatgcattttggcgcgaattgttccccatcagtggcacaaagctccgttatagtactgcttaccatcctgagtccgatggtcaaatagaagtccttaacaggaccctagagcaataccttcgctcttttgtacatgatcgccctgccctgtggttttctttcctctccttagccgaatggaataacaacacatccactcactccggcacgggtctttctccctacgaggtcacctatggtaagcctccacctaccttaccacaatatattccagggacatcttgcattgaagctgctgattccataatcaccaccaaacaggcagtgcactccaaactccaacaacgcctgctaaaggcccaaacacttatgaagacatacgtcgaccgccatcgttgggatgtccagtttcaggtaggggattgggtttatgtccgccttaggccttatcgccagctttccctccgccctcattactccaagctcgccaagcgtttctatggcccttacctggtcgttgagaaaattggcaccgtggcataccgccttcagctgtcggtgtga

SEQ ID NO: 52015 - DNA, 961 bp, Glycine max
  Peptide Sequence Number=SeqID_168793
gatgatgtcgaggtatctccctcccctgctccacctgattcgcccttctttcctattgattcccttcccccatcacccacggccgataaccccccacacttgagcctgaatgcaatgtcaggcatgcccgcccctaagacttttcgtgtctatggcactattcatggtcaccattttacaatacttgttgacggcggcagtacgcataatttcgtgcaactgcgcattgccaaattcctcggcctgccttccactccgatacaacccctacctgttatggttggtgacggcggcgtcatcgattgcaaccttcgcttccctcaggtttccatcaccattcaagggcaccatttcattaatgacctcttcggacttgacttgcatggcgcggacctagtccttggagtccaatggttgcgggagttgggccctgtgactattgattacacctccctgtctatgcacttcacccacatgggccttctagtccaattgattgcagacattcctgctatctcaaccttattccatatccaccccaccccaccttcttcttcaccacttcacacctcccccacccttttggaagacgaacacctacctccccctgaattcaccaaccttctcagtcaattccaccaccttttccgcgaaccaactacccttccccctgcctggccaatctcacaccacattcacctcgcccctgactcgaaaccaataacggtcaaaccataccactatccctacagccaaaaaacagaacttgaaaagcaagtccagtcaatgctcgactccggcctcatccgactcagccacaaccccttctcctcccctgtcctccttgtgaagaaaaaggatggtagttggcgatgttgcattgattattgtgcactcaatgccattacaatcaagcacaagttccccatgcccaccattgatgaactcctcgacgagctcg

SEQ ID NO: 52016 - DNA, 261 bp, Glycine max
  Peptide Sequence Number=SeqID_168794
atgaccaactcatcatcgtcatcaaccaaggagtggtttctttggggcgtggtggtggatttgctgcacttgagaatggtattatgggaggaagaggaagaggaaggagcgggtgccgaggtggaaacgatggtgatggaagaggatgtgacatcggatttgaaagaagaggaacaagaggaggaagaaggagcacatatatggagagggaaagtgatagaatcaaagaaaagggggattcagagagtgagaaaagagtag

SEQ ID NO: 52017 - DNA, 911 bp, Glycine max
  Peptide Sequence Number=SeqID_168795
ttttggaaccaacagtgactcatgttcaccaccacgcttttatccagaatcgttttactggtcttggcaaagattctgctgttctgggttgggtgaaatcattcttcaagcaattttatggatctgtgaccaaattagattatgtgacattaaggcttgggttcattatgacccactgcaaaggaaatccaaagtttaatttccataaatacatgattcgtacccttgaagatgatttcaagaaagttgttggtataagctggtatctttggatctttgtggtcatctttatgttgctgaatgtccatggttggcacgcatatttctggatttctttcattcctctcattcttctacttgctgtgggtactaagttggagcatgtaataatccaactagctcatgaagtagctgagaagcattcggccatagaaggtgaattagttgttcaaccaagagatgaccacttctggtttaatcgtccgcacattgtcctcttcctgattcacttcatcctcttccaaaatgcttttgagattgcatttttcttttggatatgggttacatatggctttgactcctgtataatggggcgggttcgttacattgttccaaggctcattattggggtatttattcagttactatgtagctatagtaccctgccactttatgcaatcgttacacagatgggaactcactttaagaaggccatatttgatgaacaagtgcaagcacgccttgtaggttgggcacaaaaggcaaagaaaaaaggacaaagaggtgataatagcctctctggccaagaaagttctcgtgcaggtgctggaattcaactaggatcagtgttcaggagggaatctgcctcagaagacaatgttattgtcccaagaaatgatggatccgaatga

SEQ ID NO: 52018 - DNA, 639 bp, Glycine max
  Peptide Sequence Number=SeqID_168796
atggtttcgtccgacaagcgacccttctcaggatatgacttcaccctaggtagtttatgggtcttgttcttgactcgaaaagctccctctacaaatccttcttgcctcataagcctcctttgttcttgtgcttgtagtacattcaccaattttgctagagtaatacttgacaaattccttgagttctctagagatgcaattgtggcttcaaattttttagaaagggacattaggaaagattcttggaacttgatatgtgacctagttgctgatacatctcttccctggttaatatttggtgattttaatgattttgtctctaatgatgagaaaataggttgggttaaccacccctcttggcttcttagaggttttcatgagactattttagaatgcaatcttcatagccttcccatggaaggatatcaattcacttgggctagaaggcttggagaatgtgatggagtagaaggaaaattggatagagaccttgcaactttggaatggattgaccttttccttaattttagattacttagtggtctatcttcaaaattttaccacacacctattattctcaaccttgacggcattcatagaagaggctttaaaatgcatttttgttttgagaatgcttga

SEQ ID NO: 52019 - DNA, 723 bp, Glycine max
  Peptide Sequence Number=SeqID_168797
atgggtggtggaggtgaagaagggaacaatttggaattcactcccacttgggttgttgctgttgtttgttctgtgatcgttgctgcttcatttgctgctgaaaggtttcttcactatggagggaagtttctcaagaggaagaatcagaagccactctatgaagccctgcaaaaaattaaagaagagttgatgctgttgggctttatttctctgctactgacaataacacaaaatgggatcatcagaatttgtgttccagtgggttggactcaccatatgcttccttgcagtctaaaggataaagaaaaggaagaatcaacaaaaaccacatcacattttcagacatttttctctttctctgatatttctggcactgctaggcgccttttagctgagagtgagagtgagaatgaggatcaccaaccagcaacaggagaaaaactttgtgctaggaagggcaaggttcctctattatctgtggaggcactgcaccaccttcatacctttatttttgtcctagctgtggcccatgtcacattttgtgttctcactgttgtctttggagggttaaaaatacgtgagtggaagcactgggaagactctattggcaatgacaataaaaatgaaacacaaccagcatttggtagccatcaaacgctaagcctttcaactcatcatgatcctgtaggccaaatttctgtttctgtgattgctaatttttaa

SEQ ID NO: 52020 - DNA, 489 bp, Glycine max
  Peptide Sequence Number=SeqID_168798
atggttggttgtgaccctaaagggaccttctcagttggggctaagctttcccgctctaggatcttttttggcttcctctcggactcgccatacgaggtcgccagtctctttgtcgatgattccccaccttctatggggatcatggtgtttgtgccatatgcctttagacttgtcaagtctagtacgcagggccctgagaatgactcgattagttgcctctgcatgtccgttagtctaaggatgttcaacagaggtgacaaggtgcttgatccctatccttgtcaagaagtcttcgtaagtctgagctttgaattgagtgtcgttgtcggtgacgatagcatatgggaggtcgtacttggagataagtatttaataatgacaagtaagtatttcacagctcctagggcctttggtagcagtcccagtatgtccattccccacatggcgaaagggcaagcgccacatggcgaaggaccaaggggagcttag

SEQ ID NO: 52021 - DNA, 333 bp, Glycine max
  Peptide Sequence Number=SeqID_168799
atggtcttcgtctgcaaaaggatcgaagcgggtctgaaaagaggcaaatttgatcatcctactttgataagtgagaaagctggggcaaatgaagaggatgagaatgagggagaaacccatgctgcgactgtcattccctacatggccaaacttcccaccagcccaacaatgtcattactcaaccaatatcagctcttctcattacccaccacccagtcatccacaaaggccatccctaaatcaatcacaaagcctgtctaccgcacgcccaatgcccaaacactacctttagcgaaaaccaaaaaggaattttgtagcaaaacgcttgtatga

SEQ ID NO: 52022 - DNA, 315 bp, Glycine max
  misc_feature (288)..(288): n is a, c, g, or t
  Peptide Sequence Number=SeqID_168800
atggaatctattccaaacatatataccatggttccttacctcgacagggagttcttctattcaatccttttccttctccttgttgctggatatctcgttcgtacacatcttctctttgtttctcgagtctatagtgagttacagacagagttcgaaaagaatctctttctagttgctctggaacaattaggagattctctagaagaaatacggagttttgcttttggtggcaacatgctatggggtggtgtcccacttatggggtcaaatcaatacgttctaagaagntatatttgtatctcatcgatctcataa

SEQ ID NO: 52023 - DNA, 240 bp, Glycine max
  Peptide Sequence Number=SeqID_168801
atgggtttgggtgtatacgagaaaaagagagctccgtgtgaagaacatttctctcaccacaaacattatatcacaaattccaatggtggggatgtgagaaaatgtgttttgaatctggtgtccaaacttcgtgatgatccaacagttaacgagtatggaatcatagttttactaggacaggtagggtaccctagaaatataggatttttcagcccttgtattttagggcacctagactag

SEQ ID NO: 52024 - DNA, 1290 bp, Glycine max
  Peptide Sequence Number=SeqID_168802
atgttcagcaaacttgcttactcaaccctcgcattgaccgtttctcttggcaccgtgatgtcctgtcaggccgaagttaccggcacaaattttgcggccgcctttgatcatccgcagcaaattaacgccggcgatctgaacgtcggttatgtcgatatcggcccgaaagagggtcaaccggtcattttgttacacggctggccttacgatattcacagctacgccgaagtcgcacccgcgctggcggcaaaaggttaccgcgtcattgtgccttcgctgcgtggctacggcaccacgcgcttcctgtcagcaaaaacgccgcgcaacggtcagccttcggccatggcgaaagacatcgtcaacctgatggacgccctgaatatcagacaagcggtatttgccggatacgactggggtgcccgtacggcagatatcgttgccgcattgtggccagagcgcgtgaaatctctggtctcggtgagcggatatctcatcagcagccagcagattggtaaacagccgctgccgccaaaagcagagcagcagtggtggtatcagttctatttcgccaccgcgcgtggcgcacaaggctatgccaaaaacacgcatgacttcgcgcgcttaatctggtcgcaggcatcgcccgactggaaatttagcgatgcagtctttaacgccagcgccaaatcccttgataacccggatcacgtcgcggtgacgctcagcaactatcgctggcggttagggctggaaaaaggggaaaggaaatacgacagctacgagcgaaaactggccgccttgccgaacattaccgtcccgaccatcaccattgagggcggaaacaacggcgcgccgcacccggcaccacaggcctatgcatctaaatttaccggtaaatatgagcaccggaccttcggggcaaccgtggggcacaacccgcctcaggaagatccgaaggatttcgtcaaggcggagagttcggtggagcatattgatcatatccttgtcgtcgatgacgacagggatattcgtgaactgattgtcgattatctcgggaaatctggctaccgcgcgacgggcgcggccaacggcaaagagatgcgcgccgtgctggataaacagcatatcgacctggtggtgctggatgtcatgatgcccggcgatgacggacttacgctatgccgacagttgcgcagcggcaaacataaagatctgcccattctgatgctgacggcgcgcaacgaagagacggacaggatcctgggcctggaaatgggcgcggatgactac

SEQ ID NO: 52025 - DNA, 192 bp, Glycine max
  Peptide Sequence Number=SeqID_168803
atgccctcctttcgcgatttggagcagaaatgggcaccaaaggttgaagctttgttgggcaacaatggtggaggaagaaaagaagaagaaggctgcctatgccacatgtctccatttgagtggagcaaaaagggcccactttctcttttgattgtgacccatactcagccacaaaaagtgagaaaaatctga

SEQ ID NO: 52026 - DNA, 318 bp, Glycine max
  Peptide Sequence Number=SeqID_168804
atgcatgaacgacaatcaatgcatgaggctacgaataaaagtggagaatggagaattgtgctaggcaatcacttcgcgtggctccagactcattggtggaggatgcatgaacgacaatcaattcatgggcctccgaataaaagtggagaatggagaatggcgctaggcaatcacttcgcgtggttccagactcattggtggaggatgcatgaacgacaatcaatgcatggggctccaaataaaagtggagaatggagaattgtgctaggcaatcacttcgcgtggctccagacccattggtggaggatgcatgaatga

SEQ ID NO: 52027 - DNA, 729 bp, Glycine max
  Peptide Sequence Number=SeqID_168805
atgcaggatttgcaggtatgtgatgtgcgagaggaatggctgggccagtctttggatatttcaagattgaaggcactaggcgatgtgcgcgccaaaaatctgttgcgtggctggtttcagcagttaaatctacgcatgcctaatacagaacagttgtttgagtattggcaacaactttcatccgtaaaacctcaccgatacctgcacctgccattacaaggtcaaacgcaaagtcatcgtgcttacctgcaccattaccagcaacgcttatattgcgtgggcaagcctaatgcgttaccgcaaaccccactcatttggcaggggcatcagagtcagatatggggcgactggcaagtgcagtttaaagtcagcaaagcgcggggcattgccctggctcggctcggtatctctcctgccgccataaccttgaataaacgctatggtcagcctatcccattaccagaaggggtcgagttgctattgatgccgcgctcaggaggtgaagccttgcaaccggatgccaaacgaccaagacgtgagttaaaggttatttttcaaatgctggccgtgcctccgtggcagcgcgccttctatcctgtggttcaggttaaaaccaatcaaacaatatcctccccgtcgctagtgggtttagctggactcgcagttgatcactcctggcgtccaggccgtaatgcttacggtctagaaattttcctaacgcccctctaa

SEQ ID NO: 52028 - DNA, 1092 bp, Glycine max
  Peptide Sequence Number=SeqID_168806
atgcggcatcccggcaattgcacggcattagccggtggggcagattttgtgcgcgttaaccagtgggccaatgcctatatcgccaatgaaggttttatcgaaggggcagccgctaaagcgctgcgctatcgcaatcagctgcgggccgatcacatccgcgtatttgccgatagccatgttaaacacggcagccacgcgattgtcgccgaccgctcgattcaggagctgacgcgtgacgtcgacttcttcgaagccgatgcggtgatcgccaccggccagcgcaccggcgacagcgccacgctgagtgaaatcgacgaaatccgcgccgcaacggccttgccgctgctggtgggctcaggcgtaacgccggacaacgtctgccagatccttggccgcacacagggggtgattgtcgccagcacgctgaaagttgatggcgtgtggtggaacccggtggaactggcgcgcgtgaagcacttcatggcggcgatgcagcagcaccgctttgtcgtcgacattgagcacgatcggctgccggccagcgtgtttaatcgttatctggtgtttgagggtaacttcgtcgccaccgccatcgctatttttgcgctggcggtgagcaaggcgcccggcattcgtcagcagcgctggctgattggcgtgctcaatgcgctggtggatacgcaaatcgcctggtttgaggcggtgctggcgcggcgcggcattcagccggcggattacccggacgatctgcccggcgtcagcggattccgcgatggcatgctgaaagtcgcgcagcagggcagctatgcggaaatcatcaccctgatgttcggtgccgagtggatgtattaccactggtgcctgcgcgtcagcgcgcaatcgcagcaggacgctgacgtgcgccgctgggtagagatgcatgccgaagacgagttccatcagcaggcgcagtggctgaaaaccgagctggaccagtgcgcactgacgctcagcgcggcgcaacaggcgcagctgtcgcagctttacgcccgcgtgctgcagtgggagatcgatttccacagcgcggcttacccggagagcgcccatgactag

SEQ ID NO: 52029 - DNA, 312 bp, Glycine max
  Peptide Sequence Number=SeqID_168807
atgaattgccttttcgttcatgtgtcctccacattcgagtttggagctatgcgtagtgattgcttagtgcaattctccattgtcaatcgtttcggagcccatgcattgcggttttcggtcatgtggtcctccaccttggagtttggagccatgcgtagtgattacttaggtggcaattctccattctcaagcctttttcggagccccatgaattgcgttttcgttcatgtgtcctccaccttcgtgtttggagccatgcgtagtgattgcttagtgcaattctccattctcaatcttttcagagccccatga

SEQ ID NO: 52030 - DNA, 2263 bp, Glycine max
  Peptide Sequence Number=SeqID_168808
cattgaggaggaatggtggtatttggacactggttgttcaaaccatatgacaggacataaagattggttctgtgaaattgatgaaacagtgaaaaggaacatcaaatttggtgatggcaggtcaataatggctaaaggaattggcaaggtggccataagaagagtagatgggagcaaggtgactattagtgatgtccaatatgttcctaacatggaaagcaatttgctaagcttgagacaattgctagagaaaggattctcaatgcatatggaaggtgaacacatggaagtagttgattctaatgggaaatatgtcttgaaagttgttgtgtctaagaatagaacattcaaggtgggtgtgagcaccattaagcagaagtgcttgactgctcaaagcaatgacagtgtgtggaagtggcatagaagacttggacatttgaacttcaacaacctgaacaagttgcagaagaagaacatggttgtgggactaccttcaattgaagtaccaaggcaagtgtgtggtagatgctgtgaaggaaaacaaccaaggaaggcttacaatgcagcaattccaaccagggccaaagagaaacttgcagtgattcactctgatatgcttagaactgatggtggaggagagtacacttcacttgaatttgagaatttctgcaaggaagaaggaataattcatgagaagcatcttccacatgatttctgggcagaggcagtattcacaactactcacatcttgaatagatgtcctacaaagaggcttgacagtttgacaccaaaagaagcttggagtggactcaagcctagtgtgaaacacttcaaggtatttggctcactctgttacagacatgtgcctgagcaaaatagaagaaaactggacgcaatggctcaaaccttgattttggtaggatatcacagtactggggcctataaactatttgatcccttgagcaagaaaattgtgataagtaatgatgtgattgtggatgagacaaaggaatgggactggaacattggtatggaaagacaaaccaatgaaacagtagaagtggaactggaaggagaagaaatacaggatgaagttcagattgacaatgagcaatatgtgaatgatgagttggggtcactaagacagataactccaccagtgaggtttcaagactatgatgtcttccctgatgctgctatcaatgttaatggtgagctgatgaacttagtgctgttagcagaagcagaaccagtttcacttgaagaggcactagctattccacattggagaaaggccatggaagaggaactgagatcaattcagaaacactacacttgggaaatggtgaatttaccaagtaataagaaagccatagaagtgaagtgggttttcaaaaccaaagtcaagccatctggtgaaattgccaagtataaggcaaagctagttgcaaaaggtttcttgcaaaagcttggtcttgatttcaatgaagtatatgcccctgtagctagaattgaaactgtgagactcatagttgcaattgctagcatgaggaaatggacagtaagtcagctagatgtgaagtctgctttccttaatggtccattagaagaagaagtatacacaaggcagccacctgactatgagaagatagacatggaagataagaagcaaaagtttttgaaatgcaccactgaacatggagtgtacttgaaagattgtggagtaactggtgtagtgatgctatgcttgtatgtggatgatcatcttgtcactggagatagcaaacaggagattgacatgtttaagaaggaaatgatggatgagtttgaaatttctgatataggcataataacttatttcctaggaataaagctgtctactggtgaagacacaaatttggttgattcaacactatataggcaactcattggctcattaagatatctgtgtaattctaggtcagatattacctatgaagttggcttggttagtagattcatgaagaaaccttgcaaggatcatctacttgcagctaagagaattcttagatatattggagtcgagatgttggtgatagaaagagcacatccaactgagtatatctcagctgcttttggtgcaagccaagccctctggctaggaatgttattggaagagcttaacatcaagtgcagtaatgtaatgaagctcaggattgataacaaatcagccatagaccttgctaagcatccaataactcatggacacaataagcatatagag

SEQ ID NO: 52031 - DNA, 1081 bp, Glycine max
  Peptide Sequence Number=SeqID_168809
atgggggtgcaaatagcaaccaggcccatttgggccttccaggaagttctccagaaggtgccttctggaggaagcaacctaactcgcctgggagagctgggtggcaagctcctcccttattttcctataaatagggggaggagggaagaacaaaaatgttcaaccctcctggtatctgagattcacttaaaattagtgagaaaaattgttttcgtgaaaaaaaaatccaagccgaggcgcttctgtaacgcttccgtaacgtttccgtgggtgatttcgcgaagatttcgccaaggtgtgagaagagcagtacgaggattgtttgctgtactccagctctttatgtatggttggtttcgcacactttttcgccaagaggtaaggcatgcttgcccgctagaaagtcaccgttcatgcacagagaaaggaggggcaaattgggaccaactcttagtaagcaaggaaggagcatctgtcaactgcttccctcgatggaaggaaggaagaaccggagttcttatttcatgcggaggatttccaaatgttcccttgatggggacaaggggttgcatcagctacaatctcgttcttgctataagacaacttggctaccctatgagagaggcaccactagaggatgagctcgcgcctgtcatttcacgaggcttcaataagaccaacatggagacacttcagaaggtccacaaggcatgggaggtgttgcgaaaaaaggacaaagaactcaggggcagtaacaatgggcccattagtggctgccgtaagtggttgaaagtccacatgcatggtttggattggctcccaagtttgagaaccactaaaaggaaggaagttgaggcaccggaggaagataaagaggtgcaggccctttgggcggaacttgagcaagcccaaacagttaaagaaaagttcgaatcagcagctctgaaaatccgaaaagagaataccgaactgagagatgtaaatgtggctaccaccaaagccttggaacgagaaaccaagagggcttgtagggaagaactcggtcggaaacagttccgaggggctctgtggggtagcaata

SEQ ID NO: 52032 - DNA, 654 bp, Glycine max
  Peptide Sequence Number=SeqID_168810
gactacacgtcctcgccttgagaggactacacgtcctcaccatcagagggctgcacgccctcacctctagaggactacatgtcctcgccttgagagggctacacgccctcaccttgggactacacgtcctcgccttgagaggactacgcgtcctcaccatcagagggctgcacgccctcacctccagaggactatacgtcctcgccttgagagggctacacgccctcaccttgggtactagttaccctcaccgtcagtggactacacgtcctcgccttgagaggactacacgtcctcaccaccagagggctgcacgccctcacctccagaggactataagtcctcgccttgagagggctacacgccctcaccttggaggactgcacgtcctcaccttgagaggactaaacgtcctcgccttgagaggactacatgtcctcaccatcagagggctgcacgccctcacctccagaggactacacgtcctcgccttgagagggctactcgccctcgccttggggctacacgccctcaccttgagaggactacacgtcctcaccatcagagggctgcacgccctcacctctagaggactacatgtcctcgcattgagagggctacacgccctcaccttgggtactggttaccctcacc

SEQ ID NO: 52033 - DNA, 1280 bp, Glycine max
  Peptide Sequence Number=SeqID_168811
gtacgctggcgctgcctgactgggatccaagccacatcatcgccgtggccgccaaactctccggcagcgatgcggcgcactggcagcagggccaggcgaagctgaaagcgctgattcctaacatcaaatcgttctacaccgatgatgccaacagccagcagctgatctccaccggagaaacgccggtgcaggtgatgctgtcgatgaacgcctacagcatgattgcggaaggggtcaacatcaagctggcgataccgaaagagggcgcgatcctcggcgtggataccgtcggcatcaataaaggcagcaaacatgccgatctggcgtacaagttcatcaacatcgcactgaaaccggaaattcagcagcaggtggcgaagatctatcgcggtagcccgacggtgaccaacgcgcatatcgatccggagctggcgaagctgcctggcatgctgaccacgccggcgcagtggaatgccaccatcaataccgatccccaactgcgtgcggagaaaactgccgagtggcccggtaacacctatgcaggcagtaacgtccatgacgaaaaaaccgacatttttaccctggttcattcttcccgccacgctgaccgcgatggggctggtcgtcgcgatgtttgcggtgatgcagttcagcgtgcgtgcatacatccccggctcgctggatgtcggcggctttacgctggccaatttcagtggcctgttcaaacgcatctatggcgacgcgtttctcaataccgtgctgctcagtgccaaaacggccctgtttggtttgctgatgagttacccactggcctatgcgctggtgcgcacccgcactgcgtggatcaaatccaccattctgatcatcgcgattactccgctgtttctgggggaagtggtgcgcacctattcgtggattatcgtgctggccagccgatccagtttatgtttacccagaccggtgtggtggtcgcgctggtgcatgtcaccatgccgatcatggtgctgatgctggcgacggcgctgtcacacatcaatccggactacgaaaaagccgccaccagccttggcgccggaccgcgctttcgcgacgccccaactgattggcggcgggcgcgtcagtaccgtggctacgctggtgtatcagctgggcttctcctcgatgaacttcccgtttgccgcagcgctgagcattgctggcctgctgctgaccattctgctgctgctggcgctgaagcgcatgacgcgcttcctgcacgccatgggagggcactgatatga

SEQ ID NO: 52034 - DNA, 146 bp, Glycine max
  Peptide Sequence Number=SeqID_168812
gatgtttctactctacagcagttggaggattaagatgctatgagaatccaaagaataagattactacagtacctgctaaggaagaggaaatctggggtgcattgttcaaggtaatcttagagcttaagaagttagagttgaactag

SEQ ID NO: 52035 - DNA, 258 bp, Glycine max
  Peptide Sequence Number=SeqID_168813
atgggtcaactccagcgacaagcctttcgcaaagcctatggtaagatctgggacctaactatggtggaggtctccacggaggccattgcctcccttgcccaatattatgaccagcctttgaggtgcttcacctttggggacttccagttattacccacggtggaagagtttgaagagatcctgggatgccctctgggaggaaggaaatcgtatctttctcaggcttctatccctccttggctagaatctccaaaatag

SEQ ID NO: 52036 - DNA, 207 bp, Glycine max
  Peptide Sequence Number=SeqID_168814
atgtctcctccacctctagaacctcacaatcactcacaaactcatctcaagctctcaggacgacttcctcttcaatctccgttctctggaggtcttcgcacagcaaaatctctcaaaactctctggcactttgctccgggtatcagaatgactattattatatatggtgttgctctcaaaattttagctcatttggatattgtttga

SEQ ID NO: 52037 - DNA, 228 bp, Glycine max
  Peptide Sequence Number=SeqID_168815
ggaatagaagagaagactgccaagttgaaaggaagtgagaaggctctagttgcacggcatgaagctagtcatgctgtagtaggtactgcagtagcaaaccttcttgctggacagccacatgttgaggtgtggactttggaatatcttattttagaattcattgatcttgttttatggtgggaaattaaagaaaagtataaatctgttatgtgtgatattcaacgataa

SEQ ID NO: 52038 - DNA, 213 bp, Glycine max
  Peptide Sequence Number=SeqID_168816
atggagaaaactgacaaaatgagaagaggagaatctgcgcacgagaagtgtcaaaagtataaagaagggaagtttgttcttgaaagtgtttatactaataatgcacatcctctgtgccaatacaatagaggaaggattgttgatgaagttgatttctccactgagttctacatcgatagtcatgccagcatgagtgatgctgaagaaccttaa

SEQ ID NO: 52039 - DNA, 177 bp, Glycine max
  Peptide Sequence Number=SeqID_168817
atggccggtgtcggtcgctatatggccccgactgatatccttcagccgacattgcacaatttcttttacaaacgttggccgataatgtgtttttacggtagaggaagtcggctaggtttttccgtgcgacctcaaccgaggttgtggttcgaccgacactggcatgttctcatttag

SEQ ID NO: 52040 - DNA, 1086 bp, Glycine max
  Peptide Sequence Number=SeqID_168818
atgtgttgtgtacaagattctttggaggagcaggcgtcacaggaacaccctggtcgtgtgcgtgctgctggagctggtgtcaccattaagcaatactttggactggctgaacggacctcccacacttcttcttccatcactccagaagaactagagcaactgactcaacaaattagggaccagttggaggagtcgatcacaaaaaaaatgactcggcaactgatgttatccttcatccagatgcaatcccaattacagtcacaaatccaatcacaggggcttgcactgcctccggagcctgaggttggtccctcagctacttgtgtcagcacaaaggggagttgtattgatccctcagcgaccgatccagacacgggtgactcagacaaatgccgattgtacatcgaagaaaatcctcctcgcctggttaaagatacagatgctcccattcatgtacccactaacaagggagctatgggaccagcaaaacctacagataggccggatcttgaggttatgtgggatgcttccctattcgggctgtttaatttagacttccctttgtacataaagcatgaagatctgtctgaaataacacacggtggtcaatgtctcaacatctctgttatacagctgtggattctgcatctgactgagacaagtatgcgattagggaattccgacgtgtatggattccttgagccacagtgcatccaaaaatctttgcaatcgcagtttgaatcagaaagttacatcaagaactggatgcagagttcaaaatgggatgtctacctaggagcctacctgaatggtgcacactggcaaatggtcatcattttgcctaaggaaaatcttgttgtccggttttgttccttgcataataggccagacaactatctgaaaggaataattaacagtgctttgaaagaacttaacgatactccacaacctaaatccaaagctgcaggtgctaagtggattgttgttaaatgtaataaacaaaaaggaagcactgagtgtggctattacgtgatgcactggatgtcaactataatcttaggaagtttcaggaataattgggaaatg

SEQ ID NO: 52041 - DNA, 535 bp, Glycine max
  Peptide Sequence Number=SeqID_168819
atggtggaggcatctgttaattggttcccccgatggaaggaaggaagagttggagttctgtcctcatgtgaggggttctcaaacatccccttgatgggaacgaggggctgtatcaattataatctcgtccttgccataagacaacttggctaccccatgagaggagcgctgtcggaagaaagtatcatgcccttcatcgcacggggtttcagtgaccccaaagcaaggatatttcaaggggtccgaaaggcatggagcgtggtgaaaagaaaggataaggaacttaggggaagcagcaatgggatcatcggaagctatcacaagtggctgaaagctcggacgcaagagttagtttggctcccgaagctaaaggcatcaagtgaggaagaggctgaaacccctgaggagagtaaggaggtgcaagccttgaaggcagaacttgaaagggcgcaagcaatcaaggaaaagttcaagatgatagctatcaaggtctggaaagaatatgatgaactgagagacatcaatgtggccaccg

SEQ ID NO: 52042 - DNA, 1653 bp, Glycine max
  Peptide Sequence Number=SeqID_168820
atgatgtctaatccagagctgatgaggatggcctcggagagcatgaagaacatgagtgctgaagactttaaacttgctgcagagcaattaaagcatacccgtccggaagaaatggccgagattggtgagaaggtggctaatgcgagtcctgaggaagtggcagcgatgcgatcccgggttgatgcccagatcaaatatcagttgagtgcggctgagatgttgaagaagcagggaaatgatcttcataatcaaggaaggtacaatgatgctttgaagaagtatatgcttgctaaggaaaacattaaagaggtaccatctttccagagtagaaagcttcttttggcatgctctctgaacttgatgtcctgttacttgaagacaagccagtataatgaatgcataaaagaaggttctgaggttttggcatatgatgcgaagaaccttaaggctctttatcgaagaggtcaagcttataaggaactgggtctactaaaagatgctgtttctgatctgagcatggcacttgaagtgtcccctgatgatgatacaattacagagcttttacgggataccaaggaaaaattggcaatggaaggtggtgagcatgcacctagaagaatagtaactgaagaaataactgaagttgaggatgttccttctggaagctctttgaaacaatcggtggttcaactaaaaaaatctggtgactcctctaagagttacagtacagccaacaatggaattccaaaaacaaagacagacagtttagatgcattgaaaaaagatcctgaagctgtcagatcattccaaaactttatttcaaataccgatcctgccacactggcttctttgaatgctggacaattcaaagatgtgtctccagatatgattaaaactacctctgatatggttagtaaaatgtcacctgaggaacttcaaagaatgcttgacatggcttcttcatttcaaggggataatccaatttttagaggaggttcccctgattcttctttcaaccctggatcaatgcctccaaatgtgacacctgatatgtttaaagcagcaagtgatatgattagtaaaatgccagcagatgaccttaagaggatgtttgaaatggcatcctcactgaaagggaaagaatctactccattagcagcagcagtagatgagaatgaaagaaatgtttcccggtcaaacttaccatcatcaagtactaatggaactactgcttttggagaatcaagttctcataatgtgttttcaaatatgagaaatgcttctcagtcaaacttcccttcctcaagtgccaatctccaagaacagatgagaaaccagatgaaagatccagctatgcggaagatgttcacatccatggttaaaaatatgagcccggaaatgatggctaacatgggtgaacaatttggtgttaagctttcaccagaagaagctgcaaaagctcagcaagccatgtcatccttatcaccggagagcttggataaaatgatgctttgggcagacaggattcaaagaggagttgaatctgcgagaaagacaaagaactggctgctagggaaacctggcatgatctttgctatattaatgctcattttggctgtcattcttcaccggttaggcttcattggtggctag

SEQ ID NO: 52043 - DNA, 219 bp, Glycine max
  Peptide Sequence Number=SeqID_168821
atggattgcgacattataagatgtgaaattgtgaacatgagttttagttgtgataagggtgaggggttgtacctgaatcaagagggaaagaccctgacagactcttcggagtgtaggccttggcgatggcggaaaacgctgtcgaaaatcgctgggagctttacggatcacttgatccgtaaaatattcaacatactttacggatcacctgatccgtaa

SEQ ID NO: 52044 - DNA, 372 bp, Glycine max
  Peptide Sequence Number=SeqID_168822
atgaatgataaacagagatacactgggtgtagtgggcagagaggttcacgggacctaagggaattagcaaatggtgattacctggcatttagtgcacttatttggcgcaaggaagttcacatgcctcactttgttattcctgatgagccccaaataccactgatcactgtaaaggcacacaatacatatcacgttcctttcgagcatactcctcggcgtgacattaaccatgatacggttgttgaagtcttcgaggatatgagagattttatcgatgaagaggatttcacaccattcaagattgctttctaccggggtgtttgcaatgaagagataccctggggacagatggtttcatccgataaggaatag

SEQ ID NO: 52045 - DNA, 279 bp, Glycine max
  Peptide Sequence Number=SeqID_168823
atgacaactctccagccaaaggatgaaccatttgtatcacttagaccgcgaaaagaaccaacaatcaactggaagatatcctgcaatgaggtctaccaaagatcaggacaaaggataataggagcttcaagtgcactgatccaagttaactcacaagcacacgttgcaactagaagcttgacaattgtattaaaaaatggcttcatttactccaatgttgatgtcaaaggtgactggtccaactctgcaaggcacatggttgcttgctgcatattgtaa

SEQ ID NO: 52046 - DNA, 462 bp, Glycine max
  Peptide Sequence Number=SeqID_168824
atggctcaccaagtcatggtccgtccgcagccggcccacggccaccggagacgcggcgtcggcgaggtggccggcggcgtcgcggccgactgcgcagccgtgtgctgctgctgtccttgcacggtcgtcaacctcgtcgtcctcgcggtgtacaaactccccaagagactcgtgaagaaggctgcgaataagagacggcgccgtttgccgaagaagaacagcaccgacgtcgtgctgttgcagccgcagagatcgagcagcgtggacgcgctcgacttcgcggtggggcccatgttctttgaagagtttctcaagaatgaaaaagagtccgagaacgagaagggcaaggaggaagaggaagaggaagaggaagaggaagaagaagaaggattggagatggagatgtgggcccggttcgcgggaaccgggttctggcggagcgagtctcagcgtcaaccctaa

SEQ ID NO: 52047 - DNA, 1686 bp, Glycine max
  Peptide Sequence Number=SeqID_168825
atggatttcctcataatccatcttctagaagaggaagaagtggttcaactggttttggtcgaggaaattcagcatggataccctcctggtcataaatatcataagcctcaaggaccatcaaccaataatgtaaatgttgtaaaagataaaaatgcaaattcaaatgtagagcagaatcaagaggcgcaaggttcagatgtcaaattgactgctcaacaatacaaagccttaatgacactactgcaacaacaaggatcttcaagtcacaatagttcacatgtgaatcagattgacacaatgattggttctggtcatgtacttataggtaatgtgtcatcaataagttgtagtatgagcaaggcagctccttatgagaaactctatgggcatccctatgacattaccattctaagagtctttggttgtttttgttttcctagcacactttctgcaaataggaagaagctagatcctagagctgctacttctgtttttctgggcttcaagtcacatacaaaaggttatgtcacttttgatcttaaaataaaggccatcagtgtatccaggaatgttatcttttatgaagattgttttcctttcaatgtccaggattctcatgatcccattactgttttgcctataccaatttcttcttttcatgatggcattgaatttcctacctccacttcttccatattaccatttgtcccacctgatttttctcctgcagcctttacacccacagaaataccacaaacttttagaaaatcagaaagacagattcaaagaccaggcaaatataaagattttcatgttagctatttaccatcaactgttgccaatcactctacagttgaacctaagtcatatagtgaggcatccaaagatcctaattggattcaagccatgaatgttgagattcaggcattagaagctaatcatacatggacacttactgatcttcctccacataagactgccaatggttgtaagtgggtctataaaatcaaacataaattagatggttcaatagaacgatacaaggcgagattagttgccaagggatacactcaagtggaggtggctcgtacttctattggtatcaatcttttccaaagaaagtatgcattagatattcttactgatattggcatgttgggttctaaaccaatatccactccctctgattacactaccagattgcatcaacattctggttctcctttctcagctaaagatgcctcttcttacacgagattaatagctcgtcaacaagttgcttcccaaattctaagatacatcaaagggtctcccggtgcaggcattttcttttcagtagatagttttatccaattgaaaggctttagtgattcagagtgggctggctgcattgacactacaagatttattacaggatttgctgtttatcttggttcttctttaatttcatggaaatctaagaagcaagatactttttctataagctcttcagaagttgaatacatagctctagccagtgccacttgcgagctgcagtggctaacctttctattagaagaattcaaagttattttccatcaacctgttgttctgtactgtgataacaagtcaactttacatattgctacaattcctgtgtttcatgaaaggaccaagcatatcgaaattgattgccatatcatttga

SEQ ID NO: 52048 - DNA, 840 bp, Glycine max
  Peptide Sequence Number=SeqID_168826
atgtctgaaacatcggattccaaagccacagtgcttcggctctataagccagccgactcaaccggctccaagcttcctgttttcttctactttcacggtggcggcttttgcatcggctcgcgcacttggcctaactgtcaaaactattgttttcagcttacttctcggcttcgagccgtagtcattgccccagattatcggcttgcccccgagaaccggctccccagtgcaattgaggatagcttattggctgttaagtggcttcaaactcaagccttgagcaatgagccggacccatggttgagctatgtggctgattttagccgggtcttcatttcgggtgactcggccggaggaaacatagctcaccacttggcggctcggcttgggtttgggtcgcctgagttgactccggttcgggtcaaaggttatgttctattggctcctttctttggtggaactatccgaactaagttagaagctgaaggcccaaaagatgcttttctcaatttagaacttattgataggttttggaggctttctgtacctgttggggaaactactgatcaccctgttgtgaatccgtttggcccttatagcgagagccttgaagcaattaatttcgacccaattttagtagttgctgggggaagtgatttgcttaaagacagggcagaggattatgcaaggaggcttaaggagtggggtaaagatatagagtatgtagaatttgaaggacaacaacatggtttcttcactattgatcccaactcggaaccatcaaacaagttgatgctgatcatcaaacaattcatagagaagcatttcgggaaagtttga

SEQ ID NO: 52049 - DNA, 288 bp, Glycine max
  Peptide Sequence Number=SeqID_168827
atgcgaaggtattgcaggctttgtttacccgttggggaaactactgataaccctcttgtgaatccgtttgggccaaatagcaagagccttgaagcaactaaacttgacccaattttagtggtggctgcaggaagtttgtttaaggacatgacagagaattgtgcaaggaggcttaaggagtggggtaaagatgtagagtatgtagaatttgaaggacagcaacatggtttcttcactaatgatcccaactcggaactatcaaacaagttgatgctggttgtcaaataa

SEQ ID NO: 52050 - DNA, 1215 bp, Glycine max
  Peptide Sequence Number=SeqID_168828
ggggtatgggaagacctatctatggacttcatcacccacctgccaacctccaatgggttctctgtcatcctcgtggtggtcgacagattttcaaagggcgtccacctaggtgcgttagcttctggattcacagcattcaaagttgccaacctcttccttgatattgtttgtaagctgcatgggttcccaaaaagtatcgtatcggatcgcgacccaatctttgtgagtaaattctggacggaattattccggttaagtggaacacgcttacggctaagcaccgcgtaccacccccagtccgacggacaaacggaggtgatgaaccgcattatcgagcagtaccttcgttgtttcgtccatgacaacccatcctcgtggttccaatacctgacccttgcggagtggagctacaacacgtccatccactccggttccggtctcacgccatttgaaatcacctacggcaaaccgcctcccacaatggttgactacattccgggagccacgaaaaatgaagccgttcaaaccatgctcgagactcggcaagctttgcactcgaagctcaagcataaactgcagaaggcccaggacactatgaagaagcatgctgacacaaaacgcgacgacgtgtcgttcctcgaaggtcagtgggtgtacgttcgattacgaccgggccgtcagacgtcccttacgggtccactccacccgaagctttctaagcatttttttgggccattccagatcctcgagcgaatcggacccgtagcctatcggctcctccttccaccggagtcactgatacaccccgtgtttcactgctttctcctccgccctcatcacggttccccacccgccaccacgtacacatggcccttacaggttcgagatgaccagcccctcaggcgtccgctgtgtttccttgactataaagacgacaccgcgaccaccccaccaacacgaatggtccttacccaatgggaaggcgagccaccggaggacacctcgtgggaaaaatggtctgacctatgccaggcctaccaccttgaggacaaggtggttttcggggaggacggtagtgttagcaatgccggcaactacaactccgatagcgagcatctccgtcacgacaccaacccaagaccagtacgtatcaggggagcgccagcacgtctgcgagattatcacgtgcaatacctaccaggaacaaaaggatag

SEQ ID NO: 52051 - DNA, 937 bp, Glycine max
  Peptide Sequence Number=SeqID_168829
accaagcatggctggtaaggatgacagtggcataaaacgcatgaacctgattgcccgtgctgctgagtctattgctgatggggatatagtgaatgtacagattcgcagatatcgacagtggcagctctctcaaactagttctgttgctacaagcataattcctgcgtcattgttacacgggcagagggaaatacttgaacagggagagcgaaatttcaaccggtttggtgggtggctggggaagaactcgacaatgggcaaaaacttacggcttttggatgatcttcatgttcacattcttgcttctcgtgaatctagttcaggaagggataccattcgcatggaataccttactcttcttcttaaacaaatgacagagaccctgcgaaccctgcccaaggctgaagcagttcagcaagttgtggaatttatgaatacatactctatcagtcaggaagattttgatactattgtagagttgtcaaaattcaagggtcatcctaatccactagatggcatacagcctgccgttaagtcagccttgacaaaagaatacaaagagcaaagcacatctcgagttgttcgagttgcagatctaatcactcttcctggagtaaagaaggtccctaagaagcgtattgctgctattctggaaccagctggcgaagaagtggaaaaaggtgaaggtgatgccttggacgagagtgaagaggagaacagctctgatacagaagagttggagggcaccaccaagggtgagaagctgcaatcagaacttcaaagcttgaattcaaaggccacgcaagtacagttggaactgaagggaacgggaaattcaagttctaagaagacatcgggtggtagaggtaaaggtgtttctgtatctgggaagaaggttgctcaagctccaaagactactgcaaaaagaaaaaggtga

SEQ ID NO: 52052 - DNA, 1326 bp, Glycine max
  Peptide Sequence Number=SeqID_168830
atgtattttcgcatctatggcgtcacgatcctcctcttcctcctcccaaccctcacattctccctctcgcagggtcagataaactcaaactcaatcctcgtcgctctgctggactcgcattacaccgaagtagctgagcttgtggaaaaagccatgcttttgcagacgctggagaacaccgtgatgaacaacaacatcaccatcttcgctcccagaaatgaagccctcgaacgcgatctcgaccctgatttcaagcgcttcctcctcgaaccccgcaatctccaatccctccaaactctccttttgtcccacatcgtccccaaaagaatcatcaaacccgaatacctaaccgggacgggcaatccgggtaggtcaaataacccgacccggcaccgaacgctagctccgaaccaccacctcactctccagtccctgaatttgactcactggaatgtcgattcttcccgggtcatgaacccggattcagtgacccgacccgacggagtgatccacggcatcgacactttactaatccctcgctccgtccaagacgaattcaaccgtcgccggaatctgatctccatcgcggccgtgaaacccgaaccctccccggaggtcgacccgcgaacccacaggttaaaaaaaccagcgccggcatcgccggcgggttctccgccggcgctcccgatctacgacgcgatggcgccggggccctcgctagctccggcgccagcgccggggcctggggggccccgccaccacttcaatggggagaagcaagtaaaagacttcatccacacgcttctccattacggcggttacaacgagatggcggatattctggtaaacttaacgtcactggcgacggagatgggacggttggtgtcggagggttacgtgttgacggtgttggctccaaacgacgaggccatggcgaagttaaccacggaccagttaagtgaaccgggttcgcccgaacagattatgtattatcatttgattcctgagtatcagaccgaggagagcatgtacaatgccgttagaaggttcgggaaggtccgttacgacaccttacggttgccgcacaaggtgacggcgcaggaggctgacggctccgttaagttcgggcacggggacacttccgcgtacttgttcgaccccgatatttacacggatggacggatctccgttcagggaattgacggcgttctctttccgcctcaggaggaagatgctgggcccgttacccgatccaagcccgctaaggtcgtcgttaagcaaagaagagtcaagctggggaaaaaggcgaggataacgtgtgtttaa

SEQ ID NO: 52053 - DNA, 372 bp, Glycine max
  Peptide Sequence Number=SeqID_168831
atggagacgacggcggtcggaccagtttttaggagattcgaaggagagggagaagatgatggagttgccggcattgctaacaccaataatcttgggttttcttctcttgagcctgggacgttgcttcaatcaaacctcatccacaattggatgttgtcggtctacttcttcaccttcgtcaatgcactgttgtcggtggtggtgatgagacacttgttgtcgttaggcaaagaggcaatttcggccatgtatggaggttgcaaccgagatgaaagtggggttgaggcaacagtctttttgggtcgatggcgagaggtggagcagcagatggacaagggacctttacccgttgtgattgaaaataattggtga

SEQ ID NO: 52054 - DNA, 2868 bp, Glycine max
  Peptide Sequence Number=SeqID_168832
atggcagaccacgaaaccaggaagacgactaccgatcgtcttgaagacgccatagctcgtctcaccaacagccaagcctccatcaacgagcgttgcaacgacctcaccgataagatcgactcgatcttagaacatctccacctccaagcatcagaaaataacaataacaccacgcatcaccaagcgcatcatcaccatcgccacgccgtcaagatcgacataccacggtttgacggacacgatccactaggatggatcttcaaggtaacgcagctttttcagtatcaacatatgcctgaagaagaacgcattacggtggcgtctctgtacctcgacggtccagctttaagctggtatcaatggatgcatagtaatggccttatcacttcctggaatggcttccttcaagccctagaatcgcgtttcgcgcctacattctatgatgatcctaaaggagcactgtttaagctcacacaaacaggtacggtcaatgactacttaactgaattcgaacgcttagctaaccgtgtggtgggacttccacccccattccttttaagctgtttcatatccggtctaaagcccgacgtccgacgcgaagtattggctcttcagccattatcattcttacaagcttctgcgttggccaaacttcaagaagagaagttgcgcgatcgagctcttaccccagctcgaaactctcttcctccaagacccttcgttcccaatacatccaatattccggccaaggttaagcctccgtttgtgcagcgtactccggcggaaatggccttctggagagagaagggtttatgttataattgtgatgaaaagtggagtgtcaatcacagatgcaagggcaaggtactactgttcatcacgaacgaacattcttcgcttcctgagaccaccacacatgacactgaggtgtctacagctacaattctcgaaaccgattcagaaccaccttccgacgtagactcccatatcagcctccatgccctcgccggcgtaccatcatcggacactttccggatttatggcatgatcaagcacgctcgtttgacgtttttggttgatagtggaagtacgcataacttccttcaacctcgaatagcgcagttcctcaagctctcatcccagcacactgtccctctgcaagtaatggtcggaaatgggtctatgttgacctgtgatcaagtttgcccaagcactcagttaaccctccagggacaccccttcgtggtatcatttcacctactccagataagcggtgccgatgcggtgctcggagtcgattggttacgacgactagggccattcactaccaattatgctgactccgtcatgcggtttaagcacttgggccacgacattaccctgacggcggacgtttccaccaagcctgagtccacctccgcggcccaattgaagcgccttttacagatagggtccacctcagccctttaccagttgcatgttctacccatcaaccaacccgacccacccacacagtcacaccctctcccagctgtggaccaccttcttcttcaacacgatcatcttttccagaacccatctcagcttccccctccacatcaaattgtgcatcgcatcacgcttaaacctaacacttcaccaatcacggttcgtccctaccgctaccctcatttccaaaagaatgagattgaacggcaggtttccgagctcctcgccgccgggctcatcagaccaagcactagtccctattcctccccagtgcttctcgttggaaagaaagatagcacgtggcgactttgtatagattaccgggctctcaactctgcaactattcgagatcgattccctatccctacgatagatgaattgctcgatgaactcggccaagcctcatggttttccaaactagacctccggcaaggctttcatcaaatcctgatgaacgaaggggatattgagaaaaccgcttttcggacgcaccacggacacttcgagtatttggttattccctttgggctctgtaatgcaccttcaacgtttcaatcagctatgaaccagcttctccggccgttcctacgccggttcgccacggtgttcttcgacgatatcctagtttatagcaactccttagccttgcatctgcatcatcttgaactcgtcttcaacacccttaacctggccgagttcttccttaagcgttccaaatgccttttcgcccagaacaccattgagtacctgggtcacattgtttcaggcaagggcgtctcaccagatccttcgaaggttcaggtcatgctgcagtggccaaccccagcatcggtcagagaactgcgggcctttctgggcctcactggattttacaggaagtttgtccgagattacgcctccatcgcagccccactcacatcccttttgtgcaaagatgccttcgaatggtcgccggaatcacagcaagcctttgaccgcctcaaacgggccatgaccagcgcccccgtacttgcactacccaacttctctgaaccctttgtagtggagaccgatgcttccgggattgccattggtgtcgtcctgctgcaacagggtcaccccctcgcatatttcagcaagtgtttaggaccgcgcatgcttcatgcatctgcctatctacgagaactccacgcagtggtggctgccgtaaggaagtggcggaagtacctcttgggtcggccgttcaccatacttaccgaccataagagtctccgtgagctgatgacacaagtcatccagacgccgaagcagcactattacctgtcgaagctgctgggctacgaatactccatccaatacaaaaccggcgccaccaacattgtagctgatgccctctcacgg

SEQ ID NO: 52055 - DNA, 1872 bp, Glycine max
  Peptide Sequence Number=SeqID_168833
atggaagtgattatagataaaacaattatgggtaaatttttcgcaactgttgtaggagcaaatcttcattgggatcaacgcagtcaatatttgaccgttgtcagtttttatggtgtattgacaattagaggttttcagcgagggtcacaacacaacacactcgttcagcttgttggagcaaagttttctctgttctcccgcctcaacctcaacgcacaaatgagtgatataaggaagtggttcatgaaaacacatgacaagggcaacaatgccgcttcctccaagccttccaatcaacctaagccttcttccgataaaccccagtccgagaaaacggtggctggaggtcaggaaagttcagggaggaggataactagcaaatattttaattctaacaagcaaaaggggaaagacaagaaagaaatgcaggagctccctgctaaaagaaagaatatgaaggacagtgaggaaataccggagccaaagaaaattcatgaagatgatggagatgactctgtgttgcccactaataaaaagaagttagctgacaccactccaacaaagaagttgaagagtggatcaggtagggggcttccccagaaatctgcagttttggaagaaagtgatgaagatgatgacaaagatgctgtgtctgctgctaaatctgctggaaggggtgatggtggaagaggagcaccagggcgatcaactagtgggagaggtagagggggtgggaggggtggattcatgaattttggagaaagaaaagatcctccacacaaaggagaaaaggaagtccctgaaggtgctcctgactgtttagctggcttgacttttgtgatcagtggaacactggacagtttggaacgagaagaagcagaagatttgattaaacgccatggcggccgtgtcactggatcagtcagcaagaaaacgaattatctgttatgtgatgaagatattggggggcggaagtctgaaaaagccaaacagctaggaacttccttcctcacagaggatggtttgtttgatatgattcgtggctcaaaacctgcaaaagctccttcacaagaagacaagaaacctgtgaataaggctgttgcagtagcatcccagtcaaaagtttctccgaaatcacaagttaaggtccctctgtcttcacgctcaccttctaaccaagccaagccaaagactgctactactgttcagtcttctttgatgtggactgaaaaatatcgacctaaagatccaaaggatatcatagggaatcagtcacttgttttacagcttcgtaattggttgaaagcttggaatgagcattttttggacactggtaacaaaaagcagggaaaaaagcaaaatgactctggtttgaaaaaagctgtcttgttaagtggaactcctggtattggaaaaacaacttctgcgacgttggtctgtcaggagcttggtttccaagccatagaggtggcaatatttcttgttaaatttatatatttggaaaaggtaaatgctagtgatagccgtggaaaagctgatagcaaaattgaaaaaggaattagtggaagcaagacaaattctgttaaggaacttgtaaccaacgaggccattggtattaatatgggacggtcaaagcattacaaatctgtgctcattatggatgaagttgatgggatgtcagctggtgataggggtggtgttgctgatcttattgctagcatcaagatatcaaaaattcctattatctgcatttgcaatgaccgttacagccagaaactgaaaagccttgtgaactactgtttgcttctaagttttcggaagcctacaaagcaacagcttgtgaaaacattaggcatactgtcttctccctga

SEQ ID NO: 52056 - DNA, 132 bp, Glycine max
  Peptide Sequence Number=SeqID_168834
atgggtagaaaccactggcgtcgaactctaacttggccacctttgggcgcaaaattcacaagcatgggcaccattgtagtgattggcgtggtggcatcatgtgtagctgaccacgatatataccaagtgtga

SEQ ID NO: 52057 - DNA, 486 bp, Glycine max
  Peptide Sequence Number=SeqID_168835
atgaaaagggggtcccaaactgagcaggttgatgtagaaatgagagatcgattagaggacatgattcgtgatcttggacaatattttttcatcaagcacatgcctctttcggtgttaagtctagtcaatgtgaaggtcagatataggtggagtgacaaaagtttcacatcattgcttaaggcagtggagggtatgcttccagaagaaaacatgttgccaaaaagatactatggggcaaagaagacattgtgtttgatgggtatggagtatcagaaaattcatgcatgccctaatgattgcatacagtataaagatgagtttgaagaaatgcataaataccccaagggtggagtatctaggtacaaagtgaaggatggtgatgagtgtagtagtgatgaaagcatagagaaaggccccccaacaaaggagttatggtatcttcctatcactccaaggtttaagcgactgtttgttaatgggggatga

SEQ ID NO: 52058 - DNA, 819 bp, Glycine max
  Peptide Sequence Number=SeqID_168836
atgttgcagctactctacactgcgattttctccgaaatgcttttgattctcacgctcgtcttcaaaaccccactgagaaaactcgtcatcgtttccctcgatagtgtgaagcgcggtcgcggtcccgtggtggtttccaccgtgggcgccacattgatggtggttctcgcttcgagcctctacagcatggccaagatccagcaacgcaccctcgaggccggcatagtcaaccccaccgaccaagtcctcatgtccaagcacatgctcgaagcttctctcatgggtatctctcaaaaacccttctttcggttctcatccctaaacccctcttttctaggctttttggaatggtttaaggtgtgtcttaggaagggggacgtgaattttggacttgagctgctgcaactgcatcaacaagagcctcttcccactgtggggtttctgctgttcctctctctgatgattgatagattgcaccattacataagagagcttcggtcactcaggaagaccatggaagctattaagaaacaaagccgaagttttgaagatggtaaaaatggaaattcagaggaacataaagcattgaatgaagaaattaccacattgaagtctaaaattaagaaactagaatctgaatgtgaggcaaaaggaagtcaagctaagactttggaaactgaagtagaggctcttaaaaagcaatccgaggggttccttatggaatatgatcgcctcttggaagacaatcagagtcttaggagtcagttgcaggccattgaccagagccctttgaattttgataataaaaagagtatgtga

SEQ ID NO: 52059 - DNA, 234 bp, Glycine max
  Peptide Sequence Number=SeqID_168837
atgcacattacaacaacactcacggaaacccatttccgatggaaactagtagtgacacccataattgccgaaacaatacaaatacacacactttatccacttgctgttgctgctcttgcattgcagaatgacgagtgtgctttttataggcttcgttcgtatccactaggcaatggtataaatggtgcatgttgtgaaccgttggggaattggcgccaagtcattaaaccatga

SEQ ID NO: 52060 - DNA, 987 bp, Glycine max
  Peptide Sequence Number=SeqID_168838
atgttgcctgagaggaaggtggagctctatcacactgagctagatgattttaagactgaattggagaggtgtaatttccataaacgcctcaccaatttggttgatgggagcatagacttggctttggtgaaagagttctatgcaaacttataccgctctgagggcccttcaccaaagcaatctagagttagaggccacctaatgaagattgatgctgacaacctcaacacattcttagagacacatgtggtgttgacagagggtgagactttgcccacatactctagatactgcatgctgcccacagattacagagagattgaggttgccttatgcataccaggccgagggttcatcttgaacactaatggccatcctgggaagattctcaagaaggatttgactactctagctcaggtgtggagtgttctctcatactccaacctggctcccacatcacatacctctgatttgacagtggacagagctaggctgatctttggcctagtctcttgcatggacatgaacataggagctcttatttctggccagatgacttctatagcccagtctaacacttctagacttgggtttcctactttgatcaccgcactatgggctacaactgagcttccttccacatttgcagctcctactccaacatccacatcagcagctccttctgtcccagctcagacatattctcaacactttaaagccatgcttcagagcattcatcagggacagatcattttattacagagtttacaggtggtggcgactccaggatctaatcctttagttgagcagttcagggagatgatagcctggccccggactcaaccttctcttcatagggaagataaaggtcccacagcccaggtaccaaagcatatggaggatgaatcatctgaggccaccattctagagccatttgttctaggggaggaggaaggtgagacacaggtgagacaggggatcctctag

SEQ ID NO: 52061 - DNA, 288 bp, Glycine max
  Peptide Sequence Number=SeqID_168839
atgcagagtgcaaaacgtgatgtttatcttagggcctacctgaatggcggacactggcagatggtggtcattgtgcccaaggaacacctagttgtctggttttgttcattgcataataggccagacaactaccttaagggaataattaacagtgctttaaaaggtcttcatgatgctccacaacctaaatcaaaggctcctgctaggtggattgtcgtcaagtattttaatgatgctagaccattggagccagagggattaaaggtgttgcggatccagtgggcatag

SEQ ID NO: 52062 - DNA, 551 bp, Glycine max
  Peptide Sequence Number=SeqID_168840
agaaaggcggtagcgctcagattctcgaaagattgatgtcttcttatggtgttagcacgcagaaagatcttgcagcagcccttgctataccggcgaacaacattagtggctggacgcatcgtgatagtgttccaggaaactcaataatcaagtgtgtgttggacactggcgacgaattgcaatggctagtaactggtgaacttgcaaaagcaaaatttgattatgaacctaatgctccaaatggtgaggctctttatagcgaaataacttcaaacgggggcaagcctgtactacgccggatcatggatgcttatgggttcacccttcaaaagcagctctgcgactcgcttggcatatcatctggaacagtcagtacctggttagcaacagggaaggggttaaacctcagaaaaaccaaagaagaaactcataaccaagttataccacataaagagtttgatatcaggcatgctgaaagacgttgggacttggttaatcgacataagctttattccgaacacgctaagcaagccagtatttatttcgagtag

SEQ ID NO: 52063 - DNA, 594 bp, Glycine max
  Peptide Sequence Number=SeqID_168841
atggtgaaaggggaaatgcagtttcttcttgacaaactggtatttgcattgggttgtaccattggcacatatgcaaatggacttgggtgcaatgatggcgtacgaggggttgtcagagaatgggagggggaggtggtagttgttgtctcggtgaaggagtcttcatggagaataaagaggaggtgggaggggttcaaagtgggggtcatgggttttgaaattatattacagaataagcatgctgaaagtgttggggaagaattactcctatccggttataagaaaaagaaacacctatccgtaagagttataattccggataaggtgcaaactaaacaaggcttccgtaataggcattccacaatcccacaaaattgtcatcatgtaaattgtagatgcaaggtgatagcaagggaattactatatgtggctgaatccacaagtaaatctctacatgttgattatttttttcactttggcttaagggatgccaaaacgggtttgactcagcagattgacttgtgtagtccatccaaacgagttcagtgttggtttgaaaaattcagtccttcaacccaccaacctgataggtaa

SEQ ID NO: 52064 - DNA, 270 bp, Glycine max
  Peptide Sequence Number=SeqID_168842
atggaggacgaggatgagattgatgccatgcttcaccataccggagtggaacgtcgccatccccctacttttcccactcgcaatctctctgccatcgatggagctaaaattgttgcaagattcgccgcagtgggaggtggaaaaggggaagaaagagagaaggagttggatgacacggtggtgacggttgatggcagtggtggcacaatggtggttgtttttgttggagaacgggaagaaggtgatggtgtgacacttatgtgtgaatga

SEQ ID NO: 52065 - DNA, 213 bp, Glycine max
  Peptide Sequence Number=SeqID_168843
atgttgggcatttctaacagtggtgctccagctaagcctatcaacaactacaccctgctacagatgaagattattaagaagaaggaggcgggtatgctttggtctgacctcttccaccacttggccaggagcagaaacctcagctacaacaataggcaccacctcaaagagacaaagagcatcactcccccaatacatcattatgaggagtag

SEQ ID NO: 52066 - DNA, 860 bp, Glycine max
  Peptide Sequence Number=SeqID_168844
gtcgccgctcgtgcaccgagaaaagagaggcaaattgggatcgactcttagcaaacaaagaaggagtgtctatcaattggttccctcgatggaaggaaggaagagttgggattcttttctcatgtggaggatttccaaacgttcccttgatggggatgagggccctagcgggggtccttcaaggagtccgcaaggcatgggaaatggtgcaaaagaaggacaaagaacttaggggaagtagcaatggggccgtcggcggctaccataggttgaaagccgctaaggaggaggaggttgaagccccggaagaaagcaaagaggtgcaagccctcaaaatggagcttgagaaagcccaagcggtcaaggaaaagttcaagtcaacagccgttaggatccgaaaggagaatgccgaactaagagacgtcaacatagccaccgccaaggccttggagcaagagaccaaaagggcccgcaaggaagaatacggtcggaacaagttccgaggggccttgtggggcagtaacagcgaacttaaactccgaagagaggagagggaccagtcacaagtagaaggcatgattctgaaagacgaattgaagacttgcctgaggtcaaaaaggagcttgtcccaaaggctgagcgagaccgaaacaaacatgttggccatcatcagcaagtacaaagaagaattagatttggccaccgcccatgagcacaaggtggtggatgaatacgcccaagtgtacacagaaaaggaggctaggggaagggtgattgactcattacaccgagaagcgatgatgtggatggaccggtttgctcttactttgaacgggagtcaagatcttctccgattacta

SEQ ID NO: 52067 - DNA, 432 bp, Glycine max
  Peptide Sequence Number=SeqID_168845
atggccattcttgtggaagtaggagaactaacctttagaattgaaaatttgtatctgaaccacaatgaaggaaatctcatagtcgagcttaacctcattgaagaaaacagaaaggtggttgccataagagatatggcactgaaaagaaaaatagtggccaggtacaacaaaaaggtcatcccacacacctttgaagaagaagatttagtcttacacaaagccatcgtcgacggaaaaaataatcaccacgaaaaactcacagaaaattggaaaggaccttacagggtgtcacaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaacttttaa

SEQ ID NO: 52068 - DNA, 204 bp, Glycine max
  Peptide Sequence Number=SeqID_168846
atgaaaaggatgcatgtcacacgttgcatgcgcaagcatggagccgtgcaacaaaaacatcccgattaccactcatgcaccctcacgttcgcaagacttgacaccactaaacgaaccacaccccacaataccaaaggcatgcaggcaaatggaaacatcgagtggcgcctcatccgcatcgctaggcacggtgggatcctctag

SEQ ID NO: 52069 - DNA, 252 bp, Glycine max
  Peptide Sequence Number=SeqID_168847
atgaggtacacgatgaattcgtttataacagtgttgtatttcaatggaagggtatatgaagataatgatggtgtaatatttgaaggcagtaaaaaagcgattcagattaaatgtggaattagtttcaatgctttgaagaaaaaaattggagacaagtgtcagaaaaatatattgtcttgcaaatttgtgatgacgaagacgttgaaacgatgctggaaagttttaaacaacaacaacaaatgtcaattctag

SEQ ID NO: 52070 - DNA, 782 bp, Glycine max
  Peptide Sequence Number=SeqID_168848
ccccatgaattgattgtcgttcatgcatcctccaccaatgagtctggagccacgcgtagtgattgcctagtgcaattctccattctccacttttattcggagccccatgaattgattgtcgttcatgcatcctccaccaatgagtctggagccatgcgtagtgattgcctagtgcaattctccattctccacttttattcggagccccatgaattgattgtcgttcatgcatcctccaccaatgagtctggagccacgcgtagtgattgcctagtgcaattctccattctccacttttattcggagccccatgaattgattgtcgttcatgcatcctccaccaatgagtctggagccatgcgtagtgattgcctagtgcaattctccattctccacttttattcggagccccatgaattgattgtcgttcatgcatcctccaccaatgagtctggagccatgcgtagtgattgcctagtgcaattctccattctccacttttattcggagccccatgaattgattgtcgttcatgcatcctccaccaatgagtctggagccatgcgtagtgattgcctagtgcaattctccattctccacttttattcggagccccatgaattgattgtcgttcatgcatcctccaccaatgagtctggagccatgcgtagtgattgcctagtgcaattctccatgctccacttttattcggagccccatgaattgattgtcgttcatgcatcctccttaccaatgagtctggagcctagagtagtgacccg

SEQ ID NO: 52071 - DNA, 589 bp, Glycine max
  Peptide Sequence Number=SeqID_168849
atgttcttaggtttgaaacggctatccatcgaagggtgtgatttacaacatatattatctgtctcttttgttggataccaggcgaaattagaagatataagaaataaagagactcataataattttgaacatcttcagcgaaaaaacattcagattggacaagtgcgtttgaagttaaaaaagttggagttgtacgacctacctcaaatgacttatatttgggtggcttccaagagttcacttttcctccaatatcttaaaacattagacatagaggaatgtgcaaaattggaagtaatctttccatcgtgtgttttacgatgcctaccaaaattgaagcatctagagataagagaatgcacagaattaaagcagatcatcgaagaggacgtgactgataaaaaattgtcagatcattctacacagccatgcttcccaaagctagtagatttggttgtcaaagaatgccacaagttgaaacgtttcttctctgcgtcttcatctagtgatcttctcaacctggaggttcttatcatagatggagccactgaactagaagagattattggatttaaacgtggaaaaggtg

SEQ ID NO: 52072 - DNA, 150 bp, Glycine max
  Peptide Sequence Number=SeqID_168850
atgactaatgcaaactgtccgcaagagtcattgcattcagtctcaaaggggaatctaaggttgagacaaggagaccctttggctccattactctttgacttagtggttgaaggactgacagggctaatgagggtctatgtgtgtggctgt

SEQ ID NO: 52073 - DNA, 417 bp, Glycine max
  Peptide Sequence Number=SeqID_168851
atgtgtgtcaagatatctttactattgccattggcaaactcaagcaccctggtcgtgttcgtggtgttggttgaggttgtagatacaatagtacattgtgtgagcacaaaagggagttgtgttgttgctgatccatcaggggaggataatcacattgatacccgtaatcaatgtgaggtatatgttgacgttgatcttacccatttagtggcaattcgaaaagtgtacaatttagggttagctatacaccacaagaaaatagaggatcataatgtgagggtggtggttaaaaaggttagatatgcagacgctctagcacctttccccactgatgaggttcaaacagtggggcaagcccacaataatttcattcagtggccaagaagactcgacaagtttatttcaacaaagttgtaa

SEQ ID NO: 52074 - DNA, 471 bp, Glycine max
  Peptide Sequence Number=SeqID_168852
atgcctaggccattcatgtgcaagatcctcaagcttcctctcaaagaagaatctccacactgcaatggaaatgtgaagcatcacacacccttaggcaaagaaactctgaaagtctatgtccttaacaaaagcaaccatcaagagaagaaatcctattgtgaacaacaacaagccagagaaagaatcagaggtgtcaatcagaagctgatcatggggtgttgtcccttgaaacttgcttgcggtctcggatctgtggccaagcacaaagatctctttggagtagaatatcatcaaagctccacaagtaagagctattgtggaatgaagaacacacataagggtatatatagaagaaaccatttatccgaattcacttcaaaggcctttaattgctttcttacttttaactcaatggagcctttgccctctaaaccaacaatggtagttgaaattccaatcacttctttctag

SEQ ID NO: 52075 - DNA, 327 bp, Glycine max
  Peptide Sequence Number=SeqID_168853
atgtcgcctgaagtatttattagtgcaggtgttccatgctgcagcatcaaaacggtgtgtcgtttagctatgagaatgaggagagcagggaatgatggagagttgagcagcacagagatggaatgcataaggagacaccataggcaggaagcagcagatgacaatcagtgtgcctcttctctcgttaagcatataagggcctcactgcctctcgtcgtgtggtcattagtgaagagatttgatgagccgcacaagtataagcgggttctctatgttggggatcacatttatggagatatactaagcaggaaaaaggaggggaaataa

SEQ ID NO: 52076 - DNA, 225 bp, Glycine max
  Peptide Sequence Number=SeqID_168854
atgttgtggccattcaaagttgttgtcggtattaatgacaaaccaatgattgttgtcaagtacaaagggcaggaaaagcacctttgtgctgaggaagtatcatctatgggaaaagctattgttgctgctattgcatatggccttgacaagaggactaattgcattggagagaaaaacattttcatctttgaccttggtggtggtacttctcacgatcaaggataa

SEQ ID NO: 52077 - DNA, 162 bp, Glycine max
  Peptide Sequence Number=SeqID_168855
atgatccgtattttcaattcaaagcttgtattggcctctccagaaactgctactgatgcagattatgctgcaatattgggagttattattggccatgagacgctcacaattccacacaacatacgagccggaagcataaagtgtaaagcctggggtgcctaa

SEQ ID NO: 52078 - DNA, 1059 bp, Glycine max
  Peptide Sequence Number=SeqID_168856
atggttgataaatattctcttttagggatgagaaatgaagaaaggcctatgggtcaggttaccaaatttgtcagcggggatgatattgaggatgacttcatgacagatgacatacatagtggagacaagaaaaaagccagcaaagtcaacagaagaccatgtaaaaccaaagaagaaggaggttgcaagcttcatcttgacctccttcactctgccgtgagggtcatactgtgccgcaagctcggttgtcgtcgccagtcctccactgtggcgtgttctgcacctggcagtgactacactgtcgctgaatctggactccaatgggctggacttgggcctcgacccgcttcttctgcttcttcgcgggcggcgaagacgggagcatcacgtggaaggaatatcaaacggctgagatataacgcgaagcccatctatggcagtcaaatacttctacaaaaggagcatgctattccagttcgtcactttgctaaagagtctgcccctcctgcccttaagggagacgagatgctgaagaacatttttgtggaggtgaagaacaaatttgagaccgccataggaatattaaagaaggagaaaatcaccattgacccagaagatccagctgttgtttctcattatgcaaaggtcatgaaaacaattagagagaaggcaagcttattgccggagtcccaagacatactatccaccattgaaattgagacacaggatattccagatgctcggacctatcttctgactttgaaggaaataagagtcaagagaggtcttacagatgatcttggtgcagaggctctgatgatagatgcattggacaaagttgaaaaggatttaaaaaaacctttactgagaaatgataagaaaggaatggaccttctcttggcagagtttgataagattaataagaaacttggaattcgaaaggaagatctaccgaagtatgaagaggagctagaacttaaagtagccaaagcacaactggaggagctgaagaaggatgctcttgaggcaatggaaactcaaaagaagaggtactactaa

SEQ ID NO: 52079 - DNA, 171 bp, Glycine max
  Peptide Sequence Number=SeqID_168857
atggccgaggaaccggagagcaccagtgccactaacaaatcattgcttgataagatcaccgagaagcttcacgatcacaattcttcgtcctcttcattcttcgccacttcggaagagaaacacccgttcactccgtcctcggcaccagaaaacatgacagcaatggagtag

SEQ ID NO: 52080 - DNA, 234 bp, Glycine max
  Peptide Sequence Number=SeqID_168858
atggtgcaatgggagtggcagttgtggagaggtgtggcgacagagatctcacgtgacattttgggaaccctagagacgattcttgctgaacgttgtcgtttcgctgtcgtaaaaaatgctttttctagtagtgttcagaagggtattatgtttgctagggatcttcatcttattaatgccatatttgaggtggattttctaacacagttggtgaagaaaatgaaggtgagttga

SEQ ID NO: 52081 - DNA, 540 bp, Glycine max
  Peptide Sequence Number=SeqID_168859
atgaatcctgaggaccgaacggacctccgccacttggtgttcggaatcgcggtgtcgaccaagctatgggaccaaaggaagagctacatcaaacttaggtacagagtaagggacatgcgcgacattatgtggctcaacgagaaggtgaaatcgaaggaaaacaacagcgacgtgctcccgccgctgagaatcttcgatgacatggtgatgtttatgtatacaaacaggcaagggcaccgattgacaattaggatctcacggattgtgtcggagacactacagctggggatgaaggatgtgcggtggtttgcgatgggcgatgatgacaccattttcgtcattgaaaacctaattcgcattttgagaaaatacgaccacaatcagctctattgcattgggagtttgtcggagagtcacttgcagaacatttttttctcttacaacatggcctatggcggaggaggctttgcaattagttatcctctcgcaaaggctcttcacaaattgcaggaccgtgaaggaggagctcttttgttttag

SEQ ID NO: 52082 - DNA, 261 bp, Glycine max
  Peptide Sequence Number=SeqID_168860
atggcaacaccaccggatgtagccaaattaagaagagtggtgcatcgtaatcgtgaagaagacacgctcaacaaccatgatgaatactttcaaatgagggtcgatgcactacgttcaaaaggcttatctccattgcagaagtgcacaactgctattcgtatattggcttatggaccacctattgacaatatggatgaatacgttcgaattggtgaaacaactacagtggaatgcttggagcgatttgtatcaggcatgtga

SEQ ID NO: 52083 - DNA, 174 bp, Glycine max
  Peptide Sequence Number=SeqID_168861
atgtacaactcagtttctatgttctgtgttcggcttatgcagtttgaagatgaagctactagcttaagcccgttgaacaaacaatgtaggacaaaccaagagtgtgcttcttggctaggtactcccttgataaacaaagcaggagtacttctcttgggcaaggtattcccttga

SEQ ID NO: 52084 - DNA, 420 bp, Glycine max
  Peptide Sequence Number=SeqID_168862
atgatgcaagactggatgagaaatctggaagttggtattcccacactccttgaggaaggaatcaaggtgcttatgtatgctggagaagaagatctcatatgcaactggctcgggaattcaaggtgggttaatgcaatggagtggtctggtcaaaaacaatttggggcgtctagtacagtcccatttttagttgatggtgcagaagcaggaacgctgaaaagccatggacctctcgctttcctcaaggcaaggcctctactgggatctgaaaatcagaaagaatcctatggaaagaataacaatgaatatgtaagatttgtgttgagtaacctgagtgcaaaagcagtgtggacagcaaggtcaatgtctggagctaacaagaagatgattgaggcactagctgctaggaagaaggaatag

SEQ ID NO: 52085 - DNA, 681 bp, Glycine max
  Peptide Sequence Number=SeqID_168863
atgagaatgaagagtgatggttggtgggggcgagggaagatatgggatgctatcaagtctagggtggaagaatatgtctcattctactacaagtcagataaggaacttcaaaaagaccccgagctccaagcttggtggaaagaacttgtagaggtgggtcatggggatttgaaggataagccatggtggcaaaagatgcaaactcgtgaagagttggttgaagcttccgctaccctcatatggattgcttcagctcttcatgctgctgttaactttgggcagtatccatatcgaggagattcatgcctgagaaaagggtctcctgaatatgatgcgttggctaagaaccctgagaaggagtttttgaagactattacaagcaagaaagagaccctcattgaccttacagttatagaaattttatcaaggcacacatctgatgagttctaccttgggcagagagatggtggtgactactggacttctgatgccgggccattagaggcctttaagaggtttggaaacaatcttgaagagattgaaaagaagcttatagagaagaacaatgatgagacattgagaaaccgctatgggccggctaaaatgccttacactttgctttatccttctagtgaggagggattgactttcagaggaattcccaaaagtatctctatctaa

SEQ ID NO: 52086 - DNA, 429 bp, Glycine max
  Peptide Sequence Number=SeqID_168864
atggcatccaaactgtatttttactattcgtatagctatgaccttacaagagatcttgctgaaattcggggatggctagttgcctttcaggttccagaattgcaacttggaacctcaaccaggacactcattcctatggttaagttccagaacatgtcccaagtaattagttgtgaaagtcttagaaccattcaagggaacatatgtatcagtcctagaaccattcaagggaacatatgtatcagtcctagaaccattcaagggaacttttctagccttagaacaaaacattatatccttagtgatgcaatcctacccccaagggcattggatagaaaacttcaagaagattgggccagagatgcaggagaaggccttacggttctcatgggccttagggtagattttgggcccatgggttcaatatga

SEQ ID NO: 52087 - DNA, 159 bp, Glycine max
  Peptide Sequence Number=SeqID_168865
atggtgggagtgccggtctgtgaaagaattgatagaccttgttcatccctgaaggctggaaataatctcaggtcttgtgagagtggcatatcccaaggaacctacaatggactgatcaaagcagatatgcctttatcatcttccatgtttgatttgtag

SEQ ID NO: 52088 - DNA, 153 bp, Glycine max
  Peptide Sequence Number=SeqID_168866
atgaagcaacacatggaggttcaatgcacaattacatcttggagttctgttgctgtgaaggatggcattgcaatcaagcctgacacacaaatatatggctgcccaatatggaaaacacaaggcttaaagggtttatatggagggacacactag

SEQ ID NO: 52089 - DNA, 1318 bp, Glycine max
  Peptide Sequence Number=SeqID_168867
atggtgcttttctttgtcatcgttgttacgcttatctctttacggaaatcagcttacaggaccaattggggtgactacacctttcccaatcttcaatatttagatctatcaaagaaccaaattcatggcaggattccaaaatggtttaatagcacagggaaagatactttgtctgtttttgacctttctcataaccttctaacatcagttgggtatctctcgctctcatgggcgtcgatacattacattgaccttagcttcaacatgttgcaaggagatattccaattcccccatcaggcaccaaattcttttcagtctcacataacaaattgactggacacatttcttcaactatttgcaacgcaagctcccttcaaatgctcgacttgtctcataataacttggcaggaaagcttcctcaatgccttggaacctttccttacctttcagttttggatctacgaacgaacaaccttagtggaatgataccgaaaaactctcttgagatagaagcattggagactatgaattttaatggcaatcaattggagggaccattacctcggtctgttgtcatgtgcaaacagctaagagttttctacatctccaacaataatttcagtggcaattttccaacagcttgcataaaagacttcaagggaatgatggtgaatgtcgataatggtctgcaatatatgaggggcaaacactattcttctagttactatgattcagtggtaatcaccataaaaggaaacacttatgaactggagaggatcttaactactttcacaactattgatttgtcaaataatagatttggaggagtgattccagcaatcattggagaattaaagtcactcaaagggcttaacctttcccacaacagaatcactagtgttattccacaaaactttggtggtttggaaaatctagtgttgggctatgaccaaaatccatatttcttgtttgttcttcatcacttccataacaaattggtatcaagagctcaagttgcgatcaagggaattcaagattctcatttgaatacaaagatcaagctgcgggagtcttgtttctggttctttcgctgcttcactgtgatcaagaacactcaagaaatcatgtcaaacacaatcaagattgagaaattcaatggaaagaacaacttcaatctgtggcacatcaagatgcgttctttgttgaaggaacaacatgggttcaaatgcagcactgaaaatggggtcatgaaaattcagaaaggctctacaatggtgatgaagagtataaagaggggtaatctctatatacttcaag

SEQ ID NO: 52090 - DNA, 147 bp, Glycine max
  Peptide Sequence Number=SeqID_168868
atgatgatggcaactggcccactaggttgtttccagaaaggcaaggttgagtttttgaagatgaatgaggttgaagagagtggttttgggatgaaattcaccttgaaggcaactgcagctaaggtctatgccaattacgtgacctga

SEQ ID NO: 52091 - DNA, 205 bp, Glycine max
  Peptide Sequence Number=SeqID_168869
acaagaaggagggcttcgaaccattgggcgattcgagctggtgtatgttcgagtcgaagtcaaggcagcaagatttctggacttagcacaatttctgacaaaatttcacaaaatcagttcgacttcgagcaatgtggataaccgttctaaggagcagttatgtgcatataaggtgtacgtagcaggacacttggcattaggatag

SEQ ID NO: 52092 - DNA, 612 bp, Glycine max
  Peptide Sequence Number=SeqID_168870
atgaacagggtgatagaacaatacttgcatgcctttgtacatcgtcgggcggcaacatggggcaagttcttgccatggattgagttatctcataatacttcatggaacagtggcacgggctccacaccttacgagataacatttgtacgcaagcccttctcatttccagattatctagcgggctcctccaggattgactctgtagatgaccttctaacaactcgcgatgaagtgtttgctagcattcgctggaagttgatcaaagctcaagcttacatgaagaaaaccgcagatgctaaatgtcgagaagttacttatgatcttgtcattgatcatgttggcaaagttgcaaatcgtttgaagctacctgatacagcccgtattcatccagtgttccattgttctctcttaaagcctttccatgtgctagtgcaatggaagggattatctcctgatgagacttcctgggaagattgggcacaactccaacaagatcatcaccttgaggacaaggtgattctccaagggccgaaggaagttgatagcagggtagcaacaacatcagcatcaaaagggcaaagaggggaaatagacaatggaggagtaaaatag

SEQ ID NO: 52093 - DNA, 1715 bp, Glycine max
  Peptide Sequence Number=SeqID_168871
ctcctgggaatgccgtggagtttgacaacaatgtcgatgaacaacaaggctaccatgtgagctgtgtgagcctaagaccagtgatgaaatcaagggagaggtcctacaatggtctgaatggaattggaagagggcacaacaagcccgtgatacgcttagtttcatatttagtgaattggcattcagcacaattagctacaaatttcgcgacatcagctttgagacctggccacgtgaaattctccgacaaccttgctattgtttttgtgactcctgtatgtccccccatgggagtggagtgtctggatatgtcgccggagaatccaaaatgtcctgtcgttgccggcagtactgctggtggttggccaattgatgccataattattcaaggaaggtcaaccagggaacttagagaagcaaaaaagtggatgcagaatattccggtgaccgtgacaaagcatctgcaacttgattatgagtccttgatcgatattgaatttgataatcaaatctcattaagcatgccaaatgcgtatgctgttcagggaggtgatggcaaactgttctcgaacataagtggatgttgtcagaagcttcttagtaaatggtttgctgaagtaagcaatgggaattggagctatggacagagcagctttgaggttctcaaaagcttgttgagcctaaggggtccaatgaaaaggttcaatggtggtgactcggaccaagggatcaacaatcatggcatagcctttgataaattagcggtgatgcaaatgatcttcaaaggtgccactgtaaatgagtatgtcatcgaagaaaacaatgacgaagcggcggagaaatggctagaaaatcaaattcatcatcgcttgaaacgaggatggagcattgcagagcccaaagggcatgactctgaactcatagtgtccgtggtgagttcgaaaagcagtcttagggatatctgcagaatgcattcgtatttgatggtatccctgcaaaaggtcaagtttagaaaagcattgtgctcctcccaattcatcaagcaattcatcaattgttggaattgggaagcggtccttgatcgtaatcaacttgcaactcaatttcctacttttggaaatgtggataacgatatgggcgaacattcaccggcgtggactgaggcagtaagtggatgtggtgatccgtggtgcgtgccggcggcaaggtctgaggttgttgaaagaggacactatatttgtagagcccgaaattctgtgttctgcacaaacgatgaaactaagaggaagtcaatgagctcaggccctaaggatttgagccactgcacccctaagacaatattagcaccagagatgggaagcacgtacactccaagtactgaccgttacccaccatcacttgcaagggagtggtgtcgcgacaaggtaaacctaattgagtcaccaattggtgcgacaagtcagaccaatctctttgttgtcgacgtaaatgcgaaagccccgctggcagtccttgattcagaagttccagctagctgggaaggtccaactcgttcgaacgaactcgacgaagagtctgcttcaatatggaagagatttaagaagggggttcaagaagaagcaagaggtcttgcgtgcgcgagactagggttagaaaaaggaaggttcagtgcgaaaggagagaagttgggacgagcgagggtctgctacgtttag

SEQ ID NO: 52094 - DNA, 3396 bp, Glycine max
  Peptide Sequence Number=SeqID_168872
atggccgaacataatgaacgtaccaggcttcaacaacttcagtcccaagttttcgccctcacatcttggatggaagaacaacgttcttgtgatcagagtttacaggatcgttttaatcaatttcaagctgacaatcaagctcgtcgtaattccagcactctagtctcgtcaccctcgcaaatttcaataaattatggtgttaaggagattacatttggttttccgcattttgatggacaaactccagtcatggaatggattttcaaggcagagaaattcttcaactatcataatactccagatcaagatcgtgttgatatagcttcaattcattttgagaaagatgtaattccatggtttcagatgctgcagagaatggagacggtgaatacttggactgagcttcgacagttattcaaacttcaacaacagggtacagttgctgattattatttgaaatttatgtcattagctcatagatatgatggtttgactcatgaggccttacttaattgtttcattagtggattgaacaaggacatgcgtagagatgtggttgctcaagctcctaatgatttgttacgtgttgttgctttggctaaattgtatgaggaaaagtatgttatagtgcctattactcgtcctattccattttcacctagatactcaaacttgtcttcttctaatactcataataataatgatgatgctgagcttgaatttcatgacagtgaagacagatttgatagtgtgactaataatgcggaggtgattcttgaggatcatcgcttgtcattgaatgctttaaaaggtggtatgggtgtaggcacaattcgatttgtggctaatgttgacaagctcccagttaaggttttggtggatgggggcagttcagacaatttcttacagccaagagtggctaaatttctcaaattacctgtggaaccagcacctttttttaaggttatggtgggaaatgggaattatatggaagctgaaggaataattagaaagttaactatcaaagctcaaaatgtcaggtttcaattgcctgtgtttttattaccagtatcaggtgctgatcttatcttaggagctagttggctgaaaactattggtcctcacatagctgattatgacaagttacaattgaaatttatgtatgatggaaaatttacaaccttacaaggagagaatgatataattccaggacaggctcatttacatcatatcagaaggatgttgaagacagatgctattgctgagacttttaccatgcaattaattgagcccaattctgtacagtttcccttattggagttgcccactgatatggaacctaaattggctttacttctgcattcttatatcaaaccttataggtatcctcacagccagaaggaagaaatagagaaattggtgaatggtatgcttgaagaaggaattattcagccaagtgctttaagaagatttgttttggtattctttgatgatattcttatattcagtccttcatggaaggatcatttgtctcatttggaaattgtgttgagcattttgaagcaacatcagttgtttgctagattctctaaatgtgcttttggagttagagagattgattatttgggacacacattatatagagctggtgtagcaatggagacaacaaaattacaagttgttttggattggccattaccaaattctctcaagcaattaagaggatttctgggcttgacaggatattatagaaaatttgtgaaaggttatgctacaatagcagcaccattaactgatcttttaaagaaggactcgtttaagtggtctgcaagtgccactacttcccttaataagttgaaggaagtcatgacttcagctccagtcttatccattcctaacttcaaggaaccttttgtactagagactgatgcttcaggtactggaattggggctgtattaagtcagaatgaacatccaatagcttatttttccaaaaagctatcatccagaatgcaaaaacaatatgcttacattagagagtttcatgccattacggaagctttggctaagttcaaacactacctattgggccataaattcattatccgtactgatcagaaaagcttgaaggaattattagagaaaaggttgcaaactcctgagcaacaacagtggctacccaaatttttgggaaatgattttgttattcagtacaagtcggatagggagaatattcctgcggatgcattgtccagaagtttttctatggcgtggtctgaagcagtaggagtgtggatgactcaagtagcaacattaatgaaggaggatgctattctggctgcactttataaacaatgtatagagggaactatgatgatgattccttcgaatgaggcattgaagcagaaaattatgcatgagtttcatgcttctaagattggagccaaggtagaacaagcgctgccagctggcttattacaaccacttccaattcctcaaagaatttgggaggacattgctatggacttcattacacatttgccatcatcacatgatgtctttattgttaatatagtaaagatgcatggctttcctaagaccattgtttcagatcgagatcgtgtttttatcagtgccttctggcaacagttattcaaagctcaagtcaccacattggctatgagttctgcttatcatcctcagtcggatggccaaacggaggtgttgaagaagacactagagatgtacttgagatgttttatgtttgatcatcctaaagcctggtttgagatgcttccttgggctcaattttggtacaacacttcctttcatcacaacattggtatgtctccctttaaggttgtgtttggtagggatccaccatctgttattcctcatgaattggtggatcgaattggcagagtggcatataagttgaaattgcctgaaacagctcgtatacatcctgtttttcacatttctgcattgaagaagttcgttggtagctcaaatcagccttatttaccattacccttaacagtgggtgaaagtggtccaatggtccaacccatagcagtattggattcaagggaaattgctggtcttgaggaagctaaatgggaggatgcaacttgggttaaggcaagttatcctcacttcaaccttgaggacaaggttgtttataaaggggagggtaatgtaacatgcgggaagcaggaaggaaaattggtgcgtgagtcagttataaaggaaggacacgtggctgatgatctgcatgtgaacactcttcctgtatgcttctcagatccctctgttaattccttcttctctacaccttctctgaacctttctactctccttaatctcaggtgctattctgaaccgatgatggtttag

SEQ ID NO: 52095 - DNA, 426 bp, Glycine max
  Peptide Sequence Number=SeqID_168873
atggcctcgttcgatgaaactcctcccagaaactccaagaacggcgagaagatcttcaaaaccaagtgcgctcagtgccacaccatcgacaaaggtgccgacaacaaacaaggtatctatcgtcactcatcaccttcggttcgagagttactctgtattgatgttgagggaaacattatgcttgttgaggcaacatggacataccaaactttctcagcctacaccattgaagaaagtggcagaaaaattggactgatggcgcaaattctgctccatgggactcttcacgccactgtctatgaagtcgataagctcaaaattggtggaggcaactttttaaccaagattagtttattgataatcttgcaatggtatcagcgctgcctctgttactgccttctccaaacagagaataaacctaactaa

SEQ ID NO: 52096 - DNA, 447 bp, Glycine max
  Peptide Sequence Number=SeqID_168874
gaaaatgagagaggagcttgccacccagctcgtgtaggcgagctaggttgcttcctccagaaggcaccgccttctgggggaacttcctggaaggcccaagtgggcctgaaccttacggattacgcaatcatcccttctttggcttccagaatgttacgaaacttcacaaattgcacaacaatgcttgcttttgagttccggcatgtcacggaacttcacggattgcctaatgatgggtgccaaaacttgtggttgtggaacacattgggaaggtgtggagagaacgtatttgaaagatcaagaaatatccagaacccaattcttgggagtcttactaactatactagagatgtggataatagagcatcaatgtccagatcacctccaaggagggatggaactacattcaagcttgcaggggcaatcgcctcccctaaagatcactaa

SEQ ID NO: 52097 - DNA, 414 bp, Glycine max
  Peptide Sequence Number=SeqID_168875
atgtcgcagaggagcaatgcatcatcatctcgaacaagagtttcatcacaagttgttcttttttgtggttgtggtagaagggctgttaggcgtgttgctggaacaaatattaacagaggaagggcgtttttcacttgttcaattaataaggatgaagttggatattgtgggtactttatttgggttgatcaattgattgaagcacttggagttgatgattcacttgggacattttccatggaacaaagaagacaatttagaagagaggaagataagacaatgtggaaggctcaagttaactcaaagcttgattgtatagggattgaaatgaagatgtttagaacaattgtctatggaatgttcttaatccaattgttgtcaatggtggtgtttgtatgtattcacaagtactag

SEQ ID NO: 52098 - DNA, 234 bp, Glycine max
  Peptide Sequence Number=SeqID_168876
atggcctctccgggaattccgctaagtaataccaaccacggttcgttctttgatcacatgctcggccaaatagtggccatcgtgatcatcgttttggtggtcgttgcctgcgccatcttcatggctctcaaatgtataaagatggtcaaggtcttccgccacaatcgctccatggcaagggtcgctcccgagccgctggagccaccacaaggagaggctatgcatcaagtatag

SEQ ID NO: 52099 - DNA, 150 bp, Glycine max
  Peptide Sequence Number=SeqID_168877
atgagtatgcaagataaaaacagaaaagaaaataggaaagaaaaacctggagcgcttagcgcaacaccccctcgctcagcgcgtgtagattgcatgcttaacgcgcgtgttgcaggcttagcgcgtgcttctgttggatcgcaggcttag

SEQ ID NO: 52100 - DNA, 1185 bp, Glycine max
  Peptide Sequence Number=SeqID_168878
atggatctgcctcctgggttcttaccgcctggttcttcttctaataaagtctgcaaattacataagtccatatatggactgaaacaggctagcagacagtggttctccaagttatccactgctcttatctcccttggatactcaccttcatctgctgaccattctttgttcacaaaactacataattctcatttcactgctcttctagtctatgttgacgatattgtcttgacaggtgatgatttgcaggaaatacaatctgtcaaacaattccttgactccacattcaaaatcaaggaccttggcaagcttaaatactttcttggattggaaattgcaagatctactcaaggcatctttctcaatcaaaggaagtatgcattggaattgcttgaggacagtggtttattggctactaagcctagtacaactccctttgattgctccttgaagcttcatgacagggactcacccccttatgaagatgaaacagcctataggagacttgttggcagacttttatatttaactacaaccaggcctgacattgctttcattgttcagcaacttagtcaattcatctctcagccattacaagttcatcactcagcagcaattagagtcctcaaatatctcaaaagtgctcctgccaagggattgttctattcttcctcctccacactcaaactctctggttttgctgactcagattgggcaagttgccctgctactcacagatcagtgactggttactgtgtctttcttggcacatctatgctgtcttggaaatccaaaaagcagtccacagtatccaggtcaagttcaaaagcagaatatagagctttggctagcttaacttgtgaattacaatggctgcagtatttgttcaaggatcttcacatctctcttgatcaacctatctcagtctactgtgataataagagtgctatctatcttgctcacaaccccatcttccatgagaggacaaaacatattgaaattgactgtcatgtcattcgtgagaaaatacaaactggcctcattcatctcctgccagtttcttctgttgcacaattggcagatgtacttaccaagccattacttgctccctccttcaattcattgatttccaagcttggtctattagacattcatagtccagcttgtggggggctattacatgat

SEQ ID NO: 52101 - DNA, 364 bp, Glycine max
  Peptide Sequence Number=SeqID_168879
atgacgccccggcggggctgccacacccaccgcgcaggcaccgcgctacgtggattcgtcctcgcgcacctcgtggaagggcagcatcgtctcgaagccgaattcgtgttccatgctggtgcggaccaggccgccgatggcgtagcggctggtgttggcatgcacgtctatgccaccgagccgccattcggtgcgcagatgcagcgtctctgcgcgtcgcatgacgatccgttcctcctgcagcagcgcgcgacggtgcttcttcatcagcaggcgcagcggtttcaccgtggtgatgccgaatgctgccagttcgggcagcaactcggcgatatcggcatcgtcgccatagtcgtggctgcgc

SEQ ID NO: 52102 - DNA, 909 bp, Glycine max
  Peptide Sequence Number=SeqID_168880
atggggtggtttccttttcttgtcctgagtttcttgctttctcattttccttcacaaacgtcttcattcatgccattttgcaactacgatgacgcctccgtcttgcttagcttcaagagctcatttactctcgatagctcttctctctctaatccttggtgtgagtcttgtcatccaaagacagaatcatgggaaaatggtacgaattgctgcctgtgggaaggggtgagttgtgacaccaagtcaggtcacgtaattggcatagaccttagctgcagttgccttcaaggtgaatttcatcccaacaccactctcttcaaactcattcatcttcaaaaactcaaccttgccttcaattatttttccaattctccaatgcctaacggctttggtgatcatgtggctcttactcatctaaatctatctgcctctgcatttagtggtgttattccttctaaaatctctcacctctcaaaattagtgtcgcttgatctctcatttcttggaatgagaattgaagcagcaaccctggaaaatgtcattgtaaatgcaactgatataagggagctcactcttgatggcctagatatgtcttccattaaaccgagctctctatctttgttagtgaatttctcatcctctttggtctctcttagtcttcaacaaacaggattgcaagggaagttagcaaataacatactctgtttacccaatcttcaaaagcttgatctgtctttcaataggtatctccaaggtgaacttccagagttcaatcggagcactcctcttagatacttggatctctgttacactggttttacactggagtctcttaactatttggatttttattcctctgacttcgaaggaactattcctctgtttttatataaaaaatacctcatataa

SEQ ID NO: 52103 - DNA, 648 bp, Glycine max
  Peptide Sequence Number=SeqID_168881
atgcagaagaatctaggattcccaatctccaaaagcctcgaccaattcaaatcgctgtacggttcaatttcggcaacaccgaagccattatcttcgcgtccttctgcggattccgtttcgtcggggagtttcgcaaacctgaagctcaccgcagagaaactggtgaaagagcaagcttcggtgaagactgatcttgaaaatgcgaattctaagcttaagaagtcgcaggagtatgtacatgcattagaagaaaaattgcagaatgcgttaaacgaaaacgcgaagctcaaggtcaagcagaaggaagataagaaaatgtggaagggattggagtctaagttctcttctactaagactttatgtgatcaacttacagagactttgcagcagctggctggtttggttcaggacgctgaaaaagataaggaaacattggaaaataaactgtcagctagttcagaagcgcttgatagcttgaataaacagatggatggtttgtctttgaagctagattctgcacaggaaacaattagtacacgtgataatgagctagagaagatcaaatatgctacagaagaaagggagaaatttcacagagatgaacagtgcagagttaccaatgttatacaagacaagggtgaggattaa

SEQ ID NO: 52104 - DNA, 1857 bp, Glycine max
  Peptide Sequence Number=SeqID_168882
atgttaacatctagtagattggctacagagaatttgaactcaaagttggaagaggttcacctacagttaaaagttaaagaagatgaaattatgcatcacttaaccagtcaagagaaattggagaaagaaaagagtgatcttcaattgtggaatgcaggtcttgcagaaaagcttgacatctcacttcaggaaatcaaaaaccttgaagaatcacttcattcattggctgcacatttgtcaaatttagataaagaaagcctgaatcttttgagcaagtttgatgaaatgaatctgctctatgcttcttgcttccagttggttcagcaggagagagaaactttctcaaagcatgctcgataccagtatagtgagcttaacaataaattttttgtcttggaattagaaaataatgcagctcaaatgaaaattcatgagttaagcaaaaatgtggatgaacttcagaaagttcatgaatctactctagccaagcttacagaggactctcgattagctgctgagagaattcaaagtttggagtcagaagctgaaactttaatctcaaaaaagaaagatgcagaggttttaatttccaaattagaaaagaaagctgattttttgctagaaagttctagatcatcagagaaccaagtgcaaggtttactgctgaaggtttcaaccttagagactgaaagcaaagaaaatacagaaagactgcaggcagagatatcgaagaaatcagatgaaatagatactttgcaaaacgagagaatgaaactagagcagcatgctgattctcttgataaagaagtcatccagcttcagaattccttggaggaaaaagataagtgtattttacattctaaggaacaggaaaagaagctggaagatcagattgcagagaatctatcattattgactgctgctgaaagcaaactttcagaggctagaaagcaatatgatcaaatggtagagaataaacagttagaactatcaaggcatttgaaagaaatatctcagagaaatgatcaggctattaatgatattaagaggaagtatgagttggagaagatggaaattgtgaacatggaaaaagacaaggttaacaaagccattgcagaaattgagggaaagtgtggccaaaaacttgcagaatggaaagaagaatcaaggcagcagttgatgcgcattcaggaggaacacgcgttgctcgttactcaaatgaagcaggagcatgacaagatgcaactaagcctcatagctgaacacaatgaacaactaaagcgtacccaactgcaagctgagaatgaactgagagagaaaacaatgtatatgaggaatgatcatgaagctcagattaaagcattgaggtgtgaacttgaagatgagtgccagaagctggaagaggagttgcatcttcaaaaatccaaagaagacaggcaacgggctttgttgcagttgcagtggaaagtgatgagtgacaagcccaaagaggaccaagaagtgaattcaaaacaggattactccatttcatccattaagagaaggagttcttttggtggtaaaagaaatcagcatgacctagactctcctcacattgaagcgacacaaagaccagtaccaaagttgttgaaaaaagtggagaacgttaaaacaggaagtgcagtgagcattcccaagcatcatagaaaggaccctagaaatgggaagacaaatacaccaaaagtaaatacccctggaagtgttgttaagatgcagagcatcaaaggaggaggccatcctcgtccttcaaatattggtgatttgttttcagaagggtctcttaatccatatgcggacgatccctatgcatttgattag

SEQ ID NO: 52105 - DNA, 474 bp, Glycine max
  Peptide Sequence Number=SeqID_168883
atggggacgaggggttgcgtcaattacaatcccatcggcagttaccataggtggttgaaagcatacgcacaagatctggattggctcccgagtttgaggactactaaggggatggagattgaaactccggaagaagatgaagaggatccgaaaggagaacgccgaactgagagacgtcaatatagccaccaccaagtccttggagcaagagaccaagagggccctaacagcgagcttaagctccggagagagaaaagggaccaatcgcgagtagacgctttgattctgaaggatgaattgagggttttcctaaggtccaagaggagtttgtctcaacggttatgcgagaccgaaacaaacatgttagccatcatcagcaagtaccaagaagaattaaatctagccacggcccacgagcacaaagtggcggacgaatacgcccgattgtacgcgaaaaaggaggctagaggaagg

SEQ ID NO: 52106 - DNA, 357 bp, Glycine max
  Peptide Sequence Number=SeqID_168884
atggccacagatccgatgtctcccccgcagtccgatggtcaatcagaggcgacttccaagaggagtagaacaacgacacggttgagaacattgacattaagaaccgtggatcagcccagaccggcagtttatgtggatcccgctaccgggagagcatcgggaccgatgcgtgaaaagttccacagctacctaggcgtagtggcgcgagaaaaggttcccattatccacaataattggaaagacgtacctgaaacgctaaaggacatagtgtggaatgacattctatggtccaaacatccactactagcggtggaacatgttgagataagtctgggaaggaagaatagcaccttctaa

SEQ ID NO: 52107 - DNA, 837 bp, Glycine max
  Peptide Sequence Number=SeqID_168885
atggatttcaaatacctttgtgaggatgacactatggtatatatccttttcagtgctcttgtccttcattacttctgtagcaaagcagttgaagagaatctagggcaagtgaaagggggttcctcgatactcatagccaatggcttaagcaatggtttcaaccgacaacttcacttggataccgaggacttttccagcaaaatatcctcccacatcttcatttctgtaaactttggctgtcctctagaattctcggataagttcaggcaccaccactttgggggcttcaaagaagtgatggatgacacacaacaaaagatgggctttgatgatagagacaatgttttccagagatttaatgtcgaaaaaatgctcgacatgaagtattggttccttatccttcatcatgacttcggcaacaagaatggtcataggtgtaggtatgagggagaattgttcctgaagtctggtgcaatgtggacaactgaggttggttttgtttcttggtcattgttagggttagcagaatttttaggttttcgagaagaagagaaattagggtgtagaaaggtttctgagagagagaatgtgaaagggttgtataagggtgaagagagagaaagagatcgtaaggggaagttgaacaaatatggactttttcaaataggatccgacccatttcaggccatgggtctaaaatctactctaaggctcatgagaaccctaggaccttctcctgcatctctggctcaatcttcttggagtcttctatccaatatccttgggggtaggagtgcatcaccattttcaattaaaaacgatcttaacttttcataa

SEQ ID NO: 52108 - DNA, 1497 bp, Glycine max
  Peptide Sequence Number=SeqID_168886
atggatgtacctccgtctaaggttgcaccttctcaacaaagtccacctcccactttcattgcccccaaggcaacaagtgtcatggaaaatgtcaccaaaatgcctacacctaagaagaaaacacaaaagcctttgtccactactcaacgcctaagggcacttagtgaaactaaaagtgaggatgctttggtcttcaagaaaagaaaggttgcacccctttcagataagacctctatgcctcaagtgaagaaggtgaaaccatgtcaacaagctcctactcttactcaacctcgtacaagaaaaggagaaaagagaggagcccaacgaccaaagcgcctaaagggtgaacaatcctacattcacgatgatgctaccaacaaccctccttcagctgatattcaatcgactaaacgtcttaggaagaagaagcaaactaagtccacctcactattgaagacatcacaagggatcaaagttcttcctccacctaagtggaagcgacttcaccccaaggtatccaagccttcatcctttgcagcacaacacaagaatatctacaggattccttctgtagcctgcagagaaaaggtcagctatgataaggacatcattaggtggtttcacaagatcgacgcacaacaaattgattcatcctctgatgatttcttgcctctatttctccatccaaagcatgttcaactcttcactcccatgtctaaatatcctctaggtcttcacattcgatgcacaacctccatcaagtttatgcctgatcgaatagctccaagattgccacccttggacttaagaaagaaaaagggcaaagttcctcctcacaacaagcccatgtctcatcaaggcccaaaagacaatgttgccttgcatccaattccttatgattggagcagctactttacaagggacgcggcaacaaagactattgcgcaagaagaagataatgagttttatcaacgtttagtccatgatacttttcttcttcactctcagtttgtctttgacttgaataaatattttgaatctgcaatgagaagagctattgtcactgcttggacaaggtttctcatgcttaatgagaatccatactatcctaatcaaaatccatgggttcctagtcaaggaacgacatttgatgttcaacgtaaacaagacaagttgaagcatcacttgatggagatgaaaaaaaaggatgaagctaaacaacacatttccagtactcctcatgagataactcccttgacactctttgcttcaactgtcattgtcaaatacctcaatgattatgttctcttcaacatgaatttactaatgcaacaaaggctacctccatccgtccagccaccaaccattgttgtacaacctcttcccgaggttcctaccttagaggctactatatctattgatcatgtgcctgtgcctccaccttcaccaccaaagtcaccacctctcatccctcaacctccatccgctgaaggttaa

SEQ ID NO: 52109 - DNA, 297 bp, Glycine max
  Peptide Sequence Number=SeqID_168887
atgacgaagaaaagtgaccaagaaaacaagggttgtttcaagttggtcactgttcaagtgaacttgtttgagattgaacattgcaaccctgtccctttctcaacgcctttaatggccccgactttaacattatcccaagttcaagttgcatgttacagggacaattgtctagtgggtgtatctagagaactcgggcaacaactagatggtgatgcacggagaatcactcacaggaagattgcaataaccctaggtacgaggaggatattattcaaaattggacctagaagatggtag

SEQ ID NO: 52110 - DNA, 252 bp, Glycine max
  Peptide Sequence Number=SeqID_168888
atggccctttccaatttcggatacaaccactttgtcagtgtggctgttgatgtaagaactcatttttttaaatacaatatctcaaaagccaccacaccgaactcttctaacatgtggtacgaggtcgaggttaccttcgagaatagtgtcagtgccaatccgacctcagggttctcagatagtcacccacatgccacgcagagctcaggggggtgttgcgacagtgaaggtacggaggtgaaggtgcagtga

SEQ ID NO: 52111 - DNA, 726 bp, Glycine max
  Peptide Sequence Number=SeqID_168889
atggaacgggaaagttttgcagtcatttttgagcaccggtataggccccagttggtgatggcgtttgcgattccgttgtctcagcaactttcggggatcaacactgtcgccttttatgcgccaaacctgtttcagtctgtggtaatcggcaataactcggcgttgctttcggctgttatactgggactcgtcaaccttgcttccactcttgtctcaactgctgttgttgatcgatttggtcgaaggctcttattcattgtgggtggcattcaaatgctactttgcatgatttcggtggctgttgtgttggcagtggggagtggtgttcatggtacagaccaaatttcaaagggcaactccattgctgtgctggtgctattgtgcttctacgccgcaggttttgcttggtcgttgggccctctttgctggctgattccaagtgagatattcccaatgaagatcagatccacgggacaaagcatagccattgctgtgcagttcttgacaacatttgttttatcccagacattcttgacaatgctatgccactttaagtttggagcttttctcttctacgctggttggcttgtactcatcaccatctttgttatactgttcttgcccgagaccagaggcatttctttggattccatgtatgcaatatggggcaaacactggtattggcgccggtttgttggtgaaggacaagttatacaaccaagataa

SEQ ID NO: 52112 - DNA, 249 bp, Glycine max
  Peptide Sequence Number=SeqID_168890
atggtgggttacgcaccttcaagctttgtagatttggtcttcgccagcgaaaggatcaaagtgggtctggaaaaaggaaaatctgatcatcctgctttgatgaatgtgaaaactggggcaaatgaagaggatgagaataagggagaaacccttgctatgactgtcattcctacacgccataacccctgccagggttcctcaaccttcatttttctgaggatacgactcgaatgcaacatgtgcatataa

SEQ ID NO: 52113 - DNA, 129 bp, Glycine max
  Peptide Sequence Number=SeqID_168891
atgattgaggccgctaagattcttgcaaacttgattgtaatgggtggaggaatcttggcaagagcagttgttcaggcatatcgtcaagcgcttactagggatttcatgggctgggggggaggggggtaa

SEQ ID NO: 52114 - DNA, 772 bp, Glycine max
  Peptide Sequence Number=SeqID_168892
atggacctactcaaagagaatcttgacttgcccattgatcttaggaaaggtactcggtctacacgtaatccttatcctatttataacttcttaagttatcattgtctctcttcttcataccattcttttgtttcctctttatcttctatttctcttcctaaaaatctttgtgaagcacttgatcatctaggatggcgacaagccatgattgatgaaatgaagactttagagcataatgttggggccaatggacagattgatcgcctcaaagctcgattggtagccaaagctgccatccgtcattggtcactatatcagttggatattaaaaatgaattcctacatggggaattagaagaggagatttatatggagcaatcatcgggatttgttgctcaaggggagtctagcttgactaaggatttgggaaaacttaaatattttcttggaattgaagttgctcggtcaaaagatgggattatcatctcacaaaggaagtatgcgttagacatacttaaagaaactgtaattcgaattttgagatacattaaaaggaccccaggacaagaacaactctatgaagacaaaggaagcactcaaatagttggattttgcgatgcagattgggcaggatcacccattgataggcgttccacttcaggatattgtgtgtctattggaggaaatcttgtctcatggaagagtaagaagcacaatgttgttgcaaggtctagtgcagaggctgaatatagagttatggttgtagtcacat

SEQ ID NO: 52115 - DNA, 247 bp, Glycine max
  Peptide Sequence Number=SeqID_168893
gtccaacgagtatagattttattgtccatcacatagcactaggattgtagaattgagaaatgcaaaatttcttgagaatgatttgattggtgggagtggtcaatttcaagatattgcttttgaaaaggatcactatgaagctcaaccctctggctcaagtggcagattcattgccattcacacccctcatgcacaaatcaagtttttgatgagaaacaccaagttcctcaagaagatcacaaagtag

SEQ ID NO: 52116 - DNA, 1128 bp, Glycine max
  Peptide Sequence Number=SeqID_168894
atgaatacaaaccaggtttttgttgaaggtcaaagcctgacttattctgaatttgtaactaagttcgtgtataaccagaaacagagatgttggcaacttaggaaaaagggttatactactggcagacttcaatgggttcctccaactacaggggaattattttatttgaggatgatgctgactgtctgtagaggaccaatctcatttgaaaatatcagaacagttgatggtgttgaatattctacatatagagaagcatgttttgctatgggtttttcacaggatgatagagaattcattgttgcaatccaggaagcaaaagactggggctcagcaccttatctaaggaatctttttgtattattacttttgacaggtttatttattgtactaacttgccttgctttttttcctcccttgtgtttcgctctggaatttcaagctgttattaaaaccagaacaatctttatgcctacagaccaacaagcaaaaatttataaccaaattattcaggctgtcaataaaaatgaaggtggaatgtttttcttatatggatatgaaggaacaggaaaaacatttatttggaagacacttgcagcctcattgagagctgacaataaaatagttattatgactgcttctagcagcatagcttctttgttattgcctagaggaaaaatagcacattcaaaattaaaaattcctgttccgatatttgaagactcgacatgcaatattcatcaaggatcacaattggctgaattattgaatgaagcaagtcttatcagctgggatgaagcccccatggctcacaaattctgttttgaagcacttgatcgaagtctaagagatgttattaaggcgaaatcaagttctgataaaatctttggtggtaaagttatggtatttggtggagatttctggcagattctgccagtcattcctaggcgtagccgctctgatattgttaatgcaactattaattcatcttacctatggaatcatttccatgttttgacactgtcaaaaaacatgcgtttagaagccaatacagatgcaacagacagagaagaaactgcagcttttgcagagtggatccttaatattggtgatggaattgctggctag

SEQ ID NO: 52117 - DNA, 879 bp, Glycine max
  Peptide Sequence Number=SeqID_168895
atggcggggacgggcatcgatgcacagacgcttaagtcgtttgtactggactggcagacgcgcagcgccgccggtgaggacgtccgctacgacaatatgctgtttcttatcgatgagtcttccatgatcggtaaccaggacaccgcggcggcgtaccgcgcaatcgctgccggcaatggccgtgccgtggcggtgggggacattgcgcagctgcagtcgcctgaaagtggcgcgccgttccagctgatgcaggagcggagcccgatcgacgtcgcggtgatgaaggaaatcgtgcgccagcgtgatacggcgctgaagtctgcggtttacagcatcatcggtaatgattccgcagcggcgctgagaaatattgaaagtgtcgcgccagacgttgtaccccgccgggcaggtacggtggtacctggcggatcaattgttcagtcagcagacccggtgtccagcattgtggctgactttatgagccgcaccgatgaggcgcgggagcagaccatgatcatggtgcagttgcatgaagaccgcagagccatcaacgagggcatccataatgcgatggtggtggcgaaagagctgggcggggaagcccggaccgtctctgtcctggaccggattaatggcgggcggcacgattttaaccgcataaaggactgggaaaccggtcaggtggttatggcaaaccagcggtatctgcacgttaccggcgtggaccacgaaaatggcaacgtcaccctgcgggatgaagcggggcgcacgcactactggtcgccgcaggagcttaacgcaatggaaatcgaggtttttgaacaccgtgaaattgagctgcgcaccggtgacagcgtccgcctgagtaaaacccagaag

SEQ ID NO: 52118 - DNA, 890 bp, Glycine max
  Peptide Sequence Number=SeqID_168896
ggggtcaggtgagtttatgcggttcacggaaagtcatggcggcggtggtggcggtgacggcgatggtgaatatggttatggacatgatgatggtagaggtggtgggggtggtggttcactagggttgaattttaaccaagtgatgcaacaaggtgaggttacaacgcaaggagggtcaggccagaggagcaccgaatggatccagcaaagtggttttcctatgatgtctgcatcttctctttcatgtttgtcttctttctcttctccttcttcttctggagcctcttgggttggccacaaaagaggcagagaagaagaagagagtagctcttcccataacatgatccaacaacaacaacaaagtgctccaagactcttcagaaacattggtgacttcatggtgccttctcaaggagactcatcttcagcgacagaagaagcccccacctccacaactacaagtgtaaccgctgtggcaacaacggttactgaaaccccacccccaccgggaggtggggaaaggaggagaaagtacaggggagtgaggcagaggccatggggaaaatgggcagcagaaattcgtgatccacacaaagcagcaagagtttggcttggaacattcgacacagaagaagcagcagcaagagcatatgatgaagctgcattgaggttcagaggcaacagagcaaagcttaacttccctgaaaatgtaagagcagttccacccattcaaccttttcaagccaccactaggctaaccgtttctgattccaccacctctcaattccggccactcgtcacggagacgccgcccttcattcagcagccacagattcagggctcctctgacttgatcagagattacttgcaatactctcagcttctacaga

SEQ ID NO: 52119 - DNA, 1034 bp, Glycine max
  Peptide Sequence Number=SeqID_168897
gactacacgttctcaccttcagagggctacacgccctcgccttcagaggactacacatcctcgcctttagagggctacacgccctcgccttcagagggttgcacgccttcactttcatagggctacatgccctcaccttcagagggctacacgccctcgccttcagagggctacacgtcctcgccatcagaggactacatgtcctcgccttcagagggctacacgccctagccttcagaaggttgcacaccctcgccttcatagggctacacgcccttacctttagagagctacacaccctcgccttcagagggatacacgtcctcgccaccagagggctacatgccctcgcctttagagggctgcacgccctcgccttcagagggccgaacgtcctcgccttcatagggctacatgccctaaccttcagaggactacacatcctcgcctttagagggctacatgccctcgccttcagaggactacacgtcctcgcctttagagggctgcacgtcctcgctttcagagggctccacatctgcgcctttagagaacttaaggggctagtaggtttgcttttatcagttcctgggccatcccttgatattggagggcgaccaactgtgctagcacaactagaggatgggaccaacatatggatgatgttgctacttagcaaccttcttcccggtgaccaccactccaatctccccctaccaaaggatcgcacccgcaagacacccagtggacctgaagaagtccaacagggccctggggttctagctctgattatgggcctctgtcgggatcgtgcccacaagacacctagtggacccgaagaagttcaacagggtcctggggttctagttctgattacgggcctctatcagttctacggagtgcccgtcgcccccaatagggcaacagacgcaccgccaccacctccagagttcacctcaactcatccacaaaaaggatggatcgttgcctacgacacatggccgaccagcaggcgaccaagtccaaagccaaag

SEQ ID NO: 52120 - DNA, 186 bp, Glycine max
  Peptide Sequence Number=SeqID_168898
atgtctatttggcaaacctcagtccacctggagaatggagagtttgttccgccggagaagccggtgatgatgtcacagagaagtgaaattgagaatggggagattgccggtgagagatggaagaaaggggaggtggagaggggggagtttgtttctggaaaatggagtaaggaggagctactgtaa

SEQ ID NO: 52121 - DNA, 183 bp, Glycine max
  misc_feature (166)..(166): n is a, c, g, or t
  Peptide Sequence Number=SeqID_168899
atgaagaaggtccaaggcctaagctccacatggagttacatcaaaagacattgttgtcttcaaaatcgagcatctgctaagcgcaacactcctgggctaagcgcgaggaagactctggaagaagatgagttgtacaggttcgctaagcacaccgcttcatctcacntaagcgcaccgctttag

SEQ ID NO: 52122 - DNA, 1071 bp, Glycine max
  Peptide Sequence Number=SeqID_168900
atggtacgcaacagcgacggcgactattacgtgctggaggataatctgcgcacgccgtccggcgtctcctacatgctggaaaaccgcaaaatgatgatgcgcctctatccggagctgtttgccgcgcagcatatcgcgccggtggagcgctatccgtcgcacctgctgcagacgctgcgcgaaagctcgccggttaacgatccggtggtggtggtgctgacgccgggacgcttcaacagcgcctactttgaacacagttttctcgcccagcagatgggcgtggagctggtggagagcgccgatctgttcgtcaaagacggcgcggtgctgatgcgtaccaccgccgggccgtgcaaagtggatgtgatctatcgccgcgtggatgacgcctttctcgatccgctcgccttccggccggattcgatgctcggcgtgccgggattactgtcggtataccgatccggcaatgtggtgctggccaatgcgatcggcaccggcgtcgccgatgacaagtcgatctacccgtacgtgccggagatgatccgctactaccttgatgaagatccgatcctcaacaatgtgcccacctggcagtgccgcaagccgcaggatctaagctacgtgctggccaatctggcgcagatggtggtgaaagaggtgcacggtgccggcggttacggcatgttgattggcccggtcgccagccagcagcagctgagcgagtttcgcgaacggctgctggcgcggccggataattacatcgcgcaggatacgctgtcgctctccacctgcccgacctttatcgacaacggtctggcgccgcgccatatcgatctgcggccttttgcgctggcggcggcaccaaggacacgtgggtgctggaggatgacacatcatgctaagccggacggccagtggcctttactggatggcgcgctatctggagcgcgcagaacaacttgcccgggtgctggatgtgacccatcgcctgtcgctgatgccggtgcgcaatcgtcagggcgacgaactgctgttgccgctcaacctgaccggtacgcgtcagctgtttga

SEQ ID NO: 52123 - DNA, 561 bp, Glycine max
  Peptide Sequence Number=SeqID_168901
atggtccagccacggctgcaggccgtcgcgcgtcaggctttcccaggtgctgaagcgcatctccgccagcaggaccgtactgagatagcgcgggcgatcctcgccgctgctgccaatctgctccagctggctggcgatctcctcaatgcaggagtgcagcgagcgcggactttcgctgcgcaggatcagcatttcgttgaccagcggcggcatcagctgctgcttaaagatggcgttgtaggcctcgcgcgccgacaccgcgcgcagcaggctatcgaggcagtaatattcccgtaccgtgtcgggatgctgctccagcagttgctggttaacgctcagcagccgcgcggtgccgtcgctgcgctccatcagcgtgccaagccggataaaacgcagcgcatcgccgcgcagcagcgtgccggacatcgcgccgcgaaacagatgcgaacgctctttcacccagtcgaagaagctgtcggcaccggccgacgagatgccgcggcggcgcgtgttgcgcatctcaatccacgtcgagttaatgctctcccacacttcggatga

SEQ ID NO: 52124 - DNA, 603 bp, Glycine max
  Peptide Sequence Number=SeqID_168902
atgtctgcccaatcttccagtctgctgttactgatgtctttcgccgccggtaccttttccgcgggatcgtcaggtaacccgcagcatttaatgttatcgctgccgtccggcggtgtacccaataatccgctgccgctgatcatctggccgtgcgtggtgccggaagaggaggaggacagcgcggcctggtttgaaaaaacctttagcgccagcggctggcctgcggcgtggcgcgcgccgatttttccttacacccactatcatcccaacacccatgaggtactgggcgtcggcgcgggctgggcggaagtgctgtttggcggcgacagcggtcgcatggtgacgctgcgtgagggggatgcggtgctgatcccggccggcgtgggccataaacaggtgtttgcctccgacgactttttcaccgttggcgcctatcctgaagggatgtcaccggaaaccgtgcgcgacgaaccttcccggcttcgcgcgtcaaaagagcagatccagcgcgtgccgctgccggatcgcgatccgtttaccggcggcgaaggagcaatgaccgaaatctggctgccagtggcgcagcagctgatgcaccagtaa

SEQ ID NO: 52125 - DNA, 564 bp, Glycine max
  Peptide Sequence Number=SeqID_168903
gaagatctggacagcgtgctgtcgcgctccgacgccgagctggcgcagctgcgtcagcagatccagagcatcatcaacagctatcacgcccagaacctgctgacgctggaaaccctgccgcaggggctgcgtatcctgattcaggatgaccaggatcgcatgatgttcccgcgcggcagcgcggtgctgacaccgttttaccagcgcctgctgactgaactcggtccggtgtttaaccgcatcgacaacaaaatcatgatcagcggccacaccgacgccgcgcagtacagcggcaacgcggcgtacaacaactggaatctctccggtgaccgtgcgctggcggcgcggcgcgcgctggagcgcggcgggctggaaagcacgcgcgtgctgcaggtgaatgccatgtcatcccgtatgccgctggacaaagccgatccgctcagcgcacgtaaccgccgcattgaaatcatggtgctcaccgaggcggccgccgagacgctgtttcagttttatggtcgtgaaggggagaacgtagtgaaacccatcgctgaccgcctgcgataa

SEQ ID NO: 52126 - DNA, 288 bp, Glycine max
  Peptide Sequence Number=SeqID_168904
atgaaagcacgcgaccagatagcatcaaccttctacgatgagatgttgcagagcgatggtcagcaccgcgctcactatcagcattactgggaatggttacaacaggcggacaaagaggcggtggcgcgtaaacgtgaagaggcagaactgctgtttcatcgcgttggcatcaccttcaacgtctacggtgacgatggcggtgccgagcggctgatcccgttcgacagcgtgccgcgcatcattcctgccagcgagtgggcgatgctggaacgcggcattcgccagcgc

SEQ ID NO: 52127 - DNA, 801 bp, Glycine max
  Peptide Sequence Number=SeqID_168905
atgccgcccggtaattttcctgccagcaaagaacctccgatgaattacgcttcgctattagaccccattcaccagtttttacaatgccgcacgccgcaggcgtggattgatgaagcgcgcaagccggaaaatctcacgctgctgcttaccgatcacatggtatgcgagttgaaagcggcgcagaccgcggtgtggctgattcgcaaatacgtcgcggataaacccagcggcgacgcgattctggcgtggctgcagccgtacgaagattttattttcggcgagaatcacgacagcgattttatcaatgcccacaagaatctcagcaaaagcattattgtgcgtaatgaactgccgtgggctgatgagatggtggaaaagatggtgctgctgattaaagaggagctgcaccacttttatcaggtgtgggaaatcatgcaggcgcgcggtttgccttatcgcaagattaccgccagccgctacgccaaagggctgctgcgtgaagtgaccacccatgaaccggatacgctggtggataaactgatctgcggggcgtatatcgaagcgcgttcctgcgagcgcttcgccagcctggcgccgtatctggatgcgcagctggagaagttttatatctcgctgctgcgctcagaggcgcgccactatcaggattacctgacgctggcggcacagatttcaccgaaggatatcgcgccgcgcgtgcgggcgatcggggtagcagaagcgcgcttgatcagcgaaccggacactgagctgcgctttcacagcggcgtgccggcgttttga

SEQ ID NO: 52128 - DNA, 483 bp, Glycine max
  Peptide Sequence Number=SeqID_168906
atggacgcgattaaacaaattctgatcgatgaaatcgacacgctcaaccgcgaagagcggcgcgataatctgccgcgttttagctttaacttcctgaaaacccatccggggctgtggggcgtgatgtacctgtgctacggcctgtgcgtggcgctgattttctcgactgagatgctcggctggccggccttctggttcgccacggtgttcgtgctggtgatgagttttctgatgctgctggacatcaacccgaaataccgcttcgaggacatcgatacgctggatctgcgcgtgtgctacaacggcgagtggtattacgtgcagccggtctcacagcaggcgctggacaagattctggagaatccgggcacgcccgagcgcgtacgcagcggcatcgatcgcctgatgcagcagaaaggagaagtggatttttatgatgtctactacctgacctggggccatcagcgcgccgcgaaaatctga

SEQ ID NO: 52129 - DNA, 1848 bp, Glycine max
  Peptide Sequence Number=SeqID_168907
atggcatatggcccggcgcgctcatcagctccggcatcgctacgcaggcggaactgcgggcagatcgatttccggcaccacgcgcacgccgcgctgggtggcatagtgcaccagctcgcgcatttgctgctggctgtagaacaggccatcactggcctgctgctgcagctgcggatagtgactggaagcaaagcgccagccctgatcgtcggtcaggtgccagtggaacacgttcatgcgcgccgcggcgataccatcaatctgccgcttgagggtttccagcggcaggaagtggcgcaccgggtcgatcagcacgccgcgccacgggaagcgcggccgatcgtcaatggtgacaaagggaatttgcgtgccgctggcggtgttggcgatcagctgcagcagggtttccatgccgcgcatcgcgccaaaacgggtaggtgcctgcagcagtacgccactgctgctgacctccagacgcggatcgaccgcgtcggcaatccggacctgaatggcgggacgatcgctggccgggctggcgggcagcagcgcccagccggtttgccgcgcaatgcgggcgcgccagcgcgcttcggccccttccaggtgatcgccggtgatgtgcagcgaaaattgcggcgtcagggtaaacgcgccaccgcctgcgggctgcgtcacctgctgtggccacggcatcagcggcagatcgcctgccggtgcggcctgcgtggaaaacgtcagggaacacaaaacggccagcagcgtacggggcagaagcatggtgggcatccttcggctgttgaccactgcacggctttcaggcgctggccgcgcttctttgcgacagcggagaaagggaagatggcaacggtagtgattaagcgtgacggctgcagggtgccgtttgatgcccggcgcattgaagctgcagtgcgggccgccgcgcaggctgcccaggttgacgacctggcctggtgcacgacggtcgctcagcaggtcagcgtgcagctggcaacgcaggctgaagtcgatattcgcgacatccagtgtgccgtggaagaggcgctgatgagcggacgctggccgcagctggcacgcgcctatattgaataccgtcacgaccgcgatctggcgcgcgagcagcgcggcgagctgcaccatgccattcgcggcctggtggaacagaccaacgcggcgctgctcaacgagaacgccaacaaagacagcaaagtgatcccgacgcagcgcgacctgctggccggcatcgtggccaaacattatgcccagcagcagttgctgccgcgcgatgtggtgctggcgcacgagcgtggggaaatccattatcacgacctcgactactctcccttcttcccgatgtttaactgcatgctgatcgatctgcacggcatgctgacgcacggcttcaaaatgggtaacgccgagattgaaccgccaaaatccatcgccaccgccaccgcggtgacggcacagatcattgcgcaggtcgccagccatatttacggcggcaccaccattaaccgcattgacgaagtgctggcgccatttgtcaccctcagtctcgacaagcatcgccagattgcccgcgaatggcagattgctgacgtggaagcttacgcgcgcgcgcgcacggaaaaagagtgctacgacgcgtttcagtcgctggagtacgaggttaatacgctgcacaccgccaacggccagacgccgttcgtcacttttggctttggcctcggtaccgactgggcggcgcgcctgattcagcaatcgattctgcgcaaccgcattgccgggctgggcaaaaaccataaaaccgcggtgtttcctaagctg

SEQ ID NO: 52130 - DNA, 395 bp, Glycine max
  Peptide Sequence Number=SeqID_168908
atgactcaatctcttgctttctcaaaagggtggacccttggagggttgcacgccctcaccttcagagggctccacgccctcgccttcagaggactacacgtccttgcctttagaggactgcacgtcctccacttaagaagaccacacgtcctcgccatcagaggactaaacatcctcgctttccgaggactacacattctcgccttcagagggctacacgccttcgccttcagggagctgcacgccctcaccttcaaagggctacacgccctcaacttcagaggactacacgtcttcgccttgaggactacatgtcctcaccttcagacgactatatgtcctcacactaagagggctacacgccctcgccttctgaggactacacgccctcgcct

SEQ ID NO: 52131 - DNA, 174 bp, Glycine max
  Peptide Sequence Number=SeqID_168909
atggggaggaataaggtgggtgcatttgatccgaggcccagcattgacttcgcaactgccccgatctgtaataactgctggatcgagagatccaaatcggtcttatttcggggttttggagaagcaacaaagataggggaaggggtggcagcatcgattgtgtggagctggtag

SEQ ID NO: 52132 - DNA, 583 bp, Glycine max
  Peptide Sequence Number=SeqID_168910
gtatgccacccactaggcaccctctggacccagataagtctaacagggccctggggtttccgacgttgatcacgggcctctgccagccattcggggttgccgtcacccccaacgcaccgccaccacctcggcaggccgatcccactagatcactaggcatggagtgttatgtacaacacttggttcgccaacaggcggccaaccactgtgggcaggggcagggttccgctccttttgcatgccctactccggagcagtttggggttgaggtcgcatggctcggagactggcccgaggcccaggcaggggaggagcctgcacgatctcccggtgaggcagaggaggcccgtatggatgaagatatgagtagcttgctcggcttcttgggaggaagcggagccacgtgcttggcaccctttgttgcacaatacgtgaagttccgtgacatgccggagatcaaaaggaagcattgttacacaatctgggtgcaaatagcaaccagacccacttgggccttccaggatgttcctccagaaggtggttgcttctggaggaagcaacttggctcgcctgggcgagctgg

SEQ ID NO: 52133 - DNA, 389 bp, Glycine max
  Peptide Sequence Number=SeqID_168911
gtcgaagaaatctaggaaaggaaagagtcccagaaagggtgggaatcgattttggaagtgcattgtggttcgccttaagactcctagggcgttcttcttctttcaccttctgcctaagttcgtctttgtcgcaaactgggctgcgcttccgtgactgcaaccacattgtggagttcgtctttgtggagttcgtgtctgccacttatcgattaagctcgaagaaaactaggaaaggaaagagtcccggaaagggtgggaagcgattttggaagtccattgtggttggctttaagactcccagggaagccatcgaaggtgatttgttcgtcttctttagtcgttgtcaaggttcgttgttgcttgtgttctgtgtgctgctaagtgattag

SEQ ID NO: 52134 - DNA, 287 bp, Glycine max
  Peptide Sequence Number=SeqID_168912
tgacttcttttggataccgtaaggatcggaatggtcaatggctaaagaaagatgcacttcctcctcaagatgagcgtactccttctcctcctcctcagcgagatgattcagccctcatgactgaagtttttttcgagttacggggtcttcgtacttatgttggcgaatgttttgattctttagatactcgctttgccggcaaggatatccgtctcacacagcttgaagaagatgtgggttatattcgtcagagcttcgaccttccaccaccacctccaccttcttag

SEQ ID NO: 52135 - DNA, 490 bp, Glycine max
  Peptide Sequence Number=SeqID_168913
atgattggtgtgctagttatacgtgttcctctatgctcacacccgattgatattttaggagctcagactgtgtttcttgaagaagacgaccttgcattgcgtactacagcagcttcagcagatctttttcatgaaggcttaacctgtgttgtgcttagaaggttggacacatttaatgatcttgaagttactctgagaaactctggtgtcaatgatctggaggagcctgagactccattgcaagctacgtctccacctggaactcctaatggtctagtgagcaactttgagatgaaatcatttgatggttctaccaatccatacttgggcttaactgccatacttgctgctggcattgatggactttgtaggaagctttctcttcctgaacctgttgagaaactagacctgcacaatgctcgctaccttgtaaagaaacaacttgctcgtggtttaaggctcaattatgttgaaattctggcattaagag

SEQ ID NO: 52136 - DNA, 483 bp, Glycine max
  Peptide Sequence Number=SeqID_168914
atgccagcagcaagtatggcagttaagcccaagtatggattggtagaaccatcaaatgatttcatctcaaagttgctcactagaccattaggagttccaggtggagacgtagcttgcaatggagtctccttatttttgtttcccaagaaaagctatgcatcactccatgtgttagaaacaaaaaatgttacatacaaatgcacaattgatgttggaggagccaccattgatggcaatacaatcatcacctgtttaattataaagacagtaaatgtcaaatccatcagtgttaggactatcaccaggagcactaatattaatatgagaaaatgtggcaccctcacgaccatttacgtgtatgtgagattttggactattaatcatgatcaggttggtaacactaagagaattgaaggaattgataataagaacctgcatcatccacatgaaaatctcagtcatgtgatattgagaataaattag

SEQ ID NO: 52137 - DNA, 375 bp, Glycine max
  Peptide Sequence Number=SeqID_168915
atggctacgaggggatataaggccaggtttgtgctcataattgtgctacctcttcttctgtctttgatgtgccaagagattgtagcaacgggaagattaagaagcaaaaaggagggttgtgtatctactggcattgcttgccatgtcaaggtcactggatcacatgatcctctagaaatggatgaatatgatcaagcttttgtttctccacctcatgatgattatgacttctatagaaaacatggtgatattccaagcccagattggcttaagattgtgattatggttttggggaccaaaacttgcctgttggtcaaataccgtgccgaagaggatgtcagagatgttttatatggattactgtgggtattttag

SEQ ID NO: 52138 - DNA, 777 bp, Glycine max
  Peptide Sequence Number=SeqID_168916
atggtggctgaaattattgatctttcagactcccctccatcatcacccagttcatctcataatactgcagcaagaattctcaattttgattctgtttctaatggaaaaattcaatttgagaaagttattcctatatccttaatggcttgcacaaataccaaccagccacaaagtactctatgggcagcttcaggacataccaatgagcactctcagattgctactacattccaacccagtatgcaacaaagggttgctacagtacttgaaccagtacctgaatcaatcacatgcatgtttcctcatggagctagactcaaggagccctggactcacagagaacatgagctattttttgtggggctaatcaagtatggaagaggtcactggagcaaaattgctagacagtttttgttgaataagacaccacatcaagttcagagctatggtgctagcttcttcaggcacctaccatctacacacctacatggttttaggagaaggaagccaacctactcaacatctagcctcatgcccaaaaacaacaatcttatggctgcatctgtctccatgcctatgattgttaatgagctacaacaacaaactcacatgcttttcccggagaatgctcctttccttctggccccatcacatggagaagcaagtagcagcaacaacaccaccatgtatgggttccagatgcaaacaggtggtgcaagaacatccatgaatgctagtgctaatggagaagttgatttggaactgcgtttgggttga

SEQ ID NO: 52139 - DNA, 2285 bp, Glycine max
  Peptide Sequence Number=SeqID_168917
gaggtacttttgctctatattccttgatctgtaggcatgctaaagttagtctccttccaaatcgacaacatgcggatgaagcgctctctacatataagatggaggaggctccggagaaagatacttctaaagtgaagatggtgcttgagaaatataagggcttgcatacagctctcctaattgtggttctacttggcacttgtatggtaataggggatggactacttaccccagctatttctgttttctcggcagtatctggtcttgaggtatctatgtccaagaaacaccaccagtatgctgtgattcccatcacttgcttcatactggtgtgtttgtttgcactgcaacactatggtacacatagggtgggattcctttttgctccaattgtgttggcatggctgttgtgcatcagcacacttggtttatataatatattcaaatggaatccacatgtatataaagctctttcaccatattatatgttcaagttcttgaagaagacaaggataagtggatggatgtctttgggtggaatattactgtgcataacaggctcagaagctatgtttgctgatcttggccatttctcatatatggccattcagattgcattcacctttctggtgtatcctgcgcttatattggcatatatgggtcaagctgcttatttgtcacatcatcatgattccgaactccaaataagtttctatgtctcagttccagaaagtgtgaggtggccggtgcttatcttagctattctagcttctgttgtgggaagccaagcaatcatcagtggaacattttctatcataaaccagagccaatctctgggttgcttcccaagagttaaggttgttcatacatctgacaagatacatggtcaggtctacatccctgaaattaattggttactcatgatcctctgcattgctgtgaccattggatttagggacacaaaacacatgggaaatgcttcagggttagcagtgatgaccgtgatgctggtgacaacatgccttacttccttagtaatcgtagtttgttggcataaaccccctattatagccctttgcttcctgttgttctttggctttattgagctgctgtatttctcagcttcactgacaaaattttgtgagggtgcctggttacctattctgctggccctattcctcatgattataatgtacctttggcactatgcaaccatcagaaaatatgaatatgaccttcacaacaaggtatcactagattggcttcttgccttgggtccaagcttgggaattgctagagtccctggaataggcctagtgttcactgacctcaccactggcatccctgcaaacttctcccgctttgtcaccaaccttcctgcatatcaccgcatccttgtttttgtttgtgtgaaatcagtgcctgtccctcacgtccctgctgctgagaggtatctagtaggccgtgtaggaccacctgctcatcggtcctaccggtgcatagtcagatatggatatcgcgatgtgcatcaagatattgattcctttgagtctgaacttgtagcaaggcttgctgatttcatccaatatgattggtaccgatctaggaggagtagcatgagcattgacgatgatgcctcaaactccaatgaatcatcaagttacagattaaccgtaattggaacaactggtttcactatccaaccaggatatgaaagtggtggggagagtatgcagcaagcaagtgtatctgttggtttcccctctgtacaaagtgtgactgatgttattgagatggaaccggttgtgactgagaggagagtgaggtttgcaattgatgatgagcctgagagtgatgcaaggtctgaggcaggagtgcaaatgcaggaagagttagaagatctttatgctgcacaagaagctgggattgccttcattcttggacattctcatgtaagagcaaagcaaggctcatctgtactaaagaaattggcacttaactatggctacaatttcttgagaaggaattgtagaggccctgatgtggcacttaaggttcccccagtttctcttttggagagacataggcttcaatgccatagcagtgtgcagtttccaaaggattttgtgaatgagactgtgggagtgactctacccttaaaatttaacggtaatttatataaaattaggatgcttgagtgcatgacagaaggcttatatagatgtatgttaccattccctgtccttgatgctactcgtaagatgttttccaaattgtcagattag

SEQ ID NO: 52140 - DNA, 246 bp, Glycine max
  Peptide Sequence Number=SeqID_168918
atggttacttcagaaatgtttaagaagccagctatttctgtatactttcaatatggcatagaaggacctgtatatttgacaaaagcagaaaagggaagtggagaatggtatgtagatgagcaacagcagaagattaaaaagatggatggtagcctttcatacaacgttttgcagacagtccaaattcacatggaggttgtggagcctcagcctaaccggccaaaacttcagcttaccctcatctag

SEQ ID NO: 52141 - DNA, 1446 bp, Glycine max
  Peptide Sequence Number=SeqID_168919
atgctccacaacaagtccttcgtcaagaaaaccaaaggtggcaaagtcataaagcaagtgcgggagcactacctgcgcgacgatatatactgtggcgcaccgttttgcaccgtttgcgattcttccagtgctcgcctcagtgcttcgccttccatcattctcgtcgtcgacaccaatgtcgttctcaaccagattgatttgctggagaatccggcaattgacgatgttgtggtgttgtccattgtgttggaagaggttaagaacaagaacatgtctgtttacaaccgtataagagctatctgtagcaattccatgaggaagttctttgttttttccaatgaataccacagtattacaaaggagaggaagggaaaattaaggatgcaggatacatatattaaggaaatgagtggggaaactaaaaatgataggaatgatagagctattcgagtggctactcagtggtatcagaatcatcttggtggtgcagtaaaggtgttgcttttaactaatgacaaagagaacaaaaggaaggctagtgaagagggtattttggccgaaacagttgagtcatatgtgaagtctttggaccaacctgatttacttgatctgcttgtgcggcctgcatctgaagatgtggacatggaagaggttgaagatcttagaccatccaagaggaaagtcatctactccgagcataagccgatgtcagaaattacttctggtttgcatcgtggaatatatcatcaagggaaacttcgtgttaaccgttataatccatttgaagcatatgttgggagtgagagcattggtgatgaaataattatttatgggcgctcaaacatgaatcgagcatttgatggggatattgtggcagctgaacttctgcctcaggaccagtggcaaggagtctcatctctatctatagcccatgaagaatttgtgttcaaatttctcagacttgggagacatttgccatcttttctaaaaagccatgaagaaagtaacacatttcttgagtatggtctattgtttaaccgtgtgaacttggtgtttggtggaaatggtgaagaaccggttcagcaacaaagatctggttcagatctagatgtcatacggtggagtgtggtggtgatgggatacgcagcgacggtggagtacttgcatgcacttcgacgtccaattaggcggttatggtcacatggtccgtatgacctgtccagggtcacacgttctacgcttgcccccttgttggtgttatgtgcctctcaagttatcggtccagaagacgaggatgaggatgaagatgttcatctagctccaaatagtgctgatgatgcacctagaactatttctcagcagggttcttctgaacaagtaaatgctgtgcccagtcgtccttctggtcgtattgttggcattataaagagaaactggcattcgtaa

SEQ ID NO: 52142 - DNA, 564 bp, Glycine max
  Peptide Sequence Number=SeqID_168920
atggtgggcccacagtacgattttctggcgaaccctttgggcgccgtcagatccaccttcgacgccgccgtagcctccgttcccgatccctccgccttcgacggccgcgactggggcgtcttacccctcttccaacacttcctctcagatccgtccagactctctcaggttcctcttctgacccctgccaccatccaatgggtgaagcccaatactctcgttcggtttcgcgggatgatacaagacatgctcgggaatgaattttacgttggcgcttataaggatggttcggtgtggaggaccaacaagtttatggatgcttctcaatctcttacggcttcttcggcggatatgcgaatctgggaacgtcgactgctttattgtgttccggttccgggattgagtccatggactcaagtttcaactgaagaatttggccatctatctatggatcggacatcagagaatagagaaaaacggaggagagaagatgatgagtcttctgatatgcctgtaatttctggccttgtgttactgcttctattgatttattgcttcctctaa

SEQ ID NO: 52143 - DNA, 597 bp, Glycine max
  Peptide Sequence Number=SeqID_168921
atggctcttcaccaccgcttgttgcttgtcgacacaaattcaagctcacctgcaccaagcagcatgaataagacaagagagactttcacaggcgatgcaaattttgacaccaacatggtgattatcttggccgcgttgctttgtgcacttatatgtgctttggggctcaactcaattgtgagatgtgctctaagatgcagccgcagatttgcttttgagaccccagaggagacagcggcacgtttggtggcgaaaggcctaaaaaagagtgcattgcatcagatccctatagttgtttatggttcaggtagtgctagtattgcagccacagactgtccaatttgccttggagagtttgtggatggggagaaagttagagtgttgccaaaatgtaaccatagattccatgtaaggtgcatagatacatggctcctctcacactcctcttgtcctaactgcagacaatctttgcttgagcatacaactatttctggagctgtagctgtagctgcaggaaccagtcatcatgcggggaatgccttgggaggacgacatgaacatgagtctttatctgtggctgtggaagtggttggctaa

SEQ ID NO: 52144 - DNA, 571 bp, Glycine max
  Peptide Sequence Number=SeqID_168922
atgaataattggcatatgaaacgacttgatgttaacaatgcttttctccatggtgatttgaatgaagaaatgtatatgtttttacctcctggcacaactgctgcaaaaccaggacaagacttaggagatttgagattttttgtaggctttgaagtagccagaagcactagagctgttgaaactccacaattaaaggccttcagtgactcagattgggcaggatgcttggatactaggcattccattactgctaagtataaagcaatgattagtgtcacttgtgagcttcaagggttcacctacttacttgaagattttggtattcagttcaatagacctgttttattgtactatgataatcgttcagcgttgtctggatttggtaccaaggacattgggagcaaatggttcctcttcaatgacaacgacgacaatcctttaggctacgacagtggaggcgcaacgagaatcgaagctcttgaactgggagcagagaacgtggagcaacacggcgaggagcgagcaaaggaggcagtaggagccgacggtgaagcggaagttgtagtggcgg

SEQ ID NO: 52145 - DNA, 1110 bp, Glycine max
  Peptide Sequence Number=SeqID_168923
atgtcctccgaagacatcactctcgtacccgaccagaggatcgagaacggtctcaattcccctctcgtcttccaagacgaccctctccgcttcaattgccccaccccgcaccagcgtcgggtcggggacccgcctccgaagacccgcgaacttggcgccttcatcgacgacaacaagatgttcatcgaccgcgaccgcttcttcgccgccgcccagaaccccgaattccgccgctacgccgactgctccgcccgccgcgacccgccccacgcccgcaattggagcgccacagacgatgacgaagagtctgacgacgacgacgaagatgacgacgacgatgaagcggatgacaccgaagtaggaggactcgttggtgatggaaccaaaagcgaacttaacaacaacaacaacaacaacggtggcgctaatttacctgctgttgcaaacgggaaagcccactcttacgtttctggaagagagctattggtgaaggatggtggtgatattgggcaattggtgcatagcaatgtgagtggtggtgatgaagatcatcggcaagaggggttaggtaagtctcagaattcagttaccgttgctgaaactgactgtgaggagtactattcgcactatcttcacggcggcgaaggggcttctgggcagaaagtgatggtggatgatagtggttgtgggtttagtgggaggaaggatgctatgtattcgagcgagtcaggggagtcactcagggcaattctttcagatcctgtcacgggtgctcttatggatgatgctatgatattaccatgtggacattcatttggtggaggtggaatagagcatgctattagaatgggtggttttggagattcagttgttatggaaccatcaaggagtagaggtgttcagtttccatttgctgtgatggaccgggttatcataaaggacaccacaacgctttgttgggcgcgaagctattgttacaacgcaatgcctgaatggatgacattggacaatgcagagagtgtaaagttgcagtatcgatcccttgccaaggttatggatgatccttcaaaacctgcagcctccagcaagatgccacctaattggctttag

SEQ ID NO: 52146 - DNA, 1272 bp, Glycine max
  Peptide Sequence Number=SeqID_168924
atgaaaatcagcaagaataagggtctcaagcctgaacaagaaaaggcttctaattcaaacaatggggtgttgatggatttcatgaagctttcaaaggatgacaaggctcaagaacaaccatcaagtaaggtggtggttgattcatctctttgtgactctaaaggtgcagatgatgagaagaatacaaaggaagcaaagactttctcatgcaactattgcaagagagagttttctacctcgcaagctttggggggacaccaaaacgctcataaacaagaacgtgctcttgcaaaatgtgcccaaggctttgatgttggtggctttggacactttccttactacccttatcctagtttttacaactctcattctccttatggaggatctttcaatagggcactcggggtccaaactgattccatgattcacaagcatccttggaccccaaggtatggtcattcttggttgaaacaagatcgtgtgacgataccgaattcgtcaatatttgatgggtttgaaattgtgaaaggttattatccaattatgaagagtgatggaactcttactttaaggcaagagaatggtaatggtaatgccaatgttggaacactttctctttttgcaaattatgctaccaattcatcaagccaagtcataaacagtgatggcaatgccaatgttggaacactttctctttttgcaaatgctgccaccactccatcaagccaacttggacacagagcaattcttgcaaccaaaaaaattgatgattattccatgccagaagaaacctccaaaggaaaacttgatcttcatcaagattttcctatcatacaaccacactccacacttattacatatgatgacattcctcaacttgaattacattcagcacttgatacacctttgcctaatgaccttgaccctcattcaccattagccattaacactgagcctattcatactattgctcctagctttcttgctactattgttgttccaagacagtcaaagagacaagttcatagacttgagagattcaaagactttctcacacaattcaccccaacagtaaccattgattcctcagttagtcattatccattatcttcagttcttatttataccaagttatcactttcatatcgccatgctatcatgtttatttcttctcacactaagcctaagacttatgctgaagcttctaagcctgatcaatggatagaaattatgaatgttgagattcaagctttggaatccaatcatacttag

SEQ ID NO: 52147 - DNA, 771 bp, Glycine max
  Peptide Sequence Number=SeqID_168925
atggctaaaggatttgacgctaatcaggaggaaatgagacatggattcattgaaggcaacatagtagtaaaatgggtcggtacaatgaacggtggcactcgtgccacctaccgcatgggtggcctaggaacttcccatgaaatggctactgaagaggttttggttgatgaaatcacttacccttccaagatcactactaccaagcccctatctttgcttggccatggaatcaccgacatggagatccactttatccatgtgaaattctattcaatcgggatttatttggagcctgaagtagttggccacttggagcagttcaaaggaatatctgcaaaggagctggaagagaacgatgagttcttcaatgctctcatttctgctccggtggagaagtttattagacttgtggtgatcaaagagatcaagggtgcacagtatggggttcagattgagactgctgtgagggataggttggcagctgaggacaaatatgaggaggaagaagaagaagctttggaaaaagttattgaatttttccagtccaagtacttcaagaaacattcagtgatcacataccatttcccaacaaattctgccactgctgagattgtggtgtctttggaggggaaagaagactccaagtatgtgatagagaatgccaatgtggtagaggcagttaagaaatggtaccttggtggctcaagtgcggtgtcttcctcaaccattcgatctctggctagcactttctcgcaggagttgtccaagtga

SEQ ID NO: 52148 - DNA, 864 bp, Glycine max
  Peptide Sequence Number=SeqID_168926
atgacgtggcaatcacggttccgacatggcatccacattgcaccctattggccaagctttgctcaaagcgaacgctccttgtgtgcccgccttcgcaatccatgcacttttcgcgtgcgtgctcgtgccactctcgtcatcgtttcttttatttactcttttgccccaattccatctccaccgtccattctgaccctattcactcacaactgttctccaaggcttgcttccttctccgatggcgtcgtctctggccattgcttgcggcggaaacaacaacgccaacttagggatgcagaagcagcggtgcgctcgggttctccagccgccgtgctccgtctcgatgggccggtctacggcgagggccgggaggatcacggcggcgatgccgacggtgaaggagcaagagactactccgatgatcatgatgggggcaatggagctgctcgggaagcgcgagcgaggaggagcgaaaaacgacgccctcgagggacaggagaggctggacaggtggatgagagagtcggtggtggagatcgtgaagaatttgaaggaggcgccgctgctggtgctggtttttcccaaatcggcgacgatggcgacggagaagagggtggtggtggaggactggccggcggtgaaggagcggtgggaatccggcgagacgccggttccggagggattgatattcgtggaggagttggacggggacacggcggaggacggtggcggagagaggacgacgagggcgtggggggtggtggttcaggggaagggcgtcgggtgcgtgaacgacttcagggaaacggttcagtcgcagctcaagaatatttggcttttgcagaaccagtgccagtggaataa

SEQ ID NO: 52149 - DNA, 288 bp, Glycine max
  Peptide Sequence Number=SeqID_168927
atggcttgtttcacccgccgtgcttacaaaacctactgcaccctgcaattgcagctgcaccttgtgcgcctaccacctgcactttgtgcacctagtcctgcatgcctacctcagctgtattgccaggttgattggcggaatcactatttcgcaagtggcattgttgttttgtttctctcgattgttttcacttcctatgagaaaaattgtaaagttggaaatattagtataagcaaaggggaattggagatccacgtgtttatctatgtgactaaaaaggcaggataa

SEQ ID NO: 52150 - DNA, 468 bp, Glycine max
  Peptide Sequence Number=SeqID_168928
atggctgcaagttcttcttcaaattgggtcatggaaagtggtgatgttcctcatgttttggccgttgatgacaaccttattgatcgcaaactcgttgagaaactcctgaggaattcttcttgcaaagttacaactgcagaaaatgggccaagggcattggagttattgggcttgacaagtggtggacagaacaacatgaacggtagatccaaagtaaatatgataatcacagactattgcatgccagggatgacaggctacgagctacttaagaaaattaaggaatcgtctgtaatgaaggaggttccagtagtgatcatgtcatctgagaacataccaacacggattaacaagtgtctggaagaaggagctcagatgttcatcctaaagcccctcaaacaatctgatgtaagaaaactgacatcagcactccagaaccctgcatttgtcatggccgtcttttgctaa

SEQ ID NO: 52151 - DNA, 1035 bp, Glycine max
  Peptide Sequence Number=SeqID_168929
atggctaccattgaaagtagaaggaaatcagtggctttggctctctccaagtacttttcattggatcctgtaagtgcatgctatggtttccaatttgccactcatattttcattgagcacttcaaaaccaatgcagaaaagtttcatggggttggggtcgcattgcatttacctagtgttgttccagccgatagttcagacagtgatattaagagtctttacttgaacatcatagcggtttctggacatagggttaatcactctgatgagtgggtagcatttgcagaagccttccccgtggcccttgatgcatgctttgagaatctcaagagattaaatgatgaactgtctggaaaggctgtgcttctgggcaatggattgaacccctctgaagctgatgttatagtgtattcagtggttcattcttccctgatcaacctttcagatacaagcaaggagaaactgccacatgtcttgagatggatggattacatccaggtaacaaaacctgttggtgctgtggaagctgatttaaaatcaaacaagactgagcaaagtataaagaatgtcaacaagtccgaagcagattcaagcaaggataaaaacaaagctgagggaaaggcaacaggaggaaaatcaactggagacaaagaacctaccaaaggcaaggcaaaacctgctgacaaagtggctgagaaagagaatgaagttagcgtcagtttgcttaatattcaagttggattaattcacaaagcgtggaagcatccatctgcagatagtttgctagttgaggagatagatgttggggaggccaaagtgcggcaggttgttagtggtttggcaaagtactacagtcctgatgagttgatgaatcgtcgtgttgtacttataacaaatgtcaaacctggaaaactacgggatgtgatgtctgaaggactggtcttatgtgcttcgaatgaaggtccaaccattgtggagcccttgctccctccagaaggagcaaaaattggtgaacatatttctttttctgggtaa

SEQ ID NO: 52152 - DNA, 255 bp, Glycine max
  Peptide Sequence Number=SeqID_168930
atgccttgctctaaggcagaatttttagtgtacacaaaatctacttgcttttcagggtcacctcctgtctacattgagatttatggagcaaaacaaggatacggtggcaatattacccactacagaagccatggttcttcaaagctgttaaaccacaaagatcagcaactaaccaagaatatgttcactcttccaatttcttgcatcttgcaagcaatcagcaaacggaataacaatactaatgagccagaataa

SEQ ID NO: 52153 - DNA, 536 bp, Glycine max
  Peptide Sequence Number=SeqID_168931
gtatctttgagaaagaggtggtagttggtgtatgccatcctgacacggatcagcgttcacgtggcctaggcctctgccggtcctacggagttcttgtcacccctagcaaggtaatccgaccaccgatcacccgagccttcatcgagaagtactgcatgcctaagcaggcccagggtgacgcacatcaggccgcgggggcacccctaccaccacggaaggccgatccggctgggccactgggtgtggagcattatctacaacatttggttcgccaacaggcggtcaaccaccgtgggcaggtgcagatacatgagtgtctctaccggttcagcctcagtcagcaggggcagggttctgccccttttatatgccctaccccggagcagtttggggttgtggtcgcatggcctggagactggcccgatgcccaggcagggaaggaggctgcaagatcacccggtggggcggatgagtcccatagggatgaagatatgactggcctgctcagtttcttgggagggagcggagccacatga

SEQ ID NO: 52154 - DNA, 1101 bp, Glycine max
  Peptide Sequence Number=SeqID_168932
atggctgagaaggcacaggaaatatttaataagatggagaagcttggatgttttccttccatagtgaccttcaatgctcttatggatggactgtgcaaggctggtaaacttgaggaggcacaccttttattgtacaagatggagattgggagaagtccttcgttattcttccggctttctcagggttctgatcaggttttagatagtgttgctctccagaaaaaggtggagcaaatgtgtgaggctggacaacttttggatgcatacaagcttctcattcaacttgctggtagtggggttatgcctgacattgtgacgtacaatgttctaatcaatggcttttgcaaggcttctaatatcaatggtgctttaaagcttttcaaggatatgcaaaataaggggctctcacctaaccctgttacttatgggacacttattgatgggcttttcagggttggcagagaagaggatgcctttaagattcataagcatatgttgaagcatgggtgtgaacctagctttgaagtttatagagcacttatgacttggttgtgtagaaagaagagggtctcacaggccttcagtctttatttggaatatttgaagaaccttcgtggcagggaagacaattcaatcaatgctttggaggaatgttttgtcagaggagaagtggaacaggcatttcgaggtttactagaattggacttcaggtttagagattttgctttagctccatatacaattctactaattggattttgtcaggcagaaaaagtaaatgaagcattacttatatttactgttcttgataagttcaatatcaatatcaatcctgcaagttgcgtatatttgatccgaggtctcagtgaaaatgggaggctggatgatgcagtaaacatcttcgtttacactcttgacaaaggtttcaagttgaagtcaagtgtttgtgagcaactcctcaaaattctttcacaagataaaaaggagtgtgctattgatcttgttcctaggatgaagtctgctggatactgtttaaatgctcttcgtacatctccattaaggaaagaggctatgaatcgggagactcaatacactttctaa

SEQ ID NO: 52155 - DNA, 903 bp, Glycine max
  Peptide Sequence Number=SeqID_168933
atgggaaccgttagtaacattggcttcccttcactattcagagttcatctagattcacaagtactatcaaagcatatgaagaataaatcatcgtgcgattttatggttccttctaatcataactactctgttaggctgagtccaatatgttgtaagctatcagaaagtgggattgaggagaaccacacgagcacgagcacgggcgagaggccctctaagatcaaggacaggatggaggagtacaatatagctatgaagaaaatgatgaggaacccttatgagtatcaccatgatctgggactagacatctcgagtatctcgagcatgaaggactggatatctcaagctgaagttttcaggattgaacacctacagaaacctgaagacatagatcacctcaaaaaggaagagggtgtggcatacattttaaacttgcaacaagataacgatgttgagtattggggagtagacttgcagtcaataataagaaggtctcgtgaacttgaaattagccacacaaggagaccggcaaaagactttgatccagattccttgcaaaatgaactacctaaagcagtctcatccttagaatgggcaatttctgagggaaaaggaagagtttatgtgcattgtacggctggacttggaagagctccagcggtggcaattgcttatttgttctggttttgtgacatgaatctaaatgaagcatatgatatgctaacttcaaagagaccttgtggaccaaataaaagagcaatacgtggcgctacttatgatttggctaagaatgatccttggaaggagccatttgagactcttccagaatatgcatttgaggatatagcagattgggaaaggaacttgattcaagatcgtgcccgctcccttcgtggaatttga

SEQ ID NO: 52156 - DNA, 1392 bp, Glycine max
  Peptide Sequence Number=SeqID_168934
atgcatttattaagtgcagctgaggctttgttcactttcaagggttctattggaggtccacaacaattaggatgcagcattgtgaaatatccatgtcaaatgcaatggccttgtcttgactgctataaactaaaagatccaggtggaataacagcaaagatagatgggaataacgacgttccaacacttacacctcttcaagaaactcaagttagaaaaccaggaggaacaagggctgctgccatagttggtattcttgttgctgccttagtcgtcattgtcattttggtgactgtctgtatctgcttgatgcgtgttaaaagatttatgaggcaaacatctgaggctgcttcttctatgccatctcccactgttgagatgggaagagtcaacaacactcagaatgttaatgctttccctccacattatacgctgaacacaagacagttaacaattttggaactagaacaagctacacgaaatttcagtcatagtaatattattagtgaaggtggatttggttttgtatacaagggcttgcttcaagatggatccattgtggctataaaaaggcgtctatttgctctgacacaggatttcgtccttgaggtgaatcagatagctcatattcaccacacccatcttgtgaagctcataggctattacgaagatagctatcaacaattacttgtatatgaatatctccctaacggcaatgtagggagtcacttatatgacagtgaaggtttacctattggaaggttagacttgtggcgaaggatatctattgctttaggcgcgtccaaaggtgtggaacatcttcatagtttggtccctcctttggttcacacaaattttagaactagcaatgttctgttagatgaaaattacacggccaaggttgctgtttatggattctgcaaattgcaaacacaagttgataatgctggctcatcttcacatgtagactgctttctagacccagagttgagctttccacaaaactattcggagaagagtgatgtacacagtttcggggtcttcttactagagttgattagtggttgtgaagcacaccgcaaaagcttgtcaaacccagatgaaaacatagtgtttaaggcaaaaaatagcgttgacttggacaactttgttgacataacgctgggagagcaagaaaagcatggtgctagacgaatgatgaaattggcattgctatgtgtggatgtgactagtagaagaccatcaatggcgcaaattgtgcaagagttggagcagattcaaagagaaattgctccagtgtattctcaattcaacgaggagattggtgccgtgactctagggagtgagctctttcagtataattggtcctggaaggatattattcatttgtaa

SEQ ID NO: 52157 - DNA, 468 bp, Glycine max
  Peptide Sequence Number=SeqID_168935
atggatgaaggtcaattgatgtatgacagtataatgtctaaagaaattgatatgaatgaacaagatggagacgaagctggtgtgaatgaagaacatgttgattgttctgatgtgtttaatatttatcaggtcagacacaaacagtggtatgagaggaaggacttaattggatttgtcttaattggttgtgaaagaagtgatcagtacaagtctaagaagaaatattttgtaagaagagatactgatactaggaaatgtgagtgtccctttaagcttgtgggaaatgagtggttggaagccaataatgattccaaacagcagccattaaagagaagaagaaagcttacctcgacaccgaaaatggcacggcggtggtggagacgtcctcaaaggcggcaatggaagcagcggacggcagcggcacgacacaaatcaaaaaagataaaggaagaagacgagaacatgtga

SEQ ID NO: 52158 - DNA, 645 bp, Glycine max
  Peptide Sequence Number=SeqID_168936
atggctctccctcctctggtagaatggcataggggtaggaaacccggtaaaaccaaggcagataatcagaggatattaacaccatctaagttctctctaataagtgttaaactgaaacacagaaaaaaggttggaagagaagttaaaaatctgaagactctcgctcagtgcaccatacgtgctcagcgcgatgcagtcgcttatgcctcatgttggcttctatctgttgactatcgggtcatccagagcattggtcccaggctcgaaatagccaacagtgggcatattcgcaaacgaccaaaaatgagaattggtcgtataggtacactagtgcagcgactccctaagcgtaccgatggcagtcatcaaggttgcaaggtagaggaggtaggcgacatggacgtgagtcgaggacttgtctgcaaatatggtactgttcaccaagtgcagaagataagttgttgcagcccacaatgtaggagacatgacacatcatctatagtaatggtcatctcttcgacggatagatctctactgaaggatgtcatcggccacgtgttgatgcaatcagcctccgatgcctctctcaagcatcatccttttcatgtgaggggcccccgccctcatgagaaggatcacgtctag

SEQ ID NO: 52159 - DNA, 159 bp, Glycine max
  Peptide Sequence Number=SeqID_168937
atgggcgagggagagaaactccagctgggaactgttggtgcattgagtttgtctgtggtgtcatcggtgtcaattgtgatttgtaataaggcgttgatgagctcactacatttcatttttgtctcccttaacatggagaaccatggattgaatccttaa

SEQ ID NO: 52160 - DNA, 354 bp, Glycine max
  Peptide Sequence Number=SeqID_168938
atggaaaatgacactggtttccctctcatccccaacgtgttctccggcttcaactccctcgtggcctccgcgacatatggctccctctccgtggcacgtgtcttaacggggcagtttaaccccgctaatggcattggcttggccaacaccagcttagccttcatcgggaatcgtctcttcgcgcttgccgaatctgacctcccttacgccgttaacgtaacccctgacggcgacatcgacaggctcggccgtcacgactttgacgaaaaactcacattcagcatgacgacgcaccctaagatagaccttgacacagtggagtgcttcgccttccgttacggccccgtgccatga

SEQ ID NO: 52161 - DNA, 588 bp, Glycine max
  Peptide Sequence Number=SeqID_168939
atgagaaggtggaaatggatatgtgtttcattttcgctcttggttaacaatcattttcctccaactcaactgctcgtggctttagtaaaactagaagttttcctagatactgtttgcgggaatgtgacaggatctgttggattgttgctgccgagtaatgtgaataagatttctattcatgaagaagctacaactttgaccagctggcatctgcttgtcacgttttgttcccttcatgtggcgctcaaaatgagattctttgagcacaaaccttttgagcagaaagctgtaatgggattcgggattttaaatgggatctcaattggacttttaaatttgagcctggggttcaattctgttggcttctatcaaatgactaagctggcaatcattccttgtactgtattgttggagaccatttttcttgggaagagattcagtaagagaattcaatttgccctcagtatcctccttttgggtgtcgggattgctactgtcacagatttgcagctcaatgctctgggctctttcttatcttttcttgcagtgattacaacttgtgttgctcagattgtatccttaaaataa

SEQ ID NO: 52162 - DNA, 594 bp, Glycine max
  Peptide Sequence Number=SeqID_168940
atggccgcgcgagccctgttgaccagaaaaaccctagccaccgttctccgcaacgacgcgaagcccataatcggagctggcatagctgcagctactcattctcgtgggttgcacgtgtacacgctccccgatctggattacgactatggcgctctggagccagccatcagcggcgaaatcatgcagctgcaccaccagaagcaccaccagacttacatcaccaacttcaacaaggccctcgagcagctccaagacgccgtcgccaagaaagattcctccgccgtcgttaagctccagggcgccatcaagttcaacggcggagcattagtacaaaaagttaatgcagaaggtgctgcactacaggggtctggatggggtgggcacagaagctattgggtctgtgttccttttcttccagatctggacccactggttactaagggaccaaatttggttccattgcttggtattgatgtttgggagcatgcgtactacttacagtacaagaatgttagaccagactatctgaagaacatttggaaagttattaattggaaatatgccagtgaagtgtatgagaaagagagctcttag

SEQ ID NO: 52163 - DNA, 285 bp, Glycine max
  Peptide Sequence Number=SeqID_168941
atgtcgctaattcaagcacaagaggaaatgtcacgtcaaaccatctttgctattgtcgtagaagagttatcattcgaacaacaaggacgacaagaaataatgggagactgttttatacttcaagatgcagatcgatgtaatctcttttcgtgggttgatgaatacattgatgttggtgcaactgaaattggtagaatagaaccaataccaaactttggtctaaggttgagattggagattctgcaaagagaagttagggttttaacattttggggaaaaagatga

SEQ ID NO: 52164 - DNA, 624 bp, Glycine max
  Peptide Sequence Number=SeqID_168942
atgtctcccccatcggagaccatcgccactcgggttcctcctatgttgtcgccggtggaggatgccacctacgttcaacccaacctccaagatcaattgttagcgttacagaacatcaatagcgggaacaacacttatgatcacccgcagacacagtttgttaatagcgcaacgaaccaggttgctcccatgtggccaggctcccaaatcaatcactcgctgtcacggaagggcagttcttcgaagtccaatgagtgcaggagatggagtgaagaagaacacaggttgtttctgcatgagcttcagaaatatggaaagggagattggataaacatttcaagaatcatcaaaacaagaaacccaactcaagttgctagtcatgcccaaaagtatttccttcgtcaggcctcaagtaataaaggcaaaagaagaagcattcatgacatggtcctaccagatggtcctgtccctcaccgcatttaccaacagaatggagtttcttttccaaatcttgatggccctatcactcaccacattgatcatcagaatgaggttccttttcaaaatcttacaatgcaggagttatatgaaatccatttggcagtccctcactacattaattag

SEQ ID NO: 52165 - DNA, 369 bp, Glycine max
  Peptide Sequence Number=SeqID_168943
atggaggaatcccattgggaaaataacaacgatcacatttcccagtcaagagggtccgctcttgacggtgaagaacacattggagaatggaggaatccaatcgggaaaataacaaagatcacatttcccagtcaagagggtccgctcttgacggtgaagaacacattggagaatggaggaatcccatcggaaaataacaaatataacatttcccagtcaagagggtccgctcttgacggtgaagaacaccttggagaatggaggaatccaatcgggaaaataacaaagatcacatttcccagtcaggagggtccgttcttgacggtgaagaacacattggagaatggaagaatccaatcgggaaaataa

SEQ ID NO: 52166 - DNA, 789 bp, Glycine max
  Peptide Sequence Number=SeqID_168944
atgaaaatatccacccgacttgcaacgggctttggcctgcttgttgtactttttattatctgtaccggcattgcgctcaacgctctgagtaatgcgagcaaaggtatggacgatgcggttaacgtcaaaatgaaaaagtatcagctggtgctggatatgcgtggcagtatcagggatatgggcattgcggttcgtaacctggcgctcttaacggatattgaggcaatgaagcctgaatgggagcgcgtacaaaaacaagaagcgcagtatatagccagccgcaaggctttggctgaggtgatgcaggaggattcaacaccgcaggggcgggaagtcatgagccgcattactgaagctgaggagcctgcacttgcgtcgctgaagcaggctggccggctcgggcttgaaaatcgtgccgaggaagccactgcctatctgctgaatgtcacgcgcccggtgcagagtaccttgctcaaagcgcttaatgacatgacgctggttcagatgaaaaatacgcagtccgctgttgaaatcaacagtcaggcgacacgccgggcatcgctgatactgatgttgctcgcggccgcatcagcactgctggcagtgggaacatgcgttatgaccattcgcgtactgatgcgccagctgggcggcgagccagtgcaggcgcagacacttgcggcgaccattgcttctggcgacctgacgacgcctgtaacgctgcgaaacaatgacagtaccagcctgatggcttctctggatggcatgcaggcaaacctgcgtggtctg

SEQ ID NO: 52167 - DNA, 858 bp, Glycine max
  Peptide Sequence Number=SeqID_168945
atggccttgaaacacaaggtccagagtttgatagaagttggatggttgacgtttcaagaggacaggcccagtataaaaacaaacccgctcgctaatcatggaggggcagccgttaatgccatcgaggtgtgtaggttgcacaggcccaaacatttgaaggatgtaatgacctctagaaggtttatccacgaagccttacaaaaggcgggcgtgattccatgtggtgggcataagaaggatttttgcttaatgcgttcgggcatgccgcaagacatagaaacatgtttagcggtaggagaactattacaacaaatgatagaccaaggctggcttgaggtcagcaatgaggaggaagaggaacaacatatatgcatgcagttggtagataaggaaagtcctcagaaacctaaacccttggtaatacacttcaccaggaacactgctccccaaaggccccgacacccctcggcggtatcgggcgttagacttgttcctttcccttacaaaaatagtcacgcagtcccgtggaggtacgcccctccgggcgacaggaaggaagaagctaccgacatcgactcactgttggccaaagtaaccaacatcaccggcttaagcagcataacccgcagcggtcgcgtgtttaaaccccccgacctaccaacgcaacccacgaatgctaaaggtgaaagcaaaggtgaccgaaggacaaaacatcaaggcgatccctgcactagacaaggatgttccgacggggggatttgccaagggaaaagagggccgcagcaagaaagaggtattgctcgaggaggccagcgagttcgtctacattatccaacagagcaagttcaaggtcattga

SEQ ID NO: 52168 - DNA, 417 bp, Glycine max
  Peptide Sequence Number=SeqID_168946
atgcctcgtattcatgacgcgatcctgtattacaacggcaaatggaacatgccaccgcagaacaaatttgttggttgcgcgttcacaggaaaaaatcctaagaaatttcaaattccttcaacatgtaccatcgatgaactgaagaatttaatcaagcaagttgcacctaaagggatcccccctcttggaattcacgaatcacaaacggtaagacgattgtttttccgccaaccagctcggtttgagtattcagatacggttataaaatatgaaataaatgagctgatcaccaacgaagaactgctgaaggtgttagtacaatctaactactggaaaaaatatggaccaatagaaattttagctgtctttactaaatatgttgaagacgaggtcagtgggacgtcgctaaacaactga

SEQ ID NO: 52169 - DNA, 434 bp, Glycine max
  Peptide Sequence Number=SeqID_168947
gggtgacaaggtgtcacttagaaaaatccacccccttttcgtgcggcgggcggtgttgcttcccgctcgagtgcccggctcacgtgccgttgtcgtgtcccgttgtcgagttcctccgtcggacgatatcggtgggtggtcgcgaggtggcgcggtggagcacggtgggacagtgcgctggcgaggagaggcaacgctcgaccgtcgtgatgcccgtggcatgggccaggagtggtgcccagtccgggccgtggatcggtcagctggggatgtccggtacggcgcgcggcgtccgtgatcacgtatcgggcagctcacctcctcaagcgcgaacgcgctgcgtcaatcgcacggtgagaggcgaaccgcaggacgaggcaggggtgtgctgtgaacggcccgcggccacgcgagcgaggcgagcgacgggatga

SEQ ID NO: 52170 - DNA, 403 bp, Glycine max
  Peptide Sequence Number=SeqID_168948
gtggatattcgtcgatagtgggaatgaaatggagcatgaaacattccttgcaacttggttggcagagattgatttctctcccaatggcttggtgagcaaggagatgtcaccacacgttatgcaggatggtggaagcagtcaatactgtatcatcatcgtgattttgcaaagaatattactcggtgaaagagcagtctatgcaatgatgctggtgtttccacctgaattttctcctttgaaaactattttatttggaaatccttcccaagacaccgttgaaccacttatggaggctttggtggaagattataaagatgaaaatgagataaatgaatcaaggcagtttattggaggagtattggatcttgaaaagagaataaatagactagatacattgacttag

SEQ ID NO: 52171 - DNA, 224 bp, Glycine max
  Peptide Sequence Number=SeqID_168949
gtcaaaagaggctaaatcttgaggtgctaaagggagcagttgcgctcagctcaccatttgggctcagcgtgcatccaacgttgagtgcagctttagcgcgcttagcgcgacagaagaatctggcagagcatcaatatcaaggccgcgtgctatgcgcgatggttgactttagccaggttcagcgcataacttgcgctaagctcaaatccacttactcacactaa

SEQ ID NO: 52172 - DNA, 654 bp, Glycine max
  Peptide Sequence Number=SeqID_168950
atgggcttcattattcaacaacgacggtctcaacatatcataaacatcaatcggacaaccgagtcaaaagttatggccgtccaaatttgcatgggcattccatatcaactttcgagcgccatgatatattatgggcctcaatcggatatccgagtcaaaacttctgcccgtcgaaatttcttcgagtcttccttgttaaattctgagtttctgaataggtttctggccttatgtggagatccagaggaaagattatggtcgtttgtatttgtgatgggcttcatttttcaacaacgatggcctcaacacatcataaacatctatcggaaaactgaatcaaaagtttccgaccttacgcagagatctagaggaaaggttatggctgtttgtatttgtgattggcttcatttttcaacaacgacggtctcaatatatcataaaaatctatcggactaccgagttaaaagttatgactgttcgaatttgcgtcggtatttggtttccacttttgagctccataatatattatgggcctcaatcggacatttgagtcaaaacttttgcccatcggaactcgcccgagtcttccttgttgatttcttggtgtctccatatgtaacgacccgcctcgtcgctacggtatccacactctaa

SEQ ID NO: 52173 - DNA, 255 bp, Glycine max
  Peptide Sequence Number=SeqID_168951
atggcgggcaaaaccctgtatgaaaagctgatcgaacaacatgtggtacgtcacctggacgatgaggggcacgtgctgctctatatcgaccggtcaatcctcaatgaatacaccagcccgcaggcgtttagcggtctgcgcgaccggtcgcgtcgcgtgcgccatccggccaccattctactcaacgtcgaccatgtgaacccgacgcggccagtgcgcgatgcggcgatgaccgacgcaggcggtcagctgcag

SEQ ID NO: 52174 - DNA, 1647 bp, Glycine max
  Peptide Sequence Number=SeqID_168952
atgactcagaccaaaaaacttgtgtccgcgctttcgctgacggcactgcttgtctcttcagcggttcacgctgagaacgcaccagaaaaaaccgacgtgctgctgattggcggcggtatcatgagcgcctcgctcggtacctggctgcaggagctgcaaccgggctggaaacaactgatggttgagcgtctcgacggcgtcgcgctggaatcctccaacggctggaataacgccggtactggccactctgccaacatggagctgaactacacgccagagcgtgcagacggttccatcgatgtgagcaaagcgctggaaatcaatgaatcgttcatgattacccgccagttcctgaccagccaggtacagcgtggcgtgctgcacgatccgcgttcgttcatcaactccaccccgcacatgagctttgtctggggcgacaaaaatgtcgaatacctgaccaaacgctatgcggcgctgcagaaaacgaccctgttccagggcatgaagttctctaccgatcacaaacagatcgagcagtgggcaccgctggtgatggaaggtcgcgatccgaatcagaaagtggccgccacctggacgccggtgggtaccgatgtgaactacggtgaaattacccgtcagctgatcggcagcctgcagaaagatcagaacttcaagctggaaacttcctctgaagtcaccgatttcaaacgcaacagcgacaactcctggcacgtcaccatcaaagacgtgaagagcggcgcaaaccgtgaagtggatgcgaaatacgtattcatcggcgcgggcggtgcggcgattaagctgctgcaaaaaaccggtattcctgaagccgataactacggcggtttcccggtgggcggttcgttcctgatgaccgaaaacccggaaatcaccagccgtcacctgcagaaagtgtatggtcaggcttccgtaggcgcaccgccaatgtcggtaccgcacattgatgcccgtaacctcgacggtaaaaaagtggtgctgtttgggccgttcgccacgttctcgaccaaatacctgaagaacggttcgctgttcgatctgctgagcgctaccaccaccagcaacttcatgccgatgacgcacgtgggcatcgataactttgacctggtgaaatacctgattggtcaggtgatgctgaacgatgatgaccgctttgccgcgctgaaagagtactacccgaacgcgcgtaaagaggactggaaactgattcaggccggccagcgtgtgcagatcatcaagaaagatgctgagaaaggcggcgtgctgaagctgggtaccgaaatcgtgaccgatcagcagaaaaccgtggcggccctgctgggtgcttcaccgggtgcatctaccgcggcaccgatcaccctgaacgtgatgcagaagctgttcccgcagcagttcgcgtcaccggagtggcagcagaagatccgcgctatcgtgccaagcttcggccagaagctgaacggcaacaccgcgctgacccagcaggtatgggataacaccgcatccgtgctgcagctgaccaaaccgccagtgattaacatggacgatcagcagtcggcacctgcgcacgccaaaccgcgcgaagagtccgcgaagcatgatatggcgctgtaa

SEQ ID NO: 52175 - DNA, 681 bp, Glycine max
  Peptide Sequence Number=SeqID_168953
atgaccgctgccgaaaacctgattaccggcaacccggatctcaccgcgatctatgccaccggcgagccggcgctgctgggtgccattgccgcagtagaaaaccaggggcggcagaaggacattaaggtattcggctgggatctgacggcaaaagccatcagtggcattgacggtggctacgttaccgccgtgctgcagcaggatccgaagaaaatgggtgaagaagcgctgaaagcgctgaatagcctgacggccggcaaaaccgtgagcaaaaccattctggtgcctgccacggtggtgaccaaagccaacgtcgacagctaccgttcgctgtttaacatcgggaaacgcgttcagcgtgccggtgcgactgacggtgatcgccgccgccgcgctggcatgctgcagcgccagcaggtcgggcgcgacgccgcgcagcagggcagacgccagcagcacggcgaggaaggtgtcaccggcgccggtggtatcgacggccgcgacgttgatcgccgggcagtacacgcgctgattgccgcgtatcagcagcgcaccggcagcaccctgggtaatcaccagcgtgttaacgccggcgggttgcagcagatcggcttccggttgattgaccaccgcgatgtcaatcagtggccagagatcggcgaagtccggattgaccggtga

SEQ ID NO: 52176 - DNA, 159 bp, Glycine max
  Peptide Sequence Number=SeqID_168954
atgctccaaccatgtgggatcagcataggcttaaaggagcactcaaaccgggtgacccccaaggcctacacttcgaagagtccatcagggtctctccctcctaattcagacactactcatgaattatacaatacccacgacctcacactcatgttttaa

SEQ ID NO: 52177 - DNA, 1375 bp, Glycine max
  Peptide Sequence Number=SeqID_168955
gggggtgggcttcacgctgaacgtcgcggccagtgccgcgcgcggcaatgccgatggcaaggacaccagctggaccagcagtacggtgacggcgggcaaggtgcttggcctgcagtctggcggcgacacgtcgttgatcggcgccatcggccaggctgatcggatcgtggcgtcggtcggcaacaacctgcgcatcgagaccttgcaggacataagcacctacgcgtccaaacagcaaagcgcgggcatcgcaggcagtctttgctatgggtattgcaccagcagcatatctggcaacgtgtcgcaaggccagatgaagagcaacttcaagtcagcctcggagcaggcgggcctgaaagcaggggatggcggcttcatcgtcgacgtcaagaacaacacgacgctgataggcgggctcatcgccagcagcgacaaggccgtggccgaggggctgaacacgctggcgacgggcacgctggtgaccgagaacctgaagaacagcgccagctacaaggcgagccaagtcgggatcagcggcgggtacggatggggcggctcgggcggaaaggatggtggcaaggatgctggcctgggtacggacgccaagggcaacgtggccggtggctcgaaggcgcagccgggcacgagcgtgccgcagacatcgggcgggctggggatgggcaccccgatggtggcagccgccagcggtcgggacagctcgaccacgtatagcgcgatcagcggcggcaaggtggtgatccgcgacgcggtcgctcagcagaacctgtcggggatgacggtggccgggacgatcgcgtcgctcaatcgtgacacgtcctccgataccttgaatgcgctcaagccgatctttgacaaggagaagatcgaagcggggttcgagattgtgtcggaggcgaaccggcaggtggggcagttcttgacgaatcgagcaaaggagatcgatagcgccaagcgccgttcggaagatgcaagcttgccctacgccgaacgtgttcaagcggcccgggagtatgccgacctggaaagcaagtggggcgctcgaggctcctatagccaatggagcaccatcattgtcggtgcggccagtggcaacgtgatggggggaacgagccagttcgtgcaggcggcggcggtgacctacctgcaaaccctgggtgctgcgcagatcaaggaactgagccgtcaattgggcggcgaaggatctgtcggacatgccgcgttgcacacggtactgggatgcgccggggcggccgcccagggcgcgtcgtgcggggcgggtggcgtgggcgcgctctctggcgtggtgttgggccaactgctcgagagtgccgaggcggacaagaccaaaggttga

SEQ ID NO: 52178 - DNA, 201 bp, Glycine max
  Peptide Sequence Number=SeqID_168956
atgacagatcttgtgagcgcggaagatgacgcttttcatcttacggatagcaaaaaggtttatacggataaccactcgggtatctccgcccgtcagcgtgactcaaaagtcagtatgacggatcttgtgagcgcggaagatgacggcgcaggagacgacgttagtctctgcgtgctatcaggcttttcgtcttacggatag

SEQ ID NO: 52179 - DNA, 572 bp, Glycine max
  Peptide Sequence Number=SeqID_168957
gggctagtagggcgagggcaaggcccgccaagctttcttctactacaacagctcctactccagcacccacttcagcagccccttctgtcccagctcagatagattctcaacactttgaagccatgcttcagaacattcatcaggaacagatcattctattacagagtttacaggtggtggcgcctccaggatctattccttcagtggagcagttcactaagatggtagcctggcccgggacccaaccttctcttcacagggaagatggaggtcccacagcccagccaattattatagaagaagaggcagaggagacacaggtgagacaagtagttgctgccacacctgagcgatcccttgaggctacttcagacccttctacacagggggaggacataccctcacctcaacccgcagtagacccctccactcctcttctagagatgtcagaggacccgactacatcattcctggctatggacacttctcctccagctactctagtattgcatctgacggataaggaggatgttcagacacaagacacccaggaccagtcacaggaattctga

SEQ ID NO: 52180 - DNA, 252 bp, Glycine max
  Peptide Sequence Number=SeqID_168958
atgatgaagaagaacacttaccggctggagaggattcttctctccttcagagtattttggacaggtttgacggacttcaaacctatgttggtgagaggtttgactatttggaacatcaagtggacacacaattcgaggagatggactcaaggattacaaaggtttgtcatcatcaaaaagggggagattgtagaaacaagcttcatgatgatgaacaacaattttgatgatgccaaaagctcaaatgattga

SEQ ID NO: 52181 - DNA, 495 bp, Glycine max
  Peptide Sequence Number=SeqID_168959
atgctctcaggaatggaagcttcgcgcacacttcaaacatcttctcaaagatcccaatgggtgttacacctacttccaagatcaatgtctgaccccctgaaaccaacacaagacttttcagcacattttgtcctcactcacatgttttccggaaacttcccaaaaggtcacacatcttataactactccaagccaagaaggcttaactatgaagtgtcgcaacctacccttcgacaggggtgcaaaaaggccaaaatagatgggccaaatgcgtggacttgtcaccaacgtttattcaaggaaaacgttaggaaaacaaaaaaggcaaggtctgcggattttgaaagtgagggttcgggagttgtttacgcacggggaagcaaaacaaggcacccaggagagctattacttcatcctgaagcaaccttgctcgcccaggcaagctgtttgcttcaccatgaagttatttggtggcccaggcgagccagaggctag

SEQ ID NO: 52182 - DNA, 123 bp, Glycine max
  Peptide Sequence Number=SeqID_168960
atgggggaactgcttcaagctcaggcgaagaaggtgtgggctcaggcagagcagcctcgttgggtctcaccaatggaagttgagcttcaggccaggctgcttgctcaagaaaatgttccatag

SEQ ID NO: 52183 - DNA, 210 bp, Glycine max
  Peptide Sequence Number=SeqID_168961
aatgaacttgaaatgagtattgaggcatatatgatgagaaccctaatggttgaaaactttgttgacatccttgagatgcgtatccagagaaggctgctaattgatattatgcttgtgatggatgatgttggggcatatatccaaaaacatgcactggaggtacattgggttcaacatatgattgatgttggtgatgaccatgataatact

SEQ ID NO: 52184 - DNA, 159 bp, Glycine max
  Peptide Sequence Number=SeqID_168962
atgacttcaattcatgttgacatgatcttcatagcaacgtcatctcaaatcaatatcatcataaatatcagcatcaccacatatcaattaaagtcatcaatagcaacatcaacagaaaatcagcatgcaacagggacaggcatatattcttgtagctag

SEQ ID NO: 52185 - DNA, 285 bp, Glycine max
  Peptide Sequence Number=SeqID_168963
atggaagtgaatgagcctgagatagacacgacaactcagaacacgtctttgatttcctcacaattagatcgtactattcaaacatttgaatctagtgcatctgctcaagacccaactagcattactgcatgcatagcaaagttgaaagatctaccaggacttgagtgtgggagtgaactattttacaaagctactagacttatgaaaaaaagggcaaacatgatcacctttgttgctttagaaaagcctgagctacaacttggatggatcaagtctgacacttaa

SEQ ID NO: 52186 - DNA, 175 bp, Glycine max
  Peptide Sequence Number=SeqID_168964
acttagaatgtcatatttctacatcggttgtcctgaaaaccgatgtaaaaagtcatcattctacatcggtcgtcctgaaaaccgatgtaaaaagtcatcattccacatcggtcattctaataaccgatgtagaatgctagatattctacatcggtcgtcgcctgaaccgatgtag

SEQ ID NO: 52187 - DNA, 1080 bp, Glycine max
  Peptide Sequence Number=SeqID_168965
atgacggatgtctttcagttggttgccatggcccctatttttccgccaaatgattcgatccccggaccaaggggattcaacgatgacctacgccatcgaagtacaggggctgagcaagtccttccatcccggcgcgcgggcgctggacaacgtcgacctgcgcgtggccgacggcgagatggtggcactgctgggcgcctcgggctccggcaagtccactctgctgcgccacctggccggcttcgtggtgggcgacgccgggcagggcagcgtgaccgtcaatggccaactgatccagcgccacggccgcctgtcgcgcaatgtgcgcggcgcccgcgccggcatcggcttcgtgttccagcaattcaacctggtgggccgcctgccggtgatcaccaacgtgctgaccggcctgctgccgcgcgtgccgatgtggcgcagcctgacgcgcgtgttcctgcgggccgaagtgcgccaggggctcgacgcgcttgcccaggttggtatagacgactacgcatttcagcgcgcttcgacgctgtccggcggccagcagcagcgcgccgccatcgcccgcaccctggtgcagaacgcccgcgtgatcctggccgacgagccgatcgcctcgctcgatccggaatcgtcacgtcgcgtgatggacacgctggcgcagatcaatcgcagccgcaaggtggccgtggtggtctcgctgcaccaggtcgatgtcgccctgcgctactgcccgcgggtggtggcgctgcgccatggcaaggtggtctacgacggtccctcggccgagctgacgccggccatgctgcgcgacctgtacggctcggaattgagcgagctgcttcccgaatacacgccgcaggtcctgcccatgccgggcctggcgccgctttcccgacaggcctgcgcggcctgaccttacccgttccctacccggagctttccatgctacgcagaacctttgttgccctgatcgccgctgccgccttgtccacgcaagtccatgcgcaagaggccaagccgttgaacttcggcatcatttcgacggagtcgtcgaccaatctgaagtcg

SEQ ID NO: 52188 - DNA, 237 bp, Glycine max
  Peptide Sequence Number=SeqID_168966
atgcttgccgcccagctcgcccaggcgagctcagctcgcccaggcgagcagggttgcttcctccagaagcaaccgccttctggaggaaccttctggagggcccaaatgggcctgggaaatcctagagaaacttctccttcaagtgaagaggtggtgaacaataaccctcaagaaagaccttcatcacaacacaacagtcttccaaaagaatggagagcacctaaggatctcaattga

SEQ ID NO: 52189 - DNA, 692 bp, Glycine max
  Peptide Sequence Number=SeqID_168967
ggctacacgtcgtcaccttcagagggctgcaggccctcaccttcaaaggactgcacgtcctcacctttagaggactacacgtcgtcaccttcagaggactacacgttcccactttcagaggactacacgtcctaaacttcaaagggtttcacgccctctcctttagagggatacatgctctctccttcagagtactacacgtcctcaccttcagagggctacacgccctcgccttcaaaggactacacatcctcggcataaaagggtcgcgtaccctcaccttcagagggatgcacgcactcggcttcagacgactacacgtcctcgtctttagagggctgcttgccctcgccttcaaaggactacacatcctcgccatcagagggctacacgccctcaccttaagaggactacacgtcgtcgccatcagagggtcgcgtaccctcaccttcagaggacttcacatcctccccatcagagggtcgcgtaccctcacctttagaagcctacacgttctcgcctttagaggactacatgtcctcgccttcagaggactacacgtcctcgccttcaaagggccacatgtcgttgccttcagaggactatatgcctcgccattagaggactacacgacttcacctttagagggctacacgtcctcgccatcagagggctacacgccctcaccttga

SEQ ID NO: 52190 - DNA, 459 bp, Glycine max
  Peptide Sequence Number=SeqID_168968
atggatgccctacaatatattaaggaagtacaatgtgcatttcatgacagcacagaaaagtttgacaagtttatggatgtcatgaaagattacaaatttcatagaattgatgttgggattgtcgtagaaaaaatggaggagattcttaaagaccacggggatttgattttgggattcaacaagtttttgccaaagggatatgaaatcttacttctagatgagggtgaggatgggtttggaaatgcttcaaaatatttgaagaagattcaggatcgatttgaaaacaaagatcatgtttacaagtcatttctaaatatacttcttaagtacaaaaataatggagtcactctttatgatacataccatgaggttgctacactttttgagggtcaccgtgatcttgttcgtgacttcactaagtttttgccctctgtacatctaaggggaaaatctacttaa

SEQ ID NO: 52191 - DNA, 330 bp, Glycine max
  Peptide Sequence Number=SeqID_168969
atggcaggagatgcatcaaagtttattcatatttctcccaaaaatagtgaacatgtgatctatggagacaaaaacaaagtgattacaaccaagaagttatgcccacttcttgcaatgaacccaaaagctgttagtcttttgagtccagtgataacaaccaagaagttgtacctacttcttgcaatgaacccaaaagcggttagtcttttggatccagtgatcaaccaagaagaaaatccacttcttgcaatgaacccaaaagcggttagtcttttgagtccagtgctcaaccaagaagacctcctcttgaaaaacagtcaccaagagtag

SEQ ID NO: 52192 - DNA, 216 bp, Glycine max
  Peptide Sequence Number=SeqID_168970
atgtatgtagcaaggagtattgagaagctaatggacatgacaaagacaactccaaagttgatgaagaagaagaaaaatgtgtcatcagtgaaacaaaggttgtgtgcgagtattgcaaagcctttttatcaattggtgggagaggaggcagcacaagtcatcttaagaggcataatgaaatttgtttgccaaggagttgcaaatggaaaaagataa

SEQ ID NO: 52193 - DNA, 246 bp, Glycine max
  Peptide Sequence Number=SeqID_168971
atggaaattctcatcctgggtcaaggtttatggtggtttgaggtcttggctcaaaaggcttgcagaacggccggacatgatgtatgtcagggtgttggtttggccaatggttcagggataaaggggatgtcccacatttatttccatgactcacatacaacaatgatgatttggaaattttatgcaaaactggtcatgcatgaggccatgtggacactcaagcatcaagtttttatggtcatgtga

SEQ ID NO: 52194 - DNA, 1059 bp, Glycine max
  Peptide Sequence Number=SeqID_168972
atgtcggaggaagagaagttgctgaaggaggcgaagaaactgccatgggaggatcgcctcttccacaagaattggaaggtgcgcaacgaggcgaacatcgatttggcctcgctctgcgactccatcaccgatcccaaggactcccgcatccgcgaattcggtcattttttcagaaagacggtggcggattcgaatgcgccggtgcaggagaaggcgctcgatgcgttgattgcttacttgcgagctgccgacgccgacgcctcgaggtacgggaaggaagtctgtgatgcggttgtggcgaaatgtctgacggggaggccgaagacggtggagaaggctcaggcagtgtttttgctatggattgaattagaggccgttgatgcgtttctggatgcaatggagaaagcaataaaaaacaaagttgctaaagcggtggtacctgcaatagatgttatgtttcaagctttaagtgattttggagcaaaaattgtgcctccaaaaagaattttgaagatgcttccggaactctttgatcatcaagatcaaaatgttcgtgcatcctctaaagggttgactcttgaactttgccgttggattggtaaagatagtgtaaaatcaattttgtttgagaaaatgagagacacgatgaaaaaagagctagaagcagagcttgtaaatgttacaggaacagcaaagcccacacgcaaaataagatctgagcaagataaggaacctgaacaggaagctgtgtcagaggttgtgggtcctggcccttgtgaagaatctgggaatgatgctcctcaagaaatcgacgaatatgaacttgttgatcctgttgatatattgactcctttggagaagtctggattttgggatggagtgaaagctaccaaatggtctgaacggaaggaggctgttgctgagctaacaaagcttgcatcaactaaaagaatttctcctggtgatttctctgaagtttgtcggaccttaaaaaaggtgacattgatgagttatttcttattggcaaaataccctgggtccggtttgttagtttactga

SEQ ID NO: 52195 - DNA, 1533 bp, Glycine max
  Peptide Sequence Number=SeqID_168973
atgaaagtaaacaaacttattacagatgtgaatattgctgttgcagttgaagctgtccaggctattggcaatcttgctcgtggattaagaactcatttttctgcaagttctcgttttttattgcctgttttacttgaaaaattgaaggagaaaaaacctgctttggctgaggcattgatgcagactcttcaagcaatgcataaagctggatgcatcagccttatagatattgttgaaggcaggctacaggttaaaggatttaatcactggatttacagaatcttagaatctacagcatacttttttctaatagtcccacattaccatgggcttgccctttttggtgtttttcctgatgttaagacagccacaaaaaacaaagtccctcttgtgcgatcgttaaccttgacctgggtgactttttgtattgaaacaagtaacaaggttgttattacaaaggtgcacaaggattatgtgccaatctgtatggagtgcctaaatgacggtactcccgaagtcagggatgctgccttttcagcattggcaggaatagctaagtcagttggcatgagacctctggagagatcgttggagaaacttgatgatgttagaagaaagaagctttcggaaatgatttcaggttctgaagatgctgtgcctggtgcttcttctgcagcttctgtgcaaaatacacgcgtaagtgcatcttctgcagagacctctgaaagtgtacttgtcaaaaggtcggcagcaggcatgcttagtggaaagagacctgttcagtcagttcctgctgttaagaaagtgggggttgtaaagttggggacaaacaaaaaaacagatggagttccacaggtgaaggctttaaaatcagttgaaccacctgaggatgttgagcctactgagatgagtcttgaagagattgaaagccgaataggttctcttatagagtcggatactatcactctattaaaaagtgctgtgtggaaggagcgtctagaagccatttcttcactgaaacagcaagtagaaggcttacaggaccttgaccaatcagtagaaattttgattcgtttagtctgcactttacctggatggggcgagaaaaatgttcaggttcagcagcaggttattgaagttatcactcatataagttcaactgcaactaaatttccaaagaagtgtgtagtactttgcctttcgggactaagtgaacgtgtagcagatattaagacacgtgcacatgctatgaaatgtctgagtaccttgtctgaagcagttggtccaggattcatttttgaaagactttacaagatcatgaaggagcataagaatcccaaggttcttagtgagggaattttgtggatggtttctgctgttgaagattttggtgtctcacatataaagcttaagcctctttgcatatgcaagggtaaggctgcgtacaacatccctcccccataccttcgcatagcgaagagcttctgggcaatggggtatgaagttattggaagtttctatggtttaatgtaa

SEQ ID NO: 52196 - DNA, 3335 bp, Glycine max
  Peptide Sequence Number=SeqID_168974
acattaaagggtttcttactgatgtaaagcctgcactgctcagtgccctggatacagagtatgagaagaatccatttgagggagcttctgcagttaccaagagaactgtcagggcaaaagactcatcttcaactgttgttgctggtggactggatagcttgcctcgggaagacatcagtggaaagatctcaccaactctcctgaagagcttggaaagccctgattggaaggttcgtatggagtctgttgatgctgtaaacaaaatattggaagaggctaataagcgcattcaagcaactggaactggtgagttgtttggggctcttaggggacgactccttgatagcaacaaaaacattgtcatggcttccttgacagcaattggcaatgttgcatcagcaatgggtcaagctgtagagaaggcaagcaagggtattctgtctgatatattgaaatgtcttggtgacaacaagaagcacatgagagaatgtgtactgaataccttagatgcttggctggctgctgtccatctggataaaatggttccgtatattgcaattgctttgatggactctaaacttggtgcggaagggcgtaaagatctttttgattggttatcgaggcaactttctgggttaagtagttttgctgaagctgcacaactgctgaagcctgcctcttctgcaatgacagataaatcttccgatgttcgcaaggcatcagaggcttgtattaatgagatactgagagttagtggacatgaaatgatcgaaaagatggttaaagacattcatggaccagcactgacactaattgttgagaagttgaaaccatatggagcttttcaaggcacgttctttggttcattcttctttgcgaatgttggtgaatttgtgtggatatcttctcttaactcctcctttttttggtctttagagtcatttgagtcaggtagagcagtttcagtgggtgcaatatcaaaagcaaaggctgggaaatcaactgccaatggtgtttcaaaacatggaaatagagctgtatcttctagagttgtggcaacaaaaggtgccaagtctgaatcaatatctgttcaagatatagcggtccagtctcaagccttgttaaatatcaaggattcaaacaaggaagatcgagagagaatggtggttcgaaggtttaagtttgaggacccacgtattgagcaaattcaagatcttgagaatgatatgatgaagtatttcagagaagatttacataggagactcttaagtgcagattttaagaagcaagttgatggacttgaaatgctgcagaaggcactcccatccattgctaaggaagttatagaagttttggacattcttctgaggtggtttgtgttgcagttctgcaaatcaaacacaacatgtctattgaagttttcttcttttcctttccttccttgtcatggagatgtgctggaatttcttccggaactgcttgacactttgaaggacgaggggtactctttgaccgaatctgaaggggcagtgtttcttccatgcttagtagagaagttagggcataacattgagaaagtacgagaaaaaatgcgggagctgacaaaacaatttgttgccatatactctgcgtgtaaatgtttcccttatatattagagggtttgcgctcaaagaataaccgaactcgaattgaatgtgctgatcttgttggatttattattgatcatcatggtgcagagattagtgggcagctaaagtcattgcaaattgttgcaagtttgactgcagaacgggatggtgaaactaggaaagctgcattaaatacactagctactggttataagattctaggtgaggacatatggagatatgttgggaagctaactgatgctcaaaagagcatgttagatgatagatttaagtggaaggttcgggagatggaaaagaagaaggaaggaaagcctggtgaagcaagggccatttcaaggcgctcagtcagggaaaatgggtctgatgtcgcagaacaaagtggagaaatgactagatctcttgctggtccaatattgaggaaaaattatggtcaacctgatagtaacattgatagacagttgatgccccgtcccatgactgttgctagtggccccacagattggaatgaagcactcgatattatttcttttggttctcctgagcagtctgttgatggaatgaaagttatttgtcatgagttagctcaggccactagtgatcctgaaggaagtgctatggatgaacttgtgaaagatgcagataggctagtttcatgccttgctaataaggtcgcaagaacttttgacttcagtttgactggtggtgcctcatcacgatcttgtaaatatgtgctgaacactctcatgcagacttttcagaataaaagattagcgcatgctgtaaaggagagcacacttgacagtctcattactgagcttcttctgtggctcttggatgatagggttcctcatatggatgatggaagccaattgttgaaagctttaaatgtattgatgcttaagattctggataatgcagataggacttcatcctttgttgtcttgatcaatcttttacggccactagattcatccaggtggccttcaccagcatcaaatgagtcccttgcttccagaaatcagaagttctctgatctagttgtgaaatgccttatcaagcttacaaaggttcttcagagcactatctatgatgttgaccttgatcgcatacttcaaagcatccatttgtacctgcaagacttgggaatggaggaaattaggagaagggctggtgctgatgacaaacctttacgaatggtaaaaactgttctgcatgaacttgtcaagcttcgtggtgcagcaataaagggtcatctttcaatggttcctatcgatgctaaacctcaacccatcatccttgcctacattgaacttaatcttgagactttggctgctgcaagaatgttgactgcatctggacctgggggacaaaaccattggggtgattcagcaaccaataattcagcctcgggcacccattcggctgatgcccaattaaagcaagagcttgctgctatatttaagaagattggagagaagcaaacttgcacaattggtctatatgaactatatcggattacccaattgtacccaaaggttgacatatttgctcagcttcaaaatgctagtgaggcatttcgcacctacattagagatggtcttgctcaggttgagttaatttacttgtattaccacatgttcttaattgaacttgcattttgtatttctaccggcgattgggagtag

SEQ ID NO: 52197 - DNA, 198 bp, Glycine max
  Peptide Sequence Number=SeqID_168975
atggctaatgaggtggtggatgaagctagaaggaaaaacaaagttgtttggtcttcaagcccttcaagagagtttgggatgcaaaggagattcagacaaggtgactcattggcactatttctttttacaattatggcggaaggtcttagtggtcttatgagggagacggtcgcaaaaaagctttgttctagttgttag

SEQ ID NO: 52198 - DNA, 741 bp, Glycine max
  Peptide Sequence Number=SeqID_168976
atggaggagagatctaaaaaaattgtgtgggggttgagtgatttaagatggtttgataaaggagtagaatggaaggtgggaaaaggggataaaataaaattttggtgtgatgcatgcgggaagaacaaaactttgccaatttatatcccagacttttcctcatttcattgcgaaaatttgacgaaattgacaatatggggaggagggacgtggaggtgggaatttagttggtgtaggaattgttttgcctgggaaaaggacttgctaagagagtttcaacaacttgtgtcaagtatggtcattgatagggaacggttggatgggtcttattcagtaaagacgacatataatctcattattgggaatgacgggaaccaacagacaaacaaaatttttggtgctagatggaagttaaatattcctccaaaagtgatcttttttttttttttggagattgttcttgaacaggctggccactttggacaacttaaaaagaaaaatgtgagcgtagccgcgaataattggttatgcccgaaatgcagtttggaggagacaacagctcacattcttttctcttgcaaattggcggattcagttttggaaagtgtttatgatttggaaaaattgttggaccagattcttttcactagttggtcatggttgaaaaatagttccaaaacatttcagttctcatttgcagagtggtctatgaatacggctgcctgcttatacagatcttaa

SEQ ID NO: 52199 - DNA, 378 bp, Glycine max
  Peptide Sequence Number=SeqID_168977
atggagttctgtgctgaaagttcccattcgaatgggaaacacactttgaagcattctaaatctgcagatgaagtgaagagatccagagaaaaggcccatagaagttctcattccaatggaaagcaaaatgtgaagcaaacttctacttttgttaatcatgctgcaattgcttggcatgaggatagaacaaaatgggttggtgataagtctcaacatccaccaagaacagctaaggatccaattattagtcttatgggcagaattggagtttctccattccttaagacatgggaaatcattgttctcatgcctgttatcttttataccagttttatgctgaatcctattcatcacctgataaaaaatcttggccaatga

SEQ ID NO: 52200 - DNA, 852 bp, Glycine max
  Peptide Sequence Number=SeqID_168978
atgttatctgctattgcctttggattctcagcgaattggtggttgcgctgtcacgggcgaacgcctcctcctttatcttttccggtttcagtgtcttattcttcctctttcaactccaactcaactaagttcaactatattcatagagcatcctctgaaggacttcctaatgagttggttgaagactcaaaatttgttcctttgaatgaggaggatcctatatatggtccacctgccttattgttgttgggctttgaagcagatgaagctttgaaggtcatctattgtactgaagacatgattatgcgttcgctttgggaggcaatgcatacaacacaacccaatgtagaagatgtcaagatagccaagtcacttcctcggatatgcttcttatctggtttaagtggagaggagatgatgatgttcatagattctttccccgaaactggactaaaaccagctgcatttgcggcacttgttccgaacagtgctaataaaccactggaggagttgatagatgaaataatgggagaccatgagatgttggaggaatgggtggaggatccgttgaaagtaaagaatgaagctagtagattcttccacaatagatttagtgaggagtgttgggatagaccacttcttgatggagtacactttaaccaaatcacacaaatcgataatgttggtttggttgacaggttcggggaggaggaggtaaaggagacaatatgggaatgtgaaagtgctaaaagtccgggttcgggtggatttaactttaaattcattaaggctttttggcatgtcttgaaggatgacatcattaggtttatggaagaatttcatagactaggg

SEQ ID NO: 52201 - DNA, 1314 bp, Glycine max
  Peptide Sequence Number=SeqID_168979
atggagcattgtaactgctacatgttcacgctgagccttcttcttcttcttcttcttactccgccttctctctccgacgatctcggattcgattttccggcgaagaagctgataagagaccttaacctttttccttctgaagatgtcaacatcgttcctcgccactccaattctcacgccaacaaaatcgtcgagaaaccgcttaggttcccaaacttagtgccttcagactccggcatttccctcgacgacttggctcaccgcgctggctattatcttattcctcattctcatgctgccaagatgttctactttttctttgaatcaaggaacagcaagaaggatcctgttgtgatttggttgactgggggaccaggttgcagcagtgaattggctgtgttttatgagaatggccctttcaagattgctaacaacatgtccctagtgtggaatgaatatggctgggacaaggtttctaaccttctgtatgttgaccaaccaactggaactggctttagttacagtactgataagcgtgacattcgtcatgatgaagaaggtgtgagcaatgacctctatgactttctacaggccttctttgctgaacatcctgagtatgtaaagaatgacttttttattacgggtgaatcatatgctggacattatattccagcttttgcagctcgtgtccataggggaaacaaagctaaagaaggaattcatataaacctaaagggatttgccattggtaatgggcttactgatcctgggatccagtataaagcttatacagattatgcactggacatgggcataattcagaaggctgactatgaacgcatcaacaaagtgatggttccagcctgcgaaatggcaataaaactatgtggggttggagatattgattttgtgtcttgtagttctacagtttatcaggctatgctggtggattggatgaggaatcttgaagttggtattcctgcccttcttgaggatggaatcaatatgcttgtgtatgctggggaatttgatctcatctgcaactggcttggtaattcaaaatgggttcatgccatggagtggtctggccagcaagaatttgtggtctcatccgaagttcctttcacagttgatgattctgaagctggattattgaagaagtatggacctttaagtttccttaaggtccatgatgcgggtcacatggttccgatggatcagccgaaggcttcgttagaaatgctgaagaggtggactcagggaaccctttcagaatctgcagctgatgcggagaaattggttgcggagttgtaa

SEQ ID NO: 52202 - DNA, 213 bp, Glycine max
  Peptide Sequence Number=SeqID_168980
atgacgccttcgaaggagaagttacctgtatcggcaagtggagagttcgagattctaacccgaatttttggttcccaggttcgaggtctaataagggtggctctggtggaaatttgctggtcaggatcttcgtcgatgaactccgaggagtatgggacgatgacaacgtgtttggaaagccagatcggatcactacactcccgacggagataa

SEQ ID NO: 52203 - DNA, 735 bp, Glycine max
  Peptide Sequence Number=SeqID_168981
atgcacgtggaactacagtcaaaccccgctgctacaccgccatttgtagtatcctaccgcacctacagaagggtagaatggtcattacagattgtaacatacacgaaagaaaacagtgttaaaagcgaggaagaagaagaagatggaggcaaagcgaggccatgccctcatgtgcttggcacgtgtttcactcttccgctgcgctctaaccctatccgctgctcacggaagcaccacggttcaagacatcgcgagaaagttgaaactcggggacacgagcttctgcgcacggagaagaagttcaaggttttcatggagaattacgggaggagctactccacagaggaggagtatttgcgccgtttggggattttcgcccagaacatggtcagagcggcggagcatcaggcgctggaccccaccgccgtccacggcgtcacgcagttctccgatctcaccgaggacgagtttgagaagctctacactggcgtcaatggcggcttcccgtcatcgaataatgccgccggcggtattgcgccgccgttggaggtggacgggctgccggagaattttgattggagagagaaaggagctgtcaccgaagttaagttacagggtagatgtggatcatgctgggctttcagcaccacaggatctatagaaggagccaattttcttgccaccggaaagctcgtcagtcttagtgaacaacagctccttgactgtgacaacaag

SEQ ID NO: 52204 - DNA, 300 bp, Glycine max
  Peptide Sequence Number=SeqID_168982
atggggtcactaatggcctctgcttctatcactcttgcttttgccataatccttttcagcctcccatctgaaatctcagcaaacaactacatctactcctctcctccacctcccaagaagccttaccactacccatctccacctccaccagttccttcaccacctccacctaaggctccttaccactacccatctccgccaccaccaccaaagaagccctacaaatacccatcaccaccacccccagggaagcaaccctaccctgacccccacccccaccgccaccctcaccctcaccct

SEQ ID NO: 52205 - DNA, 874 bp, Glycine max
  Peptide Sequence Number=SeqID_168983
agggcttcacgccctcgcctacaaaggactgcgcgtcctcaccttcaatggactatacgtccacgccatcagagggctgcacgccctcgcctttagaggactgcgcgtcctcaccttcagaggactatacgtcctcaccatcagagggctgcacgccctaaccttcatagtgctacacgccctcacctttagaggactacacgtcctcaccttcagaaggttgcacatcctcaccttcagagggctgcacgcccttgccatcagaggactacacatcctcaccatcaaagggctacacgtcctcaccttcagaggactacacgtcctcaccttcatagggctacatgccctcacctttagaggactagacgtcctcgcctttagaggacaacacgacctcaccatcagagggctacacgccctcgcctttagaggactccacgtcctcaccttcagaggactacacgcccttatcttcagaggactacacgtcctcactttcagagggctacacgccctcgccatcaaaggactacacgtcctcaccatcagagggttacacgcccttgacttcgtagggctacacgtcctcgctctcagaggactacacgtccttgccttcagaggactatacgccctcaccttcatagggctacacgccttcacctttagaggactagacgtcctcgccttcagaggactacacgtcctcaccatcagaaggctgcacgtcctccccttcagagggctgcatgcccttgccatcagaggactacacatcctcaccatcagagggttgcacatcctcaccttgagaggactacacgtcctcaccttcataaggctacatgccctcacctttagaggactagac

SEQ ID NO: 52206 - DNA, 258 bp, Glycine max
  Peptide Sequence Number=SeqID_168984
atgatcggtggggaaaagagggaggtggttgccgcccagctcgcccaggcgagctgggttgcttccaccggaaggcaccgccttctattggaacctcctggaaggcccaaaactttacggattgcgcaacaatgcttcccttcgacttccggcatgtcgcggaactccacgaattgcctaacgatgggtattaagtacctcgaagcgatcaagcgagggtcgcatgctatcagacagatggtccccagacgaaattag

SEQ ID NO: 52207 - DNA, 1545 bp, Glycine max
  Peptide Sequence Number=SeqID_168985
atggtcgcagagatttctgaattgcgtttcctactaaatggtgagggatggcatagctgttcgattgagactggcgctaatcggccaatcctctctaaattcgaagtttttcttcccgctattggctggcttttaatgcggggtgtctacttagagcaaatcatggcagcgtgtcgcgtcatggacgagaaaatcgccgaagccaatagtgatctctatgaagaagcaaaggccaaaaaggtgccacttcggcacgagacatttagccaagcctatgtgttcaatcataagatcgcgctttcgcagcttgtgtccttcgttcatagtggcggccttagttttcgccatagtccagagagcgaatttgataaagcactgaaaaaatcatggaaggaagcgagcacgcatagcgaattctacatccttctcggaatcactaggttcacgaagcaagcactatgggcagcaccatgtgtgctgaatcttcttgagagactgcagagcttgccctaccacctccagctagccacgatggacttttgtgtccacttaaggaaggtggatgatgccgtcaaggcaaagatgatctctgcgttagagaattccatggacaaaatgggcatggttatgaattctatgattttcgaagcactgaagggtttaggcggactagacgccgaagaagaaaattacagaacagtggttttaaaggagatagaaagtgttttatccgagtcaggtacgcagtccaaaacggaagcatggaatattttctctcgacaattcgatcacccgtatgacagcatttattgggaagaaataaacaatctcgctagcgatcagaaacggcagttcctcttcaaggcactcaaaggggcgagtaccgattttgtgatgtttgtcagtatcctgattcgtcagctcgcagaaatcggtgatccagctgtttctgaagctattgaaccatggcttaggttgccagccaaaaggtcggtcatgctacaagatacagtcgaggtatttttcgcagcacacgaagccatggggattttgggccttccacttcctgccaatgcaacatcaactgtcgatgtcgatgaaactatgcaggcctgcggggagttaacttactgggcttgccagttgaacaattgcgaactcgagtcctcgcctcagactctcagtgcgcgaactaaattactgacttactccgcttcagcaagtgccggagcactgtggtcttcaacatcacgaatgatgtcttcggatggcgcaagaatccatatcgcaacgagttatccgaacacagccctggctgtatgccgtaatgcattgatcaatcacgagacacagaagacgtaccacgaacacggggtcatgaatgatctggtgcgcattgtttccttttccattcaagtaattggtcagtttggagacgccgacgacttgcaacgtttacgcagtctttgcgacgaagaggaactaggtcatgaagcactcaacgcaatccataagattgaagaccgtgttcgttatttgaagtag

SEQ ID NO: 52208 - DNA, 1261 bp, Glycine max
  Peptide Sequence Number=SeqID_168986
atgaataaaaaattgaacatgattgcggcactgtcgctggcgctgtcggcccagagcatggcggcggagaaattcaccttcatgaccaactggtatgcgcaagccgagcatggcggtttttatcaggcactggcgcagaatctgtataaagatgccgggctcgacgtcagcctgaaaatgggtggcccacaggttcacaccatgcagctgatggcggcaggccaggcggactgcatcatcagcgacaacatgcaggcactggaatcctggcagcaaggcgtggaagccatgcccgttgccaccacgttccagcactcggcgattgcttttctcacccatcctgatgtgaaagataaagccgatctgcaaggcaaaaccttcctgctggcggcggaagcttacacctcctactggccgtgggcccaaagtgcgctcggcctgaaaaatgcgcgcgtgcgcccttacacgttcagcatccagccattcctggcagataagacgctggtgcagcagggttatatcacctcggaaccttttgcggtgcagaaagcccatgcgcaagccaatgtctacccgatcagcgaatggggctatccgccttacggcaacagtattgtgtgcatgaaatcgaccattgaaaaacgtccgcaagcggtggccgcgttcgtcaaagcctcaatgcagggctggaaaaactatctgcaggatccgcgcgctggcaatgcgctgatccgcaaagagaatccgcagatgagcgaggagcagatcgccttcggcattgcccagatgaagaaataccagatgctgacgggcggtgatgcgcaaacggcgggtatcggtatcattaccgagccacggctcaaacagacatggcaactgctggtggacaacaagctgatcgatccggccaaagtgccgtttgcaggtcatgccatgaacaccgccagcaacataacgccgatcaatccggatagccagccgcggcctgtagcgccgccggcgattgaggtgctttctgcggagaaaatctatcccaacgggacgcgggcgctgctgccggtcgaactgacggtgcgtcagggcgaatttgtctcactgctcggtccctccggctgtggcaaaagaagcgacactgatgccgtggagcagcgtgcacaagaatgtccgcctgccgctggatctggcgggcgttccgcgcgccgaagccgatacccgcgtgcgcgagattctggaactggttggcctgggccagtttggtcac

SEQ ID NO: 52209 - DNA, 975 bp, Glycine max
  Peptide Sequence Number=SeqID_168987
tacattaaaaaagcaaaacttgttgggcttctcgagtctcgggatgacaaaagagtgggaggtaagggttcaagaggattacatgttatcactccaagttcagaagaattgcaacaagctcatttgtatatactgaataatagtaatgaagttctgccatacacagttcatggcaaagctttagttaaggaaagtaacctaaaaatgaccaagaataaggtgttgaaagagcataacaagactttcctaaattggtttaaagatacaatctttggtgacgataatgcttttgtaacattaagaaagctagcagatgggcctaaaagaaatgttataacttggaaaggatatggtataaacaagtattcattctatacgaaagcacaagatgacaagattacaatgcaaaatagtggggttagtctaagggttgtatctcaacactttgcaagtgtacatgatgacaatccacatctagcttccatcccttactttggtaccattgatgaaatctgggagcttaattatgtcaaattcactgtatgtgttctcaagtacccttgtgatgaaaggtggtcagtggttctacacgggaaaacaattggtgttaatgttgaagatgatgattcactcattgatacttacatcagccctttgtccacacaaatctcgcctaatgtcatcgaagaagaagaagttgatgatgtgcatgcaaatcataatgatcatgatgaaggagaattagttaacaccacaagaaaagcgacacggctgagatcattggcaactagaccaatcggggcagagagaccactagtccatgtggatcttgcgactgggaaagccgacggtccccacagaaagaagttaaggacatatttggggatcaccacttgcgatatggtggatgtcacatatgagaatctgaaacaagtccctgcaactcagaaggatttgatatgggacgatatttag

SEQ ID NO: 52210 - DNA, 642 bp, Glycine max
  Peptide Sequence Number=SeqID_168988
atggcccgcacgaagaaaactggtcaaatgacttctgaggcagcaaaggaaattgcaaacaagattgcctcacagggaagctttgtcgcctgtggacgtcaggatgtattgattgctgccattgggggaccggaacaccctagtcttgtccgtgctgctggagctggtgtcacgatcaaacaatactttggaccggttccaagaagttcccgcacgtctttgtccataggtcccaaagacttagagcagctaacacaaaaaattaaggaccaactggaggagtcgatcacagaaaaacctgaggttggtccttctgctgctcatatcagcagaaaggagagttgtgttgatccctctgggcacgacctagacacaggggggttgacaaccattcacaacatccctttgggcaatcatcaagtaaaggttggtgttgaggaagttcaggatgctaatgctcacattcttgtacccactcaagaggttcaattagtggggcaggaaaaacaaggagctcagggaccggtgaaacttgtagataggccagatcctaatgttgatcccatatatctaatgacattgactatcccacagctttttttgaagatgttacaggttatgtgggatgctattgtgtttggg

SEQ ID NO: 52211 - DNA, 165 bp, Glycine max
  Peptide Sequence Number=SeqID_168989
atggcgccaaaaacttgttcgctttcggcaagtgcaccggatcgcacaaataagtgtgaatatgaacaagtgtgtaaactatctatgcaaaaaggaaaatcacgcgagagagatgatgtgcaaaaacaagtagaaaacacattggccttcctaataggtgcctga

SEQ ID NO: 52212 - DNA, 477 bp, Glycine max
  Peptide Sequence Number=SeqID_168990
atgccctatggtgagcaccggcgagtcagggcctttgacttgatatcatcgtacaccggccagctcagatggggtcagattgtggtgtacgttcgacctgagcgggttcttcaacagtttggctaccttcaaatggtccctccaccatcggtttgtgattctttgacgggtgatgatatagatgactggtggctaaattttccagaccatttggtgccttcaggggagctctgtgtagttcctggacaggtggcgacagactacatggagtggttttttcggatatcgcactcattcgtcacgtggaccgaggagactgctgcgtcgagacatccgcctccccctcatcatgaggagttcgtcgagccacccatccccaaggtttcagtcgcgaccgatctccgtacgcattcagtggttcagtgcgaaggatgtcaggggatggctcaggatttaggagcgattgctgaggattag

SEQ ID NO: 52213 - DNA, 198 bp, Glycine max
  Peptide Sequence Number=SeqID_168991
atggctagtgacatggtacctgtcagatggggaatcagaggcagcactggtggtaacaacattagcctgcggtttagggaaagacaaaaagaaggctttctaccaaatttatttttgttaaacccatgccttttgaaggacttagagaaaggctttgagcaaaatcagtccacgaaggagacaattttgaaatcatga

SEQ ID NO: 52214 - DNA, 204 bp, Glycine max
  Peptide Sequence Number=SeqID_168992
atgtctcctccacctctagaacctcataatcactcacagactcatctcatgctctcaggacggcttcctcttcaagctctgccgaggagtgttgcgctcagcggatggctcgctaagccagaagattggcttagcgagaggatgcaaatcagtacttcacaaacttgcctaactaacctgaaattgagaggaaatgattattaa

SEQ ID NO: 52215 - DNA, 207 bp, Glycine max
  Peptide Sequence Number=SeqID_168993
atggaacacagctccaaactcgaaagtggaggacacatgaacagccctacgcagtatcattcatgtggctccggaaaaagggcaatcatggaacacagctccaaactcaaaaatggaggacacatgaccagccctaagcaatatccttcatgtggctccagaaaaaggatgagaatggaggattgtcttgagggtcctccttcttag

SEQ ID NO: 52216 - DNA, 207 bp, Glycine max
  Peptide Sequence Number=SeqID_168994
atggcgcgcagcgtgtttgctccgtgcccctatttaagggacctacaagggagagaactaactaggcatttagcaataaccccccaagtccccagtggagtcgccaactgtcacaccctacccttcggcgggagggcgacgcgtgactcgcgggatgcgtgttccacgaaaggaatacgcgcggagtcgccaccaacgtttatttga

SEQ ID NO: 52217 - DNA, 324 bp, Glycine max
  Peptide Sequence Number=SeqID_168995
atgtggtcgagggagcacttggcagaggaagagttgaagcggcgtggtgccactcttcgagaaaagggaaagagctttgttccatggaggaaggaagaatcgtggagggagggcgcagagagtgataaggagagaaaagaggacatgggtgcacgcaattggaaaccaagttgcaaaatttggtgtgaatggttttggttcctacggcgagggaagatagtaaatagagttgagcatcaggataagtttatcccacaaatcctaagcttatcttcttcttcttctttttttttttttgagtttgcacatagtatgctggcttag

SEQ ID NO: 52218 - DNA, 813 bp, Glycine max
  Peptide Sequence Number=SeqID_168996
atggctttggaggctttgaattcaccaacagcagccaccactcccttccgtggttaccaagaagaggaggaggaggttgaccttcacctacgcgagccttgggccaagagaaaacgctccaaacgacctcgttttgagtcggaggaagagtacttggctctttgcctcatcatgcttgcacaaagcggtaacaacaacaacacccaattaccgtcttcgtcacagtcacacaaagaagcgtcaccgccgctgaaactatcacacaggtgcaccgtttgcaacaaggcttttccttcttaccaagcactcggtggacacaaggccagccaccgcaaggcctcgtcggaatccaacaccaccgcctccgccgtcgccgtctctgccacagccaacgacagcgtttccgcttcgaccgtcggcggcggaaggatgcacgagtgttccatctgtcacaagagtttccctaccggtcaggccctgggtggccacaagcgctgtcactacgacggcggaaacaaccacagtaacagcaacgccaacggcaacaacagcagcggcgtcactacctccgacggcggcgctgcctcctcctcctcccacgcgttccgtgggtttgacctgaaccttccggctccgctgacggagttctggtcgccggcggggtttgatttcggaaagaagaaggttggcgttgaacaagaggtggaaagcccgttgccggtgggatcgggattaggttcggattttgtttctgctcctctgtacagacaaaatttgttcattgcttttggattcttgtttgccattgattga

SEQ ID NO: 52219 - DNA, 99 bp, Glycine max
  Peptide Sequence Number=SeqID_168997
atggctagtggtagagaatttgtttacgaaacagaggtggaagtatcagtggtggggtttgaaaggttatttcctagcgcaaatgcagccaaagaataa

SEQ ID NO: 52220 - DNA, 1785 bp, Glycine max
  Peptide Sequence Number=SeqID_168998
atgaagttcatgaagcttggttctaagcctgatacctttcaaactgatggaaacaatgttagttctcgcttacagacattgatctccctcaataatgaagaaaatgtagatgaagttcaaatttttgacattcctggtggtgcaaatacctttgagatatgtgctaagttttgctatggcatgactgttaccctcaatgcttacaatgtaatagcaactcgatgtgcagcagagtatcttggaatgcatgaggccattgagaaagggaacctcatctacaagattgatgttttccttagctctagcattttccgtagttggaaggattcaatcatccttcttcagacttcaaagtctatgttacccttggttgaggacctaaaggttgtcagtcattgcattgaatctatagcaaataaggcatgcgttgatgtatccaaagttgattggtcctacacctataaccggaagaagcttccagaggaaaatgggattgagtccaaccagaatggactcagaactcgactggtgccaaaagactggtgggttgaagatttatgtgagcttgaagttgatttgtacaagtctgtgattacgaatattaaatccaaggcagttcaatctaatgaagtaattggcgaagctttgaaagcttatgcttatagaagattgccaaatttcagcaagggtatgatccagtgtggggatgtatccaagcaccgtttaatagttgaaactattgtgtggttgctgcctactgagaaaggcagtgttccttgtaggttcttactcaagttattgaaagctgccatttttgtagaatcgggagataggactaaagaagagctggtaaagagaattgggcagcaactggaggaggcttctgtaagtgatattttgattcaagcaccagatggggctgctacaatctatgatgttagtatagtacagaacattgttagagtgttttttattaaggatcacaatgctgagattgagtcagttgggctggatgaacttgaggggataagaaaaccagggattttatcagatgcttctaagctgatggttgcaaagctcatagatgggtaccttgctgaaatagcaaaagatcccaatttacctttctcagagtttgttaatcttgccgagttagtgtctagcatctctcggccagctcatgatggcctttatagggctattgacacatatctgaaggagcaccctgggatcagcaaaggcgaaaagaagaggatatgcaagctgatggattgtagaaagctatcagttgacgcgtgcttgcatgcagtgcaaaatgagagactaccattgcgtgtagttgtgcaggtactatacttcgagcagttacggactgctgcatcatcaggtaccagcactcctgacatacctagaggaatcaaagacttgaacaatgaatcgaatggaagctcaaggtcagggacaactaacccagaagatgagttggatgctgtggccacagctgaggagctgaaggcgttaagaaaggaacttgcatcattgaggctgagcaatggagttggaaacaatgacaaagatggagacaccaaacccagcatggacaaggctgtcatggggaaggtgaaagggttgctcaagtcaaagaagtctttcattaagctttgggccagcaaagggggacaaggtgaaaatagtggctcagactcatcagagagtatgagttctgctaacccagaagaagccaaatctactccatccagaaataggaggcattcagtttcctga

SEQ ID NO: 52221 - DNA, 516 bp, Glycine max
  Peptide Sequence Number=SeqID_168999
atgagctgcaatggttgtcgagtcctccgaaagggttgcagtgacgactgcatgctacgacattgcctactgtggatagagaacccacaagcccaagctcacgccaccctcttcgtcaccaagttcttcggccgtgccactctcatgtctttcctttccaccgtaccccccaaccaaagatccgctttgtttgagtcactgctctatgaagcagtggggcgtactataaatccagtgaatggagcagtggggctgttgtggacagggaactggcacctctgccaaatgggtgtggagaaagtgctacgaggtggtgctgctgctgcgttgaccccactgatccctcaagtaataacaacgagtgtggtgagaggtgaaataatgtgtcaccagccaaagaagcaatgtgtggggacaccctctgaggatgaggaatccgagacctccacgttcgcaagtagaccacaggattctgctcctcaacctcaaaccaacctccttacactattcttctga

SEQ ID NO: 52222 - DNA, 153 bp, Glycine max
  Peptide Sequence Number=SeqID_169000
atgggcatggaggggaggaccatgttggagccatggatgagaggcacaagccttgaacagggagggaaaagtgaagctattgggttggagggtcttgtgggttgtggcatttttgcaacttttggagaattgggtggttcaagttcaacatga

SEQ ID NO: 52223 - DNA, 1119 bp, Glycine max
  Peptide Sequence Number=SeqID_169001
atgttggctgcctatgcacaaagtgcaagtcatgttagttactcaaccagttttgaagatgctgatatgtccttagaggcattgcatttgttctgtgacatgcagttgtctcagataaagcccaatgaagttacacttgtggcattgattagtgcatgttctaatttaggtgcacttagtcagggtgcttgggcacatggttatgtgttaaggaacaatcttaaactgaatcgttttgtggggactgcactggtggatatgtattccaaatgtggatgccttaatctagcatgccaactgtttgatgaattgtctgacagggacacgttttgctacaatgccatgattggagggtttgcagttcatggtcatgggaatcaggcacttgaactgtatagaaatatgaaacttgaggacctagttcctgatggtgcaactattgtagttactatgtttgcgtgctctcatggtggattggtagaggagggcctggagatttttgagtccatgaagggggttcatgggatggagccaaaacttgagcattatggatgcctaatcgatcttctgggtcgagctgggagattaaaggaagcagaggagaggctacaagatatgcccatgaaaccaaatgcaattttgtggaggtctttacttggtgcagcaaaacttcatggtaacttagagatgggagaagctgctctcaaacacttaatagagctagaaccagaaacaagtggaaactatgtgcttctctctaatatgtatgctagcattggtaggtggaatgatgtgaagagagtgaggatgctgatgaaagatcatggggttgacaagttgcctggttttagcttagtggagattaatggtgccatgcatgaatttctcacaggtgacaaagctcatccattttcaaaagaaatatattccaagattggggagataaatagaagactgctagaatatggtcacaagccaagaacgtcagaagttttgtttgatgtagaagaagaagataaggaagatttcctctcttaccacagcgaaagactagctatagcgtttgcactaatagcatcttcttcaagtatgcctataagaattataaaaaacacttag

SEQ ID NO: 52224 - DNA, 174 bp, Glycine max
  Peptide Sequence Number=SeqID_169002
atgagatttggaggtggaggtgaaaggacaacagggtggttacggagggagtgcaatggtgaaatttgggagtggaatgaagggtcgacaatggggttaaggagcgatgggagtcgtgatgatggtgaagggtgtatggtggtggtggactggaagggtgagggaagaagataa

SEQ ID NO: 52225 - DNA, 348 bp, Glycine max
  Peptide Sequence Number=SeqID_169003
atggcatctgcagtgcccgcgacggggcgagagttgtcgaatcctccatcggacggcatcaccaatcttcgattctccaatcacagcgatcatctgttggtgtcctcatgggacaagagtgtccggttgtatgatgcgagtgcaaatgtgttgagaggagagtttatgcacgctggtcccgtcctcgattgttgcttccacgatgattcctccggcttcagtgtcgccgccgacaacactgttagaaggtcacttactctactcactctcttcttcaatttcaaacctacctgcttgtcttgttcttcaccctgtgacctagttgtgttgttctttgtacctggataa

SEQ ID NO: 52226 - DNA, 714 bp, Glycine max
  Peptide Sequence Number=SeqID_169004
atgttgttcaatgtttcagagaacaagggtggtgccactgacagaggtgaaacctccggatctaaagctccctcttttggtgttcgcttgaagccttcctatgtgaatggcttttccttggaaaagcgaagagatgatatcctacttcaggtctcggatggctcggatgggagaacttggcttattgaattcaggagggacagattttacaggggatggagaaattttgcttcagataatcatttggaaacaggggacatttgtgtttttgagctcaccaagaatcaaggccaatgttttaatttaaaaatcattaggatttcagaagaaacaccttcaagttcactagagtatattaatggttatagttttcttcctttgaatcggttcaaaggagatgcagatccttggggaatcccagatttgaaaagcataactactcttcccatcgaagctatgcgagaagctaagaagttcaccccagaaaaccccattaaggaaaatcagaagggagatttcagatcgaaatcgtggcatgtaaacttgggaggtcatgttccaacaaagttatctaaaggttggcccgaatttgcgaaggaatgtatgttgcaacctagagatgtttgcctctttgagttgctgaacaaagaagatgtagtgtttgatgttcacgtttttaaaggagactcatttggacctccttttcaatcctaa

SEQ ID NO: 52227 - DNA, 571 bp, Glycine max
  Peptide Sequence Number=SeqID_169005
gcttgtcttcagctctaacaaagaggatattctaggaaggcatgatgcacctgttcgttgtgttgagtactcatatgctgcagggcaattgatcactggtagttgggacaaaaccctgaaatgttgggaccctagaggtgcaagtggccaagagcgcacacttgttggaacatatccacagcctgagcgtgtgtactctctctcactggttggacatcgtctggttgtagcaacagctggaagacatgttaatatctatgatttgagaaacatgtctcaacctgaacaaagaagagaatcttctttaaaatatcaaaccagatgtgtgcgctgttaccctaatggaacaggatatgcacttagttctgttgagggccgggttgcaatggaattctttgacctctcagaggctagccaagcaaaaaaatatgctttcaagtgtcacaggaaatcagaagcaggaagggacattgtctatcctgtaaatgcaattgcattccaccccattctttccacttgtggtagtaagattgcgtcacacatctctaccctttctgcaagactccaatag

SEQ ID NO: 52228 - DNA, 234 bp, Glycine max
  Peptide Sequence Number=SeqID_169006
atgagatttgacattcctttgggatgcagcatcgagaaactcaaggatgtcatcaagcaacttgcacatctaggggtttccccttatggaattcatgaacaacaagttgtcagacaattgtactttcaacagtcaggtcatgctaaatattcagaaaaattaatcgaatatgaaataacagagttgaaaaacgatgaagacatgttaaaggtgttagtagaatccaactactag

SEQ ID NO: 52229 - DNA, 1069 bp, Glycine max
  Peptide Sequence Number=SeqID_169007
tgtttcctctgggagcacgtcaggagcacatgactcttctggggctgccaagggcactaaggagcctcgtggcattgttgtgtctgccaggttttggcaggaaactaacagcaggctgcgccgccttcaggatcccggttcgcccttgtcgaccagccctgcttctaggattggggtgccaaataggaatgctcagttgaaaaggtataatagtgatggtcccatgttgtcgccgcgaaccatggcttctcctgtcagggggaatgtgaatgctcggcctgcttcgccgagtaagctttgggcgggatcatccccgtcaaggggggttagtcctgctagggtgagaagcacggttgctagttctatcaatagtggttcgggtaacacaccctcgattcttagcttctctgctgatgtgcggagagggaagattggggaagatcggatatttgatgcgcatacgttgaggcttctgtataaccggtatgtgcagtggcggttcgtgaatgcaagggcagatgctacgtttatggtgcagaaactgaatgctgagagacatttgtggaatgcatgggtaacaatctcagaactccggcattcagtcatacttaaaagaatcaagcttgtgttaatgaggcaaaagttgaagttaacttccattctaaaaggacagatttcttatttggaggaatgggcccttctggatagagatcactccacttctttgcttggagcaactgaagctttgaaggccagtaccctccgtcttccagttgttgaaaaagcaatagctgatgtaccaaatctaaaggatgctttggggtcagcagttgatgtgatgcaggcaatggcatcctcgatatactctctttcttcaaaggtggaagaaactaactgcttggtggcagaaatcctaaaggtgacctcaaaagaaaggtttttgcttgaacattgcaaggagtttttgtcctcgttagcagccatgcaggtcaaggattgtagcttaagaacgcatatgttacaactttctcgtgtgccaacttccagctgcctgacaacacgtgtgtag

SEQ ID NO: 52230 - DNA, 312 bp, Glycine max
  Peptide Sequence Number=SeqID_169008
atggagtttgaaattaaactgtgttgtcagctgtgcatgttaggatatggtacatttgccacgggaggttgtgacgggtatgttaacgtatgggacggaaacaataagaagaggctataccagtattcaaaatatccaactagcgttgcagctctttcgtttagcagagatggacgcctgttggctgttgcatcaagttacacattcgaagagggacctaaaagccaagaacaagatgctatcttcgttcgtagtgtaaatgagattgaggtcaagccgaaacccaaagtctatcccaaccctccagcatga

SEQ ID NO: 52231 - DNA, 1026 bp, Glycine max
  Peptide Sequence Number=SeqID_169009
atgcgaaccaatcttaatctgggggatgttaagctggacggggtgaccaaagatactgttaaagctgttgctcaagctttgaaaaattcggctttggtcagagtctctgaagatgggaccaaagttggcagggcaactgaacttctgaagccagaagaggtaattgagcaggtagagataagaacaattgctgcattgccatttgaatatgatgtgaagcttgaagatgtggagacattctttgctcaatatgccaaggttaatagtgttcggttgcctcgccatgttggagacaaaaagttcttttgtggcactgcccttgttgagttctcatcagatgaagaaacggaaaaagttttgaagcaaagtctggtctatgcaggggctgagctacaattaaagctaaagaaggactttgatgcacaaagagaaaaggaattagaagagcaagaaaaattccggccacctttgggttcaggtcaccagaataacacaaatacagaagcaaactaccctaaaggcttacttatagccttcaaactaaagagcatttctgatcaagttcctttggatcaaaataacattgatcagcaagccaatgacagtaatgttgtgaaggataatgctgacaatgataaagaaaacaatggagtgagtgaaggaaaagacacagaaggtgaagaaaagagcaaagaaactgatggaaaaaattatgctgctgcttacaaggacaacaatgatgttgtctcacgtgaggatttaaagggtgtctttgagaagtttggtactgtgaagtacattgatttcaagattggagaagagtcaggatacattcaatttgaagaacctgaagctgctcagaaagctcgtgctgctgcagttctttctgaaaaggagggcttagttgtgaaaaattatattgctactctagatccagtaactggtgaggctgagagagaatactggaccctgcttcgtggtaatcagggaaagatccgaggatgcacaaataaccgaggaaggtaa

SEQ ID NO: 52232 - DNA, 258 bp, Glycine max
  Peptide Sequence Number=SeqID_169010
atgcctgtgagttatgatgtgtttggggtaattttggagatattgggcttgaaaggacatggtcgtaatttagaaaatggaattgggaagatatgtaatgtcatgcttattactgagcttgaagtgggtgacgtgggtataacggagcgatatgatttgacgaatggcaaagcaaagaagaaacggtgttggagggggaaccaaaaaggtgctgttgagaataacgagaccttaggactttggacaacgtttaccctc

SEQ ID NO: 52233 - DNA, 369 bp, Glycine max
  Peptide Sequence Number=SeqID_169011
atggtggctgccatttcggaagacccattgacctcttctaatggcaccatccccagaagaccaaagggtaggcaagtttcttcaaggtacatgtctcactcaccttcaccttcttcaaccacaactacaacaacaactacttcaacttcaacttcaacatctacaacaagttcttcttctcgtcgattcccttcccctcttctctcgcattccaccaattcctccacccctttgctcccaaagcgttcccaatcggtggaccgccgccgcccgcgcccggcgacgccgcttcccgaggcggcgaagcttctcgtgacttccactaggagcctgtcggtttcttttcaaggagaggccttttcgctgccc

SEQ ID NO: 52234 - DNA, 531 bp, Glycine max
  Peptide Sequence Number=SeqID_169012
atggatctcatcacaatactcgtcgtacatcaactcgtcgcccttaaagggtcttacgtattgatcagacaagacaaactcatctaccttgatcttcttgtcttgtgcgattttgaagcacgatctgtgatggttgctgctgatacttcttgtgatgcttggctagcccttgcttgttccttttctaatcgatcccattcaataattatgtcactcagggaacgactcagttccataactaaaggcagctcctctatctcaacttatttaccctcaatccgcaatattgctgataaattggccctcattggtcatcctattgataaccttgaaatggttattcaagccttaaatggtcttggaccaaccttcagagaatttactgcttccattcacactcgtgattcaccaattgctttcaacgaactctatgacaagatggtggattttgagatgtttctgcaacgtcaagaacacatcttgacatcggatcctaatacttcaaaccttactcagcatcattataattga

SEQ ID NO: 52235 - DNA, 675 bp, Glycine max
  Peptide Sequence Number=SeqID_169013
atggcacctttcgtttccctctctttgttgcttctctttctcaaccaccccctcctttccctctcaaccaaccctgaagggaacgctctgcatgctttgagaagcaggctttctgatcccaacaatatgttgcagagttgggacccaacactggttaatccctgtacttggtttcatgttacctgtgactccaacaatcatgtgattcgcttagacttgggcaactctaacgtttctggaactctgggcccagaacttggccagctacagcatctgcagtacttgtatgagttttttcccttgcctgttacagctgagaaggagctctacaggaatgagataacaggaaagattcctaaggaacttggtaacttgaaatcacttattagcatggatttgtatgataacaagttggagggtaaaattccaaaatcatttggaaagttgaagtcacttaaattcttgcggctaaacaacaacaagttgacaggatccatcccaagagaactcactcgtctcactgatctcaaaatctttgatgtttctaataatgatctctgtggaacaataccagttgagggaaactttgaatctttcccaatggaaagttttaaaaacaacaggtttagtggtcccgagctgaaaggacttgttccatatgattttggatgctga

SEQ ID NO: 52236 - DNA, 294 bp, Glycine max
  Peptide Sequence Number=SeqID_169014
atgaagaaaaccctaattcgagtagttgtctataaattgatatctgcagagtacaaagagggttctcctacagattcttcagcaactgcgattttggatcggaacctcttctgcggcgtagcaatgggacactccaacgtttggaattctcacccaaaaaactacggtcctggttctcgcacttgccgagtgtgtgggaatccacatggattgatcaggaagtatggccttatgtgctgcaggcagtgcttccgtagcaatgccaaggaaattggcttcatcaagtatcgctaa

SEQ ID NO: 52237 - DNA, 1065 bp, Glycine max
  Peptide Sequence Number=SeqID_169015
atgacaatatccaatcacagtttttctcgaattgacacattggagctgaaagctctgattgttcggaaggttggtcgtcagagagctgacaagtactttgatcagcttcgaagattattgagttcaaagataagcaagtccgagttttacaggatttgcactgtgataattgggagggaaaatatccctcttcacaatcgactcattagagcaattctgaagaatgcttgtctggctaaagtcccacccgtgagaggctctgcaagagttgggagtgccaccagtgtaaaagattcaaatgggtcacagagaggctctattcaatcgctgtttggggaagcatttcctccttccatgcggagaataagctctttggctgctcgagaccatagatttaagggccgccaaaatgcttttgggccactgggcaagccccattttggtcttgcgtctgaagaattggtatataagacactggagcagcagagtgcaacagaactgaattcccttggcagtagacctccgatatctgttgaagagggagaggaggttgaacagatggctggaagccccagcattcaaagtaggagcccagttacagctcctctcggtgtatccatgcattttggtcgtagacttcatttcaatgtatcattatgtagcaaagattatccagagacctgtcacagcaatggatctctccctgacactagatctttgaggagtcgtttggagcaaaagttggagaaggagggtttaactgcgacagtggattctgtaaatctgttgaataatgcactggatttgtatctgaagaggttgattgagtcctttatggatttggctggatcaagatttggaaatgagcatctaagacagcaaaacagacagttaggaaccagttcaaatgtattgctacctggaagatgtatgcagacagcaacaagatctaccagtgcatctgttttagattttcgccttgcaatggagttaaatccacaagttcttggacctgattggccaatacaactcgagaagatttgcatacgtgcctctgaagagtga

SEQ ID NO: 52238 - DNA, 414 bp, Glycine max
  Peptide Sequence Number=SeqID_169016
atgagcagtgcttttctaatgaaccctgccaagattcctcatgccatgatgcagaggcagttcatgttggtgaaccgtgccattcatcccatcaaaaccccttcgtttcatttcctcaagaaaccaagacaatatggaatctcttcatctttttgttcttcttcttcttcttcatcatcatcatcgtctgctgcaatttccatctccaaggttggctttgtgggttggtatttggggatgataaagtcgtggccaattttgacaaagagtgttacttcttcccttatttacatcgccgctgatttatcctctcagctgtggaactatgattctgagagttcttgcttcttggttctccttgccctttcttcctctgcttactgttatatgtggaactatgattctgaaagttaa

SEQ ID NO: 52239 - DNA, 225 bp, Glycine max
  Peptide Sequence Number=SeqID_169017
atggagccacctcaagatggttactatgttaatcaacacagcatgcaaggcctgggtccattgaattctatgggtccaagccatgatgggttttttggaacacagcaaggcattcatgggctgggagggcaattggaatttcgtccggcaactacttttggatatagccttcatcaggatgaacctgatccccagtttcatggcaacagttcaagaaatacttag

SEQ ID NO: 52240 - DNA, 2790 bp, Glycine max
  Peptide Sequence Number=SeqID_169018
atggcaaagcccaaacttgaaccatcaaaactggctttgcggaaaggagaaactgctgagagcacaaaagacaccagaacaaggtactttaatgagcaagctgacaacagttcaggcacattcatcagcgcatcagaagacaaatctggcatcttagacttggttgagaggaagattgctaaagttacaatgattccaaggacccatggggaaatattcaatatattgaagtatgaggttggccagaaatatgattctcattatgatgcgttcaacccagatgaatacggctctgttgagagccaaaggattgcttccttcttgttatacctatcaaatgtagaagcgggaggagaaacaatgttcccttatgagggtggtctgaatattgataggggttatgattaccaaaaatgcattggtttgaaggtgaagccacgacagggcgatggacttttattttattcattgttaccaaacgggaaaattgataaggacttttgtttgttgtatttttcagtgactggcagcacccaaagtgcaatttatattgtagctggtattcagaaagcagtgcattgtagtgcagtgagcgaaaatatgggtgatgcactaaatgaagtgcagcacaggggtggtgcacctgctgcttctcccaagagggacattgcattgcttgaaggagacaaagattttgagctgcacaatggcattgaatttgaatcccatgaagcagcatattcattttatcaggaatatgccaaatctatgggattcaccacttcaataaaaaacagcagacgctcaaagaaaacaaaagaatttattgatgccaagtttgcatgctctaggtatggagttacacctgagtctgacagtggcagcagtcgaagacctagtgtaaagaaaacagattgcaaagcttgcatgcatgtgaagagaaagccagatggaaagtggatcattcatgaatttataaaggaacataatcatgaacttttaccagctttggcatatcattttcggattcatagaaatatgaaattagctgaaaagaataatattgatatcctgcatgctgttagtgaacgcaccagaaagatgtatgttgaaatgtctaggcaatctagtggctgtcaaaacattgggtctttcatgggtgatataaactatcagtttgacagaggccagtatttggctttggatgagggagatgcccaagttatgctcgagtattttaagcatgtacaaaaggagagtcccaacttcttctattctatagatttaaatgaagagcagcgcttaagaaatctattttggattgatgcaaaaagtatcaatgattatctcagctttaacgatgtagtttcatttgataccacttacataaaaagcaatgacaagctgccatttgcaccttttgttggagtaaaccaccactctcaacctgtattgcttggatgtgcattgcttgcagatgagactaaaccaacatttgtttggttaatgaagacatggcttagagctatgggtgggcaagctcccaaagttataatcactgatcaagacacaaccttgaagactgcaattgaagaagtctttccaaatgtacggcattgtttttctctttggcacatactggagaggatacctgaaaatctctcttttgtgataaaaaagcatcagaactttgtgcgaaaatttaacaagtgcatttttaaatcatggacagatgaacagtttgacatgcgatggtggaaaatggtcactagatgtgaactgcatgatgatatatggtttcagtcattgtatgaggaccggaaaaagtgggtgccaacttacatgggggacacctttttagctggaatgtctacacctcagcgctctgaaagtatgaactctttctttgacaaatatattcataagaaaattactcttaaagagtttgtgaaacaatatgggataattcttcagaataggtatgacgaggaagccattgcagattttgatacattgcacaaacagccagcacttaaatctccttcaccttgggaaaaacaaatgtcaacagtttatacacatgcaatatttaagaaatttcaagtggaagttttgggtgtagctggctgtcaatctaggatagaggctggagatggcactattgcaaaatttatagttcaagattatgagaaggatgaagagtttttggtaacttggaatgagttgagctcagaggtctcttgcttttgtcgattgtttgaatataaaggtttcctttgcaggcatggattgagtgttctccaacgttgtggttgttcaagtgttccatctcattatattttgaagaggtggaccaaagatgccaaaattaaggaatcgatggcagataggacaagaaggacacaaactagggtgcaacgttataatgacttgtgtaaacgagctattgatttgagtgaagaaggatcgttatctgaagagaattacaatgttgtttttcgtgcacttgttgatgccttgaagaactgtgtccttgtgaataattctaataacaatggtgcagaaactagcagcaatgcctatggccatcgtgaagcagaagaaaatcaggttcctcttgctttgaaactaaataaaaagaggaatgcagctaggaaaagaaaggcacaattagagcaggatgttatacttgttgatgctcaagataccctgcagcaaatggataatcttagctcggatgcaataacccttaatggatattatggtacccagcagaatgtgcaaggactg

SEQ ID NO: 52241 - DNA, 285 bp, Glycine max
  Peptide Sequence Number=SeqID_169019
ggcataatatccttcttgtactggggttttattccaagaaaatatatacacctcagtgatttacacgaaagagacattgacatttttgaaggtatcaagactggaaggtgtcaagctagcccttcgtgtcatcatattgtacctcagcttttggatgaatgggattatggaaggatggtcgaggagacattggtggaaaatgaacgagatgatacttctttggtcatttccttggacaatgtagccaaagcattaggttataaagaaaaaaaacttggtctataa

SEQ ID NO: 52242 - DNA, 363 bp, Glycine max
  Peptide Sequence Number=SeqID_169020
atgacgagcgcttcggagctattccacaccagaaggcatcgattgggacgaaatgctctcgatctagggctcgacaccgaactccacgccgccgattctctccgccaactccgccttcgtcactactacctccgccgccaccacccggagcgtgcatctgatagaattgatgggaggtatcggcggtctttcgtaagtgagagcgtggattctgaagaaaacgtgagaagtagtcttagagggagtagcagcgagagactacccgtaggtgtggttcttgcacgggcaagactccttcagaggttgagaggggaacctctatccacaaacaggtttgcttttcacctcaatctatgtctctag

SEQ ID NO: 52243 - DNA, 540 bp, Glycine max
  Peptide Sequence Number=SeqID_169021
atgcaaaactcacccatcgtcatcgctgttccgccatcgctccccctccctctatcgccatgccctgtcgatcaaataaatgccatccacttcccgtcgctgccacccttcgccggagctctcactccgtcttccaaaccaccgtcctctcattcccgtcgccgccgccattcgctggaaagctctgtcgacctctccccccccccccccctcgaattactgctcgcgctcctcgccgtcctccgtcctccatccacagttacaaaattggttgcggcgttgatttgggcgaagatatggagatcagatgaaaggggcacttcagatatgaagaagatgggccagaacatcgccaaagccaatgagcattgtcgaaatggtgtcgttctaaaagctcgcctctgccaatgccctttccacgccgttgtcggatttctgctctaccgcacacctcctctgcttcgcggaggtccggcccatcaactcgaacgatggaggcgttcgcggtggtggggtcgttgggtgggagccggtgggtga

SEQ ID NO: 52244 - DNA, 1275 bp, Glycine max
  Peptide Sequence Number=SeqID_169022
atggaaaaggcaaaacctattgtggtttcgaagtctcgacatgataagagagtgggaggtaaggattcaagaggattgcatattatcactccaagtctagaagaatttcaacaagctcatttgtgtatactgaataatagtagtgaagttctgtcgtacatagttcggcatgaagctttagtcaagcaaaataacccaaaaatgtccaaggatagggtcttcaaagagcataacaagagttttgtaaattggtttaaagatacaatctttgatgacgataatgcttctgaaatgttaaagaagttagcagatgggcctaaaaaatgttataacttggaaaagtataagtgggttgatagcaatatgggtgtgcgaactgatgatttcggatttaatttgatagatttgaagaagctcacttataagaataagtctttcatcatggtagaacaagctaaacaaatattttatgttcaagatccttgtgatgaaagatggtcaatggttctacccagaaaaacaattgctcttaatattgaagatgatgattcaacccatgatagttgtctcacatatttctccacacaaatatcagctaacgtcaacggagaagaagttgacgacagaccagtggttcatgttgatcttgtcactgggaaagccaatggtccccacaaaaagaaattaagaacatatttggggatgatcacttgcgataaggtgaatgttacatatgataattggaaacaagtcctcgtcactcaaaaggatctcatctgggaggatattcagtttgagttagatttgaccttcaaatgggccatggcagacaacaaggatgacaaggatgaaaaagaggttcgaaagaaggtgcaagccattcagaaacaaaacattgcccctcaggtgttgtcccatggggggaggactaacacagtcgtggatcttccatctcccattagacgacacgtgaagtggaagatggtctgtacgaagaaaactggccaaatgacatctgaggtagcaaaggaaatcacagacaggattgtaagatttcttggaggagcaggcctcacagggaagctttgtcgcccatggacgttaggatgtactgactattgccattgggcgaccggaggactcagacctagagcagatgacacagaagatcggagaccagctggaggaggactcacactgcctcctgaggttgaggttggtccttctactgctcgtgtcaacacaaaggaaagttgtgtcgatccctcgggatag

SEQ ID NO: 52245 - DNA, 630 bp, Glycine max
  Peptide Sequence Number=SeqID_169023
atgtctcttccaagacccagtgagggtaaagccccttctcagctgaaagaaggagtagcacctgctgctgctgcagcctcatcctcttcttcatggaataataggctacacactttccctcctttgtctctacacaacaagagtagcaaaattgaacataacactaatcagttattcaaaggactaaatttaagggcaattttattagaagacagtgatgaagatatgttcacagttcctgatgtggaaaccacaccagttagtgttcattctgcagcgactcttcaaaatagtaaccttactcaacgtaatgtgacagaccctcaatttcaaactggctttcctggaaagcgccgcaggggaagaaaccctgcagataaggaacatagacgcctcaagaggttgttgcgaaacagggtctctgcccaacaagcccgcgaaagaaagaaggtttatgtgaatgacttggaatcaagagctaaagagttgcaagataaaaacgctatcttagaagaacgtatctctactttaatcaatgagaacaccatgctgcggaaggttcttatgaacgcgaggccaaaaactgatgatagcattgaacaaaagcaagaccagttaagtaagagctaa

SEQ ID NO: 52246 - DNA, 204 bp, Glycine max
  Peptide Sequence Number=SeqID_169024
atgaggtgtctctgcatgtcatcggacttcccatctctggatcagaaaggagtggataactatgaagtgtctccatgtttgaggtgtctttgtgtgtcatcggacttgtcgtctctggatgacaaagacttgccgtctctggatgacaaacgtgcggataaccatgatttgtcttcgcgtgatataggactcgattgtctctag

SEQ ID NO: 52247 - DNA, 444 bp, Glycine max
  Peptide Sequence Number=SeqID_169025
atggaaaaggcaaaacctattgtggtttcgaagtctcgacatgataagagagtgggaggtaaggattcaagaggattgcatattatcactccaagtctagaagaatttcaacaagctcatttgtgtatactgaataatagtagtgaagttctgtcgtacatagttcggcatgaagctttagtcaagcaaaataacccaaaaatgtccaaggatagggtcttcaaagagcataacaagagttttgtaaattggtttaaagatacaatctttgatgacgataatgcttctgaaatgttaaagaagttagcagatgggcctaaaaaatgttataacttggaaaagtataagtgggttgatagcaatatgggtgtgcgaactgatgatttcggatttaatttgatagatttgaagaagctcacttataagaataagtctttcatcatg

SEQ ID NO: 52248 - DNA, 576 bp, Glycine max
  Peptide Sequence Number=SeqID_169026
atgatgagcatgattttagctttgtggcagtacttaaaagtaggacattacctggtaaatgttttcgaaatgcagtactggtatgccaaaggtttcttgagtctttcttgtggtggaagaaccagtttcagggatacatctaatatttcatgggtaccagacacctcctacataaccacaggcaagactaccaccatcacttacagtgatgactcctccgcattgaacatctcagctcgcttcttcctgaattccagaaggcgaaaatgctacagaataccagtaaacaattcaacaactttggttctggttagagcaacatttttgtacaagaactatgatggacttgggaaaccccctaagttctctgcttctattgggacagctattgctgcaaccataaatcttgctgaatctgatccatggagtgaagagtttctatggactgtcaacaaggatacactgtcattctgcttaaatgcaattccaaaaggtggttcacctgttatttcttcccttgaaatcagaccactttcctcaaggagcctacacaaatggcatggcagattttcctaa

SEQ ID NO: 52249 - DNA, 372 bp, Glycine max
  Peptide Sequence Number=SeqID_169027
atgacacacagggacacctcatggttatctgcacctttgtcatctagagacgacaagtccaatgacacgcaaagacacctcatggttatctgcaccttcttcaaccagaggcaagcaagcccattgacacgcagagaccaatatggtcatctgctccctttgtcgaagactcgatgtctatcgaccgagactactttagtctccacccgccatccagagacgagcaagttcgatgcacccaggcccatttgggccctccagaagattcctccagaaggcggttgcttctggaggaagcaaccctgctcgcctgggcgagctgagctcgcctgggcgagctgggcggcaaccacctcccctattttgctataa

SEQ ID NO: 52250 - DNA, 1179 bp, Glycine max
  Peptide Sequence Number=SeqID_169028
atgggagtagtgcctgatagcttgggagagttagaggacctccacttactgaatctggaaaacaacaaactacaaggtccactaccacagtctttgaacaaagaaacgctagagatcaggacatctggtaatttgtgtcttaccttttccacaacatcatgtgatgatgcatcattcagtcctccaattgaggcaccacaagtcactgtagttcctcagaagaagcacaatgtacataaccatctagcaatcatattaggcatagttggaggagccacactggcctttatcttgatgtgtatttcggtattgatatacaagactaaacagcaatatgaagcctcccacacatcaagggcagaaatgcatatgaggaactggggtgctgcaaaagtcttttcctacaaagaaatcaaagtagctacaagaaacttcaaagaagtcataggaaggggcagttttggatctgtttatcttggaaaacttccagatggaaaattggtggctgtcaaagttcggtttgacaaatctcaattgggtgctgattctttcatcaatgaggttaatcttttgtcaaaaatccggcatcaaaatcttgtgtctttggaaggattttgtcatgaaagaaagcatcagatattggtttacgagtacttgccaggtggatccctggctgatcacctctatggtacaaacaatcaaaaaacttccttaagctgggttcgaaggttgaaaattgccgttgatgcagcaaaaggattggactatttgcacaatggaagtgaaccacgaatcatacaccgtgatgtcaagtgcagtaacatcctcttggatatggatatgaatgccaaggtctgtgacttaggtctctctaagcaagtaactcaggcagatgcaactcatgtcaccactgttgtcaagggcactgctggttacctcgatccagagtattattccactcaacaattgacagagaaaagtgatgtatatagctttggagttgttcttttggaactcatttgtggaagagagccattgactcactctggaactcctgattctttcaatttggtgttatgggtaacactgcattccttttattgtttgaaaaatggactaaaaccaatggttattgttaaaaaatttaaatcaattcaacccaaaagcttgagcaattag

SEQ ID NO: 52251 - DNA, 309 bp, Glycine max
  Peptide Sequence Number=SeqID_169029
atgttcatccttggtgtttctctcggcttcggtttatctgttccgaagtatttcaacgaacatggccctgttcatactggctccacttggttcaacaatatagtgcaagcaattttctcatccccagcaacagtggcaattatagatgcttacatcttggatttaactgtgagtcgtggagagaggtcaactcgccgagacggtgggagacactggtgggaaaaattcaggaccttcaaccaggatattagaactgaagacttcttttcacttcccttaaacttcaacagatttttcccatcacattga

SEQ ID NO: 52252 - DNA, 708 bp, Glycine max
  Peptide Sequence Number=SeqID_169030
atgaagggtttgcgaagccttgaggtctggaaactaggagttgtcaactctttggatgcattgaaactgcaggaaaaactggccttggatagaaaacttcataggagatgtgatactattcttctgtctttgcaacacccccctacatacactgttggcaaaaggcaaactgttcacaatttgttaatcccccaatccgagtttctggcatcagagttggacaaaattggagctgaacttcactacatgcgaaggggaggagacattacatttcatggtccctaccaggccattttgcatcctatcatatcgctccgcaccatgggactcgatgctcgatgttttgtggagaagattgagttaaccatgattgaactggctgctacatactgtgtgaaagcttgtcctggacaaagtggtgagactggggtatggattggagaaaggaagataggtgcgattggtgttcggatatcaagtggaatcacttctcatgggatggcatttaacattgatcctgatttgagctactttaagcacattgttccctgtggaattgcagatatagaagtaacatctttgagaagggagacagattctgttcttcctgaggaagaaataatacaggagcagttgatttcatgttttgcaagaatcttcagttatagggacctaatctggaaggaggatgcttcaatatttttttga

SEQ ID NO: 52253 - DNA, 252 bp, Glycine max
  Peptide Sequence Number=SeqID_169031
atggtgctaatcggaggtacggttgatttttcgtttctgattggccttccacggcttccattaatcttgattcgaagcctggtgccacggatctacctactgtacagaggtgtggcgatcgtgttcgtgttgctcttaaggtcgctttcggaagatcgtttgttcaacgatcggagattgcagcacagatcgagtgaagaaagcgtggctgtgttcttcgcattccgatgtcggttcatgttgtggtattga

SEQ ID NO: 52254 - DNA, 924 bp, Glycine max
  Peptide Sequence Number=SeqID_169032
atggaagcttgttcttgtggaggagaaaaacaaaacatggatgagtttgaattcgaacttcatcgcgttaagcaacaacttcccagtgttcagtactgtgttgccagttctccctcatggcctgaagggattcgtgttgggtttttgcattgcttggttgcgcttgggaccaatgtcatggcttcctccacccttgtacctttaatgggtggtgacaatgaggagaaggctcaagtgatagagactctactttttgttgcggccattaacacactgccgcaaacgtggtttggaacacgtcttcctgtggttatggtagcatcctatactttcctcattcctgctgtgtccgttgctgtttccaaaaggatgagtgtgcttcaagatccacatcagaaatttatacattccatgagagccatacaaggggcacttattactgcatcggtctttcaaatcagtattggcttttttggattttggaggctttttgccaggtgcctcggcccctttagtgtgatggtagattgcgctgaaattggtctccctgcatttcttatccttgtcatcgtgtcccagctggtgcatacaaaaaaaagatcgtctataactcaatcaagttgccgtaccgatcgatctgggttaattagtgctgctccttggataagagttccatatccatttcaatggggacccccttctttcagtgctggtgatatttttgctactgttgctgcttctcttgttgcaattgtagagtcaacaggaacattcattgcggcatggagattaagcaaagcaacccctattctaccatctgtgcttggtcgtggtgttggctggctgggcatagctactctttggatggcttttttggcacaggaaccgaatccactgcatcagtgtacattttgttacctttaa

SEQ ID NO: 52255 - DNA, 348 bp, Glycine max
  Peptide Sequence Number=SeqID_169033
atgtcggtggtgacgatgacagtgtcggtgacattgatggtggtggtagtaacaatgtcggcggtgatggtgctgtcaatggagtcgatagtgacagtgacggtggttggttatggtagcggtgatagtgatgatgataatgacaataacagtgatagtgacactaatagtggtgaaggtggtagcaatgctggtgacaatgatgatagtggtggcaatgtccgtgacaacgatgatgatgatagtgataataacggtggtggaattagtagtggtgcctgtgataaagacaatggtagtgatgacgatagtcacaatggcaacaaaaaatgtcattatcaaacttga

SEQ ID NO: 52256 - DNA, 111 bp, Glycine max
  Peptide Sequence Number=SeqID_169034
atgaagctatcagttgctgatggtcatctttgtaacatgggaaggatgattgaggaaatggagagtaagctgaggaactcactagatcaggttatcgtgagcaaggaatag

SEQ ID NO: 52257 - DNA, 372 bp, Glycine max
  Peptide Sequence Number=SeqID_169035
atggaaaacaaaggacaagatgtgaacaggccaccactcttcaagggtagcttcaaaagtgccaaagatatgtgggacactcttactatattgtataagggttccactaagaaagggaagtcaccagtgctcaacatccagaaaactaagagggactcatcatccaaagcattgtccaaagcactaagtgtggataattcctctaatgatgaatttgaaaaagaaactaacaaagatgatgagttttcattcatgtcaaggaagatcaaaaagatgtggaaaaacaagaatgaatctagatggaaaaactcatccaaaaagttcttcaacaaaagaaaggataaaaaagaagagtcaagccattttctataa

SEQ ID NO: 52258 - DNA, 1134 bp, Glycine max
  Peptide Sequence Number=SeqID_169036
atggaacctgttcaattgatttctgaagaatggggttctctttgtggatttcacacaactgaagaagctgacttcatggctcagttgtttggttgcaacactttagtcacagaaaagcactgtggaaataccactcttggcttttggcctgggcatgatgagtccacaatagtggccatgacagacactaatagcaactcataccttcctccaaacgttacagatactaattttttgtgtttctcacaagggagtagctccagtactgataatagtggtaataatatcttttccattacaagtagtggagcctactcctgtgatccagaagcaaactttgattctgtgtccatggttttgtgccttggagatgccaaatttagtccccatagttttcaatgtgatgacaactcaagccaacagataaatgaaaacactgatgaagagtcaagtctagacccatggaagttggctattgctgacaataattcgcaggctaagagggagtatgaaatgatggtttctgaacctgtagaagtggatagaagcagaaacctggagaacctagcaaaaagactaaagagttcaatagaggtttcaaaaacattgaggagtgctaaatcagggaaaaattcaaaatctgcttcagtgagcaacgatgaagatgatagaagcttgagcctccaagcccaaaggaatagctgtttttcacagagtgactctaatgcttatctggagccaaatggaggggcatcaaaagatcctgcacctcccaatttgcatagaaaatcaagagcaactaccggtgctgccactgatccacagagcctctatgcaagagtatgtcaccctcttgaaaggcctttcttcaataaaatcacaatgtcaactgcacataagagaagagaaagaataaatgaaaggttgagaatactgcaaaatcttgttcccaacggaactaaggtggatatcagcaccatgcttgaggaagctgtccaatacgttaagtttttacagctccaaattaagcttctgagctctgacgatctgtggatgtatgctccaattgcttacaatggaataaacattggactagacctcagtatttctccaactaaaggaatatcaatgtga

SEQ ID NO: 52259 - DNA, 1020 bp, Glycine max
  Peptide Sequence Number=SeqID_169037
atggatcctgttgagcaaatttctgaagagtggagttctcttagtggattctacacagctgaggaagctaactttatgagccagttgcttggtaactgctcactccctgagaacctgtgtggaaatttcaatttgggaattccatctgcaatatggcctggccatgaatccactatagtgagcgtgacaggaatcaatgaaagtccatattttcatgcaaatggaagtagctccactgctgatagtagcaatatttttcctactacaagtggtaatagttacactttgaatgatccagtggccaacattggctacatgtccacggattttgccaatttaggcccatgtaatgttcaagggagtgacagccaacagttaaatgaaaacacccatgaagagttaggtctagaggttattgctgacaagaaattgcaggatcgccaggaatgtgaagtacttgtttctgaagcagcagaagaggatataaacaccaatctggagaagtcaggaaaaagatctaggtgctcaatgcaggtgcgaaagagcaagaaaaatgttaaacctgtgaagaaaccaaaatctgattctataagtaactctgaagagggtagaagtcctcatcttcagggttgctgctcagagaatgatgactccagtgcttctcaggagctaaatggaggaggatcttcaagtttgagcctggaggattctacatctcttaagttaaaggggaaaaaatcaacagctaatagaggttctgctactgatccacagagtgtatatgcaaggagaagaagagaaagaataaatgaaaggttgaaaatcctacaaaaccttgtccccaatggaaccaaggtggatatcagcaccatgcttgaggaagctgtccaatatgtgaagtttttgcagctccaaattaagcttctgagctctgatgatctctggatgtactctcccattgcttacaatggaatgaacattggactagacctcaatattaccccaaccaaacaaccataa

SEQ ID NO: 52260 - DNA, 186 bp, Glycine max
  Peptide Sequence Number=SeqID_169038
atggcggcggcgaaaggaacagcaccagaaaccctagaaagacgcacagcgaagatctccgaagcttcattttgggaacacccagagagcgatcagcactgggttttccgaattccaaaatgggtcggcttcagagatcgcttctgggaagaaaaaaggaaaatgaagtatcgcgcagcagtgtaa

SEQ ID NO: 52261 - DNA, 1077 bp, Glycine max
  Peptide Sequence Number=SeqID_169039
atggggcaggttgtgtcaaccgaggctaaagcaatgtataatgtggacttggctggtttgacattttgcagtcccaatgtgaatgtgttccgtgaccctaggtgggggcgtggccaggaaactccaggggaggatcccttggtggtgtctagatatgctgttaagtatgttcgtggcttacaagaagtgaaggatgaagcaagtgctaaagcttataggcttaaggtttcaagctgttgtaagcattatactgcttatgaccttgacaactggaaaggcattcatcgcttccattttgatgcaaaggtgacaaagcaagacttggaggatacggaccagcctccgttcaagagttgtgtggtggagggtcaccttcctcatgtttcctgctttccttacagatgtattgtttcagattgtgattcagtggaagtctattacaacgcaattcattacaccgcaactcctgaagatgcagtggctcttgcactgaaagcagtaaacttggaaaaagtagatgtagcaactgtagaccaggccttggtgtacaactacatagtcataatgagattgggcttctttgatgaccccaaatcacttccatttgcaaaccttggaccatctgacgtgtgtactaaagacaatcagcaactggctctagatgctgcaaagcaaggaatagttttgctggaaaataataataatggaacttttgccttatcccaaaccaacattaaaaaaatggctgtgattggaccaaatgctaatgccaccacagttatgattagcaactatgccggcataccttgccgctacactagccctttacaaggactacagaagtacacatcttccgtaaattatgcacctggttgtagcaatgttaaatgtggtaatcagagcctcattgcatcagcagttaaggcagcagcctctgctgatgcagtggtgttggtagttggattagaccaatctattgaagcagagggcctggatagagagaacctgagtttacctggttttcaacagaagcttgtgaaagatgttgcttctgctaccaaaggaaaagttatttaa

SEQ ID NO: 52262 - DNA, 552 bp, Glycine max
  Peptide Sequence Number=SeqID_169040
atgtggtatggcatgcctccaatacaattctcatcaatgtccatttcggtcgttgaaggttttgatttccaagttcatgtctgcgtttactctgacgctgacgctcactacactaggctccgtgaccagtctttaagctttctaatttcaacaacacagcgatcacctcttggtgtcctcatgagacaaggatatgcacttagttctgttgaagggcgggttgtgatggaattctttgacctctcagaggctagccaagcaaaaatatatgcttttaagtgtcacagaaaatctgaggctggaagggacatagtctatcctgtgaatgcaattgcattccaccccatatatggaacgtttgccacaggagtttgtgacggtactcagaatatcctaccagcattgctgcactgtcgtttagcagagatggacgccttttgggctttggttgttgcatcaagttacacattcgaagaagggcctaaagcaggaactacagcggaagctctctctctctcactgttcagtgtatatctctggaatacgtgctag

SEQ ID NO: 52263 - DNA, 558 bp, Glycine max
  Peptide Sequence Number=SeqID_169041
atgtcgcaaggttccgctcttttctctttcttctcttacagttcgcgcctttttctttctctttccaaaaccctgacttgcgtttgcccaaccacgcttgatttgttagctgggctactaagttatattgcttcgtgcacaaagttcctgtctgtggggaatgtccggacttattcggaatgggttatagatggggagtatgattggcccccaaaatgctgccaatgccagtctgttttggaagagggggatggatctcaaacaactcgactgggttgcttgcatgttatccacacaaattgcttggtctcgcatatcaagagttttcctccacatactgcccctgcaggatatgcgtgtccttcatgttctacttcaatatggcctcctaaaagtgtgaaagattcaggatcacgtcttcattccaagttgaaggaagctatcatgcagcgacttcatgctcacttgggaaggggtgatgttaagggttatgagatactatctggaaagctctttcaaggcaccatgtctgattctttattaaatggacagtactga

SEQ ID NO: 52264 - DNA, 300 bp, Glycine max
  Peptide Sequence Number=SeqID_169042
atgggggaggcacatgaagtaccccgagaccatactttagctgactttgagtctcacctcatatatgccactgaggggaaagcatttggtgaaagggagaaacttgatcatataaaggaaaggatgagggctattaaaggaagcgaagattctgcctttgttgacatggcagaactgtgcctagtacccgacgtcattatccctccaaagttcaaggtgccggattttgataagtacaaggggattacttgccccaagaatcacctgaagatgtacagcaggaaaatgggggcatactag

SEQ ID NO: 52265 - DNA, 534 bp, Glycine max
  Peptide Sequence Number=SeqID_169043
atgacctacatagaatcctcttgcagtggcaccctctacccaaatctatgcattcgttgcttggcccaatatgcaaaatccaccataaatggcccacaacacttggcccaatatgctttgtcagttagcctctctagagcacttcacacaagagagtaccttttgaaagtggtcaaggaaattaaggctaagggtgtcaagaacaacaaaagggagtacctaattgtgcaagattgtgtgaaccaaatcagtgatagtgtggaccaacttagccaagctatcaaagaactaagtaggctaaaccaacatcaacatggctccaccatcaatgataacatgttgtggcacataagcaatgttgagacatgggtgagcactgccttaacagatgctagtagttgtgtgtactcatttcctggtcataggatgagtaagagagcagcttctattaaagttaaagccatgaatgtggcagaagttactagtaatgcacttgccttgtttcttagatatgcatctaggtacagaaaataa

SEQ ID NO: 52266 - DNA, 4638 bp, Glycine max
  Peptide Sequence Number=SeqID_169044
atgagggttcttcagaatgttcgagagctcattggggactctagactcggtgtaaagaacgccctcgtcgttgcactcaatggggtaccgctagcagggggaacacaggaggtagatagtagcgcgggggttagaaggttctcgaacctagttgcagtaagcatggccgttaggccgttagaggactcttgggtctcgaataccaagcgtagcattggtgctttcattgagcaacaatggtggaagcaacatgttctagggtttctgcagatcgctggccaacaaccaccgcagtcatcactgtcgtcttcagcaggccagacaccgcaagcacataacgcagtccaccgtatgaagttggatgttccaagatttgatggctcggatccaaccggatggaccttcaagataacgcaattctttgaatatcacgcaacaccggatcaagagcgcttaacaatagcatcattctatatggaggggccagctctggcctggttccaatggatgcatcgcaacgcgcaactctcgtcgtgttcggcgttccttcacgcgctgcactctcggtttgcgtcgtcaacgtatgaagaccctacggggttactgtgtaagctacaacaacgctcctcaattagtgcgtatctttcagaattcgaatgcctcgcaaatcacgtggtagggttaccagcaacgttcgttttaagttgctttatttcggggttgaacccctctattcgcagagaagtacaggttttacaacctgtgtcgttagctcaagcggtggcgtatgcacgcttacaggaagaaaagatcatggactcacggcggcagcaaacatctcggcctctcatgtccactgcgaactcgaaaacaattacaggaacaacacctccttcgttcgcgaacaactcgtcgcgaggttcaaacccttctatcccattcaaaagattaaccccagaagaactcgcagtccgccgggagaaaggactatgtttccattgtgaggagaagtacttatggggacataaatgtgcgccctcactcttcctgttagtagcagaagatgatcaattgacgtctgaagtcgtctcgacacgaccatcctcaccaacagaagaattactcatggaaccacccccagcccagcgttgtttacatgcactatcgggacattcagcgcctgagaccttacgcttgaaaggaaccatcaacggatttcatgtcagtatcttgatagatggaggaagcacgcataatttcctccatcacagagtggtcgcgacactaggtttcactaccaagggggtggcaccattgaaggttatggtgggaaacggagaggaaataagatgccaggaactatgtacggccgttaacgtacaggtgcaggagcatacgttcatggtggactttcacatcctacccttatgtggcacagatgtagttctgggagtcgaatggctcaaaacattaggaccggttctgacagactacacgtctccatccatgaaattcatcactgagggtaagcttgtggagttacagggggaacgtgagcaaataggtgaacccgtgtctccctcgcaactgcgtcgtcttctacataggagcccctctagcaccttcttccatattagagtggaaacaaacacacaatcagctacaacaccacccatcttacccgagatttctgagttacttacgaaatactcatgcctgtttcaaccacttacaaaccttccgccatctcgatccacagatcacgctatcaatctgctacccaatgcgacaccagtgaatgtcaagctttatagatacccgtattaccaaaaacaagaaatagaagatcaagtatcggccatgcttgccaagggcttcattcaaccgagctccagtccattctcttcaccagttttgctggtaagtaagaaggatgagacatggcgcttctgcgtcgactattgggctctcaacgccattacggtgcgcgatcgcttccccatcccaaccgtggatgaattgcgcgatgaaatgggaggtgcttgctggttttcgaaactagatttgatgcagggatatcatcaaatcctgatgaacaaggaggacgttggaaagacagcatttcaaactcatcaagggcactatgagtttcgagttatgccttttggattgtgcaatgcaccatcctcattccaagccacaatgaatcaactattccaaccttatttacgcaaacatataatcgtcttcttcgacgacatattagtatacaacaagaccattgttgatcatcttcttcatctggaaaacgcctttcgtaccttagtatcaggtcagttctcacttaaactttctaaatgtatgttcgcgcagcagcaattggagtacttggggcatgtagtaacggtggcaggagtcaaaccggtgccggagaagcttctgagccatggtcagttccagtggtcaccggatgccactgatgcatttcaaaagctgaaagacgccattaccacagctcctgtgctcacgctgcttgacttcacgattccctttgttgtggagactgatgcatcgaacataggtatgggtgtcgttctgtcacagggaggccaccccattgcttttttcagcaagcaattctgcccgagaatggccaatgcgtccacttacgtcagagagttggcagccataaccgccgctgtgaagaagtggcggcagtatttactgggccacaaattcaccatcttgacaaatcataggagcttgggagagctcatgagccaagccattcaaactccagaacaacatcattatctcgtgaggttattgggattcgattacacgatccaatatcgttcaggccaaacaaaaacagtagcggatgcattattgcgagttaacgaggatactcaggcgtctctttacatgttgaccatgccccggttattgttcatggaagacctacgtaaggaactcgcaaacacaccagctttcaaggagttgtacgagcagattcaagctgatcctgcaaagtactcagattatttagtaacctcaggtctgattctacacaaggggcgcatctggcttcccccaacatcatccttcatcaaattactcctcgaagagttccaccaaacaccggtaggaggccatatggggtatgataatcgaaaaccaggagggttgctatgccctcttccggtactgacactgccatgggaagacttatcaatggattttatcgttggcttgcccgcatataaaggaaacacatgcatctttgtcgtcgtagatcatttctcaaaggggttacatttgggtatgcttcctccacaccacactgcgtacaccgtcgcgatgatgtttatggagatcatagggaagcttcatggaatgccgcgaagtataatctccgatcgtgaccctctctttgtaagcaagttttggaaggagctcttcgccttgagtgggacgcgccttcgtctaagctctgcgtatcatccgcaaatggacgggcaaatggaggtcgcaaaccgcgctattgaacaatacttgagagcatacgttcatcataagccggcgacgtggggccgttacttgctgtgggcggagtggtcctacaacacgccgtgccattcagcaacagggatgactccatttgaagtcacgtatggccggaaactgcctagctttccccaatatatcacgggcacatcatggatagacgcggtggatgatatcctcaaacaacgagaagaagtctttgccttcctacgaaaaaagctgagcaaagctcaagggcgcatgaaggagactacagataaacgacgctgggatcaggagtttgacgtgggtgactgggttttggtgaagcttaggccccatatacagacgtcggcgaaaggagcaccatactccaagttggccaaacgatactatggaccctttcagatcatagctcgaatgggtaaagtggcatataagctgaagttacctgatcattcaaggatacacctcgtgtttcacgtatctctccttaaggcttacatagcgggggcaaacaccagtagcagcgcagacctgccatcggaggctattgacaaccacccagttattaagcctctgactatcgtggcatccaagattattccttcggacgcggggccacgactcatggtgctagtgcaatgggctggactgccaccagaggattcttcgtgggaagactggtccgagttcaaagcccttcatgaccttgaggacaaggtcttgtttgaagagggtgtcactaggaaggcccaaaaggagagtaacccttccctctcacctagggactacgttagaaggttctcgagcctagttgcagtaagcatggccgttaggctgttagagtgtcaaactattgaccgcatgcaacacacaatgagagcaccaatcgttggcgaggtcgtcgcggcactggaagaagtcgtaaatgttttcggaggaggtggggaccataaagttgttgtggttgatgaaggtgacggagttgacgagggaggtgagaaacgagataacggtgttttcataggcaaaactcaacgtgaacttgagttgggagcaaacttgtacgagagtgataggaattcctag

SEQ ID NO: 52267 - DNA, 321 bp, Glycine max
  Peptide Sequence Number=SeqID_169045
atggaagacatgaaagttggggctgtgaaatataaaggtatgggttatcagaaaaatatgaggattcacgatgtcggatacaatgtccaggacatcctgcctgaaaatactggaattgctaaaagcattgaagctgcaggatccacgatgtcggatacaatgtccaggacatcctgcccgaaaatactggagttgctaaaagcattgaagctgcaggatccacgatgtcggatacgatgtccaggacatctggcccgaaaatactggacatataaatctgttatatctttaacagattattgtgcagttagcaagagataa

SEQ ID NO: 52268 - DNA, 324 bp, Glycine max
  Peptide Sequence Number=SeqID_169046
tctcggcctgaaaatgctgaaatcttcgggaaaggtgcagaagatgctgacatctacggggaagacgttgacatcctcgggaaaggtgaagcaaatgagactttatcgaagtctcggctggaagacgctaagatttccgggaaaggtgtagaccctgatatcttcggggaaggtgctagtgatgacacatctctgggagaggtgctggtgacgacattagtcactgcatgctttcgggctttgagtctcacggatagcaaatgcgattttacgcagtctcggtcggaacacactaatatctacgggaaaggtgccggtgacgat

SEQ ID NO: 52269 - DNA, 219 bp, Glycine max
  Peptide Sequence Number=SeqID_169047
gccaagccatacttgcaggctggtgcatttgagattgtggatgaggacataagaggaagctttgatcccttgagtatgaggaaggcagctttcattgctataaagtcagtcgagagagatgcatcacagaggccatctattgcagaggtactagcagagctaaaggaaacctacaatattcagctcagattccttgaatcttgtcaaaatgagaactga

SEQ ID NO: 52270 - DNA, 609 bp, Glycine max
  Peptide Sequence Number=SeqID_169048
atgggtttaatgggcaccgtcgttgaactggattatccaaagatgggttttatatacactgtctttgaaagtcaagtcaattttatcttgttcccttgcgtactcgcagtgtactctagcctgctacctgagaaaaactggatttggaggccagcacctccagacaaggtaagagtggaaggaagcttaagttttcatatcggcagcaatttttcatatctccctaaggcagaccatcaaccatctagcaattcttcattccagcgcccaattgggccaattcatccaccgcacttgtatcatcaaatggggagtggtgaaagggagatggtgtctctgtatgaacaaggtttggtcaatccatattcatccaacatggctaatactgatactaatagcagtggtgtttctcagcatgattggcctatgagcttcatcaataacaataatgttagtaatagagcctctgatgcctctttgtggagcaccatcagcaccactattggtggtaactctgagaggactagtactagtggtgttggtgctggttcttcttctttcgtaaaaaaccaatggcctaatcttccagggtatggccctccaccgtga

SEQ ID NO: 52271 - DNA, 249 bp, Glycine max
  Peptide Sequence Number=SeqID_169049
atgcctcagatattcattcacagacaaaattactcacagaaattcagaaacaatgcaaatatcagcgcttcattatcatcgcaaaccctgatgcttttaacgcaaatatctggtgattttatcttgctgtgtatgccagagactggaccgagatcgcactacggcgagacaaatgaggtaccggagactcgaaaaggtaaggagagcgaagatgtcaagatgggcgacggcgagagaaatgagggttga

SEQ ID NO: 52272 - DNA, 633 bp, Glycine max
  Peptide Sequence Number=SeqID_169050
atggatgtccaacgtatactgaagtatggtccttggagttttgacaagcatttgttgatccgaggagttatcaaaccatgtgaaagtccaagccaagttcctcttttcacaatcccattttgggtgcaaaataacaacaacctttttagacctttcatgaggattgggatcttgttggatttggggcatgttgatgagttgtgtgagatgttgttctccaaaggtgtggatgatggaaactatcattggggacctaatctcaagggattgcaagcatggatgatcactaataatatgttaccagctagagacaaggtcattaatgaggcaggaattttcaaaaatcctaagattatctctcctcaatcaaatcaagaatcattacacattaagactccaaataatgatgaaatgaatgttgaggagtctgttgttaatgatttggtggaagacaaacctatttggaggatcattggcttctatggccaccctgatcgtgagaatagggaggattcttggaacttgttgcgttttctggctgaagacacatccctcccttggtttaccattggtgatttcaatgacttgctaaataatgatgagaagattggccttgttgatttagactattga

SEQ ID NO: 52273 - DNA, 669 bp, Glycine max
  Peptide Sequence Number=SeqID_169051
atggcttcctatgatggtagcttcttcttggctcatcttcttcttgaagtggactccattgatgaagaagatccaaggcctacaagctccacatggagctacatcaaaattgattcatcctatgatgatttccttctaccttttctgtgtccaaactatcccctcggtattcacatcatacccaccactaccatcaagttcatgctcgatcacattgctccaaggtttccaccattggacctcatgaaaaagaaaggcaaggttcctcctcatagcaaacccatgccttatccaggcccaatggacaatgttgccttgcgtctaattccctatcattggagtaggtactttacaagggatgttgctaagaagatttttgcttttaagccagacgttgagtttgatcaaaatgatgtcatgctcttctattttaaagacatgtatgaaaactctcgtcttgtgtacacttcaaaatataacaaggaagacacctccaatcatatccatatggagataatgagttctatcaatgtctcatccatgatattcctcctcttcgctctcgatttgtctttgacttgcacaagtgctcaaaagttgaacccttgggttccaggtcaaggaatggcggctgaacttcagaggaaacaagacaaacccaactgctag

SEQ ID NO: 52274 - DNA, 324 bp, Glycine max
  Peptide Sequence Number=SeqID_169052
atgggtttcaatgatgctccatcagcgatggtttctagaaaatcgtcattaatgaaaacacgtggtcactcatcttcctcactctcgtgctcatctaactttaaacccactcgtgctcgtgctcttgtgttggtggtgaccctcaacgtcacttttgttcgcatctcacgtgtattcttggccccaccatcgccctcgccattgttttacttagcctcactcatagaatccaagtttcaaaaacatggcctagccttccatcacagtcccaatgctaaggtctctggcataaattttgtgaaggagaaggaatattttgtgtag

SEQ ID NO: 52275 - DNA, 816 bp, Glycine max
  Peptide Sequence Number=SeqID_169053
atgttctggaggaatactaagttttccaacaagaaattcattatttccaaggttttgggaactaaggcaactaggtgccttcgtgatggaagcacataccaggaaggatgggagaagaactatgacactcatgttacaaggacgttgtacaaagagaatgttgataaagcaggagaccaggagactattatgtacaacatgttgtgtgagaaggctaagatttggaccaacattcttaaaaatagtgttctccacaaggtaggatcaaagacaacactatcagttctccataagtttgtactttttcacttgatggagaatctgccatttgatctacctcacaccatctacatcaatatgctgagaaacttgaaggggctaggtggtctagacaatatctattatgctaccctcatcaacaagttgctttgggatcaagacgtgtatcatgtcttcaatgagatggacgatgattctcatcacaccctaatggccaaagctgcccctgccccaaaaagagcaaaaaccgtccaaccagctctagaactcaaagagtttgtcattccttttgtcattctcaaatgcattaagacaagggctactaaagccaaccccaagtttggtgagaaagagtggacaatctcattcactagcaacaaggagtatcaagcttcatcttcctcaaataatgagtctacaaacgaaactcctatctctcatagttcccttaacacaaccgcgtccacctccatcccccatccatctcaagaagttcaaaagagcattccaacaaaaggaatccttgacaaatgctga

SEQ ID NO: 52276 - DNA, 324 bp, Glycine max
  Peptide Sequence Number=SeqID_169054
atggggaagggtgttgcccttgctcctacatatcctcagcaaaaaaaaggcatttgggaccatggcagctcgctaagacttacacctgaagtaactggctcacccaggcgagtaggttccttcaggctaaagtcttctaaaggcccaagcgagccagaggctagcctggtgttaaacagcacagttcgactagcaagaatcaaaacattggtgaatgatagtccccggacgaaattaggatctaacaatgtcgatcactatttctctcttcagaccctttgtctttttgcttatgacaaaaagggaagaagaaggaatttttaa

SEQ ID NO: 52277 - DNA, 417 bp, Glycine max
  Peptide Sequence Number=SeqID_169055
atgtctagtgcagccacaagtcatcaagatgcaactgcattggtttgcacctggcacccaagaataggttcgtccatcaacagagccactgtctaccttcctggactgcacatctcaagggccactgatgtcaagatagttgctaacaagatggaagtagtcaactaccctcgcaattggagttccctgtttagtgggaataagcttgcctccattttcggttctgatggaagcaacaatactaagcatcataactttattcaagtgttatgtccatttcggaactatcacttcgatgatgcttgcgtttacttcaccaaggatgtcgatggctactctttcattcaacatcttctacaacttcctactattcagtctgaatggacttataatcttttgaagatgactaaagtataa

SEQ ID NO: 52278 - DNA, 714 bp, Glycine max
  Peptide Sequence Number=SeqID_169056
atgttgagcttgtacgaagctgctgaactaagaatgcatggagaggatatacttgaagaagcacataatttcgctcttgttcagttaactaagtctctaactacccaattaagtccttctatgattgcacaagtcaagcatagcttaagacgatcacttcgaaagggattgcctaggctggaggccacatattatatgtctttctacgaagaagattcttcacatgatgaaaaattgctaacatttgcaaaactagattttaatatgttgcaggagttacatcagaaagaagttaacaatgtgaccaggtggtggattaagaatttaaatgtctcaacgaaattgccatttgtacgagataggattgcagaatgttacttttggattttgggaatatactttgagccacaatattctcttgctagaaggataacaacgaaagtaattgctctatgttctgtcattgatgacatgtatgatgcctatggaaccattgacgaacttgagcttttcaccaatgcaattgagaggtgggatatttgttgcttggatgatctcccagaatacatgaaagtatgttatatagaaattttgaatgtttatgaagaaatagaggaagagatgagaaaacaaggaaaagtatattgcatcaagtatgctaagaaagagcaacagccaaactttattgaaggaaaggtcaaccacaagcagtga

SEQ ID NO: 52279 - DNA, 225 bp, Glycine max
  Peptide Sequence Number=SeqID_169057
atgcctcgctccatagaaaatgagtgtctcgttgagcttgagaccaacctttttgagttcctaaatattgaaaaagtgttcaacatggatggaaggctcattatctttgtatatggtggtaatctctatggttgggatgaactcgacaacaaaggagttacagatggccattgcagagagtttgagagttcagaggtagggtttagatttcaaagaagaagatga

SEQ ID NO: 52280 - DNA, 729 bp, Glycine max
  Peptide Sequence Number=SeqID_169058
atgtttggctgtttcttgtccctgccccattttgctgtttttgctttgcctgcccagacctttcttgttgcccttgcatcctttgttgctgctgatttctgcatttctcttttgagggattggcttgcttggccacagatattgaaattaaaagattggcctccttctaatttatttgaggaacaattgcctcgtcattgtgctgagttcatatcttccttacccttcaaggaatatactgatcctcacaaaggttctcttaaccttgctgtgaagttgcctaatggttctctaaagccagacctggggccaaaaacatatattgcttatggatttcttcaggagcttggacgtggtgattcagtgactaagctccattgtgatatgtctgatgcagtaaatgtgttgactcatattgctgaagtgaaactggattctgatcaacttactgtcattgagaagttgaagcaaaagcatctcgagcaagagaaaagggagctacttggcgatgatcaggatggagaaactaatgttgacatgcttaataattcatcttctacaataaatgctttggacaggcaaagtagtgttgaagtcatggaacaagaaggtggattatgtgatgggaaagaagttgatcagtttcatcaaccgtctggtagtaatgaggttgccattgctaatgaggatggtatttcatatggatcagagctcatagaggttgacaaa

SEQ ID NO: 52281 - DNA, 513 bp, Glycine max
  Peptide Sequence Number=SeqID_169059
atggaagttgctgatcccacttgcataactgctcgtacctgctcaggaactctactgagttttaaaagattggctaagattttgttaaaacataagcacttagacaatgaaggaaagctggagttgctgcacatgatgattcacgatgtcggatacaatgtccaggacatcctgcctgaaaatactggaattgctaaaagcattgaagctgcaggatccacgatgtcggatacaatgtccaggacatcctgcccgaaaatactggagttgctaaaagcattgaagctgcaggatccacgatgtcggatacgatgtccaggacatctggcccgaaaatactggacatataaatctgttatatctttaacagattattgtgcagataatgatagatctcatccagcacaagtagttgcagcccagatacgcacactgctttataaacatggaggctgcacgagttctgtaccaagtccgggattgaagagttattttgtgagttttgggacttga

SEQ ID NO: 52282 - DNA, 1365 bp, Glycine max
  Peptide Sequence Number=SeqID_169060
atggacacatcattggtgtttaccgtgaggaggcgtgaaccagagctgatagctccggcgaaacccacccctcgcgaagtgaagctactatccgacatagatgaccaagatgggttacggttccaaattccggtgatacagatctatcgccacgacccatccatggcagggaaagaccctgttgaggttatcagaaaggctttggccagaacgcttgtgttctactatccttttgctggtaggctcagggaaggacgtgatcggaaactgatggtggattgtactggggaattaggtgttttgttcattgaggctgatgcagatgtcactcttaagcattttggtgatgctcttcaacctcctttcccatgctgggaggaactcctttatgatgttcctggttcccaaggagttcttaacactcccctcctgcttatacaggtaacgcggctcaagtgcgggggtttcatattgactctccggctgaaccacacgatgagcgacgcagccggtctggtccaattcatgagcgcgctgggcgaaatagctcgcgggaggcacgagccatcggtcccaccagtgtggcgcagagagctcctgaacgcgcgggacccaccaagagtcacgtgcacccaccgcgaatacgaacaagtccccgacaccaaaggcaccatcatccccttagacgacatggcccatcgctctttcttcttcggccccagcgaggtgtccgccatccgccgcctcatcccacgcgccgatcaatgctcctcctccaacttcgaggttctcaccgcatgcctttggcgctgccgcaccatagcgctgcagccagacaaagacgaggaggttcgcatcctctgcatagtcaacgcgcgcgccaagtttgacccacctttaccaagtggttactacggcaacgcttttgcgttccccgctgcggtcaccactgcagggaagctgtgcgagaatcctttgggatacgctgtcgagttggtgagaaaagcgaaagcggacgtgactgaggaatacatgcactcggtggcgaatttaatggtggccaagggacggcctcacttcactgttgtgagatcctatgttgtgtcagatgtgactcgtgctgggtttggaaacgttgagtttgggtgggggaaggctgtttatggaggacccgccaagggaggggttggagccatacctggtgttgctagcttttacatacctttcaagaatgctaaaggagaggaagggttggttataccggtttgtttgccgtctgaggccatggagaggtttcagaaggagttgaacagtgtgcttaacaaccacatcgtccaacctagcatcattgtttcttccttgtag

SEQ ID NO: 52283 - DNA, 1632 bp, Glycine max
  Peptide Sequence Number=SeqID_169061
atgcatttggtgttattcaaggttgaagggaaccaccggttaccaccaaccactctttcacctggagacatggtttgtgtgagaacatatgacagcatgggtgcaattacaacttcttgcatacaaggatttgtgaacagttttggggatgatggctatagtattacagttgctttagagtcacgccatggtgatcctacattctctaaactatttgggaagagtgtgcgcattgaccgtattcaaggactggctgatacacttacttatgagcgcaactgtgaagctttaatgctgcttcagaagaatggtttacgaaagaagaatccttcaatttctgttgttgctacactgtttggagatggggaagatgttgcatggcttgagaaaaatcatttggctgactgggcagaagaaaaattggatggaagattaggaaatgaaacctttgatgattctcagtggagagcaattgcaatgggtttgaataaaaagaggcctgtattggttatccaaggccctcctggtacaggcaagactggtttgctcaagcaacttatagcatgtgctgttcagcaaggtgaaagggttcttgttacagcacctactaatgcagctgttgataacatggtagaaaagctttcaaatgttggattaaatatagtgcgggttggaaatccagctcgtatatcaaaaacagtgggatcaaagtctttggaagaaattgtaaatgctaagcttgcaagttttcgagaagagtatgagaggaagaagtcagatctaagaaaagatctaagacattgtttaagggatgattcactagcttcaggcatacgccaacttctgaagcaactgggaaggtcactgaagaaaaaggaaaagcagaccgtaattgaagttctgtctagtgctcaagttgtggttgccactaatactggagcagctgaccctttggttcgaaggctagatacctttgatttggttgtcatagatgaagcgggacaggcaattgaaccctcttgctggattcctatattgcagggaaagcgctgcattcttgctggtgatcaatgccaacttgctcctgtcatattatctagaaaggccttagaagttggtctaggaatatctctactggagagagctgcaactttgcatgaagggattctcaccactaggttaacaacacaataccgtatgaatgatgcaattgctagttgggcttcaaaggagatgtacggaggattattgaagtcctctgagactgtcttttctcatcttctagtagactctccttttgttaagcctacttggataacacaatgcccgctgctattgctagatactagaatgccatatggaagtctgtcagttggttgtgaagagcatctagacccggctggaacaggctcactttataatgaaggagaagctgagatagttttgcagcatgtattttccttaatctatgccggtgttagcccaacagctattgcagtgcaatccccttatgttgctcaagtacaacttttgagggacaagcttgatgaatttccagaagcagcaggtactgaggttgcaaccattgacagttttcaaggtcgggaagctgatgcagtaattttatccatg

SEQ ID NO: 52284 - DNA, 531 bp, Glycine max
  Peptide Sequence Number=SeqID_169062
atgaaaaaggactcgacatgccgcaatcctcttgaaagaacttcagaaacgcggtcacaagtgatgcatgactattgtcagcttgtgcccatcaccagctgctcttctccctcagctgctctgtctccggcgttgacattggaggagggacttgagaaactgaaggaggctctccaaatcttgaattctccttccccttcttcccctactggattccttaggtttcaggtggcgctccctcccagtcctaagaccttcactttgttttgctcccaaccccactcctcctcggtctttcctctcatttatgtttccaagaacgacgccgactctaaatcactctatgtcaatttggatgataatgtgagtcaccggaaagaaagccgctcccagattgagttagatgagctggaaagtgtttccattctgtcaatgacccttgcatgggatgaattttccttctctacttttcaagaagcccattattcacttcaagattctctagaccaggtgcctgacatgcctttttga

SEQ ID NO: 52285 - DNA, 336 bp, Glycine max
  Peptide Sequence Number=SeqID_169063
atgaaccctcactctcactttcgcctctaccatgcaacgacgtcgaaggtgctttttataatggtgatatgttgtgctccccgccagtttttgtcccctaaaaattggaaattcagtttgtcgagggaaattcaggtttcttgtgaggttgatgagacactactacttgtttcactttctgttgtcaaagcacttcttgaggtcatctgcattcttgaaggtattgtatttactgcaattctagtcatgcgtgtgatttgggcagcagtttcttacatccagtcaagtgggaatagctttaatcaagggacgaattcctttggtggtgtagcctaa

SEQ ID NO: 52286 - DNA, 381 bp, Glycine max
  Peptide Sequence Number=SeqID_169064
atggagaaatatataaaagatgtcatacgggttgtggaagcttcgggactccacctgacggcaccatcgacgttggggattcgttgggctccattgtcaggcggaaccagagcagccatcgcgccggactcgccgaacagagcgcggttgtcggcttggttcttcgccaatagcctcaacttggccatcgccgatcgcttcacggccacagacggcgagtgcaggctcgtgctcaggttagggttggttgtcgatgtgaggagcagcaggaggaggttgggaggaggagacggtggcgagcctttggagcttgctggagatattgctactacaggcagagaaatcgctcagagcttgagagagctcgaggagttgttgtaa

SEQ ID NO: 52287 - DNA, 2097 bp, Glycine max
  Peptide Sequence Number=SeqID_169065
atggcattagtgtcttcactttctcctgcgaccccttcttcggttcaaaccaacactttgaacccattgggttggactgatgatcagatcctggagaaggtttacattacccacgtccacaccgctgaaaggtacgatgtggaatcgcttttcaacgttactgcaaacatcatcaagcgttctactgcacttgctgacagtgttgctgttaagactggcacacccgttggtcttattgaagacaaggttcctttgtccactttcgacccaccgttcctaaaacttaagcatattgcttctcagatgatgaacacaccgcacggtgagcatcatgcacacagcacagcaatgtcgatccttgaccagctgagaacgtacacatgggatggaaaagcgatattggttctggcggctttggctttggagtatggaaacttctggcacctcgtccagactccgagtggagaccatctgggaagatcactggcacagatgagccgagttcacatcgtggagaggaacaggcaagccgtggctgactacaacagcttggtcaagaacttgctcatcgcggttgagtgcatcaccgagttggagaggctttccaccaaaggttatgacttgaaggacgtcccagccttggcagaagccatgcaagagatccctgttgctgtctactgggctatcgtcaccactgttgtctgtgctaatcactttgatttcctccttggtgaatcggactctagatacgaaatagccaattttgacgacaagcttgcagctgttatcagcaaattaaaggcgaatctcaccaggagcagaaagaaaataggtgacctagaagactactggaggcgtaagaagttgcttcaaacccccacagaaattgtagaggttctcaaggttctgatctaccacaacgaagttcacgacccccatgtctacgatggactcaccagacaaatggttagcatcgaagtgttcaggaagaaacacgtgttactgttcatttcggggcttgacagcatcagagatgaggttcggcttctgcaatcaatctatgagggattacaggaagatccaagggaagtgaaaggatacaggaaagaggatttcaggattctgtgggtccctgtcgtggatgagtggaatcttctgcacagggcagagtatgataacctgaagcttgaaatgccgtggtatgtgacggaatacttctaccccttggcgggaatcaggctcataagggaggacttgaactacaagaataaacccatcatccctgtgctcaaccctcaaggccgggtcgtcaactacaatgcaatgcacatgattttcgtctggggcatcgatgccttccctttcagaccctctgatgatgatgtcctcacccagaaatggaattggttctgggccgaaatgaagaaagtcaatcccaagctgcaagaccttataaaagcggacagtttcatcttcatatatggaggcagtgacaagaagtggctgcaagatttcgctcaggcagtggaaagaatcaaaaggcatgagatcatcaagagggcagacgcggtgatagagcactatccattcggaagggaagatcacaggatcgttcctcgcttctggattggcatagagagcctgttcgcgaacatgattcagaagacacacaaggaccctaccattgaggagattaagagcttgctctgtctgaaacagcaacaacccgggtgggttcttctcagcaaagggtcgaacgtgaagttgttggggagtggggacccaatgctggcaactgcagctgatttcgagatatggaaggaaaaggtgctggagaaagcagggtttgacgtggctttcaaggaatactatgagcagaagcgtcgcaactaccctcaggaatgctcgaacatgcagttggctaactaccctgctgatattcttcaccccattaattgccctgatgctgcttgtggcagatccatggagattgcttctgtaagttacaagtgctgccacggtcaagcagctcatcacaaggctgaagttccagagagtggcgatgtcatgattgagaagaagctctacgcttcttaa

SEQ ID NO: 52288 - DNA, 2634 bp, Glycine max
  Peptide Sequence Number=SeqID_169066
atggaagaccatgttagtaatatgtatgaggtggtgaatatgccaattgatggggcagcaaataagtctgatgattgtagtgatgcattcaacactacagaggtctttccttcccgagaagctatgttgaattgggctcgagatgttgcaaaagagaatggatttgttcttattattttgagatcagagacatctacaacttgtactagatctacaagatgtaatcaaagaaagacatttgtaattatgggctgtgatagaagtggaaaatatagaggaccatacaagaatgaattatcccggaaggtgagtggtactagaaaatgtgagtgtcccttcaagctaaagggaaaagctttgaaaaaggctgaaggatggattgttaaggtaatgtgtggttgtcacaaccatgacttagaggaaacattagtgggtcatccatatgctggtcggttgagtgctgaagagaagtctttggtcgatgctttgacaaagagcatgatgaagccaaaagacattctattgacattgaaagatcataacatgggtaacgtcactactatcaagcagatttacaatgcacgacaggcttatcgatcctctaaaaagggttcagaaatgcagcacctgttgaaattattggaacatgatcgatatgtgtattggcacagaaaagtggatgattccgatgctattagagacatattctggacacatccagacgccattaaacttctgggtgctttcaacactgtattggtcattgatagtacttataaaaccactaggtatcagttaccactacttgagatcgttggagttacttcaaccgagttaacattctctgctgcatttgcttttgtggagtctgagcgagctgaaaattttacttgggcactaaaaaaattaagaggattgattgccaaagatgatgacatgccccaagtgattgtgactgttggagacattgctctgatgagtgcagtgcaggtggtctttccaagctcttctaatttgttatgtcgttttcatatcaaccagaatgtgaaggctaaatgcaagtcgatagttcatttgaaggagaaacaagaactgatgatggatgcatgggatgttgtcgtgaattctcctaatgagggtgaatatatgcagcgtctggcattttttgaaaatgtttgcttagattttcctattttatgtgattatgtgaaaaatacatggctgattccacacaaggaaaaatttgtcactgcatggacaaatcaggtgatgcatttgggtaacacagcaaccaatagggttgaggcgacacattggagattgaagactttgcttcaagatagcaaggaggatatgtgtagttattgggatgctatgaagaacatcattacattgcaacacaaagagattgaggcgtcattcgagaaaagcataaatgtagtggaacaccggcataatactccattttacatcaaattggtgggatttgtatcaaggagtgcattaagtcatataattgatgagtatgatcgagttaagactgctggtattgatagttctatctgtgggtgcatagttagaaccacacatggtctaccttgtgcatgtgaacttgctaggtacaatacgatgtgtcacccaattcccttggaggcgattcatgttcattggaggaaattaaagtttagtgaccacgtatcaaatgatgaggggactgagttatcattgcaacctgaaattggtgctttgtacaaccgatttcaggaacttgattatgctgggaaaattatactaatggctaaattgcatgaaatagcatttcctgttaaaatttccaagtgtccacctcttgaagaggtagggacaaagcatgctctagagggtccacggttgaaaagtgatggatcaactaaatttgatccttcgtattgggagcatgttcatgcattgcaccctacccatgatatcacaaaatctctcccttcatctcagaaaccagtccatgagtctaaacgcaggagagttctgccaatgatggaccaatttccggttgagatccatccatttattgaagacattattgatgtgaaaggagattcaaattgtggttatcgtgctgttgcagctcaacttggtatgggtgaggaatcgtgggctctagtccgtcaggatttaattagagagcttcaacagtggcaagataattatgccaaactctttggtagcaatgaccgagtggctgaattgaggcaatctttgtatgttggcaagcaggcatctgttgctagttggatgaccataccagatatgggctatgtaattgcctcaagatataacgtggtcctggtcactttatccttacaagagtgcatgacttttttccctcttagaggacgaccaccactatctcagtcaagttaccgtcttatttccattgggtttgtgcataaatgtcactttgtacaggttgttttgaaggctgactcagtgttacctcccaccgctttgcagtggtcaagatattgtaatgctgaatctcgttcttgggaaacttcatatgttagtcgtatgcaacaatttaggtcattgtttccacaaaaagaaataggttatgtagacattattgaggattaa

SEQ ID NO: 52289 - DNA, 407 bp, Glycine max
  Peptide Sequence Number=SeqID_169067
atggcacaactcaacctcacgttgctactcattttcctctctcttctcttttcatttcttgtcaccccaattgagccatcatcattgacaaggcataaaaattctcaaacaatgacctacatagagtcctcttgcagtagcaccctatactcaaatctttgcatccgttgccttgccaaatatgtcaaatccaccctaaatggacccggacacttagcccaatataccttgtcaatgagcctctctagagctattcacacaagagggtaccttttaaaagtggtcaaggaaatgaaggccaagggtgtcaagaacaacaaaagggagtacttaatcgtgcaagattgtgtgaaccaaatcactgatagtgtgaaacaacttagccaagccacgaaagaactacgcag

SEQ ID NO: 52290 - DNA, 444 bp, Glycine max
  Peptide Sequence Number=SeqID_169068
atggttgtcatcaccattattatgattgtcaacgccatcagtatcgtgattgttaccaccatcatcatgatccattgtccccatcacagctcaccggcatcggatgtagaggttgtgatgacggtcatgagagttgttccaacggtaatcattgtagtaattgcagcaaaggtggtgataatgatgtatggacatagaagtagtagtgacaatgatgacaataatcataaagtaatggtgttgacaaagacgatagtagtggtaacaatcatgacggtagtggttagaataattatcaagatagtgataataatgacaatgatgactgtaagggtagcgatgacaattatctcatccgttaattataatataatgatccctattaatggttctcatttctcattttatggaagcaacaagaaaatgcgtagagagagcttttga

SEQ ID NO: 52291 - DNA, 2004 bp, Glycine max
  Peptide Sequence Number=SeqID_169069
atgtcgatctccaacactcaactaaagcctctgcttcccaacccatttaatttgagtaatactgagatcgttgaaaaagtttatgtatcccacacttacgacgacgagatgttcgataatgagcccctcttcaacgtcgtgtccaacattatcaagctatcaactcgaattgttggggctcttcttaagatagatgagcccaatggatttttaggaaatcccataaccataagcagtttcaaaccagaattctccactctgaagctgatgtcgtgccagatgatgaccctaccttgggggccagaaaacgcacaccaaacaacccttcggattcttcaacaactgagaaagtactcttgggacgcaaaagcgctgatagctctagcggctttcgctttggagtatggaaatttctggaaccttcagcaggcatcagaccctctgggaaactcgttgagactgctgaatcaaatccaacacagacagcttcccgtgactgatatcaacgcaacagtgaagttggtcatggaggccgttgagaagatcagacggtggggaaccttgtcttctgatgaaacttatgagactgaggatgttcccgctctatcagatgcattgcaactcatccccctccttgtttactgggttgtcgcttccctcgtcgcttgcaacaccaacatccagggtgtttcgaactatgcattatcggacttccgtggcaaactttctaccgctctggatgagttcaagcatcacctggagatatgcgagcaacaaaaagctagtatagaagactaccggagacgtaagaaggcctttaaaaagcctaaagacatcgtcgactttttgaagcttctgatcaatcaaaatggatacaagtctcaaatatatgatggcaacgccaacagaaatgtgaatgttgaggttttcaaggagaagtatgtgttgctgttcatttcggggctggacagaattgaagacgagattcggcttctgaattcaatctatgagagacttgtggaagatccgaatgacaagagcggtttcaagaaagaggaattcaagattttgtggatcccgatcgagaacaaatggggggatgctaggagggaacttttcaacactttgaagagtgacataaagtggtacgtggtggagtacgctcaagtacccttacctggcatcaggctaattgaagaggatctcaggttccatggtaaacctatccttccggtggtgaagcctcaaggtgtcctgttgaacgatgatgccttggacatcattttcgaatgggggatccacgcattccctttcagaaaatccgatgcttacctacttgctcagaaatggaaatggttctgggatgaggtcaagaaaacaaatcttcatggtatacaggtgaaaggtgataggtatatcttcatatatggaggtagcgacaagtggacccgagaattcactgtggcagtggataaaattaaaaggcacgatacaataaggagggcagatgcaataatagactattaccatttaggaaaggatgaccccaagatagttcctcgattctggattggcatagaaggcaaaaggcaaaagaagcactccgagaatttggactgtgagatccaagaaattatcaggtctctgctctgcctcaagcaggatacacaaggatgggccattctgagcaaagggtccaatgtgaggattctgggtcacggccaacctatgtatcaaactgtggcagattttgaaaagtggaaagaaagagtgcttgtcaaagaaggctttgacattgcattccaagaatattatgacacacaacgtgatctacctgctcctcaaccatgtgaatttaacactttggatgtcctagcaaccataacatgcccaaatgcctcttgtggacgtgtgatggaggtcacatctgttaattacaagtgctgtcatggtggtaatgttgctgaccatgctattaaatcgaggtccacaaccgcaacctaa

SEQ ID NO: 52292 - DNA, 594 bp, Glycine max
  Peptide Sequence Number=SeqID_169070
atgaggtcatccagttgtatgactcgtgcacaagttaaatctctcgattgtgtcggttcaggagtttctaaagttggtcttgctgtattcttttacaaaaccacgtttggccagaagcaatgctgtccaagcttcttcggttttgctcaaccttgtttaactgtcaatttcaagaggatgatttggtcagttagaagcagcttaaatgacagcagttttagtccttccacttcaaatggctctaatggaaggacccgcataattagagtgattcaagagtttcagaccaagttaggttctaaaattcaggaggtaaagaaaaatcttccgatgaagctgcttttcttcttggttggattttattgcgcaacggcctttgccactgttattggacaaactggtgactgggatattctgtctgctgctttggctgtggcggttgtggaaggcattggggctctcatgtacagggcttctcttcctttagcagaagttacaattcagtgcatgaaagttggagctagttcaagttctaaggttaaaatccttgaaagccagttctcatatccagaagctatgtcattcaagctatga

SEQ ID NO: 52293 - DNA, 696 bp, Glycine max
  Peptide Sequence Number=SeqID_169071
atgtggacacttcgtcgagcttcttttcgtctcagtacgaggcgaggagttaacgcgggagctagccgtgcttctgctgtcaaattagtggcaaccactagtgaggaaaatgaggctggtatccctcagtctcgtcaaatcacttatggtagatttctgtcggctggcatgggtcgtgtgtccctgaaatttgctgtgggcaggcacgaactttcctcgcaagccggtgctagcagcacgaaagacgatgatgatgatttggagatacacggaagtaatgatgaatctgacgctgatctgtctgacggggatgaggatggcgaaaaaccacatgatgagctggagttatcagatgctgagattgatccaaccaagaaaaaatcacaagctagatggactcaattgaaactattcaaggtaattttaaatgctcctggtttgtccgttgattctgctctcagtaagtgggctgggcaagggaaagaactaagtcggaaggagatctttttggccgtgcgtgagcttcggagacgtaaaatgtatggcagggctttccagaacaaaagtgaaaattttaaactaaagatttacactttactaagattcaagtcagagaaacattacagattttcaaaggtaccacgaagagctaaactggaaattgttggagatccaacatcaactagtgatttatga

SEQ ID NO: 52294 - DNA, 204 bp, Glycine max
  Peptide Sequence Number=SeqID_169072
atggtggtggcacatgcaaatgctggtgtaaggggacaggtcacacgcgattacaatggtgtagggagaagggtcgcacacatttacagaggtgacagtgtctggcgcgtggtggttggttttggtggctatgatgtcatgaaggtggtggtgtctagcgcgcggtggttggttttggtggctgcgaaggtggtggtggcttag

SEQ ID NO: 52295 - DNA, 1338 bp, Glycine max
  Peptide Sequence Number=SeqID_169073
atgcaggagctcatgatgaagaggcgtgctgctgctcttgctgttcctacgaatgatatggccgtgcgagctcggcttcgacatcttggtgaaccgataactctgtttggtgagagggagatggagagacgggacagattgcggatgattatggcgaagctggatgcagaaggtcagctggagaagctgatgaaagctcatgaggaagaagaggctgcagcttctgcttcgatagatgaggctgaggaagaactgcagtatcctttttacactgaagggtcaaaggctctcctcgatgccagaatttatattgctaaatattctttgacaagggctgcattacgaattcaacgtgcacagagaagaagggatgatccagatgaagatatggatgcagagatgaattgggcattgaagcaggctgggaatttgagtcttgaattcagtgaaattggagatgatcggccactttctggttgctccttctcaagggatggaaaatggcttgctacctgttctctgacaggagcttccaagttgtggagcatgcccaaaataaaaaagcattccagctttaagggtcacacagagcgtgctactgatgttgcttattctcctgttcatgatcatttagcaactgcctctgctgatcgaacagcaaagtattggaatcaaggatctcttttgaagacatttgagggtcatctagaccgtcttgcacgcattgccttccatccatcagggaagtacctgggcactgctagctttgacaagacatggagattatgggacatagaaacaggagacgagttgcttcttcaagaaggccatagtagaagtgtatatggtttggctttccacaatgatggatcattggctgcatcttgtggactagactccctggctcgtgtttgggacctccgaactggaagaagtatccttgcactggaaggtcatgtcaaaccggttctcggcatcagtttttcacccaatggatatcatctagccacgggtggtgaagacaacacttgtcggatttgggatttgaggaagaagaaatccttttatactattcctgctcactctaatttaatttcacaagttaaatttgagccacaagaaggttactttttggtaactgcctcgtatgatatgactgctaaggtttggtcaggccgtgactttaagcctgtgaagacactatcagggcatgaagctaaagttacttctgtggatgttcttggagatggcgggtatattgttaccgtctcccatgatcgcaccataaagctgtggtccagcaatacgactgacgaacaagctatggatgttgactaa

SEQ ID NO: 52296 - DNA, 2412 bp, Glycine max
  Peptide Sequence Number=SeqID_169074
atggcatgcagcagggtagctaattggtgtgtagcagtagcagtctcaccatcaactttattcccccgaatttctcccactcttaatcctaatcctaattatttatcatcatcagtagcacccacccctctctctctttctctcactgggttttcatcttcacccgtttcagccatggataaggaagacgcagcggcggcggagcaagaatacgcacttcactccaccttactccaggaattcaccgccatttccgccatcgacaaggcatggctcttcaaatcccacactcacaccgcctcggcttcttcttcgcatgcaatgttctgcgttagtcaacccaacctcttggtcaacaagaggaagaaatccatcgtctccgccaccattctcacacaaaacgacgcctcctccgtcacgtttcagtgggctccgtttccgatccaagtttccggagtctccgcaatggttccgtctccttctggatccaagcttctaatcgttcgaaatcccgagagcgatggcccttgccgcttcgaaatctggagctcctctcaactccaaaaggagttccatatccctccatctaagcatggttctgtctacactgatggatggtttgagggaatttcttggaattcggatgaaacttgtatagcgtatgtagctgaagagccggcccctacaaagcccacattcaatgatctgggtggctacaagaaagctggttcttcagaaaaggattgtggtacctggaaaggccaaggggagtgggaggaggactggggagagacatatgcagggaagaggcagcctgcgccttttgtcatcaacatcaacagtggagaagtacaagcagtcaaaggaattgacaagtctttgagtgtcggacaagttgtgtgggctccatcaactgaaggctctgcgcaacatctggtttttgttggatggacatttgagacaagaaagcttggtattaagtactgctataacaggccatgtgcattatatgttgttaaagcaccacaccatgagtcaaaagctaatgaaactgagattcactcaactgaagatgttcaggctgttaacctaactcaaaccataagtagcgctttctttccacggttcaggttgatgacaaagatgataggaaagttagctaatggtgaaagcaaggggttactgacttcagatggaaagtttcttgtatttgtatctgcaagaagctcggttgattctggagtccattctgctactgattcacttcatagaattgattggcctgaagattcaaagctttataaatcagctaaaattcatgaagtgattccagttgtgttgtttgctgaggatggtggcttccctgggctttactgttcaactatccttagtgatccatggctttctgatggctacactttggttatagcatctatctggcacagcagtcaagttttactttccatcaatgtgttgagtggagaactattgcgtatcacccctgctgactcaaacttctcttggagtctccttgcattggatgggaacaatattcttgctgtttctagcagtccagtagatgttcctcaaatcaagtatggagccattgttaagaaggcagctaataataaagaatggagttggtcagatgtcgcaaatcccatatttaaatgctctgacaaggttagatccttgatctcctctcttacattcagtataatgaagatctcagtcaaggatatttctgctagcttaacaaaagatgaagatatatctagttctagtctgttccaagcttcttacatgataatatttctcagaggctcattaggatttggtgaggaagccttgcaatctcttccagggaaagctggatctcaggatgtcaatgatgtgctcactgctattgatcacgtcattaacttgggacttgccagtccttcaaagattgcagtcctcggtggctcacatggtggctttctgacaacccacttgattggccaggcaccagagaaatttgttgcagcagctgctagaaatcctgtatgtaaccttgctctgatggttggtacaactgatatccctgattggtgctatgtggagacctatggtacaaaggggagagataagtttactgaagcaccttcagcagaagatctaacactattttatagcaaatctcctattgcacacctctcaaaggtaaaaacaccaacgatttttctactaggtgcccaagatctccgtgtcccaatttcgactggactacaatatgctcgggctttaagggagaaaggaggtcaggttaaagtcattgtgtttccaaatgatgttcatggaattgaaaggccacaatccgactttgaaagctaccttaacattgcgatgtggttcaacaagtattgcaaatga

SEQ ID NO: 52297 - DNA, 330 bp, Glycine max
  Peptide Sequence Number=SeqID_169075
atggtttctaaaagtgatagtgatccaccttcccctagttctgctaagctaatgacttcattggctaagcaaatggataagttgttaagaaatgttgagaggagggtaatcgaagacatagagaggaggaggcatcatcggtcaccttatccttctcaagggagtgatgatggttatgaagaaggtagaaggcataggcataggaggaataaggatggaatggatgatgtgaaggtcaaaatttccaagtttctaggtactgatgatctggaacgatccgaaccaagcgtccatggcttggattgcatcacttttaagtttaaagtttag

SEQ ID NO: 52298 - DNA, 492 bp, Glycine max
  Peptide Sequence Number=SeqID_169076
atggtgaaagaactggtggatctggtagggaagtatggtgttgtggaggtgaggaaggtgttgcattttgggtcattgagtaatgtgataaagagcgtgtttgggagaagttatgtgtttggtgagggggtgatggatgtaagcttaagaagctgtgatcacttcccactttttggttggttggatttgcaaggtgtgaggaagaggtacaagagtttggtggataaagtgaatgcttttgtggggaaaatcattttgaagcatagagtgaagatggttgctcaaggtgaggataaaaccagggttactgagagctctggtgactttattgatgtgacattggatttggagaaagaaaaaaggcttcaacaccatgatatggttgttgttttatgggaaatgatatttagaggtacttatatagcaactatcattctagagtatattctagctaggatgattctgcatccagatatccaagcaaaggcttag

SEQ ID NO: 52299 - DNA, 255 bp, Glycine max
  Peptide Sequence Number=SeqID_169077
atgagtgctctggttgaagctctattcgagggaactgagaaagaattttcttgcaagtctacttccaatgctttgaaggaggttgccctggttctaaaggcactctacgatgctgatgtgttggaggaagagcacatagtgcagtggtatcaaaagggactgaagggcgaaaacaagaactccaagatttggaagaatgttcaacctttcattgattggcttcagagtgcagaatcagaaaccgaggaagaataa

SEQ ID NO: 52300 - DNA, 150 bp, Glycine max
  Peptide Sequence Number=SeqID_169078
atgaagtcctttcatcagttgcttggattaaaagtgtcaacattccatagcctctatcattttaatgttggaggtcctgtcttcgacaagcgtataatgagtctgtcagcatatccagccctgatgttgatgcttaaagctgctctatga

SEQ ID NO: 52301 - DNA, 1980 bp, Glycine max
  Peptide Sequence Number=SeqID_169079
atgcataaggaaactgaggatgactatgcttacctctctaacttacttcaagacttgaccatgattcccaacatggacaaggcatggctttttagctcaccgggctcgcagttgcagggaatgtttgtcgtttcccaaccagatcttctaacaaacaagaggaggacatccatcatgtcctgcaacattctaaaacaaagtgacagttctgttaagtttctgtgggctccgtttccaatagagatgtccggcgtgtctatgattgttccatctccgtctggctccaagcttttagtcattcgaaatccagagaatgaagctccttgttgctttgagatttggagctcgtcgcgaatggagaaggagttccatatcccccagtcactgcatggctcagtatacaatgatggatggtttgagggtgtctcgtggaacttggatgaaacatgtatagcatatgtagcagaagaatcctctcctgcaaagcccacatttaacgatttggggggctacaagaaaggtggttgtgcagataaggatttgggttactggaaaggtcaaggggactgggaggaggactggggagaaacatatgcgggaaggagacggcctgcactttttgttatcaacatcaatagccgagatgtacaagaagtcaaaggaattgacaaatctttgagtattggccaagttgtgtgggctccatttactgaaggctcagagcaataccttgtttttgttgggtggtcatccaagccaagaaagcttggcattaagtactgctctaacaggccttgtgcattatacactgttagagtaagagcactgcatcatgagtcaaaacctaatgaaccagtggtccatccagatgggaagtttctagtatttttatctgcaagaagtgctgtggactctggagtgcacaatgctacaaattcacttcacagaattgattggccaacagatggaaagctgttccaatcttccaaaatttatgatatcattcctgttgtgatgtgtgctgaggatggctgcttccctgggctttattgtactactatccataataatccttggctatctgataactgcacaatgattatatcatccatctggcacagcagtgaagttcttctctctgtgaatgtgttaagtccagttgatgttcctcaaatcaagtatggaatggccattgagaaggcaacaagcaatactacatggagttggtcaaatatatccagccccatattcagatgctcagacaaggtggtatctttgttgtcctctctccagtgcagtatactgagtatctcagtcaaggatgttcatgatggtcaaacaaaaggttttcaagttactctggttgcttgtatgttattgtttctcagaggttcgttaggatttggtgaggaagcattacaatctcttccagggaaagttgggtctcaggatgttaatgatgttctctctgccatagatcatgtcatcaacttaggtcttgccagtccatctaagattacagtgatgggcatttcacatggtggttttctgacaacgcacttgattggccaggcaccagacaagtttgtagcagctgctgcaatcaatccagtttgtaaccttgcattgatgattggaacaaccgatatccctgattggtgctatgtagaagcttgtggaaccattgccaaaaattgctttactgaaccaccttcagcggatgatttgactctctttcaaagcaagtctcctatttcacacgtctcaaaggtaaaagcaccaacacttttcctattaggtgctcaagatattcgtgttccaatttttgatggattgcaatatgctcgggcgttaaaggagaaaggagtagaggtcaaaatcattatgtttcaaaatgatgttcatgcactcaaaaggcctcaatctgacttggaatgcttccttcacattggggtgtggttcaacaagtactgcaaataa

SEQ ID NO: 52302 - DNA, 374 bp, Glycine max
  Peptide Sequence Number=SeqID_169080
atgggtgtgaaggtagatggtcaacgtgttggtcttcctactgggcgactgatcctggaggtgcaagcggtgcgcttagcaagtttgactctcgctcagcacacctgtataggtcatcatcttccaggttcttctatgcgctcagccagtcatgctgcgcctagcggatcatgcgctcagccagaggaggatggaatctcacaaaagtttgatatcactttcaacacttcgtcatctgcatacaacctcccaccatcaagcttttgttatcatccatcattatctactcaaatgtatggcatgggttatgatgatgaggaggaagatgatgataacaacaataccaacaataatgatgatggatggtcgtggtg

SEQ ID NO: 52303 - DNA, 741 bp, Glycine max
  Peptide Sequence Number=SeqID_169081
atggggtttgcaccctatggtgagtactataagaacctaatgaggatttatgcgactcacatgttctatctgaggagaattgttgcctttggtgagttttgggctcaagttggggcccaaatggtgaaagaaattatgggtctagtaaggaagtacaatgtggtggaggtgaggaaggagttggtgactgaggggtatgatttgcttggggtgcttaattggagtgaccacttcccaattttggattggttggatttgcaaggtgtgaggaagaggtatgggagtttggtggataaagtgaatgttgttgtaaggaaaatcattttggagcatggagtgaagagggttgttgaaggcaaggataagactaggtttactaagagctctactgactttgttgatgtgatgttggatttaaagaaagaaaaaaggcttcgacactctgatatggttgttgttttgtggttcaagccaaagcattttctgaaggataaggacatgccaattatggggtttgattttaggttaataccttttggctctagaagaaaggaacatagcaagccaaagttcaacaatgaccaagcccgtggcttttataaggcagacccttcttcaagaagcagaagaccaaacatcttggtcgtgagtgatagcccacatgttgaccatagcagtggtgccaactatactaaagtggttctcaatttacttgttgtgtatggaaaatctagcccatga

SEQ ID NO: 52304 - DNA, 1716 bp, Glycine max
  Peptide Sequence Number=SeqID_169082
atgtctgaagaggctggatctatgttggtagtttatgatgatccctccgaccaacgctcactatctttggatgatgcaagcagcacagaggagtcacctgatgaaaccaggctctccttggaaacaacaaatgatgctattccatatattggtcaaaggtttgccactcatgatgctgcttatgaattctatagtgaatttgctaaaaggagtggcttctcaattagacgtcaccgtacagaaggaaaagatggtgttggaaaaggacttactagacgctactttgtttgtcaccgtgctggcaacactcctgtcaagacatcaactgaaagtaaacctcaaagaaatagaaaatcttctcgctgtgggtgtcaagcttacatgcggattagcaaaacaacagaatttggagctccagaatggcgtgtgactggttttgctaaccatcacaatcatgaacttttagaaccaaaccaagttcggttcctccctgcatacagaactatctcggatgctgacaaaaaccgaatactcatgtttgccaaaacaggaatatctgttcatcaaatgatgaggcttatggagcttgagaagtgtgtggaacctggatatttgccttttactgaaaaagatgtaaggaatttactccagtcatttaggaaattagatccagaagaagaaagcttagatttattaagaatgtgcagaaatattaaggagaaagatcctaattttaaatttgagtacacacttgatgcaaacaaccgtttggagaatattgcctggtcatatgcttcatcaacccaattgtatgatatatttggtgatgctgtggtgtttgatacatcacaccgcctaactgcatttgatatgccactagggatatgggttggaataaataattatggaatgccttgcttttttggctgcacgcttctacgggatgaaacagtgagccattttcttgctgggatgactacaactggtcagtcaaagtcaattaatgcttttattcaacgatttctgagtgcacagacacgccttgcgcactttgttgaacaggttgctgttgctgtggattttaaagatcaaactggagaacaacaaaccatgcagcagaatctccaaaatgtttgcctcaaaacaggggcccccatggaatcacacgccgccacaatcctcactccttttgccttctcaaagcttcaagaacaacttgtgttggctgcacattatgcgtctttttcaattgaagatggttttcttgtgaggcaccacacaaaagctgagggaggccggaaagtttattgggcccctcaagaaggaattataagttgtagctgccatcagtttgagttcactggtattctctgtcggcattctcttagagttctttcaacaggaaattgctttcagattccagatagatatcttcctattcgatggcgtcggatcaacatgccgtcttctaagcttcttcaaagtgcaccaaatgatcatgctgaaagagttaagttgttacaaaatatggtttcatctctgatgacagaatctgctaaatctaaggaacgggtgtttgtgtatggggttatggttcgtgagggtgatgacatagtgaaggtggcacgtgcggttgattctgcagcgataatggagtattctggggtttctgcgtgttctggcttggtttatggtgaagacgatgggatggggtga

SEQ ID NO: 52305 - DNA, 693 bp, Glycine max
  Peptide Sequence Number=SeqID_169083
atgattatgagggtccaagacatttatagtagccaagatgaggctactacttcaccttcttcaagtgaaagtgaagaagcaaaaggggaagaatctagtaaagagatctacccccatgaagaaggacaacctttaatggttaaggaggagtgtaaggaggtaagtgtctcctccaagaggttagctaagaaggaaagaaattttgaaataaagacaaatattaaagaaatttcccctcttagacaatctccacattttctattttgtaaaaagacacttgttagcattgccacacctgggcttgagtttattcctcaagtaaaggagttgttggatgagggtttggttcgcaagagcttaaattcttgtgctttgttggtgcccaaaaaaggtgttgaggaaaaaagcccagagtttcaagaacctcaggatttgaggtcaaatccttttcaagggggagatttcagagctctttttgagcaaaggaatccattgatgaagaagatcctaggcctacaagcttcaatggagcttacattaagggagtttgcttttgcgaagaaggacttcaatctggcaaagcacccagagattgatgcagagcttcaaatccagagagaagttgaagaggtgggagggttagaaaagctggagaaagagataagtaggagagcaagatcacaaaatagctag

SEQ ID NO: 52306 - DNA, 1032 bp, Glycine max
  Peptide Sequence Number=SeqID_169084
atgggtaggccaccttgctgtaacgagagtggtgttaagaaagggccatggacaccggaagaagatgaaaagctaatggattatattagcaaacatggaaggggaacgtggagaacccttccaaagcatgcaggtctaaataggtgcgggaaaagctgcaggttaaggtgggaaaactatctaagaccagatattaagagagggaaattcactgaagaagaggagcaattgatcatcaaccttcattcagttattggaaacaagtgggcaaagattgctacccatcttccagggagaaccgataatgagatcaagaattattggaacaccaacttaagaaaaaagcttctccagatgggtattgacccagaaactcacaagcctagaactgacttcaatcacctcttgaatctttcccagttgcttggcttgtcaaatttgggcacatcaacgagtccctggacaaatcctctgggtttacaagcagatgtcactcaaatagccaaactacaactgctacaaaacatgttacaactatttaacggcacttcattggttaacataggtaacccttacctcttaggaaatcaaattctcaacccacttgatacatttctcaatgggacaaacatcctaccagacaaagattcaattttgagaggtctagaatatgcaaaccctgtaggtaacaattctggcctgtttctgtctcaaacatacagtgactcaagtgtcttcaaatcacggactgaaaaagaaaatgaaactaatcaagaatttcttggttataaccaaagcatcaacacttttccagaaaatcaagcagaaaacttacttcctgcattagttgcatccggtccaaggtcaagcaccttcaaccaaatggatttcaactacaacgcagcacgaatgtccacccagtcaccttccacaacctttgaggcttgggagaagttccttattgatgacgatgaatcaagcggttcttactggaaagagattctagacttgacatatccactttcctggtag

SEQ ID NO: 52307 - DNA, 432 bp, Glycine max
  Peptide Sequence Number=SeqID_169085
atggttattttttcaagatttcaaacatccattcgtctaagtaagaaattcgcctgggcgaattggcctacacctcttgactcttttctatacatagtcatgcaaaggttggagaaaagacacaccagaactagagaaaaatgtgagaaacaccacagaaggaagaagttagtggaaaaaaagccacttgtagttgatagtatggcaggaagaggaggaaaaggaaatagaccaccaaggaggacttttggtggctgtacttatcaacaaggaccaaagcattacaatagcatatccattcctcctttcagcaacaaggttgtggagttgaagctcgcactacttaatctgattgcctcacacccttttgctggaatggatcatgaggatccatacacacatttgttggacaagtggcctcagaaattttaa

SEQ ID NO: 52308 - DNA, 837 bp, Glycine max
  Peptide Sequence Number=SeqID_169086
atggttattgatgaatcccttttctttgagttaacccaattttctagtgacggtgtaccatttgagggcaccattgatgaggactggaagtttgatttctccagtcatgatgcccgcaggttggtttgcaccaatcaagcgaatatgaccggtagattacttgtcggatcattggcatttgaatgccgcatcatgcactatctgattgtgcgtatccttcttcctcggtcatctaaccttgctcaggcattgcgatcaaacactcctcttccttatccccatttgatcattctatttttgcatcattttaatgttcctcttgactctgagccctttgttcaagtcaagatatctttttctatcggtgctggtgcggtttcctcttttggataccgcaaaaagagggatggttcttgggtgaagaaggatgctcagccacaagcagcagatgatcgctctccttctcctcctcctcagatggatgactcttcatcccttatgcaaaacattctagacaagttggatggtctccacaccttcgctggtgagcgttttgactccttggacagttgcattgatgccattgatgcacgatttgcaagaatggatacacgcatcactcagcttgaggaggatgtttgtcatcatcaaaaagggagagattgtggaagcaaagcttccaagcttattttgatgatgccaaagactcaagtcaagaatcaagattcaagcaggtttcaagaattaaagaatcattcaatcaagaatcaagattcaagtgaagattcaagagaagactcaagatatgcaagaacctcaagaaaagcatcaagataa

SEQ ID NO: 52309 - DNA, 324 bp, Glycine max
  Peptide Sequence Number=SeqID_169087
atgtgtagttattattatatagaagggtttggtacttggccatcacggaagacaaagggtaaaactatgaaagaaaaaaatctcaagacacaatacgaagttaagaagcaaagagacaaaaccgtgagaagaacaaaggcttggatcgaaaagcaaaggctgggcaagagagggttttggagtaacagtgaggaatcaaagaaagaagagtacatatacgtagagaagttgaagctcgtcttcgagaagatgctggccatctttgaccttcgatatccactggtccaaatccatgttcaccacaaatggtttctgtttcggtaa

SEQ ID NO: 52310 - DNA, 504 bp, Glycine max
  Peptide Sequence Number=SeqID_169088
atgagtagggaatgtgacagtaatggaaatgtgcatgaaaaggaagtgaatttgttcaagaagaggaggtggtctctatacagtgacaatgaggagaataatagtttttacggggcacacatgacaggggagcgatatcaatcaatgttgggaaagcatattcagaaatacaagaggaggtttaagggtaccttgagtagtctcgcccaaaatcaggctgctactccacttgtgaaaagcaacacgggactaaaagctcccaagtcagggaatgagcacatgggaggaggattacatgtggcaaagagtacatgggaatggatgaatgattccagttctcagaaacttggaaactaccatgatgtagatttcttgccacaatatggcactgataggattatgtatgaacatgcatcattggatattggggatggaatcatttacaagattcctccaatctatgataagttggctggagctttgaatctcccaagcttctcgtag

SEQ ID NO: 52311 - DNA, 328 bp, Glycine max
  Peptide Sequence Number=SeqID_169089
caaagatccacaagggatgtaccctcccttgttttctttgaacaacctagtggatgtaccctccactagaactgatccacaagagatgtaccctctcttgttctcagtcacaacaaccccagtagatgtaccctctacttgtaccacaaaggatgtaccctccaatgtgttaaggcaaagttctcaggcggttagtccttcgaaactttgtgaagggggaaacaaaagaattcccaggcgggagaagggagacaacaaagaattcaggcgtttagtccttggcgaattctttttggcaaagggagaagggaacgaaaaagatgaatag

SEQ ID NO: 52312 - DNA, 393 bp, Glycine max
  Peptide Sequence Number=SeqID_169090
atgaagtttgcttctacacctagcaatggagttagaaataaaagcttattggccatgaagttcctcaactttgactctacaaaattccgagagaagaggaagctctataaagaaagaaccaagaggtaccatgataaaaagatcctccacagagaattcaggcctggacaagaagtattgctctacaactcaatattaaagttgtttcccaaaaaattaaagtcaagatggagtggtcccattactgtcaaagacgttaagtcttatggagctatagagatagaggaccaatccaaagactgcagctggttggttaattgccaaagattaaatatctacctcggtggagaagtcccacagcacaccatagtcatcaacctcgaagatccttag

SEQ ID NO: 52313 - DNA, 231 bp, Glycine max
  Peptide Sequence Number=SeqID_169091
atggcttcccatatatttaaatctatggcttcaataaggatttgcattcggaattcttttacaacaagagaccctcggtctcttaatcctttttcaaaacgagttgcgctcgctaagcgcctctatacagctcatccttcttcaagaattgtccccacgcttagccatcagatgatgtgcttagcggatgacacgcttagccagatgatgagcggcttagcgagttcatga

SEQ ID NO: 52314 - DNA, 542 bp, Glycine max
  Peptide Sequence Number=SeqID_169092
ttccttcttcttctgctccaccagctccttccacttctgctactcctacaccagctcctccaggcccatcttcccaggactctcagcactttgaagccatgcttcagagtcttcatcaaggacagattttgttaatgcagagcttgcaggtggtagctcctctaggatccattcgtttagtggaacagttcatggagaaggtacctcagcaggtacacgatgcatcttctgaagccaccatccctggagcttttgatttttcaggtggagggttagagatgagacccgatgaggcttcttctcctgagccagtaccagtaccagctgatccatcatctctagtggtggatccatcttttcccatgccaaaagaagctctcccatctacacctcttattatctctgaagaccccacagttccagtacctagattagccactactcctcctgttacccccgttctccatttttcagatgaagaggagggacaaactactactcctccggggactccaatgctacattttgatgatgaggaatag

SEQ ID NO: 52315 - DNA, 522 bp, Glycine max
  Peptide Sequence Number=SeqID_169093
atgacacccatttttctttctggaatgttgcaaaactttacggatttatgcaaaaagctcgttttccttccgaaacgttgcgaaacttacagattacgcaacgatgcttgtttcgagggttccgaatggaccaaacaaggttcaagggccaaccgcaagtactcccggacgaaatcagggtatgacaacgtcctagccttcagagggatgcacgccctcaacttcagaggacttcacgctactcatcctcaacttcagagggctacacgtcctcgccttttgagggcttcacgtcctcgccttcaaagggctacacgcccttgccttcagagggttgcacaccctcgccttcagagagcttcacgttctcgccttcagaaggctacacgtcctcgcctttcaagggctacacattctcgcctttggagggctacatgtcatcgccttcagagggcttcacgtcctcgccttcaaagggctgcacgtcctcaccttcagaggactgcatgtcctcgcctttag

SEQ ID NO: 52316 - DNA, 210 bp, Glycine max
  Peptide Sequence Number=SeqID_169094
atggcaacgaggcccaccacgcatatgagggcgcagaggagcgccgccaggatcactacgaagtccgactcgacggctgcggcggcctccggcggtggcgccgccgcggattggaggagtctcagccctcgtgtcatgtgtgatggaagatactatcaagttagggataagggtgaggtggtgaagacttttgactcaaaaagactctga

SEQ ID NO: 52317 - DNA, 309 bp, Glycine max
  Peptide Sequence Number=SeqID_169095
atgttgggattatacactcatttctctcgaaaaatgattgaaaatcacgtgaacatggttgttgaagtattggtaatcaaaatttttattcttgcgaacatagggtcgcaccaagcacatgcttttaagaagaggttttcatcaagtcaaggtcaagtatggaagaaaaaatgtactttacggtgcccctaccgaacgcgtgccaaagctagagtgatgagtgaactagaagaggtacaggaacagacgaaggttgacatggaggccatgaaagagcaaatgaccaaaatgatggaagccatgatgagt

SEQ ID NO: 52318 - DNA, 630 bp, Glycine max
  Peptide Sequence Number=SeqID_169096
cgtgaggaggcggtcgacgcgattgcggcggcggtcgaactgattccgcagatcaataacatcaccttcagcggagcgaaaagcgcagaacaccgcaaaattaaccgtggccatattggcaccgtacacggtgcgctggggcgtgatttgcaggagtggcggccgccgcaggtcgcggattttgtccgtctgaaaggatccgcccgctttgcgccggggcaaacggtggacggcgtgctggccgacctgcaggccctgctggatgcactgtgccagcgctatccgggcctgcaggcgcagctgttcgatgacggcctgcgcgataaacccaccatgctgccgtttgaggtgtcgccggaatcgccgattgttcaagcggtcaatcgcggctggcagactgtgcgcggcacgccgcagcccaccggggtgatcacaccgcccgccttctacggtaccgatgcggcgcacctgtatcagcatgcgggcatggagggcatcgtgtgcgggcccggcggcaagtacaacaccatgccggacgagcgcgttgagatcagtgagtttctcgatatggtgcgcatctatttgctggcgatcctcgacatctgccagccggttgaaccggcgtcatga

SEQ ID NO: 52319 - DNA, 210 bp, Glycine max
  Peptide Sequence Number=SeqID_169097
atggtgctgcgccagctggatgccgcgccgtgccgcgcgcagtcaccgcagctggcgattgacgcgtaccgtgatgaagacgatccgtggctggcagtggcgcaaagcctgacgcggcgcggctatcagcgggcgcggctgggcgcggattatgcctcctacggcatgacggtgcatagctggcagcagctggcgcgccatctgcccgag

SEQ ID NO: 52320 - DNA, 369 bp, Glycine max
  Peptide Sequence Number=SeqID_169098
atggaaggcactagagtgcagtgcatattgcacaaggttttagttgtatctataaagggtgcagaattagggggtcagcttttctgtttggcaagttggagagttaaagagactgagaggatgatagcaatctgcacagaactcagaaagctaggagcaacagttgaagaaggtcctgattactgtgtgattactccacctgagaaattgaatgtcacagctatagacacatatgatgaccacagaatggccatggcattctctcttgctgcttgtggggatgttccagtaaccatcaaggatcctggttgcaccaggaagacatttcctgactactttgaagtccttgagaggttaacaaagcactaa

SEQ ID NO: 52321 - DNA, 462 bp, Glycine max
  Peptide Sequence Number=SeqID_169099
atggcagccatatatgcacaagtcaaatccaaaaattcacaaatccatgcgcaaatgccattgaggcatttcaccgagcacttggtgggcgcatgtttaggcatgaaaatttggggaatgggggcaaagagtatcaaaaacgaaagcaaaatgcaacaaaaggtggcttgggggcgtaaaaatggcaagtcccgtagctttggtgtttttgaaagtggggggaagtttaagggaagacacaagtatgcgctctctacgggtcggcgttcgcttactcgaaccccctttagggtagatgaggcatctgatatttactttaaagacacaacacctctacttgcgtccgtccctaagtacctgaaagaaggaaacgacatcgcgctgcaaactgtggccgcattaccgttttaccttgattggcttctaccttcagacccatcccagcaattgaccactgcttaa

SEQ ID NO: 52322 - DNA, 237 bp, Glycine max
  Peptide Sequence Number=SeqID_169100
atgaagaacgcgttcgacaagaaggtgcactcgcacaagttccatgagggggaccttgtgctgaaaaagatgtcccacgccgttaaagataatcgagggaagtgggccccgaactacaaagggcctttcattgtaaaaaaggatttctccggaggggccctggtgcttaccaacatggatggcgaggagctaccttcacccgtgaactccgatgttgtcaagcgatactatgcttag

SEQ ID NO: 52323 - DNA, 1200 bp, Glycine max
  Peptide Sequence Number=SeqID_169101
atggcccaagtgagcagagtgcacaatcttgctcaaagcactcaaatttttggccattcttccaactccaacaaactcaaatcggtgaattcggtttcattgaggccacgcctttggggggcctcaaaatctcgcatcccgatgcataaaaatggaagctttatgggaaattttaatgtggggaagggaaattccggcgtgtttaaggtttctgcatcggtcgccgccgcagagaagccgtcaacgtcgccggagatcgtgttggaacccatcaaagacttctcgggtaccatcacattgccagggtccaagtctctgtccaatcgaattttgcttcttgctgctctctctgagggaacaactgttgtagacaacttgttgtatagtgaggatattcattacatgcttggtgcattaaggacccttggactgcgtgtggaagatgacaaaacaaccaaacaagcaattgttgaaggctgtgggggattgtttcccactagtaaggaatctaaagatgaaatcaatttattccttggaaatgctggtactgcaatgcgtcctttgacagcagctgtggttgctgcaggtggaaatgcaagctacgtacttgatggggtgccccgaatgagagagaggccaattggggatttggttgctggtcttaagcaacttggtgcagatgttgattgctttcttggcacaaactgtccacctgttcgtgtaaatgggaagggaggacttcctggcggaaaggtgaaactgtctggatcagttagcagtcaatacttgactgctttgcttatggcagctcctttagctcttggtgatgtggaaattgagattgttgataaactgatttctgttccatatgttgaaatgactctgaagttgatggagcgttttggagtttctgtggaacacagtggtaattgggataggttcttggtccatggaggtcaaaagtctcctggcaatgcttttgttgaaggtgatgcttcaagtgccagttatttactagctggtgcagcaattactggtgggactatcactgttaatggctgtggcacaagcagtttacagaatcaaattcttaagaaagaccttcaagaacaacatcaagatgtttcctgtgcaaaacaggctcacctacaaaagagtgtctacaagcacctttacacttgcaaaaaattccttaactga

SEQ ID NO: 52324 - DNA, 246 bp, Glycine max
  Peptide Sequence Number=SeqID_169102
atgggagctaaggttacatggtcagagaacagtgtcactgtttctggaccaccacgagatttttctggtcgaaaagtcttgcgaggcattgatgtcaatatgaacaagatgccagatgttgccatgacacttgctgttgttgcactatttgctaatggtcccactgctataagagatgttgtacaacctggtctgtgggctggtccagttcttactcatgactgtcttttgcagcaaactggttaa

SEQ ID NO: 52325 - DNA, 561 bp, Glycine max
  Peptide Sequence Number=SeqID_169103
atgattttgaggggccaagacatttatagtagccaagatgaggctactacttcaccttcctctaatgaacgtgaagaagcaaaatgggaagaatctagtgaagaaatctacccccaagaagaaggacaaccattaattgttaaggaggagtgtaaggaggtaatggtctcctccaagatgttagctaagaaggaaagtcattttacaataaagacaaacattaaagaaacttcccctcttagacaacctccacattgtctcctttgtaaaaggacacttgttagcattgccacacttcttgggcttgagtttattcctcaagtaaaggagttgttggatgaggatttggttcgcaagagcttaaatccttgtgctttgttggtgtccaaaatagcaccactcattgagttggtgaggaaccatgttccttcatgggaagatgcccaagaaatgggtgttgaggaaaaaagcccggagtttcaagaacctagggatttgaggtcaaatccttttcaagggggagggaatgatgcaatcctaccccgcaagggcattggatag

SEQ ID NO: 52326 - DNA, 261 bp, Glycine max
  Peptide Sequence Number=SeqID_169104
atggaagcttacctcgatgaagaacagaagagcagaagctcgtggaagaatggaagaagcgcactcgaaggagggagaagcagtagctcgcgttggagaagcacaaccacctcgtggaagaatgaggaaggaggaagaaagggtcgccgacggaagagtctcgcggaaggagaagatgctcgcagaaaagaaagaagaagaagagtctcgcgggaggagggaaagaaagaagaagaagagactttttttaaaaaaaaataa

SEQ ID NO: 52327 - DNA, 222 bp, Glycine max
  Peptide Sequence Number=SeqID_169105
atggaaggctacttgacaaaagctgaagctaaaacaagtaaaaaggttgttcaaagattaataatggaagtgaaagctaaagaagatctagccaaactagagcctaatccaaggcatgtatcatatcttcaatttgaagattatttcaacaaacttgaagggaatactttggagagaaagattagtccaacattgaatactgaagatgcatacgtgagctag

SEQ ID NO: 52328 - DNA, 576 bp, Glycine max
  Peptide Sequence Number=SeqID_169106
atgagtaaatacataagaatcatgtctggaagcaatacatatgagacgaatgctagcatgccaaactgcgaccacacccccacacaccagcagcaaaacacctcgccgttgcccccaagatccaacaacggcaacactatcaaaaccaccacagcagtgacatctaaagaagccaacttgggcgacaacaacagcaacagcgaaaccaccgcaaggactctcccttccaagccaacggcagcaacacatttgcaatcaccgcagtggcaacgacgatgttgttctttggagatggtggggttttctgttttcatgtttggaagtagtggagatgtcgccggcaatggtggcttcaatatccaacaaccgaagttaaagtacagtctgcgagagggacggtggagggcgagccctggtgcagcggtaaagttgtgccttggtgacttgttggtcatgggttcgaatccggaaacagcctttttgcatatgcaaagcaagctgaccgaggcgaaccaaaccatgagtaggagaattgaccatcataaggagggaagtttaagcaagagcaataactag

SEQ ID NO: 52329 - DNA, 962 bp, Glycine max
  Peptide Sequence Number=SeqID_169107
atggatctagagagagtgattgcggtggcattgccgccgttggcttggaaggaagagtcattaccatcgtcgttgccactgcgggagagtccttgcggtggtttcgctgttgctgttgttgtcgcccaagttggcttctttagatgtcactgctgtggtggttttgatagtgttgccgttgttggatcttgggggcaacggcgagagcaatttagagctggagtcaataaaggtcatcaatatatcactgccaaagtgaacaatatggcttcgcacaaagagctgcctagaactgcccaaattcaccttgtgagttcacaccaggaagtttatgaaccatgtgatgattcttttgcactggttgatgctcttctagccgaccgcaataacctgttggaacatcatccaacattgtgcatggagattggctgtggtagtggatatgtcattacttcccttgctcttattcttgggcaggaagtttgtggcatcaactacattgcaactgatatcaacccacatgcagtgagagtgacccatgagacattggaagcacatggggttggtgctgagttgatagtaacagatattgcatccggactagaggaccggctagcagggttggttgatgttatggttgtgaaccctccttacgtgcctacccctgaagatgaagtgggtgttgaaggtattacgtcatcttgggctggtggggagaacggccggagtgtaatcaataaaattttgcctgttgcagaccgtcttttgtcagaaaagggatggctatacatggtcaccctcacagaaaacaatccttctgagatatgccatcaaatgagaaagaaaggatatgcttctaagattgttgtccaaagatccacagaggaagaaagtctccatatcatcaagttctggcgggatttcgatactgaagcaaatgaaacagaccaatctgcttctgg

SEQ ID NO: 52330 - DNA, 1785 bp, Glycine max
  Peptide Sequence Number=SeqID_169108
atgagtcgtcttgttgcgttttgtgctttatcagaatctcgggcccttgagtattgtaccaaaatcttgtattggattcatgaaccaaatgtgttttcttggaatgtgacaattaggggatatgtggaaagcgaggacttggaaggagctgttctgttgtacaagaggatgttgcggtgtgatgttttgaagccggataatcatacttaccctttgttgcttaaggcttgctcttgtccatctatgaattgtgttggttttacagtatttgggcatgtgttgaggtttggttttgaatttgatatatttgtgcacaatgcgtcaatcactatgctactttcgtatggagagttggaggcagcatatgatgtgttcaataaaggttgtgtgagagacttggtaacatggaatgcaatgattactgggtgtgttagaagaggactggctaatgaggctaaaaagctctaccgggaaatggaggcagagaaagtgaaaccaaatgagattacaatgattgggattgtctctgcttgttctcaattgcaggatttgaatcttggcagagagtttcatcattatgtcaaagaacatggtcttgagttaacaatcccactcaataattcacttatggacatgtatgtgaagtgtggagacctgttggctgcacaggttctatttgataacacggcacataagacccttgtttcatggactacaatggttttgggatatgccagattcggttttctgggtgttgctcgggagcttttgtataaaattccagagaagagtgttgtgccttggaatgctatcattagtggctgtgtccaagctaagaatagtaaagacgcattggctctattcaatgaaatgcagattaggaaaatagaccctgataaagtgaccatggttaactgcctatctgcatgctcacaactaggagctcttgatgtaggaatatggattcaccattatattgaaagacacaatatttctctagatgttgccttgggaactgcactagttgacatgtatgccaagtgtggaaatattgcaagggctctccaggtttttcaagagattcctcaaagaaattgtttgacctggacagccatcatttgtggtttagcacttcatgggaatgctcgtgatgctatatcctatttctcaaaaatgattcatagtggcataaaacctgatgagatcacgtttcttggtgtcttatcagcttgttgccatggaggtttggttcaagaaggccgcaaatatttttccgaaatgagctctaaatacaatatagcccctcagcttaaacactactctggcatggtggatcttttaggaagggctggtcatttggaggaagctgaagagcttattagaaatatgccaatagaggcagatgctgctgtgtggggtgctttattctttgcttgtcgtgttcacggcaatgttctaataggagagagggtagctttgaagcttcttgagatggatcctcaagatagtggtatttatgttttgcttgccagcctgtacagtgaggcaaaaatgtggaaggaggcaagaaatgcaaggaaaataatgaaggaaagaggagtagagaagactcctggttgcagttcaattgagatcaatggcattgtgcatgagtttgtggcaagggatgtgttacatccacagtctgaatggatttatgaatgcctggtttcattaacaaaacaactagagcttattgtatttacacatgatattcctgctgatggagataatcttttttcctaa

SEQ ID NO: 52331 - DNA, 288 bp, Glycine max
  Peptide Sequence Number=SeqID_169109
atggcaccaaaaaggagtgaaactgttgtaatccctagaatcaacactgaagaaaaggccaagaatgtctttcctttggattctttcattcctagacgatgggtggacatcgaaaacctagaagataagagtctccccatcaaaggattgtttgatcgtgttggatggactatcttccttgggaacttcagttcatggcattatggctcaggcaccgtcaaagggaagaaagtggtgatcttgccaacaaccaccgttgttgcgtctggttgtgctgaagaagtctag

SEQ ID NO: 52332 - DNA, 180 bp, Glycine max
  Peptide Sequence Number=SeqID_169110
atggtgtctgaaatgtctaacgaagatggtacaccgcggtcgctaagctccggcacggcaagctggtggagcatgaggcagtttcttggtcttctttcttctcaagtacctagaatgggaagttgttctgacggaggtggtggtggtgatgctggtggagatcctcgcctccctccatga

SEQ ID NO: 52333 - DNA, 228 bp, Glycine max
  Peptide Sequence Number=SeqID_169111
atgggccctgctgatagggaaactcttgaagaggtgatgcttcagttagtcattgaagcatttcttgtggaaatagtcgataatatcattgagacaaaccttggagttattcccattcgtcttaggccagaagccatagatcttgccttcaagaccacctgctcgaaagaaactagacattcaagtgcatcccatccttcacaccagattgtatcattgttgatgtga

SEQ ID NO: 52334 - DNA, 309 bp, Glycine max
  Peptide Sequence Number=SeqID_169112
atggtgatgcctagactggggtcccaagactatgtgagcaacaagtacaagttctttgcatataagatcatggtaggagagaaggccaagttggatgagacgtttgagaagaatgcagcttttgagctagaagatggagtgcttgtgtatgttaaaacactaaatgaggaagaacacaagagaaagttggaggaagatgccatgatggagatagatcgtgagctagtgcaagaagctatcgttaatgaatcaatacaagcacaatctgcacaagaaatgaagaatgctcagatggaagaattgaattga

SEQ ID NO: 52335 - DNA, 171 bp, Glycine max
  Peptide Sequence Number=SeqID_169113
atggtggaggatgcacgaacaacactaggcaatcaattcgtggggctcaggactcaatggtggagaatgcatgtcggcaatcaactcatggggctccgagcaatcaattcgtggggctccggactcaatggtggaggatgcatgaacgacaatcaattcatggggctctga

SEQ ID NO: 52336 - DNA, 213 bp, Glycine max
  Peptide Sequence Number=SeqID_169114
atggctggagggctttctatttgtctcactctcaaattctcttgttctcccactgtgatattttccttgtccatggctatcgctcagtttccacaacaaacaaaggagactcatttcttctatgttcgcatacctatgttcgcatgcaccacttatgaagactcatttcttctaagtaccttaaggggaacgtccaagtcacatgttccttaa

SEQ ID NO: 52337 - DNA, 372 bp, Glycine max
  Peptide Sequence Number=SeqID_169115
atggccttttcacaaccagtgctgggtgcaccagcaaaactgctgggtggattagtggtattggattttaaagtatgggtattcattgagatggacttgtcggactacaggcaagcaataggaggggggttgctaggtgcacccagcattattgttggtgcacccaacattttaacttcttcttctccttccggcgccgtttgctttccttggaggttcgtttgccgcgcattgggtggttcgtcgtcggcattgaggacttgcaactccattttgctcttccaccgtcaaggcatacagatcaacatcaacttcaccatccaatcttgctctccaaccactggtttcccacgaaacttgaagggacactga

SEQ ID NO: 52338 - DNA, 234 bp, Glycine max
  Peptide Sequence Number=SeqID_169116
ggaatccctcaatttgcaaaggttgggaggtgtgttcaatcaatacaggggatactagcaagtgtcacttcggtcgaggtgaaagtgttacgggtcggtggtgattgttgcggtggttggttcgtcgtcgaagaaattgatatggatgatgaaaatggtgtaaatgaacatgttgattgttcagatgtgttcaatacttctcaggtgtttgctacccgagatgatgctttgtag

SEQ ID NO: 52339 - DNA, 264 bp, Glycine max
  Peptide Sequence Number=SeqID_169117
atggctaccattgcattagtgagtagatatgggaatatgcagcaagcgggttttgtagctgctttaggggtggcctttgtggatgattgggtgttcttggttgatacggtggggttccaaggttcagaagttgagggaattgagagaattaagaaagaagaagaagaaagaagaggaaacgaagctgaggcactactgaaatgcaaccgctatcattccctacatcgttccttgttcaatgttcttcgtgcgaccgttggttag

SEQ ID NO: 52340 - DNA, 276 bp, Glycine max
  Peptide Sequence Number=SeqID_169118
atggcctttactttttctgggtctactgatgagatagagcacaaagcctactgggctgtaaagacctgcaacttctctattgatcaggctggagaggagaggaagttgcaactaagtgagctagatgatatccatttagaagcctatgagaattccaaattctacaaggagaagaccaagaagttccatgacagcttgatagctaacaaggacttcgtgttgagatcaaaagtgaatccacagataagagcttcaaggtcaatggacaccggctga

SEQ ID NO: 52341 - DNA, 3408 bp, Glycine max
  Peptide Sequence Number=SeqID_169119
atgaagacactccatgaagcagaagaagacattgcgtgggagatcgggacagacatcgcgccgaaatacataggggaaaacatgttcttacttctaggcctatcggacaccagagcggagttgtcaacgaaggaatcgaggtatgggtcgacgccattccacacattggagaaatggaactccaacatgaaaacagggcaacgtctcatttgggttcaagtttgggtcatcggggaacctgtggaggtagatgatgatgtagaggacctacggaggctggacagagcaagactgttagtcaaaacctcttggagacctttactgcaacacgcagtcaaccttcacattgcggaaaagatgcatcaagtgcatattgttgaagaaacaaggcttgacaagcacctctgcaaatgccaagctcgacataacgctggctcgtcggaggaggtcgaatcggaagatagcaataacggaggcgagtttccaaatatcctagaagcaaaggacgccgatcatgcaaagttcgactccgatgatgaccgtagcggcgggagaacgtgcacggggcataaacaaaatcaacttttaaccaacggtccttgcgatgaaccacgggataataaccaggtggcgcagaaagtgagcgcgagccccaatgcccctattgcgcctgacctagaagccaaaaaaggaaaggtgacagcttcacagaccatggtggaggcagacccaggctacgaaaatatggaaaggggcagagctcatatggacgatgaactggtcaccgttgaccatccgttctgtccccaaccacatgccaatatagaccctggtgggtcagcccagtttatatccaccggtccttgtgtcttgtacactggtaataaggattcaaaaattgtttatagaaatgtagccaccgcccgtgataaggatatatgtgaggactattgtggacgagacgcgggtcttagtgggccacctatagagacgaagaaacagcacattgacatcaaaatgtgtcagtccatatggggagatcctgatgttagatgggaagtgcagcctgcaacgaacacagcagggggaacatggaacaatgaggatcagaagatatgtataatcaacatttatgctccttgcgatactcaaaataaaagagaactctgggaatctctgaaacagctcaagaatctggatccaaataggctttggtgcatggtgggagatttcaacagcgtcaggaatgcagcggaaagggtgggcatatctcagaggcgaatggacgatacacccatcaatgattttaatgagtggttagaggaccttgaaatggttgaaccaccacgtatagggaagaagttcacttggtttagaccaaacggaacagccaaaagcaaactagatagagcgtttgtatcatcagaatggctcaccaaatggccagctagttcgcaattagtcttagaacggaacttttttgatcattgcttggtgttattcaaatctaaaaatgttgaatgggggcccaaacctttcagaatacttgatttttggctcaaggataaatcatttggcaaaatgattaaggaatgctggactcaaactcagcagagtggttggggcggtttcgttctcaaagaaaagatcaaatgccttaaagaaaggatgaaaacatggaacaaggagcagtttggagacacctttaagagggtccagaagatagaggttgagcttaacaagttggaatctgaatcagaggacaggcagctgactttccaagaaagtatgaacaggaagaaattgcaacaagaactatggacagcaggccaagcccatgaatctctaatgagacagaaggcgagatcgagatggatcaagaaaggggactgcaactctcggtatttccacctgttgattaactcacatcgaaggtttaatcaaagattccaagaaaccatgtacagcagaccaactttgaatggcatcagctttcataccattgggcatcaggataaccagatgttggtgggtagctttagtgaggaagaaatcaggaaagcagtgtgggattgtgatagtgaaaagagcccagggcctgatggactcaattttaaattcatcaagcaattttggcaaatcttgaaacctgatgtccttcgttttattgatgaattccatgcaaacggcgtcatcccaaggggagccaatgcttctttcattactttaattcctaaagtgtccgaccctcattgcctcaatgatttcagacctatcttgctcataggttgcgtttacaagatagtggctaagttactagccaacagagtgaagagggtaatgccatctattatagacgaatgccaatccgctttcatagctggaagacacctcttgcacagcgtagtcatcaccaatgtagtggaggaagcaaggaggggcaaaaaattatgtatgattttcaaagtggatttggaaagagcttatgacttcgtgtcgtggaatttcctctcctacatgttacgaagactgggtttttgcaataaatggattctctggatagagggctgtctcaaatcagcctcggtgtcggtgttggttaatggtagtcccacagtagaatttgtccctcaaagaggccttagacagggtgaccctctagcacccctgttaattaatattgtagcagaagggctaattggacttatgagggaagctataaagaagcagatatacgctaattttttagtgggggagaaatatgtacctattagtatacttaaatacgctaacgacactatcttttttggagaggctagtatgcaaaatgttaagacaatcaaatcgatcctgagggcttttgaaatggcatcggggcttaaaataaattatgcgaagagctgtttcggggcaatgggccaatcagaacagtggaaaatgcaggctgctagctacttgaattgcagaattctgcctttgcctttcacttatttgggaattccaatcggggctaatccaaggcatagtgagttgattcccaacaaggtagtggaaaagctaactcaaattcagcaaaggttcttatggggtggtggactagatcagaagaaaattgcatgggttaaatgggatacaatttgtctcccaaaggataagggtggtccagaaataaaagatatcaggactttcaatagagcattgctgggaaaagctctagatgaaggaaaaccagccaccaatgaatcaatatggtggcaggatttaatggcgatgattcacgaacagcaaatgaataccatgcttcaaactgcaatagaatggaaggctgtatcaaatttcctgtcaacagcaaaaagttattcaggatatgggaagccataccaaaacagtttaggaatggaatcttga

SEQ ID NO: 52342 - DNA, 327 bp, Glycine max
  Peptide Sequence Number=SeqID_169120
atgtttctaagccaattaagaaaatgcgagctcaccaattgcatcaacagtggttttcccattagaaaaccttccagaaggtccaccaaggaagtcaatcccataaggcaattaatcagccctagccaaagattggagctggttgttgttcccattatcaaccaaagaatcacaaaaaatgaagtagcatggaacttgtggtgcaccttcaacacgactccacaagccaagagaaaaaacaacaactatgagtgccaacatgcttattgtgagatccaaagctaccattggagcaagaaacggtgtggcttgttagggaaggagtga

SEQ ID NO: 52343 - DNA, 282 bp, Glycine max
  Peptide Sequence Number=SeqID_169121
atggactttagaggctctatatcaggttatttagaaatcacattttccgttgagaaggaaacaggtgtaatgattgcttggactggtattgagcacttccgcatgggaagatatgaccctcctcctcctgcagaagaacctgaagactttttgtatgatatacgcccaaggtggccactgggggaagaatatgctgaaggaaaaagtgtagcacgttcgttaagaacagctcgcattcatccttctcttacatctgtaattcaagcatcattgcaacaatga

SEQ ID NO: 52344 - DNA, 1583 bp, Glycine max
  Peptide Sequence Number=SeqID_169122
atggtgtcgctgaaactgcagaagcggctggccgcaagcgtgctcaagtgtggcagaggaaaggtgtggcttgatcccaatgaagtcaacgaaatctccatggccaattctctgcaaaacatcaggaagttggttgaggatgggtttatcatcaggaagccaaccaagattcactcatgcttgcgtgctcgtaggatgaaggaggcaaagaagaagggccgacactctggttatggtaagagaaagggtacaagggaggcgaggcttcccaccaagatactttggatgagaaggatgcgtgtgctcaggcggttgcttcgtaagtacagggaatcaaagaaaattgacaagcacatgtaccatgatatgtgcatgaagagcattcacaagtccaaggctgagaaggcaagagagaagactttgtctgatcagtttgaggctaagcgtgcaaagaacaaggctagcagggaaaggaaacttgctcggaggaaggagcgcttagcccaaggtcctgttgacaagacatctacagcacccagtgccccagttgccacagcaccccagtctacccaagcgccaaagaaattcaagaaggtgccaaatagagtggtggacaagctggtgagcttacaacgcaaattcctatggggaggtggacctgagcaaaacaagattgcttggattaagtggaagacagtgtgccaaccaaaagaaaaaggtggtttgggccttaaggacatcaagactttcaaccttgcattgatcggcaaatggaaatggaatctcttccaacatcaaggagaattacgggctagggtactggattcaaaatatggtggttggaggagcttggatgcatcatctagagtatcccatgaatcagtatggtggagggacttaaaaatgactcttcttcattcgcatcagggacaggttcttcaaaatggaacgatgtggaaggttggatgcggtgatagaatcaaattttgggaggacaaatggttgggaacttacaaggacataggatgggagtgggacttcaaatggaggaggccactgtttgacaatgaaattgactcaactgttagtttcctaagagatgttgaaggcaagataatacagcaacagggaagtgatgattgggtatggaaggcagatccaagcggataccaagcaaaatttcagtcttcacctggaggttacttagagatagatgccaacaagaaaaaacttggagaggcggcaggtgcagatcacggatatgtcctgccctttctgcagaagcatggaggaggatgcagcccacttactcatccactgcagcaaaatccaacctatttggtgggaatccttgtcttggctgaatatcaaagtgcggagaaaagagaaggtggctttgggaagaagtttaggcgcgaaagtgttgaaggagacgcaagtgtagagagagaaagtaacattgttgatgcagagaagaagagaacagagtcggtcccagaggcactgcacagtgaagacaactaccagttctaccaaaaggaaggatatggacatttccatttcagtgaatctccaccaaacac

SEQ ID NO: 52345 - DNA, 822 bp, Glycine max
  Peptide Sequence Number=SeqID_169123
atggaactaaagattcaagatggaaatgctgggggacacaatgtactcgttcttgctcgtgatcttgggcagtacatacaacttggaactacaatagataatgctatcggtgaggcatatgacaagacagcaaaatggcttggacttgatttgaggagaagtggtggtcctgctattgagaagcttgctatggagggtaatgctgaatcagtcaatgatgccaaaattccaatttcttcagcaagtaatgaagatcgactgtcacgggctgatattgctgcttcttttcaggaaaggtgtgaacgagcaatactgtgggcatttaagatggagccttccataagacacttggttgtctctggtggagttgcatcaaatcaatatgtccgggcccggcttcattatgggcaaggattctggattcaaagtatggaggatggaggggtctcgatgcagcaacaagcgacaataacgtctctttatggagggttaacgtggaaggtggggaatggagccaaaatcaagttttgggaggatgtttggagctatggagacacaccgcttctggcaaaataccccagattgtacctaatttcagaccaacagaacaagaatattcaggagatgggtcagcagacggacaatggatccacaaaaaaagatgaatggatttggaaaccagaacctagtggacaatattcggtaagaactgcctataacatgttgaaaggagtggatgttgaggaggataacatgtgggttattaaaggagaggctacaaacaaagacaaacttgaggaggagaagggtgacaatcaatga

SEQ ID NO: 52346 - DNA, 231 bp, Glycine max
  Peptide Sequence Number=SeqID_169124
atggctaaaatacaaggcccaaaagaaggaaaacctattctaatatatacaaagaaaaatggactcaatcttggccccatgggctcaggagtctaccctgaggttcatgagaatcctatggccttcttcagcagctctagcacaatcctgttgaagcctcttgctcatggctctgaactaaatgcaaatgcacaacctattgaagatgatacttatgttgaacctaattga

SEQ ID NO: 52347 - DNA, 204 bp, Glycine max
  Peptide Sequence Number=SeqID_169125
atggctcacacaacacttaagagaactaccaaactagcttcaatgagaggagttaagggtggcaaagatgtggctggtgagaggagatggggttacgagggtgcagtcggtgaggtcgtgagggtcgcatgctccaccatgagccacaagggtgatgagggttcgacgagggttttccaattgcaagagcaaagaggaaactag

SEQ ID NO: 52348 - DNA, 267 bp, Glycine max
  Peptide Sequence Number=SeqID_169126
atggttcatacaaagagaaggaattatatttgttttgatgatgaatggataagtgaagagaatgctaaagaaaaaattgttgttcttccttttgaagagattcatgttggtagtgttaagtatgcaaatgtcaaaattggaaatttaagccatacaaatttagatggcattgataattttaaccttgaagcatccgaggaagagtttgatgaagcggtgaggaagaagaggacaatagtgatgaagatattgaacctaaatgattga

SEQ ID NO: 52349 - DNA, 393 bp, Glycine max
  Peptide Sequence Number=SeqID_169127
atggacttctgtgatgttgcctgctcacctgtatctagcaaggaattacaagatgcacgagtgctaactgatgttggtgatgttcctatccaagaaattcgagattgtggggtagatgatcatagattaatgaatgtaattggtgaatctgtaaagttagtgatggaggaggatccattacgtccattagttttaggcggtgatcactcaatatcatttccagttatcagagctgtctctgagaagcatggaggaccagttgatgttcttcatcttgatgcgcatcctgataactatgatgcctttgaaggaaacatttattcacatgcttcttcttttgctcgagtcatggagggtgactatgttcgacgtctcttgcaggcaattctttga

SEQ ID NO: 52350 - DNA, 741 bp, Glycine max
  Peptide Sequence Number=SeqID_169128
atgagttccagctttggtgaattacttgagctgagccagaaaggagataatagtaatactgacatgcttgttggggacatttatggtggcatggactattctaagggcatgtgggtggttgcatgggctgatatgggtgacccaaatgcaagcatgtcctcaacagtgctggctttggttgttgtacctattctttctattgttgttcataagtttggccgttacctgcgggaacttgctcataaaattcaaattgcagctacaatagcttcatcaatagccgagaaagttgtcgggctcttttttggagcccttaatgttgcacctacactttcaattattatagttggctcctttgactttgtagtgggttcttctatatctggtatgcctggatttgatcaagatggggaagtagaactagatgatgtgtggtttgcctatccatcacaccctagccatcttgtgcttaagggcattacattgaagctgcatccaagatcaaaggttgctcttgtcggtccgagtggtggtggaaaggtatattcatcattccacaatgttcatattaatgtgcttgggttgaagaggaatagaaagttaagcaagagtacaattgcaaacttaattgaaagattttatgacccaaccaaggggaagattctactgaatgaggttcctttggatttttcatacttctacaatcctaagaacgaaaattcacataaggccatgatgtaa

SEQ ID NO: 52351 - DNA, 279 bp, Glycine max
  Peptide Sequence Number=SeqID_169129
atgaaggcatctatagcattcctcatcttcactatttgtttccatgcttcagccaacattggaagttcacaaggggatggaaactcttcacaactaaacggaagtacttcacaatcagcagactcctgcggctccaatctaaacctcagtgttcctctcctctttgacacaaccaatctcaattgtcttcctgtttggaatgctcaaggatacatccttagagacaacgcttgtagttcatcacatccatataagcttgacaatgatgtagctgtttaa

SEQ ID NO: 52352 - DNA, 384 bp, Glycine max
  Peptide Sequence Number=SeqID_169130
atgggtgaaatagaggaggtgcaagagcatatgaaggccgacatggaggccatgaaagagcaaatgaccataatgatgagcatgaagaagataatggagaacaagcatgccttcccgccatctggcttgccgcccaactataaccgacccaatgtggtgcacactcccgatgagaatgtcaacaactccacttccatactcattgagggccaacaacttcaatctgatcatgcacatgtctctcaacccatgggggagacacatgcaataccccaccacaatctagctgacttcaagcctggcctcagatatgccactaaggggcaagcagttggtggtgtacccctgcaaaagactttggagggccctcaattttgcccataa

SEQ ID NO: 52353 - DNA, 666 bp, Glycine max
  Peptide Sequence Number=SeqID_169131
atgcccttgcgggataggattgcatcactagcaggttacgctaccattgaggatgatatatggtgggataacgggcaaaacatatctccaaagtacattagcggagacatggttttgcttctcggtatcacagaagaaaaagcgaagacaatgttgaatggaatacctatagtagcatgggatacgctctatatcaaacagattttgtttggtataggagaagtggtagacgttgatgataaagtagaagagcgaagtaggctagacgtggcaaggatcctaatcaaaacgacatggaaaccttggatacaacataaagtgaatgtcaggatacatggggagacgttcttggtgcatgtagcagaagagagtgggcctccaagcgatatgtggcacacaaagagacaatacgcttatagctcctcggaggagattatctctgaagaagatgacgatgaaggcgaggagaaagcatggaggaatatccctaaagtagcggacacgatggaggataaggtggaggacagaagagcaatagacgagggcacgggtgcagaagctcgacggttggattccgagctctcggaagcagccttgatgaaagatggctcagatagtggcgggagaagcgaaagggggtcagcacagttccatacgggaggctga

SEQ ID NO: 52354 - DNA, 132 bp, Glycine max
  Peptide Sequence Number=SeqID_169132
atggatggcacctccactcttccgacaccggcatcaccgacattgctttgcactcctccgggatcaagtcagaaaaagatttgtttgtttgtttgctatgcgtcttcctttcaattcccatctcatccttaa

SEQ ID NO: 52355 - DNA, 348 bp, Glycine max
  Peptide Sequence Number=SeqID_169133
atggctgctaaagtggtagttacactgggatgggccataaacatacagaaggatatggtggctctccctcctctagtgaaatggcatatgggtgggaaacccgataaaacaaaggcagatgcgatgaacataaccaaactacttcagcatcctctccagaagatacagccacacgttcgtcccacacatgatgaagccagagaaaaaagcctattgggtgaaaagtttaacacctttgtggtgctcataaggacaccagacaacaacatccatttggaggtcatccagcttctccctaatcgaatgagtctgcccagtgcttcgtgttggcttccatctgctggctaa

SEQ ID NO: 52356 - DNA, 312 bp, Glycine max
  Peptide Sequence Number=SeqID_169134
ctttgctataagcagttaactggaaggatacctacacaacttggtgatttgaagaagcttagtgttcttgctcttcagtcaaacctgctgggtggagctatccctgctagtctaggtgatttgggaaagttaatgaggctagatttgaaatctaataatatctttggtttcattcccattaaactagctgatcttccttcactgcaagttctggatgttcacaataatactctctctgggaatgtacatcctggtaaacatgatgctactcctctcattttattttattgctactatccatttcttcattga

SEQ ID NO: 52357 - DNA, 573 bp, Glycine max
  Peptide Sequence Number=SeqID_169135
atgaccacgattgccgggattaaggtgagagttaggaacgaaagagataggagagagagtgctagagttcgtgcgacgaggggttctagtctgatcatcggaaggaaaaccataggaaatcatcaaacctacacgcgagagaattggagagatcataaggatgtcaccacgttctacttcaccaggttccccgaaggtgcaactacagaagatctttggctccatttcaaacagagcggagatgtgcgtgaagttttcatacccgagagacgaaacagccaaggaaggagatatggcttcgtgaggttcaaaggtgtcagagacacacaacagctccaaaagaaactggataatatggtctttagaggattgaagattaacgtcaatgtccccaagtatgggagggctaagagtggagagtcatcgacaacaaaaggggtcagaacagaggtcacatatccacaaaaagggaaaagagtagtgtacctgagcaagataccaggagataaggagggagttcagcgaaggtcgtatgcagaggtggtcagtcggcatattccaagaccaaaatag

SEQ ID NO: 52358 - DNA, 1023 bp, Glycine max
  Peptide Sequence Number=SeqID_169136
atggatatgcgtggatttgaacatttgccaagtgtcctttgttgtttacatgctcgttccttgcctccttatgtgaaagccatcaattggaacacctcccacagctttgttcaaaacaaccccctcctttctctcttggaaaggtgcaagtcattggaccagttaaagcaaatccaggctcagacggtcttgactggcttggttaacgatggctttgccatgagttgtcttgttgcattctatgctttattggaatcgggatacgtggaaagcgaggacttggaaggaactggtctgttgtacaagaggatgttgcgatgtggtgttttgaagccggataatctcacttaccctttgttgatcaaggattgttcttgtccatctatgaattgtgttggttttacagtacttgggcatgtgttgaggttgggttttgaatttgatatatttgtgcacaatgcgtcaatcactatgctacttttgtatgtagaattggaggcagcatacgatgtgttcaataaaggttgtgtgagagacttggtaacatggaatgcaatgattactgggtgtgttagaagaggactagctaatgaggctaaaagactctaccgggaaatggaggcagagaaagtgaaaccaaatcagattacaatgattgggattgtctctgcttgttctcaagtgcaggatttgaatcttggcagggagtttcatgattatctcaaagaacatggccttgagttgacaatcccactcaataattcacttatagacatgcatttgaagtgtggagacctgttggctgcatgggttctatttgctaacaaggcatatcagacccttgtttcatgggctacaatggttttgggatatgccagattctgtttctgggtgttgctcccgagcttttgcatagaattccagaaaagagtgttgtgccttggaatgcaatcattagttgttgtgtccaagctaagaatgattaggaaaatagaccttgataacgcgacatccacagtctga

SEQ ID NO: 52359 - DNA, 228 bp, Glycine max
  Peptide Sequence Number=SeqID_169137
atggggaagcatgttactattcttatacctcaccctgacacccttaaatgctcccttcgcattgtcattctggatctgttaatgtggtggtggtgcgatgtaaatgatgggtttggtgttaagggtgatgatggtgcaagtcgcgaggagaggtttgtaaggaagttagttaagagaagtccttacaactttaaaactggtgaaaagtggtcttcactcttccgttga

SEQ ID NO: 52360 - DNA, 231 bp, Glycine max
  Peptide Sequence Number=SeqID_169138
atggcagttccagacttgattctaggtcacactgggactggtcagcatgctcagaacacagtttcagtactgacagttcatctaatggttctcaggatgtgtttcctagggaataatcccatcaaacatatgatatggaagttgaaagactcaaggctgaacttgctgcattggccaggcaggcagatgtgtcagacttggaactgtagactcttaggaagcaaattgtaa

SEQ ID NO: 52361 - DNA, 2016 bp, Glycine max
  Peptide Sequence Number=SeqID_169139
atgtcggcccttttccgcaaaactcaaaacaacatttcctacaacacatacatgcatatatgggacatcgtgttcgagtttttattgctaaaggaaagggtcaatatacctccaatagaaggtaatgtaagggagatcacgagattcccagaagacgtaactgagaaggacctctgggtccagttcaaaaggtggggagatgtaagggaggtcttcatctccaagaaaagaaacaaaggaggcaggcgatatggctttgtgaggttcagtggagtgactgacgtgcacagactggagagacagctcgacaatctcatagttggggggctgaagctatatgtcaacgttccaaagtacgaaagagggaagggtagagatgcagttagaagaccagagccgaaaacccaaactgaaggcgatcaccaaggaaagacaacaccctaccagaaccattcacggtacagggagccccagatgtcctatgcgaaagccttactcactaacccaacaacctcaacgccgaggagatatacagagaatgcgagtcccaggtctgagggatcacagtcatcggtgcacctcgagattccgacggggactaaacaatggtatgtcgaggcgtggatgggtcgtatcaagaaactagcgaacctcgaaacagctgaagatgacatagcttgggagttaggaacagatgtcgtcccgaaataccttggggacgacctgttcttattactaggcttgtcggataacagggcagaagaggtggttgaggaagaagcacgacacgggacaacaccgtttcatacgctggagaaatggaatcccaagctgagagcaggtcacagactaacctcggttctctgttggggtatcccgctaaacgcatgggagacggcgaatatcaggaagatcgtggcaccgataggggagttcatggaagtggatgatgacgcagacgagatgcgcaggctggatagggcgagggtgttaatcagaacttcatggaaaccaatactccagcacacagtaaatctccacatcgccggagaattacacaaagttcacattgttgaagaaacaggtctcatcaatgggaggtgcagttgtaaactccgaagtatatgtgggtcatcggatgcgattgcttccgacgacagcgtcatagctagcccgcgctcagacgccattgaagtgctagattccacccttacgccgagggatatcgacggtaacaccaccgccaggggaacgaacacggacaacagagaaaatcccctattacccagtggtacaccccatgatgatgatccagcggataaaacccctgctaggtggacaatctgcaaaaatagtaaagctgacaggcctattccgagagaaggaaatgagaagccaacaggcaggctactcacatcgaagatggagacaactttcgcaaatgaggaaacacccagtacccacttcaagccacgtgacgagagcaacggagaccagaatgcagcaagatcgtcccgtgatacagaaattgttgaccccatgcatggccaaggcacacaaaacgaatggggagtgggtaatttacagatggcatcatccaaggctacacgtgtgccactagcagctgatagaggacaaacaattgattataaagaaacaatgcccacacttgtcaccgagagcaaaaaggaagcatgtgacattagtgatgctatttgtgggcctctgttagtgggccttaataatcccattcttgttgaaccagacactcaacaaaatataaactcagctgctaataaacccgaaacactgggaacgcggaaggtgtatctcagaaacaaggggtgcaggaagcagaaggccctcattagtgtaaatgtttgtcaaacggatgaaagtccagagacaaacaatttgaagcagaccacagtagatatcgcaactaactccctgagtaataagggagctgaatcaccttcgaataaggccatgaagtctactgcatgccagttttga

SEQ ID NO: 52362 - DNA, 165 bp, Glycine max
  Peptide Sequence Number=SeqID_169140
atgggatcattggtgttgatcaaattagtccctgctacgaggtttgggttgggcttggctggtggttgtgggtttccaagccaacctatagaccccacggtccaaacccgcatagcctgtagattatgcggggcaagctcaaaatcccatagccatggattttaa

SEQ ID NO: 52363 - DNA, 198 bp, Glycine max
  Peptide Sequence Number=SeqID_169141
atgtcctttggaagctggcagcaaccatggcctttatttcgtatctctctttgccatcggagaccaggaaggaagaagatggacaaagtggaagatgaaaagaacatagggttcatgaataagaatgagagtgagagtgagaggaaaacctttcaagtgggtagcaggctcacattcacctttctaacatcatcataa

SEQ ID NO: 52364 - DNA, 123 bp, Glycine max
  Peptide Sequence Number=SeqID_169142
atggctggaattgaattgaataagaactttgtgaagcttgtttcttggtacgacaacgagtgggggatacagttggttctaataccttctttgtcctcggttctacagctaacgtgtcactga

SEQ ID NO: 52365 - DNA, 249 bp, Glycine max
  Peptide Sequence Number=SeqID_169143
atgctacaatgcttaaggtacttctctcagctcaaacatgatatcaaaattcccaactgtgagaatgctaggagatgggctgtaaacgtagtgctcaaatttcatgacgatccaacggtgaatgagtctgagatcatcatttttctgagacaggttaggtggcctacgggaaaaagagaggattttgggagaagagagaagaaacgaaattgtgaggagaggaggctgaggaatcagtctgaaaattga

SEQ ID NO: 52366 - DNA, 1215 bp, Glycine max
  Peptide Sequence Number=SeqID_169144
atggtggatgaggagatgaaaaatctcccacgcctagactatgctaaagtgcttgctagaacgtctagactgggagtgataccagaaaggaaacttgtcattaccactcaggacaatgacaaagatggcgatccagtgacgaaaacaggtacttcagtaaaggttgtttcaaattttgaaagtgaagtaaaggaagctagtcaatgtctgttacaccatgatgaaggggctaaggctacacaaggagtaggtatggacgaagttgcaaaggactcggcagaaagggttggacaaatcatagaggatggagttaaaggagtggggatcaatttggacaatgaaatcacggaagatcaacacaacagaggtagcatgggtcagactttggaaggtcaaaatgacaagggacggttgacgacagaggcagtgggaaataaaagaaagagggagttgaagaacaaagaaggcaggatcattattaaagaaagacactatccatcatcaaaagagaaagtggatgcttcaagcaacaattcggggattcaagcacgacttaaaagaaggacacatggtgcgaagggacctggagaaaaaagagagtatcttatgaagatattaagccagaatgttagagggctgggtgagaagtttatgtggagggctataagggagtgtttaatccaagaggagtgtgagtggcgggagtctccagctatcaatttagctggaggacttctttgtatttggagtaaggagctcatgaaggttactatgacttttattgggaaaggctacatgggagtgcaaagggtgtggacagaagtgatggaagagaggaaagacaattacaatgtacctattggaggaagggatatggggatgtttaatgaattcatcaatgatatggaagtggataatgtcccacttgatggagataaaagcccggacctcgatggacttaatttcaactttgtcaagaattgttgggataccttgaagccagaggatgatccacaaggtcttaatgaatttagacctatccctttgatcggaattatgctagataatgtgcttgttgcaaataagatggtgaatgatgctgagtgtaggaaaaagccatgtcttgttttcaaagttgattttgaaaagtcatgcttggagacaatatctatttccattcttgttaatggcaaccccatggaagagttcaattga

SEQ ID NO: 52367 - DNA, 738 bp, Glycine max
  Peptide Sequence Number=SeqID_169145
atggaaagcgacgttaatttcgaagatacctgtaagggttttcttgaggtagccaaggaagctgtgcatcaaactgtcagtgtgatatttgaagatcctggggtccaggagttgctggtgaagctataccagaaagaatggagtgaggggcaggttactgagtacctggttgcaacatttggtgattattttggtgatgtaaaaattttgttgaggaaaactaagtttcaactatccatatattcaaggtacattgaagaacgatcttttaggagatttgttgaagcctgcctggaagaaacagtggttgtttatgttgatcgtcttttaacacagaaaaattacattaaggaagaaactattgaacggatgaggctagatgaggaggttatcatggatttttttagggaacatatcagtgtttctaaagttgaaaacagagtgagtgtactcagcgacttgagggagcttgcttcagcagagagcctggatacctttacactcatctatacaaatatactcgaacatcaacctgactgcccgcctgaagttgtagagaaactcgttggtctacgagagggcattcctcggaaggatgccaaggaggtcattcaagagtgcaaagagatatatgagaattcacttgtcgatggaagacctccaaaggcaggttttgtttttcgacgggtgaagtgcctaacagcaaccaagggagggctttggcgtaaactcacttga

SEQ ID NO: 52368 - DNA, 156 bp, Glycine max
  Peptide Sequence Number=SeqID_169146
tagactgagaggctttggcagaattgatcgaacttcttgctctcagggtgcttcgcttgagctcaaccatccgggatgcttgttttctgaggatgattctttcgcggaaggacatgactacgttaaccagccgcaagggtgtgccgaaatggcaca

SEQ ID NO: 52369 - DNA, 753 bp, Glycine max
  Peptide Sequence Number=SeqID_169147
atgccctcacctttagaggactatacgtcctcgccttcagaggacaacatgtcccggccttcagaaggctgcacgccttcaccattagaggactacacagggctatacgccctcgccttggtagggttacacgccctcaccttcagaggactacacgtcctcgcctttagagggctacatgccctcacctttagaggactgtacatcctcgccttcagaggacaacatgtccccgccttcagaaggctgcatgccttcaccttcagaggactacacgtcctggccattagagggctgcacgcactcgccatcggaggactacacgtcctcgccatcagaggagtacacgtcctcgccattagagggttgcacgcccctgccatcagagaactacacgtccttgccatcagagggctgcacgccctcaccttcagaggactacacgtcctcgcctttagaggactacacgtccttgccaatagaggactacacgtcctcgcctttagagggctacacaccctcgccttcagagggctacatgccctcaccttcagaggactacgcgccctaaccttcagagggctacacgtcctcgccaacagaggactacatgtcctcaccttcagaggactacacgtccttgccattagaggactacacgtcctcaccacccgaggacttcacgtcctcaaaggacttcacgttgttcgatcaagtggggggttgaataaattattactagacctttactaa

SEQ ID NO: 52370 - DNA, 657 bp, Glycine max
  Peptide Sequence Number=SeqID_169148
atgaaaaatggaattgaactagataacagatttgttgtaccatacaatccacaactcttattaaagtataaaacacacctaaatgtggaatggtgtaatcaaagtacatccattaaatatctgttaaaatacatcaacaaaggttctgaccgtatcacagctgctcctggaaatcatcacaatagcaatggtgacaacactcaggttcaagatgaaattaaacaatatcttgattatagatatgtatctccgccagaagcatgttggaaaatttttgcattcccaatgcatgtgcgttccccagcagtggagcggctatatttccaccttgaaaatcaacaacatgtttactggacagatgatcaacaaataggtgaagtcctatcaaaaaacacaatcaaagaatccatgttcacagccttgatgcattctaacaaaatatattcttatggacgggatattacatatcatcaatatatctcaagatttgtttatgtcgcccgcaaaagatgctggcaaccaagaaaacaagggaatacaataggcagactcatatgggtcccaccttcagttggtgaactgttttaccttagaatgatgctattcactgccaaaggtgcacagtcttacagtgacattagaacaatcaatggtgtg

SEQ ID NO: 52371 - DNA, 178 bp, Glycine max
  Peptide Sequence Number=SeqID_169149
atgacgactctttgcaaatccaaaggaaggaaatccgaacatttccataaggattacctaaagtgcaagtcttggttcgaaaagaaaagtgagcttaatgctcgtagattccttacaatccaaaccataagcccaaatgagaagttcattttcatggggaataaagtgaaactccagt

SEQ ID NO: 52372 - DNA, 345 bp, Glycine max
  misc_feature (271)..(271): n is a, c, g, or t
  Peptide Sequence Number=SeqID_169150
atggaggccatgaaggaccaaatgacctccatgatggaggccatgatgagtattagaaggatgatggaggacaacgtggctgcaattgccaccaccagtgccgccactgaggtggatccgactcatctatctgttataaaccaaacaagtcatccagccccatacatggtaggtcagggaggagaagtattgggaagtatgggtggtccccatatggtgcaaagtaagaattctttcccaccgtacggcttgccacctaagtatacaccanccaatgcggtgcacgtgcccagtgagaatgccaaccactccattctcgttctctttgaaagccagcaaccccag

SEQ ID NO: 52373 - DNA, 1236 bp, Glycine max
  Peptide Sequence Number=SeqID_169151
atgcatcacatttatctcgtcatttttgtcacgggaatccagaaggtccgcatcgccttcttaattacatgcattgggcactatggtaatgcctgcgaacaaaccatgatacgtaatgcattatggggtgttaaagtattgttcatcagaattttcattctagcaaacatagggtcgaaccaagcgccctcttttaaaaaaaggttctatcatgtcaaagtcaagagcctagaactagccagcttgcgagagctagggcagcgaatggatcaagttttacgtcaagccttccgcaaggcatataggaaaatctgggatttggccatgatagaagtgtccattgaagccatcgcatccctcgctcaatactacgaccagtcgctcagatgcttcatgtttggggacttccaattaagcaaggaaagcccgatcgatggtgttttggccgatgcatatgacacattcgacctgagatgcgaaaagagtagcgccaggattgtttgttgcatgcccactcattatgtgtggttggtctcccacgtgcttcatcatgaaggtagacctgtctgtcctctacaaggtcatcacatgtgcgctgaaaagggaaaagcaaattggaatgaactcttggcaggtatgctaggagcgtccgttagttggttcccccgatggaaagaaggaggggccggagtgttgtgctcgtgtgaaggattcccaaacatccccttgatgggaacaaggggtggcattaattataatcccatgctggccataagacaactaggctaccctatgagaggtgcaccgtcggaagagactatcgtgcctttcgtcgcacggggtttcattgaaggtaatgcaaaaatacttcagagaatctgtaaggcatggagtatagtggaaagaaaagataaggagcttaggggaagcagcaacgatgtcatcggtggctatcataagtggttaaaggctaggacgcaaggggtaacttggctctcaaagctaaaagatccaagtgggaaagaagctgaagtcctcaaggaaaatgaagaagtgcaagccttgaaagtagagcttgaaagaacaagcgtggttaaggaaaagctaaagacgatagtcaccagggtccagaaagagtgtgacaagctaagggatgtcaacatgactatggacgaagcattagagtgggaaacaaagagggcccgaaaggaagaatggggcagaaacaagttctga

SEQ ID NO: 52374 - DNA, 162 bp, Glycine max
  Peptide Sequence Number=SeqID_169152
atggggagttggatatgtgatgaaaggagggaagagtcatggtttgataattggaagttgggagatgggaggagctctttgcaaaaagaggacttagtgggtgatgtgggattgtggaaggatggatcttggtgttggaggttggaatggacaagacaatag

SEQ ID NO: 52375 - DNA, 1113 bp, Glycine max
  Peptide Sequence Number=SeqID_169153
atgtttagaactgagcacaagacatatgcggaggtcacagctaacaacaacccaatggttgttggacagagaaggcaaccccgaccaacatacagtggacaaacacagtcacagtcgacgatacaattgcaagtagactgggggaagaaggaatggcttaaagaagcatgggttggacgccttgagaaggcaaatgattttgaaagagttgaagacgagataacgtgggatctaggactgaacgtagtgccgaaatatatcggcaacgatatggttctaatacttgggctctcggacagcaagacacggaagctccaacatttgttccactcgttagagaaatggaacccgaacatgaagccaggatacagggtgatatgggcccaatgcctgggggttccactacaggtatgggacaccgacaacattcgaaagattgtggctgccgtcggtgatctaatcgatgtcgacgacgactttgaagagctgacacggctggacagggcgagagtcctcataagaactccatggagacccctacttcagcacacagttgtcgcgactattgacggagcagagcaccatatagctatcgtagaagaaggggcggtcaacggcagcacacagaatcgtcgagccaatagtgaatcaatcatgtcggaggacgtccagtcggaagatattgacattgactccgtcggcgtggcaccgtcaataaatctcggcttcttcaacttgctgaaaggcaccgccggcgaagggggggacggcggagaagaaaatgctctttacgggcctttaactgagagtccgttcctggtcaaaagctcgacggacattgtccaacagaaagtggagataatccggagaccacagcaacgcacgcgacccgaaaaaccccaacaaccatctgcagagatgacagaagatacacaaaagaaggaagtagaagggagcagaaggaagatgtcagggacagagagtgctgaagaggaaatgagtgttgggtcagatcgaggatacgagaccgacgtccttgaagctgtgaatggaaatattaagctgaacaagaaagaggatgtggaagatttcaatcagataacatttttttag

SEQ ID NO: 52376 - DNA, 1572 bp, Glycine max
  Peptide Sequence Number=SeqID_169154
atggggaacgttgtagagtccattattattcaaacgaaaaaggagaaaacaaaatggcttgataatgtttgggtgggtcgtttagaaaacaaaggaatgttcgaaagggtggaggaggagatgcaggggatgtttggaatggatgtgaaacccgcatattggggagaagatatggtcatcctccatgaaatggacgacgacacagctgacaaaatcaaccaacaggaacttggtaatggagggactcctttctcttctattcagaagtggacgccagagttgacgtcgtcatatcgcctaacctggcttctcatctggggcgttcctctggaagcttgggaaacagaacacttcgcaaccattgtggagacatgtggggaacttgtggagctagatgcggcaacggaggataaggtgaggatggacatcgcgcgggttctggtacgcacaaaggagaaaccattcatagctctttcggtgaacgttgtagtggatggaattcggcactgtctggagattcatgaggacatggcctctgggtggagaagaacggcgcgttttgaacctgaggaggtctttccgccgtctcctttctctacggacatggaggtctcggatgtagagccaaacatcctcgtccctcgtggagtttcccccgaccgccgttctggtaactacctcggagatttccccacccagtggttctcgccctggtacggtggaaacgggttggagacgccgggaccttggttcccgtcggtggcggaaacacggtggcacgagacagttcatggtcctgtgaagttgacacctaggagagaggaccagcagcattgcaacggtcattttcctatggatttacatggtaaaggaacgcctgaccctaagctttcctgccctaaccaaaatcagaccccatttgcggaaattgtagctgctgaaaaggtcaaagatgtttcagaggtgggaagtatccatcgggctttggaggaatatcccgtggccatgaactccgaggaatatccagtagtcaaccacgattcaaaattgccgggattgactgaaagggacaacagttcccaaggcttggagggggatggggtaaagaagatattgggcttggaaaacagtggcccaggtacaaatggcggtaaaacaagctctgtcttcaaagtgtataggagaaaaaatgagtgtggaacagcaaaatctacggcccaattaaatctgaacccagtttttaataagactggagaagtgggtgaatcagagaagctgggtacagttagtaataccaaacataacaacgaaggaggcatttctcgggctttagatacagccccattgacccctactcaggagcggccttctcatagccccatctcaccaagtagcttcaacaatgattattatggagtggaggatgatgctcactgggagatagctagagacttaggattatcctttgcggagaacactacaaatatggtcaagaagaagagggaagtggatagcagttgtaacacatctgtagtagcagtagagatgggaaagcatcaccatgacgcatga

SEQ ID NO: 52377 - DNA, 699 bp, Glycine max
  Peptide Sequence Number=SeqID_169155
atgatcgacatcagaaaggtatcacggagggatctgaggattagctacaaagcgattgagtccaagtgcggagatcgctggctcaatttgttgtcaccagaagttgcaccagaatttgcggaagccatgagaatggatcagaaagttctgaaaccatgtagagaagatataagggagaagaaggagagaaaagggatttgtattattgacgtagaaggaaatacaaagccactgagatctcttacaagagtggccaatgatgcacagcttagtacaatggttgccgaacaggttgagcagtcacaggcaggactaaaatcgctctccttctctgagaagacaataaatcagcttcgtgaaaactttgtctccattgagaatttatgtcaggaatgccaaacattaattgacaaccatgatcagataaagatacttagcaatgcaagaaataacttaaacacaaccttgaaggatgttgaaggtatgatgtctatctctgatgaggcagccgaggctcgggattctttgagtgatgacaaagaaatcgtcaacacttacgagaggttaacagctttggatggaaaacgaaggtttgctttagcagctgctggatctcacaaggaagagattggaaggctaaggtctgtgtcttctttggtgcactgtcacattcattggctgggtgagcaagaatcctga

SEQ ID NO: 52378 - DNA, 585 bp, Glycine max
  Peptide Sequence Number=SeqID_169156
atgctggggaagttgtttgtttgtgcttgcccacagactttagttcgtgctgtacgggttgttgaaatgcaagagatccttgatcaacagattgcagaagaagcagctgaggctgaaggggatggtgcaatggcatcagttgcaaatcctcgtaacaacggcataaaatctacaagttcaatggcttcttcaaaaaatttaatgcagcaaaaattgaaggttcaggggaaaggctataaggataaatgctatgagcaaataaggaagactgtagaaggacggtttaacaagcttctcaatgagcttgtgtttgaggacctgaaagcagctttagaggcagcacgagcgattggggaagagcttggagatgtctatgactatgtagctccctgctttcctccaagatacgaaatattccaattaatggtaaatctgtacactgagagatttattcagatgctaagattgcttagcgacagggcgaatgaattaacaaacattgagatattaaagctcgaagtcctcaacaacttagctgtcactaacagaaaccgactcagtctctattctttatattctccctga

SEQ ID NO: 52379 - DNA, 207 bp, Glycine max
  Peptide Sequence Number=SeqID_169157
atggcgtttgaatgtgggactaagtccatagacgtgcaaaacactttgcataatggaattctaaggggccaccggaatattgaagatagagtgaatgtggaagatgggcacatggaattaattactatgctaattcaagaagctcatccattagtagctgaaaagtatgcttccaactccagtatgtactttgttagacaaggttga

SEQ ID NO: 52380 - DNA, 999 bp, Glycine max
  Peptide Sequence Number=SeqID_169158
atgttttctgcccccccctataatgagtttggaaatgaggaaagaagaaagaatggagacatgctttcaatttggaaccatgatggtaagatttcatttgaagacataattaaggccacgaaagactttgatataaggtattgcataggaacaggtgcttatggaaatgtgtacaaaacacaacttcctagtggcagaattgttgcactgaaagagcttcacaaatcagaatctgaaaatccatgcttttacaagagctttagcaatgaagccaagatcttgacagaagttcgccatcataacatcattaggctttatggcttttgtttgcataacaagtgcatgtttttggtgtatgagtatatggaaaggggaagcttattttataacttgtctattgatatggaagctcaagagttgaattggagcaagaggataaatattgtaaaagggattgcctatggcttggctcacatgcaccatgattgtactccacccattgttcatcgagacataagcagtaacaatattttgttgaactcggagttacaagcttttgtctcagactttggcgcaacaagacttcttgattattattcatcaaatcaaactcttcctgctgaattggcttacaccttgactgtgactacaaaatgtgatgtctttagctttggagtggtggttttggaaacaatgatgggtagacatccaactgaattgatttcttctttatcagaaccatccattcaaaacaagaagctaaaagatatattggactcacgaattccactactcttttctcgaaaggatatgcaagaaattgtgcttattgtaacattagcattaacatgcttgtgcccccacccaaaatccaggccatcaatgcaggaaatagctaatgagcttttagtttcccagccaccattcgtttggcattttgatggcatttccatccaccaactgatgaagcaaaaaatatacataattggtagaagctag

SEQ ID NO: 52381 - DNA, 141 bp, Glycine max
  Peptide Sequence Number=SeqID_169159
atggctgaggatctcggcgtggaggcgaaggaggccgcggttcgcgaggtcgccaagctgttgccgcttccggagcttctccaatcgatctcgtccatcaaggctgattacatttcgcgccaacaggtgttattgagttaa

SEQ ID NO: 52382 - DNA, 161 bp, Glycine max
  Peptide Sequence Number=SeqID_169160
atgtcgacaatgaaagggcacaagaaagggagagagattcgagggaaaggagtttgcaaagacaagctaagatgtgttgaagaagtattggatgagagtgagcgcaaaaagatgagaggctatgaagcacagtctactgaggagaagcagaggcttttaaa

SEQ ID NO: 52383 - DNA, 408 bp, Glycine max
  Peptide Sequence Number=SeqID_169161
atgccaaatttaaggttttatgtggcagttgtggttgtgattttgtggcaatccttgatattgcgaaaaattgaagacaaggtggaggagaacatctgcaagtttgccaagaaaggtcttactccctctcacattggtgttattcttcatgactctcatggaattgctcaggtgaagagtgtcactggaagcaagattcttcgtatattgaaggctcacaggcttgctcctgaaatttcgaaagatttgtatcacctcatcaagaaggttgtttatattaggaagcacttggagaggaacaagaaggacaaggattctaaattcaagttaattttggttgagagtaggattcaccgacttgcccattactataagaagacaaagaagcttccacctgtgtggaaatag

SEQ ID NO: 52384 - DNA, 1236 bp, Glycine max
  Peptide Sequence Number=SeqID_169162
atggagtctccaactcaaacacattatttcctcttttccatgcctcatcccgatttcatgactaagctgaaggaaactcttgcagctagcctggagtttcgaaagcaacatgatgatatccaagctcgacccaatgattttccagatttttccatctctgatgattttattctttataagggcaccatctgggttgacctccaaaatccattcatcccggcgcttctacatgagtaccactctacccctctcggtggccacttcggtgtcaagaaaactttacatcatctccgttcaaatttccaatggaccagcatgcttaaggacatcaagtcattcattcgcagttgtacaacttgtcaacaagttaagcatgttacgcgtaaaagtgctgggttactccaacctataccaatgcccactggagtttgggaagacctttccatggacttcgtcacccatcttcctaactcccacgggttcacaactgtcctagttgttgttgataggttctctaagggagttcatcttggcaccttacctacccaatttacagcgttcaaagtcgccaaccttttcctcgaaatcgtgtgcaaacagcacggtttccccagaagtattatctccgacagagacccaatcttcatcagctctttctggcgtgagctgttcaaactaagcgggacttcattgcgcatgagtatggcttatcacccacagacgaacggccaaacagaagtaatgaaccgcactcttgagcagtacttgcgttcacttgttcatcaacaaccaactgagtggcagaagttcctagccttggttgaatggtcttataacacttcgcaacacttaggcaccagccttactccttatgaagttgtgtttggtaagcctccgccatccgctcccgactacactaagggctcatctcgtaatgatgcggacatgaaacatttcgctgacaagtcacgacgcgatattcagtatgaggtagcgtcctcatcatggccccttcgagttaccaacctcactcttccgccagatgcccttgataaccaaccaatattgaagcctttagcgatccttgattcaagcctagactcctccactacaccgccaactcgtttcgtcttgggtgggataatgatagcaccagcagtcaacaaaaagaggaagaccctgtggttttacacgaagatagaccacgaaggaactgcatgcgccccaaatacttag

SEQ ID NO: 52385 - DNA, 2277 bp, Glycine max
  Peptide Sequence Number=SeqID_169163
atgtgcgatcgtatttctcgcatgaaccccacgccgcctccccctcctcctcttcatcaatcacagaacaactttatcacgtcgtggccaacactcctccaagccattgaaacccgcttcacaccttcattctacgacgatccacgcggagcactgttcaagctggtacaacgaggcacattcattgactaccttacagagtttgagaggttagcaaaccgtattgtagggttatcacctccaattcttttaagtttctttatttatggcttgaatctggaaattcgacgaaaagtacaagttttccagccgatatcagtaccccaagccacagcccttgcccgtcttcaagaagacaaattaaaccatcgccgcaaacactctaaaccacctttcacgactcaccagccatcccctttaaccatccctaaccctacaccgagccagccacctcgtcgcaaacaaccattcgtccaaagaacacaagaagatatggcgcttagacgagaaaagggcatatgttacaattgtgaggaaaaatggagcccctctcatcattgtaaaggcagattaaccacgcttgagcttgcatcttcccctgaccccacacttaacacgacctcagctaatcctcacccaccctttgacccaacaccattacaaccccatattagcctccatgctatggcaggtgtacccgccatcaacaccttccgtctgtatggcctgatcaacaacacgcatatcaccatattagtggataacggcagcactcataactttgttcaacctcgtgttgcaaagtttctgaacctctgcatgcaagatacggtgccactccgcgtcatggtagggaatgactccgttttggattgtcgacaactgtgccctgacaccataatactcattcaagaccatactttcgtcgtgaccttgcatgttctaccgttaactggagctgatgcggttcttggagtagaatggttgcgcactcttgggccgatcatgacggattattccatgtttaccatgcaattcacccattcaggccaacccgtcaacctccatgctgacgtacagatcaatgaaaatctagcctccgcccaccaagtcaaacgcatgctcaccacaaatgctacgtcaggtctgttccacttatccctcttacccattacgaaacccaaacccgtcctcggtcagccttaccccatccctgccattaatgatcttctgctcaaatatcaatcattattccagcaaccttcaaccttaccacctccccgccagcacgatcactatattaacctcattccattctccaaccccgtaaatgttcgtccctacagatatcctcacttccagaagacggaaatcgagaaacaagtgacgacactactggactccggcctcatccaaccaagtcgaagtccgttctcatctctagtactattagtaaagaagaaagacggaacgtggcgtatgtgcatagactatcatgcacttaattcaattacgatacgagaccgcttcttgttaccaacaattgaagaactcctcgacgagttaggaagtgtctcatggtttttgaaactcgatttaagacaaggctttcatcaaattctaatgtcggaccaagatataccaaagacagcttttcgcacacaccatgggcattatgaataccgagtcatgccctttggcctttgcaacgcgccatcaacgtttcaggtggccatgaacgttgtcctgagtcccttcttgcggaagtttgcagcatattaccttaagcgttccaaatgcatattcaggcagcatcaactcgactacttaggtcacgtagtctctggcagcgaagtgcaaccagacccctccaaaggatatgctgccattgcagcaccattaacaaaattactctgcaaggatgccttcaagtgggttcctgagtcccaatctgctttcgaacgactaaaaggtgtagtgacaaccgctccagtattggctctccccaacttcgcgcttccttttgccgttgaaatagatgcatctagctacgccatgggtgttgtccttcatcaacaaggtcaccctatagcattcttcaacaaacctttctgttcccgactccaacatgcatccgcatacgtccgtgagctacatgcaatcgtagccaccgtctgcaagtggcgacagtatttgctgggtcacaagtttacggtgtacatagaccatcgcagcctctacgagcttatgtctcagattgtccagactccagaatag

SEQ ID NO: 52386 - DNA, 222 bp, Glycine max
  Peptide Sequence Number=SeqID_169164
atggcttcttcgaggcagtcagtggtggtgcggcgggttccgtgttctgccatggcagcaggtcagaccaaaatgataggagcgagagggaaaggggaagatgccttggttcgaggtcaagtcattttaaaagaaaagaaaattacatatcaagatggagcactaaagggtgatatggttgtccttgttgtaacatggatgcatggtcttcatgattactaa

SEQ ID NO: 52387 - DNA, 1455 bp, Glycine max
  Peptide Sequence Number=SeqID_169165
atgatcacaacgggattcatcaaaaacccttccctcgccgcaaaacttgttctttctttcatttcctcaccccatgagcctcttgtcgagttcgctcgctatgttttctacatgcaccacgcttttcacgatttctgcaacgacccttttttctggaaccctctgatcaggtcccactctcacgggcgtgagcccagaggggccctggttctgctttgcttgatgattgaatatggggttcatgggttgctgtggaagatgaattttgggtctgatgtgtttttgcagaattgtttgattgtgttgtttgttagatgcggttgtgtggagcttgcgcgccaagtgtttgacagaatgcctgaccgggatgttgtttcgtataactcgatgatcgttgggtatgtgaagtgtggggcggttgagagggcccgcgagttgtttgatggcatggaggagaggaatttgattacttggaattcgatgatcggagggagagatgttaattcttgtaattcgatgatggctggatatgttcagaatggttgttgcatcgaggctttgaaaatattttatgatatgaaaaggtcaacaaatgtggtgcctgatgatactaccttgttgattgttattacagcgtttgcccaattaggacatgttgaagatggagttgtggtacgtcattatataatggagaaggggtattctctgaatggtaagcttggtgttgctctaattgacatgtattcgaagtgtggtagcattgagaatgctatctcagtgtttgagaatgttgaacaaaaatgtgttgatcattggagtgctatgatcggtggtttagatattcatggaatggatgaaatgactttcgaatttctcatggagatgggaagaatttctgttattcctgatgatatcacattcattggagtattgagtgcttgtaggcatgctggcatgttgaaggagggactaatatggcacgttgaagaagccaagaaactcattgaggagatgcctgttgaacccaatgatgtgatttggaagactctactcagtgcttgccaaaattatgaaaacttatctataggagagcctgtagtaattttccaagaccaaggtctgttcggatatggcttatgcatccgaaatagtcatggtgcttttgttttggcaaaaacagattgtagaatggaatcccctgatgcatatgaagctgaagctctttcttggataaaggagctgaattatcaacacgtaataatagagctcgacagcaagcacatggttgatagtgttcatagcaacaatctgaatctatctgactgtggagtcgtattgcagaattcaataacacctagggatagcactaggacggttgtggaccggtctgactctttccgtcttgattcccaagaaagaccagatgaatatgtaggggtgggaaaacggacctag

SEQ ID NO: 52388 - DNA, 195 bp, Glycine max
  Peptide Sequence Number=SeqID_169166
atggacacccgtctccgtgtgattggtgatcccatgaatggagttcaacggtacaccaaaatgaaatttgacggagctgttccgtttctcattcctatgatgaggggtgggggtcacaacccactctttgaggattcacctagtgagtgtggtggtggggccgtcactgtgagatatggactaatctctaagtga

SEQ ID NO: 52389 - DNA, 126 bp, Glycine max
  Peptide Sequence Number=SeqID_169167
cgtgtgctggatcttgcgcttagcgtgctactctcgctcaacgacactgttctggtttacgcgcttagcgcgactgcttccttcgtgctcagcctgtgcttcacgctgagcgaaatattgggttgg

SEQ ID NO: 52390 - DNA, 231 bp, Glycine max
  Peptide Sequence Number=SeqID_169168
atgagtgagtaccatcctactattgatgtagaggaaccacaactttttagaagaaggaaggggaaatccttcaatatgaaggggagattcatccttcagaagagaggggaaaaccttctgatggaagcttgcttgtggggcttctatggaggctggatctttgagcttcaattgggtcctttaatggtgattttccaccatggagatgcagcggaagacaaaggaaaatag

SEQ ID NO: 52391 - DNA, 2188 bp, Glycine max
  Peptide Sequence Number=SeqID_169169
atgaagttaacatcacagcaataccaagctctaatgagtttgctgcaacagacatccaccaatggatcttcttcttctacacagacagcccatatcaatcaacttggtatagtttctaaagctgattcaattataggaagtgttttacctataatctgcaacataaacaatgattctgacctcaatacttggtttcttgactctggtgctactgatcacattgcatcttcccttgatctatatagtgaatgtaaacagatccctcccatcaccgttagccttcccaatggagaacaactgattgctagatattatgggactgtgaatatttcagaatttcttgttctgactaatgtgttgtatctacctaatttcaatttcaatttgatctccatttccaaattgactaattccatgcattatcaacttatattcttggctaataaatgtctgatacaggaaatctccaccaagaagatgattggtacagttgatgttgaatctgattccccttctcctccacctttacctccccaatctgaacctgtacctattgaccagccaaacactgaccacacctcctctacacccactcctcgtagaactgacagaattcgaaccagacccaccaaatacactgactatcaaaccagtttcacatcagccactgttaccaatcatccaggcactaaacaccctatttcttttgtgatttcctataacaagctctcttcatcttatcacagcttcattcttaatatctctgctaattctgagcctaagtcttataatgaagcctgtaaacatgattcttgggttcaagctatgcatgatgaaatttctgctctagagaggaataatacatgggtgctcactgatttacctcagcataaaaatgtgattggtctggaatatttggatacattttctctagtagccaaaattactacagtccgtcttttgcttgcattagctgcttcgaataactggtatctcaaacagcttgatgtcaataatgctttccttcatggtgatcttcatgaagaggtgtatatggttctacctccaggtatgaaatctgctaaacctggtcaggtttgtaagttacaaagatctctttacggtttgaaacaagctagtcgtcaacggtatgctcgattgtctacttttcttgcacatcatggctttaaacagtcagttgctgactattctctctttaccttgaaaagagcaaattcattcaccgcattattggtctatgttgatgatattgttctaagcgggaatgacctctctgttatctcttccattacaaaattattggatgacacttttaagatcaaagaccttggcaatttgaaatatttccttggctttgaagttgctcgtggaacctcaggtattaacatttgccaaagaaagtatgctttggaccttctcattgatactgatatgttgcattgcaagcctgtatctactccttttgattactgtaccagattgcatcaagcctctggttcaatgctttctgactcccaaatctcttcatatagatgtttaattggcaggctcatatatcttacaaatactagaccagatatcacctttgttgtacaacacttgagtcagttcattgcttctcctactactgcacattacacaactctttatcgcattcttcgctacattaaagctgctcctggtttgggtcttttcttcccttccactagtgaactacaactcaaggcatttagtgattctgattgggctggctttgtcgacaccaggaaatccattactggtttttctgtttatcttgggtcatcactcatatcttggaaatctaaaaagcaagccacagtctccagaagttcctctaaagttgaatatcgtgctctcgcttctgtaacttgtgaaattcaatggctcacatatttgcttcatgattttggtattactcataagcctactttagtgttttgtgacaataaatcagctctccacattgcagccaatcctgtcttccatgaaagaaccaagcatattgaaatagattgtcacatagttcgtgacaagctactttcgggattgatcaagctcctacccattgcttcacaacaacaacttgccgatgtttacacaaaagctttagctcctggtgcttttcgttttatctgttccaagctgg

SEQ ID NO: 52392 - DNA, 363 bp, Glycine max
  Peptide Sequence Number=SeqID_169170
atgacagtgttatataatgacaaaagtcaacggacagcaagtaattcgtcactgcaagacgtgacaagggtgaaatacttgcatggatatattggtagcgtgcttgatgccttaagagatggatcaaatataaaggggtattttgcatggtctttcctggatttgttcgagttgctagatggatacaagtcgagctttggcctatactacgttgatagggatgatccagagttgaagagatacccaaagctctctgcaaaatggtacaaccggtttttgaagggtagaaggacctctatagttggaactattgaacttgagaaggatccatcacttgtttttgtttcccaattatttgagtag

SEQ ID NO: 52393 - DNA, 252 bp, Glycine max
  Peptide Sequence Number=SeqID_169171
atgggagagaaggctaatagtgttcaagattgtctgagtgatgatggcttttttagccagaagaatactgtgcgtgtttataataggatgaatgataacattcttgtgtatctccattgtcaatcgaaggacgatgatcttggccagcatgttcttgccgttggagagcaccaagaatggtccttcaatgatagggttattggcacaactcttttttggtgcacgatgaatgcaaacaatgtgcatgtttga

SEQ ID NO: 52394 - DNA, 1314 bp, Glycine max
  Peptide Sequence Number=SeqID_169172
atgggtaccacaaatataagttatgcattcttcaactcaaccaataatttatggaaatacaaaaaatctgtaatgcaggaagatgtgctactcatggtggaaacaggcctcgaggcctatagattttccatttcttggtcgagactcataccaagaatccaaccacatgtcacactgcacaactttgatcttccacaggcacttgaagacgaatatggaggatggattagtcgtgatatcataagagacttcacaaactacgcagatgtgtattttagagagtttggtgatagagtgcagtattggactactgtgaatgaggccaatgtctttgccttaagtggttatgatcagggaagctgcccacctcagcgatgttctcccccattttgcgttacaaatatcacaagagggggaaactcaacatatgaagcctacttggcagttcatcatatcttgttatcacattcttcagctgtgagattgtatagaagaaagtatagggatgaacaacatggatttgttggtatctctgtctatacacttgggttcattcctctaacaaacacagagaaagacagggctgcctctcaaagagcccgtgattttttcattggttgttgctaccttgctggtgatgactatgataacaatttcaggattgtggaacccttggtgcatggagactatcccatttccatgaaaacaaatgcaggtgcaagaattccagccttcacaaatcgtgaatctgaacaagttaagggttcatatggctttataggtataattcactacaacaatgctaatgtcacagacaatcccaatgccctgaagacagaactgagagatttcaatgcagacatggctgcacagctaatccttttacaggatctattttcagaggaagagtatcctgtcacaccatggagtttacgggaagagctgaaaaaattcaagctccattatggcaatcctcctatattcattcatgaaaatggtcaacggacagggacaaattcatcacttcaagatgtgtcaagggtgaaatacttgcatggatacattggtggggtgcttgatgccttgagagatggatcaaacataaaggggtattttgcatggtcttttctggacgtattcgaattgttggctggatataaatcgagcttcggactatactatgttgatagaaatgatccagaactgaagagatacccaaaactatctgcaaaatggtacagcaggtttttgaagggaagtattgaactccagaaggatgcatcacttgtttctgttggccatttatttcagtag

SEQ ID NO: 52395 - DNA, 174 bp, Glycine max
  Peptide Sequence Number=SeqID_169173
atgtcctctatgccgagagggaagagtttacgaagatgctgtgcatttggaagaattaaatactctgctaggccgaagtactgggagcaaaggcttcagatggagagggtagagagggttaagcaagtaaaggagcactgggaaacgcagtgtagggcgttcatgggcatctaa

SEQ ID NO: 52396 - DNA, 369 bp, Glycine max
  Peptide Sequence Number=SeqID_169174
atgcatttcgcacaagattccgaggagaaccgcgattttctcttcagaatggaatgcttcatgccagtgctggttggcttcctcgacaatgttaatggcggcgtcaaatttggttatcagcaaaatggaacatcgcgagaggctgaaaaacttgatactgaagaggcagggggagggagaaaaatagagcgtggattctctgcttctcgttctgtaaaatggaatctgcgagagaggaattcactttcaacacgagagagaagacattgggtttggtttcggcggtggacacatcttctcgagagcctagggaagatgaaagagacattagaaaaaggaaaacaagcgaagcgaggagataggaattga

SEQ ID NO: 52397 - DNA, 705 bp, Glycine max
  Peptide Sequence Number=SeqID_169175
atggtagtagttctctctctctctctctctctctctctctctctctctaagttcgttcctttcagcaatggatacaaagatctccttcccctttcccttctcaagactgcccaaggccaccccatgctggtggaactgaaaaatggggagacttataacgggcacttggttaattgtgatacatggatgaacatccatctccgagaagtcatttgtacctctaaagatggagatagattttggcgtatgcctgagtgctacattcgtggcaataccattaagtaccttcgggttcctgatgaggttattgacaaagtccaggaagaaacaaagagccgtactgatgcatatggttttatgcttgaacctaacagtttcagagtcagacttatctcttactcttatataaatcagcaatggaagtttcatcactgtgaacaaatcgcaaaccccctggtgtgggacgtggaaggggaagaggtagggatgatggtcctggtggacgtcaacctaaaggaattgggcgaggtattgatgagggtggagctaaaggacaaggaggacgaggccggggtggtccaggtggaaaacccagtggaaacagaggtgcagggcgaggtagaggttgatttgggtgctgatatggaactacagatgggccagttgctgcttttagaggcattggtgcccattcaaaacatttag

SEQ ID NO: 52398 - DNA, 628 bp, Glycine max
  Peptide Sequence Number=SeqID_169176
atggtggcggctggcacggtgccggtggtgcccgaagccgactggctggccgatccgctcaaacgcggcagttacaccaccggcgatggatcttccactatccgggtgccggatttcaatgggaaggccgctggttctctcggagccctttttcagcgaggtgatggtgcagttgccaacggcattatcacgagggacgcgatgcagggccacttccacgcggcaagaaacccgggtgcggcctatggcgggggttcctcaattcaagctatccagtcgaacgccggaagttatgcgttcgccgatggtggcgtcggggcgccgacttcggacgggacaaacggcacgcccaggacctccgctgaaacccggcctatcaacgtatcgggcgtctggactatccacgcgttcggcgcagtcaccaatcctgggagcgcggacgcagcccagctggccagcgactacgccgtgctcaatgcggcatttcagacgatgcgcggccaggtgttcggcccggggcagaccctccaggatatgaccgcatcgcgggcgtttggcaccaactacgtgaattccaccgggaagccgattttcatttttgtctattccgaatcgacgacagcccagg

SEQ ID NO: 52399 - DNA, 270 bp, Glycine max
  Peptide Sequence Number=SeqID_169177
atggatcaggtttggggatggctttcatgtctgcaaggtttatgtcaacaaaagtcggaaggagttgataggccgcaatggtccacatttagtcatgttaactactcaggttctctttcatccacatttggtagcaaggctactcactgtaaggtcgattctagaagaaacatgctactcactgtgtcatgcaatgcagaagacatgttgcttccacgcggtaattttacattttccgattcagtttatatcccaagaatttcaatctaa

SEQ ID NO: 52400 - DNA, 339 bp, Glycine max
  Peptide Sequence Number=SeqID_169178
atggggtctaaaaatctcttcttttttgttgtttgtatgtttttgcttatggttttcactttgtgtttctctctcttgattgatttcagattcaaacgtgactggaagaagattgaagcattcgtaggtttggttttgattgccaaaatagaggaatatgcaccaatagtgtatactccaacagtgggccttgtatgtcagaactatagtggattgtttagaagaccgagaggaatgtacttcagtactcaggattgtggagaaatgatgtctatggtgtataactggctagctgagcaggttgttaactatccatatttctgtataaatttttgctag

SEQ ID NO: 52401 - DNA, 216 bp, Glycine max
  Peptide Sequence Number=SeqID_169179
atggcaggaaagacacagtatgttggactgaaggtgtggctgctggactgcatctgggacttggactgggggcagactgcatctagggcaaaaacaaggggaaaaaacaacccattgctgataagtatttgcatagctccaagaatggagcttatagtgctgttaattaggtcaaatgctcaaattactaatacaaggccaactaactactactaa

SEQ ID NO: 52402 - DNA, 633 bp, Glycine max
  Peptide Sequence Number=SeqID_169180
atgttgcaacaagaagaagaaggctcttcctcaaaaaaggaggaaacaagttcaactgaagaagaagaagaagaccctttctaccaaaatgaggatgattgttttgttccggtcaaagaaacaggtactgtagcaactagtactttgactgactttaaaaagagacctcaaacatattgtgagattcctgcaactttggctcatgttgaagctctagaggcatatacccagatatctagtcatccctttcacaaaacaaacaaacaagacattatatctcttgatatcctttattctaaggacttaattgcaactggaggtattgatacaaatgttgttattttttaccgcccatcaggacagatattatctacactcagcgatcactctaaaaaggtgaccagtgtaaagtttgtagctcagggtgaatcattcataactgcttcagcaaataagtgcttagctctactgagttttaaaagattggctaagattttgttaaaacataagcacttagacaatgaaggaaagctggagttgttgcacatgatgtccaacgttatgtccaggacatcctgcccgaaaatactggagttgctgcacaatgcacaaggcaagataaaagtcaaatga

SEQ ID NO: 52403 - DNA, 213 bp, Glycine max
  Peptide Sequence Number=SeqID_169181
atgtgttttgacagtcccaaatctgcaattgatactagtgatggactgacatatttggatttgatcattaaccaaattgagaccctcaattccaagtatggaagcagggttccattgcttcttttcaataaagatgacattcatgatagttctctaaaggtgaaatgccattttcaatttccatatgcgattgttgacctcagccactattga

SEQ ID NO: 52404 - DNA, 1119 bp, Glycine max
  Peptide Sequence Number=SeqID_169182
atggctgaacaaaaaaatcatgtcatccctcttcttactccttacgggatggggaacttcaatctatcccacagaatcgttttggcaccactatttagagcaagatcttacaacaacgttgctcagccccatgctattctatattactctcaaagagctaccaagggaggtcttctaattactgaagccaatagtatttcacccacttgtcaataccatccaaacgcagttggtatatggtcaaaagagcaaattgaagcatggaaacccattgtggatgctgttcatgccaaaggtggtatattcttctgtcagattcttcatactggaagggtttcagatccagattttaagcccaatagacaaaccttaatatcatcaaccaacaagccattgacacataatggcatcgaaccaagggcactaaggacagatgaaattcctcatatcgtcaatgacttcaggcttgctgcaaggaatgctattgaagcagatattcaattcctaaccgcaattgcaattgtagggtttgatggagttgagatacatggggcacatggttttctaattgatcagtttttgaaagatcaagttaacgacagaacagacaaatatggtggatccacggagaaccgttgtcgctttgcattagaagttgttgaagctgttgtagaagaaataggggcagatagagttggaataagactttcacccttttcagactacaatgaatgtaatgactctaatcctcaagcattgggtctctacatggccaaatcacttaacaaacatggtgtgctttattgtcacatggttgagccaagatgggacatttctggggagaataaggaaacccctcacactcttgcaccaatgaagaaggcctttaatggcactttcattgttgctgggggttatgatagaaaagaagggaacaaggctgtggctgaggagaaggcaaatcttgttgcttatggtcgtttgtttttggctaatccagatttgcctaagaggtttgaggttgatgcaccactcaacaagtacaatagggagaccttctacactcctgatccagttgtgggttatactgactatccatttctagaaggaagttcttaa

SEQ ID NO: 52405 - DNA, 531 bp, Glycine max
  Peptide Sequence Number=SeqID_169183
atgtccgacgacgtcttggactacagctccaccagcgaggttggccgtggcggtggacgcggtggtgatttcttggcttcagcggagcttctccagcttggtagcctccttcttggtggcctttttgctgacttgggcctccgacgatgctgcggcagcggcgagatcgtgtatagtagacctcgtcacgtggagatccacctttttgcgaggacggcgtggatcgtgtatagtagagcttcgcctttttgtgagcggaagcacaagagacggaagggttcaaaggaagtgcaagagacgagattgaaagaagcactcgctagcttcaaggtctacgagcctctgaagaagcgaaagctctacgagcctttaccagtaccgccaccgtctttgcccggcggaacaaggatgaaattcgaagcgtgtaagaaggctacaagcggattaagcgttgcttgcttcggaaagacgctcactcctccttgtctaaactcgaacaaagttatctcgctctcatcacttcttccagag

SEQ ID NO: 52406 - DNA, 1725 bp, Glycine max
  Peptide Sequence Number=SeqID_169184
atgtccttcttcaaattttacggcaaggtcgatgaagcggagcacgccatgctcgaagctcgccgcaaaacgcgaaagcgagtcaccatcatagccttgtccacaatagtcctcgtcggagttgtgtgtgctgctgtatttggaaccgttgcacacaacaacaacaactcaaataatgatggtgtaaataatgcaccatctctttccaattcagtgaaggctgtttgtgacgtgacactttacaagggcgcgtgctacagtagccttggtcctcttgtgcactcgggtcaggttcgacctgaggagttgttcttgctgtctattgaagttgccctagctgaggcttcaagggctgttgagtatttctctcagaagggagtttttaatggcttgaatgttgataataggaccatggaggggtttaagaactgcaaggatcttttgggtcttgcggttgatcatttgaatagctctttggcttctggggggaaatcttcgttgtttgatgtcttggaggatcttagaacttggttgagtgctgcaggtacttaccagcaaacttgcattgatggccttgaagaggcaaaagaagccctgaagaccagtgttgtaaacaatctaaaaaattctacagagttcaccagtaacagtcttgccattgttacttggctcaacaaggctgcaagcacagtgaacttgaggcgcttgttgagtactttgccacatcatatggtagaaccaaagtggcttcattctaaagaccggaagctgcttcaaaaagatgatttgaagaggaaagctcacattgttgtagcaaaagatgacagcgggaaatttaaaacaatcaccgctgcacttaaacaagtccctgataatagtgacaagaggactgtgatctatgtgaagaaaggagtttacgatgaaaatgtgagagtggagaagactaaatggaatgtcatgatcattggtgatggtatgaatgccacaattgtatctggaagccttaactttgtggatggcaccccaacattttcaaccgcaacatttgctgtgtttgggaggaatttcattgctagggatatgggatttcgcaacacagctggtccacagaagcaacaggcagtggcactgatgacaagtgctgatcaagcagtttattacaggtgccaaatcgatgcatttcaggactctctttatgctcattccaaccgccaattttacagagaatgcaacatctatggcacagttgatttcatttttggcaattcagcagtagtcctccaaaactgtaacattatgccaagggtgcctatgcagggccagcagaacaccataacagcacagggaaaaactgaccccaacatgaacacaggaatttcaattcaaaattgcaacattacaccctttggggacttgagttctgtaaaaacatatcttggaagaccctggaagaactactcaaccacagtgtttatgcaatccacaatggggagtttcattcacccaaatggatggttaccatgggtagggaactcagcaccagataccatattttatgcagaatttcagaatgttggaccaggtgcttcaacaaagaatagagtgaactggaagggtttgagagtcattacaaggaaacaagctagcatgtttactgtcaaggcttttctttcaggggagagatggattacagcttctggtgccccctttaaatcttccatatga

SEQ ID NO: 52407 - DNA, 210 bp, Glycine max
  Peptide Sequence Number=SeqID_169185
atggaggagaaaggagaagctcaggaacttgggaaggagaagtgtaagttaacgttgatggaacattttttttataggagaaaaaagcgttgtgtcccgacgtccttcagcacaatattccttaaagcagttcacctagtcatctgctcccccaaacacaaagttcaagatcatcacaggatccaaacacaaatagtaaactgggagtga

SEQ ID NO: 52408 - DNA, 228 bp, Glycine max
  Peptide Sequence Number=SeqID_169186
atggaggcaggttgtaaaaataaaaaggaagtaactactacgaccgtcgaagacgaaaagatggcttttggaccatcaaaattaggaaagcagccactatggtcatcgaaatcaagccaatggcctcaagccatggaagaaaacaacatggatatcgatgccatcaaaaaggaaatgcgaatgatgaatactaatgtcataaaaagaaatgggagtgatggatactaa

SEQ ID NO: 52409 - DNA, 228 bp, Glycine max
  Peptide Sequence Number=SeqID_169187
atgttggcggagagcgatcactacagggtggagttcagagcgtgcaaggacgacgcgtggtacacggcgcgcgtttcgctggagggagaaactctgacagtgaagtacttgaacctccctgacgaatacgacaacgcgtttcgagcctccgagtttggggaacgcttcagacccctctccaaacagcttttattaggaagtagggaccatcttgctatagcactatag

SEQ ID NO: 52410 - DNA, 306 bp, Glycine max
  Peptide Sequence Number=SeqID_169188
atgatgatatccataccacttttgcaaagttaccccttcatagcattgttgtctggcttagcactatacatagtgttaagtgttgcttcaattctgaagaatcttctgtctgtaaccattaatactggtctgttccttctacaaaaccgagcagtggaacaacaccagaggggggcagctaatggcatttccatgacaggcatgtctctattcaaatctattggccctgctacaggtggtgcaatattaacttggtcacaaaagcggatggatgcttcattcctcccaggtatgatgctcaattaa

SEQ ID NO: 52411 - DNA, 1289 bp, Glycine max
  Peptide Sequence Number=SeqID_169189
atggaggagcacgcattaaaggcttctaccaatagtactcattccaacaactctagaggaaggggtagaggtagaggggaaagctcaaattttatcaaggagaaagaagtggaaaccttattgatggctattaaagatgcaaaagacagtgaggtagaaatctggtatgtagacactggttgtagtaatcacatgagtggaatgatgggaaaaggtgatattaagatgaaaaccaagaatggttttgtagaaacaatttctaatgtgctctatgtccctaacttgaaaaacaacttgttaagtgctggtcaattgcaagaaaaaggttatgatatttttattagcaaaggtacttgtgaaatttttgatcctgttcgagttgccattgcagttataaaaaagaattcaaacagtggattgaatacccttgaacaaaaaaacatggtgataggccttcctcaaattactggtccctctcaagaaaaatctgaagctctctcttcatttaaaagctttaacgctcgagttgaaacagaatccaaaaagactattaagtctcttcgaacagaccgtggtggagagtattgctcagatgaattttctactttctgtgtaaatcatgttatccggaaggagttgaccacagcatatacaccacaacaaaatggtgtctcaaagaggaaaaatagagtcattctcaacatgtcacaagcatataaattgtataatcctaccactaaaaagatcattattagttgtgatgttgtttttgatgaagaaatattttttgaaaataacatagatgaaacaaagcaaattcttgcaaactttgatgaagataatgaagatgaagagttgcagacaagggagctagaagaacaacaaattccagcaatcacagttgaagatgaaagacctcaacgagcaagaagaaggcctgcatggatgtctgattatgaagtaacagaaattgaagatccgattactcattttgctttgttttcagattgtgaccctacgacctttgaaagtgttgtcaaagaagaaaaatggagaaaagcgatggatgatgaaattgattccattgaaagaaataatacttgggagttgtgtgatcttccaaatggacataataccataggagtgaaatgggttttcaaaacaaaattgaaaagaaatggtgaagtggataaatataaggcatgcttggtggccaagggttacaagcaacagtatggggttgattacacgaaagtgttttcaccagttggaagacatgatacaatcag

SEQ ID NO: 52412 - DNA, 399 bp, Glycine max
  Peptide Sequence Number=SeqID_169190
atgtggaataatccgtggttgagagataaggataactcctatgtgacaattgcgcctgatcctaaccttcataaattaagagatgtgaaggctatattgagtatccctttagttaatattgagggggaggatagaagagtttggaggacacatggtcatttcaaccaggagagattgcatgtgtttgagagtatacccgatgtcaagaaaagggaagctttagctcttttggaagtaattcattggattggtgatctgggacaaactcgtgtcattattgagcttgattgtaaacaagtggtggatgtaatccataaacctatcatcgatgctcctgagtttggggttattacttcaattgcaaaagactcattcataatttccaaattggctttgtaa

SEQ ID NO: 52413 - DNA, 252 bp, Glycine max
  Peptide Sequence Number=SeqID_169191
atggcatggtccatagaactttcagagttcgatatccggtacgaaccccgtggccccataaagacacacttcatggtagacttcctagcagaatttgttgagaatcaccaaaccaccccaaattggtgggccctctacgttgatggtgcatccaacgtgaagggaggtggggaaggaatcatcctcgaaggccccgacaatgtcatcctaaagcaagcccttaaactcaacttcaaagccttaaacaattag

SEQ ID NO: 52414 - DNA, 1721 bp, Glycine max
  Peptide Sequence Number=SeqID_169192
gtgacaaccagactcatatagaagcaaccaaaggttccccaagagattctgttggacatgggactcacacagcatcaatagcagctggtgttcatgtcaacaatgctagttattttggtttagcacaaggaacagcaagaggtggttcaccttctactaggattgctgcttataaaacatgctcagatgaaggatgctctggtgccaccatactaaaggctattgatgatgctgtgaaggatggagtagatataatctcaatctctattggactcagctcactattccaatcagactttttaagtgatcctatagccattggagcatttcatgcagaacaaaagggggtcctggtggtgtgttcagctggcaatgatggtcctgatcctttcacagttgtgaacactgcaccgtggatatttactattgcagcttctaatattgataggaacttccaatcaactattgtccttggaaatgggaaatatttccaaggtactggcattaacttttcaaaccttactcattcaaagatgcatcgccttgtctttggagagcaagtagctgccaaatttgtccctgcatcagaagctaggaactgttttcctggatcactagatttcaacaaaactgcaggcagcattgttgtttgtgttaatgatgatccaactgtttcgaggcaaatcaagaagctagttgtacaagatgcaagagccatagggataatactcattaatgaggacaacaaagatgctccctttgatgcaggtgcatttcccttcactcaggttggcaatcttgaaggccatcaaatcctacaatacataaactctaccaagaacccaactgcaacaattcttccaacaacagaagtttctagattaaagccttcaccaattgttgcatctttctcatccagaggtccttccagccttacagaaaacgttcttaagccggatgtgatggctccaggcgttggcattttggccgctgtgattcccaaaactaaagaaccaggaagtgtcccaattgggaaaaagccatccttgtatgccataaaatctggtacatctatggcttgcccacatgtgacaggtgcagctgcattcattaagtcagtacacacaaaatggagttcttcaatgatcaaatcagcattgatgacaacagctacaaactacaacaacttgaggaagcctcttactaacagctcaaactccattgccgatccacatgaaatgggagttggggaaattaatccactcagagctctcaaccctggcttagtctttgaaacagatgtggaagactatctcagattcctttgttattttggctattcacagaaaatcataaggtcaatgtctaagacaaacttcaattgcccaaagaactcttctgaaggccttatctccaacgtcaattacccatcaatatctgtaagtacacttaaaaagcaacaaaaagcaaaagtgatcacaagaaaagttaccaatgttggatcccttaatgccacatacactgcaaaagtgcttgcacctgagggattggttgtgaaggtcatccccaataaacttgtgttttctgagggtgttcaaagaatgacctataaagtctcattctatggcaaggaggcccgtagtggatacaattttgggtctctaacatggcttgatggtcaccattatgttcatacagtatttgcagtcaaagttgaataa

SEQ ID NO: 52415 - DNA, 1533 bp, Glycine max
  Peptide Sequence Number=SeqID_169193
atgagtttcgaagaagccttgaagaatgacaagtgggtcaatgctatgaaagaggagctgaaatcaattgagacaaatcatacttggcagctaatggagttacctaaacttaaaagacctattgctgtaaaatgggtttttaaagtgaagagaaatcctactggtgaagtagttaaacacaaagccagattggtggcaaaaggattcctacagaaagaaggtgtagactatggtgagatctttgcccctgtggcaaggattgaaacagtgagacttgtagttgtaatagcaagcatgaaaggctggtcaatgtatcagcttgatgtaaaatctgcatttctgaatggtcatcttgaagaagaagtgtttgtcaaacaaccacctggatttgaagttgttggacatgaaggaaaggtatacaaactgaagaaagcattatatggcctgaagcaagctccaagagcttggaacaagaagattgacagtgtcctaattcaaattggctttagcaagtgcatatctgaacatggagtatatgtaaaaggagaatatgagtcagacttagtaatactgtgcctctatgttgatgatttactcatcacaggaaacaacaaaatagagattgacaagattaagcaactgctgaagaatcagtttgaaatgactgacttaggatctctttcatacttccttggaattgagttcaaggaaactggagctggaattgtgatgcatcaaagcaaatatgctacagacctgttgaagaagtttcgaatgactaactgtaatgcagcagccaccccagctgaaacaggattggcattgagtttgagagatgaaggagaacctgttgatgaaactcagtacagacagattgtgggttcattaagttatttgtgcaatacaagacctgatttggcattcagtgttggactgatcagtagatttatgcaagctccaaaaactcctcacatgatggcagcaaagagaattctaaggtatattagaggtacaattaactatggtattctacttccaaataccatcacaaattcaaacatggaactggttggctatactgactcagactggagaagagataatgatgatagaaaaagcactgctggatatattttcctacttggagatgcactggtgtcatggagttcaaagaagcaagattcggttgccttatcaacttgtgaagctgaatacatagcagcatcaatgtgctcgtgtcaaggcttatggctaagaaaactattgaaagaaatgaagatccagaaaactgaagctataaacatactggtggacaacaaatctgcaatcagccttgctaaaaatccatttgatcatggtggaagcaaacacatagaaacaaggtaccattttattcgggacaaggtgagcaaagggaaggtaaaactgctatactgcaagttagaagataatcttgcagacttactgaccaaacctttcaagaagaacaaatttgaagacttgagaaacaagatgatgatcatgattgaatga

SEQ ID NO: 52416 - DNA, 261 bp, Glycine max
  Peptide Sequence Number=SeqID_169194
atggaaattttatgcaaaggaagcaagagaatctacctgaagcctggcaaagcttgcaagagattatcagaaggggtattcctaagtatggggatgcttgaccctttagagagagttctcactgatgaggaccttgaccgggagttgaaacttgaggtaaacgaaatactgacgtttctccactctcaacatagtcttggactgcctagttgtgagaggttagaatggggcaatgttccaaagctaaagcctcctaattag

SEQ ID NO: 52417 - DNA, 462 bp, Glycine max
  Peptide Sequence Number=SeqID_169195
atggacatagggagatgctcatatctaaattggctagagtttccatcttcatccaatcaagaactccatagtcattgtcacaacctaccctatgatgggacaacgaaagacaaaaaggataagccaaaaagtccatctccagcgaagaaaatgaacgcagtcgccaccaacggaaatggaagctcgcccaggcgagctagttccttcagcccgaagtcatttgaaggcccaggcgagccagaggctagcctgggcgagctagggtccaaatcaaaagttaagcaagttccaaagaatcaggcttcaagaatcaagtctcaaagaatcaagattcaagaacaactaagtttcaagattcaagattcaagaacaatcaagatcatgattcaagactatagattcaagattcaagagaagttgatttcaagattcaagagaagaaatcgagaagcaacagtctag

SEQ ID NO: 52418 - DNA, 318 bp, Glycine max
  Peptide Sequence Number=SeqID_169196
atggatgacatgttagttgatgctgcagcgaaacatggtgtcatcaccttcatggatggtcattttggttataaccagatttttatggctgtgaaagatgtgtgcaaaatgacgttcaaatgtcttggagctcttgggatatatgaatggatggaagtatacattggtgatgtagtagtcaatatcaactgggaatttcctaggattcttggtatatcagaagggattaaagttgataaaagcaaggtgaaggataaagaagaatttgtttggggagaagaacacgacaaacatttgagtatatcaagcaagtgttag

SEQ ID NO: 52419 - DNA, 363 bp, Glycine max
  Peptide Sequence Number=SeqID_169197
atgaagtccaagaaatggtcaggatcaaagaagaagctaccaagctctgagcaacaagaagatacaatacaaaggcttgttaaacccaagggttcatccttgaaaagtctcaaaaaaacccaagacaagcatgtccctagtctcaactctgaaggctcatcaaacccaaggtctgcctttagtgagtctcgattctccaaaggcttgcgaaacccaaagtccgcccttggtgagtctcgattctccaaaggcttgcaaaacccaaggtctgcccttggtgagtctcaattctccaaaggaaggttaaccaagcttaatcctcacgaccactgtttctctcatacgcgcaagtgtttcaggtga

SEQ ID NO: 52420 - DNA, 607 bp, Glycine max
  Peptide Sequence Number=SeqID_169198
atggcagagttatgcttagtgcctgatgtcatcatccctctaaaattcaaggtgcccaatttcgataagtacaaaggtactacttgccccaagaatcctctgaaaatgtactgtcggaagatgggggcatacgcgaaagatgaaaaactgattatgcatttcttccaagaaagccttactggggcagctgtcacttggtatactaacttggaaccttctcgagtccattcttggaaggacctaatggttgccttcgataggcagtatcagtataattttgatatggctatggataggatgcaactacagaacatgggagattataacaatgatagtagacacattaccagtgttctactatggaaagatggcaagtttgattatcctgctttgatgaatggaaaaactagggaaaatggagagaatgagaaacaggaaggaacccatgttgtgactgtcatccctacatggccaaatttctcgtcagctcaacaatgtcatgacaaaaagatagcaatagatacctcagagccctacactggggcaatgaaaggcactgtgcatgagcctcaagcaaacctaggggcagatcaaaagttctcactcg

SEQ ID NO: 52421 - DNA, 724 bp, Glycine max
  Peptide Sequence Number=SeqID_169199
atggctgataacaactggactcttaaggaattggctacacctattgttgtatatcaatcgtactgtattcaatacaatgagacagaggttagctgtgagctaaagcctgggctaatccatttgctgccaaagtttcatggtcttgcaggattgatgttaatggacaagagcatgattcatgcagccagtggaagcgctttcatggacaaaacttctgctgctataagaaaattgatttctaacatggcagccaactataagcaatttggtaccaaagaggttgcaatatccaaggaccgcacactcacaaatgccatgctagacttaggagtttcaataaatgccatgtctgcatttgtatacagatcacttaggcttggtaatttggaaccaacgggtgtgataattcaactagcaaatagaagcgttgcaaatctgcttggcatttcggaatacgtgttaattcaagttaaggatcagattttcctagcagatttttatgtcctagatatggaggatgagttgtccaaccatggtgccactttgatgctaggaagaccattcctcatgacaacaaggacaatgatagatgttcacgcaaggacactatttatagagtttgatgataatatggtgcagttaaacatatttgaggccatgaaacatctgacagagaaccactcagttttgtgtttggatgtgattgatttattggctgatgagt

SEQ ID NO: 52422 - DNA, 225 bp, Glycine max
  Peptide Sequence Number=SeqID_169200
atggaacataaggcatgttgggctttaaagtttctgaattttgatgaagttctattaggggaaaagaggaagttgcagctctcggagctagaggagaagaggttgaatgcttatgagtcatccaagttatacaagcaaaaggagagaagtgtggaagagagtgaacttgaggaatggggttggtcacaagttggtttgaaatctcatggatatgttaagtcttag

SEQ ID NO: 52423 - DNA, 594 bp, Glycine max
  Peptide Sequence Number=SeqID_169201
ttagccgatacgcgcgtcacggagaatgaaaactttcgcgaccagctgatcgccgcagacatcatcatcgccaacaagagcgacaaatgggatgcggaagatcgccagcggctggcgagctggcagcagcagcatttgggcgaccgtcaactggtggaagccagctggggcaatattgatccggcgttgctgagtcagccggcattggcggatcgtgcggtacccgatgccgcgcatcatcatcattcgccacgcccgcaggggctggcggcgctgaaactggaaggcgaagcgcgctggcgtcgtgcgttaaatgaaggtcagggctatgcttcctgtggctggatttttgatggtgacacggtgttcgataccattccggctttagagtgggcgcggcttgcgccggtggatcgcgtgaaaggcgtgctgcgtaccgctgacggtctggtcagcattaaccgtcagggcgaagacctgttcatcgaaacgcgcccggtcacgccaccggatagccgtatcgaattgatccaccatcaggccgccgactggaacgccttgcagactgccctgttgaagattcgtttaaattag

SEQ ID NO: 52424 - DNA, 489 bp, Glycine max
  Peptide Sequence Number=SeqID_169202
ggaaaagagcaccacaatcagcaggcccatcaggaaggcgcggaagccgaaatagcgccacataaagcaggcgaagataatcagcatcatgccgtggtcgccggggaagctgtctctggacgcatcttttgccggaataccggtcagttcgctgacgcgatgcacgttatcaaagaacagcgtcgggctggcatgcttaaccggcagcaggtggcccagctggttaagaatcaccgccgtcagcagcatggtgataccaatcgccagcatacgacgtcggccctgcggcgtttcgcggcgccagaaccacagatagagcaggcccatcgccagcagcgacaccgcatcaaaaccgcggaaattggtgatcgccaccagcagcgcaaagccgtgatggtcgaccatctggtcgttaaagccaaaaaagatgcctttgtcgagagcgaaccagaacccgtgctccggcggcagataccacgacataaatag

SEQ ID NO: 52425 - DNA, 360 bp, Glycine max
  Peptide Sequence Number=SeqID_169203
atgaggattcccatttttacaggccaaggttcaaaaaggtctaaggttgtgtttcgatggagtctttcatcgtgggaacccaatcttgatatatggggcaaaacaaatttgggtgacgaggtgtcggtctcgggccgaacttccacattattccataaggcacgcgtgacaatgatgatttggaaactacgtgcaaaattagtcatcgctacagccaggtgggcactcaagcatcctgtttatggcattgtgattctacggttgggaatttatacaaacagacccaacgtttccaaattatgttctttcatcagttcaatgcattcatccatccttatctcggttcattccggaaaataa

SEQ ID NO: 52426 - DNA, 169 bp, Glycine max
  Peptide Sequence Number=SeqID_169204
atggtcactttgggacatttttcagtccctgggcccacaagaaagcttagggatgaagcaaccagcttgtccaaaagcaacctagctcgcccaggcgagctgctgtgcaaccttcacccctcatttgtaataaacaagcgtgagggggctgaaggaaagaggttccaag

SEQ ID NO: 52427 - DNA, 234 bp, Glycine max
  Peptide Sequence Number=SeqID_169205
atgttttcagaggtgctattgtggtggtgccatggtaatgtagagacatggtacaaagcagaggtgccatggtggtggcatgacgagaatgtaagagatcaagatggcgagatcatgaaagcactaaaatggatgcattgtgatggcaacaacattgcgaggggagataatgctagtggacaaagagagactcgagagggagttcgtgttcaaagggagacattgattgtgtga

SEQ ID NO: 52428 - DNA, 1938 bp, Glycine max
  Peptide Sequence Number=SeqID_169206
gtgcaacagcaccaggcccggcagcgcgatcaccaccgtcaccaggaagaacccgggccaccccaggtgctcgaccagcggcggcgtcaagggtccggccaggtaggtgcgacccaccgccgacagcgcggacagcagcgcgaactgcgtggccgagaagcgctggcggcacagggccatcaagagcccgacgaacgccgccgtgcccaggccgccgcacaggttttccagcccgaccgcggcgcccatgagccaaatgctcttggggctgaccgcgatcacccagtagcccaggttggacaccgcctgcagcagcccgaacaccatcagcgaccggtacagcgtccagcgcgacatgacgaggccgccggcaagggcgccgacgacggtcgcggccatgcccatgaccttgttgaccgcgcccacctcggtaggggtatagcccgcgccgcggatcaggaacgtggtcgaaagcgcgccggcaaaggcgtcgcccagcttgtacagcacaatcagcaacagcaccgccaacgcgccgcgccgggtgaagaattcctgcaggggcgccgacacggcctcgcccaggctgcgcggcggcttggccacgtgctccggctcgggcgcccacagtgtcgccagcgcgcacagcagcatcaggccgcccatcaccacataggtattgccccagccgatccactggtcggccaggatcagcgccagcccgcccgagacgatcatcgccacccggtagcccatgaccttgatggccgcgcccgcgccgcgctcttccttgcgcagcacgtcggtgcagtaggcgtcgaaggcgatgtcctgggtggccgacaggaaggccaccagcaccgccagcagggccagcgcctgcaaggccgacgacggcgacagcgtgcccatgaccatgatcgccagccccagcagcacctgcgtcaccagcatccagccgcggcgccggcccagcagcggcggcgcatagcggtccaccagcggcgcccacaggaacttgagcgtgtaggccgtgcccaccagggtcaggaaaccgatctgctgcaagggcacgccggccaccgtggcccacgcctgcagggtgccgctggtcagggccagcggcaatccgctggcgaaccccaggaccagcaggggcgcgacgcggggactggtgtagacgttggatacagcggtaatgacggtctcctgaaacgggccggccgggcgcacggacgggcgcggcgggcttgcggcattttaggcgctggcgcccgggccgtcagccggcgtttcagaatgtcagggcgaggcgaagcggtacaccgccagggtgctgcgccagctggggaaggtcttgatctcgcgcccttcgttgaaagtggcgcgctccaggatgcgcaggcccagctcgccggccagctgttcgaagtcgcgcagcgtgcacaggtggatgttgggcgtgttgtaccactggtagggcatctggcccgtcaccggcatgcgcccgcgcaggatggcccagccgtgcggccagtagccgaagttgggaaacgacaccacgccgtggcgcgccacccgcgccatctcgcgcaggatgtgctcggtgcggtgcatggactgcagcgtctgcgacagcaccacggtgtcgaactgcttgtcgtcgaacagggccaggccgtcttccaggttctgctggatcacctcgaccccgcgccgcacgcaggcgatgacgcaggtgtcgtccagctcgacgcccgcgccgcgcacctggcggtgatcgcgcaggtgcgccagcagcgcgccgtcgccgcaacccaggtccagcacccggctgccgggttcgatccagctggcgatgcgcgccaggtcggggcgcagcgtattgacggcgggacggggagtcacgggattcatgcggagcgtccttcggtctga

SEQ ID NO: 52429 - DNA, 266 bp, Glycine max
  Peptide Sequence Number=SeqID_169207
atggacgagcctcgactgggccagcaaaatgaaaaaaaaacttatcccatcgcatcattaaccggtgtaggattaaagatcaggtccaggattcgagtcaaatcgaccttccctctcatctcaggggcagagcctcaccttgctgtaggaaggtcttcgttgctgggacgggttcaaactggactgaagggaggaggaatgaaagactccgatcttactggggattcatcactggctagggcgaatcaaagcatgggcatctgcaa

SEQ ID NO: 52430 - DNA, 462 bp, Glycine max
  Peptide Sequence Number=SeqID_169208
atggagagttgggggtttcggttcgaaggttataaaatgcggtgcgggttcatctctctcgaccagttcaggttcaagggaaggagtgtggtggggaggccagggaaagacggattggatcgagaggcgatgcctactctactcgttaccactaaacgacgaagccaagagcggaaggagggacttgaaccctcaacctcagccttggcaaggctatgctctaccattaagctatttccgccagcaacggtagtggcgaagcactacggagcaattaacgcggggggaggggcggctgccttttcaatcaatctccggccgctcagtgccgctattggtgcgagttgtaaggagtcttggtctcgagtcgagctggggcgtcatttcattctcgtaacgggagtgagtgcaccgcaagatcagacaagttactccctcgcagcggtggcatctgtcttttaa

SEQ ID NO: 52431 - DNA, 993 bp, Glycine max
  Peptide Sequence Number=SeqID_169209
atgagcctgttccgcccccgcatgctgctgtccctcgccctgatcggcctgctggccggctgcggtggcgacccggtccgccccacgccgccgccggcaccgaccgtggtgccgcaggccaagccagtgaagatcggtatcgccctcggcggtggcgcggccaagggcttcgcccacatcggcgtgatcaagatgctggaggccaatggcttcgaaccggccgtggtgtccggcaccagtgccggcagcgtggtcggcgcgctgtatgccagcggcatggatgccttccagatgcagagcaaggcagtggcgctggatgaagccagcatccgcgacgtgcgcctgttctccggtggcctggtgcagggccagaagctgcaggactacgtcaacgagcaggtcgccaaccgccccgccgagcgcctgaagaagccgttcgccgccgtcgcgacccagctggaaacaggcgagcgcgcgatcttcgtgcgcggcaacgtcggccaggcggtgcgcgcatcgagcagcattcccggtgtgttcgagccggtgaagatcggcggtcgcaactacattgatggcggtgtggtcagcccggtgccggtggatgccgcacgccagctcggcgccgacttcgtgatcgccgtggacatctccagcaaggccagcggcaaggcgccgactgacatgctgggcatcgtcaaccagtccatctcgatcatgggccagcgcctgggcgagcaggaactggcacgcgccgacatcgtcatccgcccgaaggtgctggacatcggcgccgccgatttcagccagcgtggcaccgcgatcctggagggcgaaaaggccgcaatggccgcgatgccacagatccgcgccaagatccagcagctgcagcgtgcacgcgccgcggccgccgcaccggcacccgtggccgcgccgaagtgcgaggaagcctcgcgcctgggcaagctgatgggccgcaaggacaagtgctga

SEQ ID NO: 52432 - DNA, 960 bp, Glycine max
  Peptide Sequence Number=SeqID_169210
atgtccatgtatactgacaatcataagctgcttattcatttctttcaggacagcctgactggggccgctctgaagtggtatatgaatttggacagtgcgagcattcgtactttcaatgacctgggtgaagcgttcatccgacagtataagtacaatttggacatggccccagatcgtgatcagctccgtgcgatgacacaaaaagagaaggaaacgttcaaggagtatgctcagcgttggagggaagtggctgcccagattgtcccgccgttggaagaaagggaaatgaccaaaatatttctgaagaccctgagccagttttattacgagaaaatggttgcaagtgcaccaacagacttcactgaaatggtcaacatgggtgtgcgattagaggaaggtgtccgagagggacgtttgactgtggaaagtacccctgccgcaagtaatgccaagaagtttggaggccactttgcgaagaagaaagatcaagaggtgggaatggtagctcatggtaagcctcagcagaatttcaccccatatcgtcaggttgcgaatgtcgcatccactattccgaacccatcatatcaccaacaaaggccacattacccccaacaataccctccacaacaataccctccacaacaataccctccacaacaataccctccacaacaatatcctccacagcaataccatcagccacaataccctcaaaatcgcccgcagaccccccaacaaccatatcactcacaaaaccgccagaaaacaacctttgatccaatcccgatgaaatatgctgacttactccccgccctgctcgccaaaaaccttgtccaggtcagaacaccccctcgtacaccagatgttttacctccctggtttcgtcatgatttaacctgcgctttccaccaaggggccccaggtcatgacgttgaaaactgctatgtcctgaagaatgaa

SEQ ID NO: 52433 - DNA, 861 bp, Glycine max
  Peptide Sequence Number=SeqID_169211
atggaccctagggtactagaacctatcacctttagaggactacacgccctcgccttcagagggctacaagccctcacctttagagaactacacgtcctcaccttaagagggctacacgtcctcaccttaagagggctacacgtcctcgccttaagaggcttgcacgtcctcatcttcaaaggactagacgtcctcaccttcagaggactacatgtcctcgccatcagagggctacacgcccacgccttcagaggactacacgtcctcaccttcagatggctgcacgccctcacctccagaggactacgcgtcctcgccattagaggattacaattccttgcctgcagagggctagacaccctcacctttagaggactacaagtcctcgccatcagagggctgcacgccttcaccttcagaggactacacgtcctcgccatcagagggctgcacgccctcaccttcagaggactacacgttctcaccttcagaggactacacgtcctcgccatcagagggctgcacgccctcaacttcagaggaatacacgtcctcgccatcaaagggctgcacaccctcaccttcagaggactacatgtcctcgcctttagaggactgcacgtcctcctcatcagagggccgcacgccctcaccttaagaggactacacttcctcaccatcagagggcggcacaccctcacctcaagaggactacacgtccttgccatcagagggctgcacgtcctcgtcttcagagggctgcacaccctcaccttcagaggtcttcacgccctcaccttcagagggctacacgccctcgccttcagaggactacacgtcctcaccttcagagggctaaac

SEQ ID NO: 52434 - DNA, 627 bp, Glycine max
  Peptide Sequence Number=SeqID_169212
atggttatgaagcacacgaggggaaaccctaacatccccaccaccactcgttctcgctcccccaaaagcagaatggggaaggatcatggtgactggaatggaggcaagaagtgcctccgccaacacggtgcgagtcttccaacctctccaaggaagaggactcactatcaaaagccccatggcgagtcttctatgaggaggagccgtcgattagatgacctctcagtctaccaggggttgctgaatcgaacctctagagttgctaccgcccatacctatggtggagtcagagatgaaagacattatggaaatgagtgtaccttgagagcgaggaagacaatcacaagagaaagggaaatcacagataccgctaggaggcttgacaagcttcacaaatctgcaactctcgcacctgtcgaggttaccaccctcaacattggacaacacttgtccaagctttgggggcttgagaaactcgtgaccctcttacttgtcaaggctactgcccttgacaccagacaatctccctcgacgccagacaatctctttcactcacaagctggctcaaagcttggggggcttatgtactgtccaggatccacaaaatggatgtggcaactaacatag

SEQ ID NO: 52435 - DNA, 174 bp, Glycine max
  Peptide Sequence Number=SeqID_169213
atgcaagttataggagttagcaaaaaacttcacagcaggaaaactcaaagaaaaggagtggtgacaagtacccttctattaatagagtacataagactaggaagaaaagtaaagggaaaagctagggtaatgattcacataagccagagtagaggtggaaagcaacatgcatag

SEQ ID NO: 52436 - DNA, 135 bp, Glycine max
  Peptide Sequence Number=SeqID_169214
atgctttgtctagctcagtttcttttccctcacaccccataccaggccatcacaactaaatcttttgaagaagctctgaagtccattgagaaggccaaaccgtataaagaagataacatcgaggaagatccttga

SEQ ID NO: 52437 - DNA, 291 bp, Glycine max
  Peptide Sequence Number=SeqID_169215
atgactaagcacgtcaaaagggggtacgaaattgaaatgaaagaaaatggggaagaagcttgccacccagctcgcccaggcgagctagattgcttcctccagaagcaaccgccttctggaggagttttctggaaggcccaagtgggcctgaactttacagattgcgcactaacactttcttttaatttccggcatgtcacggaacttcacgaattgcctaacgatgggtgccaagtacctcgaagtggtcaaacgagggtcgcatcccaacaacggatggtccccggatga

SEQ ID NO: 52438 - DNA, 390 bp, Glycine max
  Peptide Sequence Number=SeqID_169216
atgaatcctttcaaagagggagggaatgatggaggtgcaactagctcatctaatgaccctttactagggattggaggtcctatgacaagatccaagactaagaagatgaagaaagcattgcaaggcctggttctaaagatcaaaaagaaagaagaccaatgtgaactaagggctacacctaattgggtcactcccctacaagttgatgaatatgttttgaggtcgcagttagggtcatgctccttttttataactttggttctatcgacagtcgcgattaggatcaagttcctttctcttaatacttgttttcaagacaatcctaagtgttctcttatcaaaatgccccccaaccgtcaaactttaaattcctccaagtatctttcataa

SEQ ID NO: 52439 - DNA, 822 bp, Glycine max
  Peptide Sequence Number=SeqID_169217
atgttggagatgaaacttgaccaaattcatatcaagaatatcaagatgaatgttaacattcctagattcagaggacctcagggaagatacaacacggactattttgaagatgaatggaaagcaaaaggaaaaaagattagcaatcaaggaaaagaaaaacaaggaacctttctagacaaaggggagcagatcgcgggggacaaatgcatgggtgatagaggcaacgtgaaattgcaatacattggggagaatatggtgttgatatcagaatttttgaagagatttttgatagagaaatggaagaggctccttataaaggttagaagtgtgaatgttggagatggagaagatgaatcgacaaaagaagactcggcgggaagcatctatagggtagaaatgttcatattatcgttgaacatgaaggggtgcaacagccagaggggaccttcaacggcgcaatacagaggtacaaaagaaagacatggtcaacatcccatcaacaactggagacaagacaaggaaattcaaaatagaaaggggaaatatggagaagacgaaggggatggtccacatatggtaacaatcaacatagaaaaggttgaagaggtaaaggtagtttttggccaaaatgaagaggttatatgcatagataatacgacccatcgacaaaagtcaagtggcccatttgtgtgtcatattgattgtagacaaaggatcaagctgaatgttttgatgatgacaaaggttcacatgcgtctcaaagctttattcaagacaaagaaattaaagatattcaagatggatgatcaagacagtctctag

SEQ ID NO: 52440 - DNA, 285 bp, Glycine max
  Peptide Sequence Number=SeqID_169218
atgttggatctattgagtggcttctatcgacaacgcctctttagattggcttcattcctacaagcaaaatgcctcatctatggcggcatgaatctagatctggaacctctgtgtgtctcgctctcagagagaagagaacaacacaataaagagaacaaggtcgcaatatgccactatcttagattcaaaaccttctggtgtttgaagattttcagcagtgaccactacgactaccttaaagccactggaagtctgagaattgaagtttgttgccttccctcttaa

SEQ ID NO: 52441 - DNA, 303 bp, Glycine max
  Peptide Sequence Number=SeqID_169219
atggggtcttttatcgtgggaacccaatctcgatatctagggcaaaacaaattagggtgtcaaggtgtcggtctcgggccgaacttccatattattccacaaggcatgcgcgacaatgatgatttggaaacaatgtgcaaaattagtcatggccacagccaggtgggcactcaagcatcccatttacggcgttgtgatactacggtcgagaatttacacaaacagacccaacgtttcccaattatgttctttcatcagttcaatgaattcatccattcttatctcgtttattctggaaaataa

SEQ ID NO: 52442 - DNA, 306 bp, Glycine max
  Peptide Sequence Number=SeqID_169220
atggcagtaggaaacgatgtatgcatgattcatgattttgagggggagttgtatgtatatgacgttgagggggagactgctgctgctgatgatgactgttgtaagctgatagaagatgctgcagtaagagcatggagacagggggagcagaagcagaaagctgatgtcacgagagatgtcttgacatcctggagaagacttgtagatgtgcaacttgaagaatttccgctgtgcttgattactctgataatggaagttgctgatcccacttgcataactgctcgtacctgctcaggaagtgtctaa

SEQ ID NO: 52443 - DNA, 285 bp, Glycine max
  Peptide Sequence Number=SeqID_169221
atgggaggatgtgcggaaaaaagcacaggccatccagaagcaaaacaccgccccccacgtgttgtctctcgtgtgcgtgttgctggagccggtgtcaccatcaagcaatactttggctccgctccacgaagctcctgcatttcctccttcatccctcccgaagaactcgagcagctcactcaacaaatcagggaccagctggaggagtcgatcacagaaaaagtgattgggcagctcatggcatccttcagccaaatgcagccccagcttcagtcacaaatgtaa

SEQ ID NO: 52444 - DNA, 177 bp, Glycine max
  Peptide Sequence Number=SeqID_169222
atgaacaatattagaactagaagggtagagataggttttgaggaagagaaaggtgagaaaaatgaaggatgtgttgaggagaaggagttttttgggttgggggttgagaagttgtgtcatatgatacggtgtagagccgtggaaatagctttgttggtttatgagatcatggactag

SEQ ID NO: 52445 - DNA, 222 bp, Glycine max
  Peptide Sequence Number=SeqID_169223
atgaccaaaatcggcaatacccagcctcgccacagtctgccaggggatcagccggacctctgcccacttaaacaccttgtctatgctgaacccaaccaggccggtaatcaccacgccgaccatgactacatcgagccggaacatttcacggccaagctgcatcatttgcccgatgccactatcggctgccagcagttctgctgccaccagaatggtccatga

SEQ ID NO: 52446 - DNA, 693 bp, Glycine max
  Peptide Sequence Number=SeqID_169224
atgtcgcgtctggatgccaatcatgcctatgcctttgcttcattggggcagatatggtcaggcgtggtcgagctgagccgcagtggcgagttactggtgaatgtccaggccagtgtgcagcgtgcgctcaccggcttgttgctgggcgccagtgccggttttctggtcggttcattggtggcggtgtcgcgcacagccaatatcctgatcacaccgatttaccacgcgatccgccaggtgcctttgctaggcctggtgccgttgttcgccttatggtttggcaatggcgatacctcaaaactcatcgtcgtcagcctgtcggcgttttacccggtggtgttatccacctttgaaggcatgttgcaggtagaccgcaagtttcacgaagtcggtcaggtgtatggcctgagtcgttggcaaatttatcgccgcattaccttgcccgccgccttgccgcaggtgtttaccggcttttcactggcattggcatttgcctggttatctaccattggtagcgagctattgttcaccgcgggtgccggtctgggtaatttaatgatgaacgcacaagaggcttctaggatggatgtcctgattatcgtgacgtttgtgattggcgtgctgggctatggcatgtcgctgctgattaaactggcgagcagccatctgtttaagtggcgccaggttgcctag

SEQ ID NO: 52447 - DNA, 633 bp, Glycine max
  Peptide Sequence Number=SeqID_169225
atgaaggccgacatggagtccatgaaagagaaaatgaccacaatgatggaagccatgatgagtatgaggaaaatcatggaggttaacacgactatagtcgttgccgcaagtaatgccactgaggtggacccgactcacccatctggcctcaatccagtaaatcattcaatctcggatatggtaggtcagggaggcaaagcattgggaagtataggtggcccccattttatgcagagccaacaactccaatctggtcatgcacaagtccctcaacccatgggggaggcacatgaagtacctcgagatcacactctagccgacttcgagcctcacctcagatatgccactgaggggcaagcattcgatggcatacccctgccaaacactttggggggacctcagtatcgcccacaaatacaacccttgcattttgcattggaaagattgcctcctgccatggtggaaacagagaaattggatcatatagaggaaaggctgagggctattgaaggagggggagattatgcctttgttgacatggcagaactatgcccgacaccgttatccctccgaagttcaaggtgctggattttgataagtacaaggggactacttgccccaagaatcacctga

SEQ ID NO: 52448 - DNA, 3213 bp, Glycine max
  Peptide Sequence Number=SeqID_169226
atggtttccaagttaatggtctcaatcatagtccccttattccttttgtccttgtttgttttccaagtctcctcttgtgaccagattgataaactgtccctcttggccttctctggcaacatatccacctctccaccttatccttctcttgattggtctgattctcttgattgttgtagctgggaaggcattacttgtgatggagatcttagagtcacacaccttttgctaccatctagaggcctcactggcttcatctccccctctctcacaaacctctcttctctctctcaccttaatctctcccataatagattgtctggtactctccaacaccactttttctcattgctcaatcacttgttggttcttgatttgagctacaaccgtctctctggtgagttgccaccttttgttggtgatattagcagcgatggtgttattcaggagctggatttgtctagtaaccttttcaatggggcacttccaaattctttgcttgagcacttggcagcttcagcagctggagggagttttgtgtctttgaatgttagtaataacagtctcacaggtcatattcccacttctctcttttgcattaatgaccataacaactcatcctctctcagattcttggattattcctccaatgaatttgatggtgccattcagcctggactaggagcatgttccaagttggagaagttcagagcaggtttcaattttctctcagggcctatcccaagtgatctttttcatgctgtttctctcacagaaatctcattgccccttaatagactcactggaacaattggtgatggcattgttggacttagcaacctcacagttttggagctctactccaatcatttcacaggttcaatcccccatgatattggtgaactctccaagctggaacggttactccttcatgtcaacaatttgacaggtactatgccccaatctctgatgaactgtgtcaatcttgtggtattgaatttaagggtcaacgtcttggagggaaatctctctgcattcaatttctcaggatttctcagacttaccacacttgaccttggcaacaatcattttactggtgttttaccaccaacactttatgcatgcaagtcactttcagctgtgaggctagcatctaataaacttgagggagagatttcacccaagatacttgaactagagtctttgtctttcctatcaatttctactaacaagttgaggaatgtcactggggctcttagaatactcagggggctcaagaaccttagtacccttatgctctccaagaattttttcaatgaaatgataccacaagatgtgaacataatagagccggatggattccaaaaactccaggttttaggatttggtggttgtaatttcacaggtcaaataccaggttggcttgcaaaactgaagaagcttgaggtcttggacctgtcctttaatcaaattagtggtccaattcctccttggttgggtaaactttctcagcttttttacatggacttgtctgttaacctccttacaggagtatttccagtagagctcacagaactcccagcactggcatcacagcaggcaaatgataaagtggaaaggacttactttgagttacctgtgtttgctaatgcaaacaatgtttccctactgcaatataatcagctttcaggcctacctccagcaatatatctgggaagcaatcaccttaatggaagtatccctattgagattgggaaactcaaagtccttcatcagctggatctgaaaaagaacaacttctctggcagtataccagttcagttttcaaacttgactaacttagagaaactagacctctccggaaaccaactatctggggaaattcctgattccctcagaagattacatttcttgtcttttttcagtgtagcattcaataatcttcaaggacagatacccactggtggtcaatttgatactttctccaactccagctttgaaggaaatgtgcaattgtgcggtttggttattcagcgctcttgtccttctcaacaaaatactaatactactgcagctagtcgcagctcaaacaaaaaagtgctgcttgtactcatcattggagtcagttttggctttgcttccttgataggagtgttgacactgtggatactctccaagaggagggtcaatccaggaggagtgtctgacaagattgaaatggaatcaatttctgcctattccaacaatggagttcatcctgaggttgacaaggaggctagcttagtggtattgtttcccaacaagaataatgaaaccaaggaccttaccatatttgagatcctaaaatccactgaaaatttcagtcaggaaaacataataggatgcggcggttttggtttggtttacaaagcaacattaccaaatggaactacactggccatcaagaaactttcaggagacttgggcctcatggaaagggaattcaaagcagaagtagaggctttgtcaacagcacaacatgagaatctggtggcattgcaaggctattgtgtgcatgatggattccggcttctcatgtataattacatggaaaatggaagcctggactactggttgcatgaaaagcctgatggtgcatctcaacttgattggccaactcgcttgaagatcgcacaaggtgcaagctgtggtttggcttatttgcatcagatatgcgagccacacattgtgcatcgtgatataaagtcgagcaacatactccttaatgaaaaatttgaggcacatgttgctgattttgggttgtctagattgattcttccatatcatactcatgttacaactgaacttgtaggtacattaggctacattccaccagagtatggacaagcgtgggtggctactctgagaggagatgtgtacagctttggggttgtcatgcttgaactgatcactgggagaaggcctgtagatgtatgcaagccaaaaatgtcaagggagttggttggctgggttcaacaaatgaggattgaaggaaaacaagatcaagtatttgaccctcttctgagagggaaggggtttgaagtacagatgctaaaggtactggatgtgacttgcatgtgtgtcagccacaatcctttcaagagaccaagcatcagagaagttgttgaatggctgaagaatgttggatcagacaaccagccaacacagaaataa

SEQ ID NO: 52449 - DNA, 177 bp, Glycine max
  Peptide Sequence Number=SeqID_169227
atggctgatcatttcaatctagctaagctagaaagaagtttttcatttgtgctcattaaaatatgtgtgaactggtatccaagtacaccgttaatggacgatgtgacattattgtatggtattattaacaatttagaagataagtttttagtgatttttagaggtaatttgaagtag

SEQ ID NO: 52450 - DNA, 264 bp, Glycine max
  Peptide Sequence Number=SeqID_169228
atggtttttaccagggtagagagaaaagatcgaaattgtcgcagaaaatggcaaaagaaaagagctaaagtcaagaagaaattgagagacttgaatagttcgacaatgctacacaaggtggtgatgaaggtgaagaggaaaagtggaaatagtggcaatacggagagtggtggcgaaaaagaggttgttttgacgccaaagaagttgagagaagagcaacgtcatccttgtcctcgagggggtcaatattcttctcgttcttaa

SEQ ID NO: 52451 - DNA, 378 bp, Glycine max
  Peptide Sequence Number=SeqID_169229
atgagtgtgttaggaatgcagcaagtgtcacttgtacaatcggggagggggagtggagagaaagagatcacattctatcctagggctagggagagagagattccagccttcttcccaactgaggcaacaaacaatcgagcagaaggggaaggagaagcctcagcgtaccaaacagattcattaggttcaggggctgaaagggacggattccctattgggttcagggacgagtacggaaagtcagagtccaagtcccaaagaacgagttcagccacttccttcgctattgatgggacatctagatctaggtcagccgcatctgcagttgaagcagttgacggccgggccaaggccaacaagagccatgtttgcatttga

SEQ ID NO: 52452 - DNA, 291 bp, Glycine max
  Peptide Sequence Number=SeqID_169230
atgagggttattatggagatggacgggagtggtatcgatggcgcctcacatattgggaggcgaaatgagttcctcgaaggtttgtgtggcttcgaggaggtggcgactgccaatgcggatcttgatgaattcagggtagagcttggtgttcaggaggtgcgtgaccatgttggtgatcttggagacgagataagggtcgagggagtagtgggaggtgagggttttggcggagaggggcttcgctggaacagatgtgttctactgagggcgtggaaggcggagacagagtag

SEQ ID NO: 52453 - DNA, 432 bp, Glycine max
  Peptide Sequence Number=SeqID_169231
atgcttcaatcaaacgaatcaggaggagaattcaaattcaaattggaagttaagaatgaagagtctaaaagatcaaatgaaagcactaacaactcatcaaatgacgatgaggtttcaatcatgtcaaggaaattcaagaagtcattgaaggagaaaggaaaagacatcttctactttgagtgcaagaaacttggacacatgaaggttgaatgtctaaagttgaagaagagatggactctaagaagaagaagaaagctgcgtaacctctttgttagtgatggttcattcttggagaggaaaaactctggttccagtgatgtgatactcaacagaaagatcattttggttgaagagaataggaatgactttggtgtgtccatgaaatggggtaatagaggttttattgttgatgttttgcttcaaatacagtaa

SEQ ID NO: 52454 - DNA, 1233 bp, Glycine max
  Peptide Sequence Number=SeqID_169232
atggcttcctcgttgttcttctttctaacgttgcttctcctctccgttatctccgccgtcaccccctgcccgccgtcagaacgggcagcactattggccttcaaagctgccctgatcgaaccctacttgggcatcttcaacacctggtcgggcactgactgttgccggagctggtatggcgtcgcctgcgaccccaccactggccacgtcaccgacgtcagcctccgcggtgagtcccaagacccaatgttccagaagcttggccgctccggctacatgaccggaaaaatctcgccggagatttgtaaccttagcaacctcaccaccctcgtcgtcgctgactggaaggccgtctccggcgagatccccgcctgcgtcgcctcgctttactctctccaaatcctggacctttccggtaatcgcatctctggcgagatttcagccgacatcggaaacctccggagtctcaccctattgagtctggccgacaatgagatctccggcaagatccccacgtcagtcgtgaagctcatcagactcaagcatctggacctcagcaacaaccaactcagtggcgagataccctataatttcgggaatctggccatgttgagtcgggcgttgctgagtgggaaccaactaaccggttcgatctccaaatccgtgtccaaaatgaagcggcttgcggacttggatgtatcatcgaaccggttgaccggttcaatcccagtggagttgggaaaaatgagagtcctctctactttgaaattggatggtaattctatgacgggtcctgtaccctccactttattgagcaatacgggtatgggtattttgaaccttagccgaaatgggttttcgggtaccatacccgatgtttttgggtcgggttcttattttatggtacttgatttgtcgttcaataacttttcgggtcggatacctggttcgttatccgcatccaagttcatggggcatttggatctgagctacaaccacttatgtggaaccatcccaattgggtctccgttgaacaccttgatgcggcgtcgtttaggcaagttgaaatggacaaaaagttatgagggtgctcctggttgcatgtgcatacaagtgagcataggtcaagaaagttctgaatatgctttgtgttgcatgtgggtttcagagctgcatgtgagtttaagagctggatataacgtgaaagatttggatcatgactccatttcctag

SEQ ID NO: 52455 - DNA, 477 bp, Glycine max
  Peptide Sequence Number=SeqID_169233
ttcttggaggaagcaaggcaacatggaaaggaagcaaaacttaagagttcatcagtgcatccagaagaatctaggaaaacaggatcagagaaagagaaaaaggggaagaagtcatggaaaagttctctggcttcatggtggaaggctgacaagaaaagcaagcatagtgaaaaaacctccaacaattctaaattaaaggattctggtaaaaagcatgctcattcttctggtccaatgtatagatcctccagaagttctgatggaaaacactggcgcccatcatctggtcctcttgtgagtctcttcaaatccacaaagaaggatgaaaatgagataccttatatttctctccaccaacacaataatagccctcctgctgaacagaactatggccctctttatgtgaattttgctggacaatgtaatagaacaactctttgtgagaaaaagaatattattgcttttgattttgaatga

SEQ ID NO: 52456 - DNA, 960 bp, Glycine max
  Peptide Sequence Number=SeqID_169234
atgagtgcaagtgacgacacatggggtgaatctggcacaattgagatcacagggaagatcatggtggtggccataatattcctcttcatggtagttgtctttgttcttgtgcttcacctctatgcaaaatggttctggtggagcatggaggagaacgccgcccctcagccccgccgccgccgccgccgccgtaggtttgtcttcgcccccggccaagacccggtgatctatgagacacaccaagttggacttgacccttcagttcttaagtccttggcagtgttggttttccaacctgaggaattcaaagaaggtttggagtgtgcagtttgtctctctgagattgttgaaggtgaaaagttaaggcttttgcctaaatgcaatcatgggtttcatgtggattgcatcgacatgtggttccattcacactccacttgtcctctttgtaggaaccctgttacttttgaatcatccaaaattgaagagaataataatgtcttggggagtagtgaggactcatcatcatcacatgaagagaattcaggtggtgggagtggtttggagccttccaattttcccacaaatgtgttggtttgggggaaccagacacaagttagttcctttggggtttccttagaagattccttagaagaaaaacaagaacaaggcacttctcagtgtcagcaaccaccaccttgttctccatcacctacgccatcttcttcttcttcttctgccagaggtaatgttaatggaaggtgtcatggaatgttggtgattgatattccaaatgagtgcacttcctcctctttgtcaccttctgggagtaggtgtgctgaagatgaggtgaaatcaccaatggctgtcacattgaggtcattcaagaggcttttgagcagggaaaaaaagttaagtccttgtagtccaagttctgtagatgtggaacaagcacagagctag

SEQ ID NO: 52457 - DNA, 438 bp, Glycine max
  Peptide Sequence Number=SeqID_169235
atggctaggaccatgcttaatgataacttaactcctaagcatttatgggctgaacacaccagaaagaaagggatccagaggctaaacaagtatgagatttgtatagttgaggatgacttaatggaattaattggtactagctataccaacaagatgcatcttctttttggtagcctatcacttaagaactccacggtgaaaaagaggctatgtcatgaattgctaaaagtgacggttgagcttagctcatcagttgggctaagtgtgcatccactactaaacgcagcttcagtgcgacaggagaatctagcagagcatcaatatcagttgtcttcagcaaggctcagcgcacaactgacactaagctcaaatccacttactcacgctaagcgcgagggtggcgctaagcgcaacattgcggatttagagcctatttaa

SEQ ID NO: 52458 - DNA, 429 bp, Glycine max
  Peptide Sequence Number=SeqID_169236
atggtgagggacgtgaagaatggtagagctctccttgttgcatttctgatgtttctgttggcatcagaagtgttgattttggaggctgagggtgcaggagaatgtggaaagacccctatagggtctgcagctgctagcctgagcccatgtttgggtgcagttagcaatgtgagggcaaaggttccattggcttgttgtgccagagttggggctttgctcaagactgctccaaggtgcctctgtgctgttcttttgtcacctctggccaagcaagcaaaaatcaaccctgccactgctatcaccattccaaaaagatgcaacattaggaaccgacctgctgggaagaaatgtggaaacaggaggattagctctggatccctcctgcttgcagaaatgaagttgaggttgtggagatcccaaaaaccttga

SEQ ID NO: 52459 - DNA, 378 bp, Glycine max
  Peptide Sequence Number=SeqID_169237
atggcggagaaatcatgcatcaagcgccttcagaaggaatatagagccctttgtaaagagccagtttctcatgttgtggctcgtccttcaccgagtgatattcttgagtggcattatgtgttggagggaagtgaaggaacaccttttgcaggtggatattactatggaaaaatcaagtttcctcctgaatatccatataaacctcctggaatcagcatgactacacctaatggacggttcatgacacagaaaaagatctgtttgtctatgagtgactttcatccagaaagttggaatcccatgtggtctgtatcaagctttatactgatgttttcaatttccgaatgcagcatattaacagggcttctttcattcatg

SEQ ID NO: 52460 - DNA, 282 bp, Glycine max
  Peptide Sequence Number=SeqID_169238
atgaattattacaagcaagccatgatgcaaccatctctctaccacgaggaggtgagtcattctgaatctctgattgggaaaaggaaggaagaagaagcattgcacgtcagtggacttccatacacagtgaatcattctgaatctctgatactaactacaccaaagtgtagggtggctctttcagtgatattgactgctgctggagttctcattgctgcccttggagatttttcctttgacctttttgggtatagcatggcctttgtttccgttttattctag

SEQ ID NO: 52461 - DNA, 285 bp, Glycine max
  Peptide Sequence Number=SeqID_169239
atgcatttgcattctaagaatgttgtgttagtgaaggtagcttggcaaggaacaactgataaagagatgacttgggagttaaaaaaagtaatgcgtgagaagtatcctcaaatgtttgagacacaaggttattttgatgatgccaaagaatcaagagttaagaaaattttcaagcaaagattcaggaatcaagtttcaagtttcaagaatcaagaatcaagaataatcaagatcaagattcaagactcaagattcaagaatcaagagaagactcaatcaagataa

SEQ ID NO: 52462 - DNA, 1308 bp, Glycine max
  Peptide Sequence Number=SeqID_169240
atggatacaatcaagtccttcaagggctacggcaaagttgacgagttggagcagcaagcctatcagaagaagacacgtaagcgcctcataataatcacagtctcttcaatcgttctaattgcggtgatcatcgccgctatcgcaggggttgtcatacacaagcgcaacacctcatcatctccctcatccgactcgcccccgcaaactgagttaaccccggccgcgtcactcaaagcggtttgcgacgtgactcagtaccctaactcgtgcttctccgcaatctcctcgttaccggattccaacactactgatccggagctcctcttcaagctctctctccgcgtcgccattgacgaattatccaagctctcgagctttccttcgaagctccgcgctaatgcggaacacgacgcacgtctccagaaggcgatcgatgtctgcgggaacatttttggcgacgcgctggaccggctcaacgactccatctccgcgctcggaagcagcggcggcgccgggaagattatctccccggcgagtgttagcgacgtggagacgtggatcagcgccgcgctcacggaccaggacacgtgcctcgacgcgctcggagagctgaactccaccgccgcgagcggcgcgttgcgcgagatcgaaaccgccatgaggaactccacggagttcgcgagcaacagtttggcgattgtcacgaagatcctagggttgctgtcgcagttcgcggcgccgattcaccaccggcggctgctaggatttccggagtggctcggggcggcggagcggaggttgcttcaggtgaacagcagcgaaacaacgctggacgctgtggtggcgcaggacggtagcggacagttcaggacgatcggtgaggcgctgaaattagtgaagaagaagagcgagaagaggttcgtggtgcacgtgaaggaagggcgttacttagagaacattgatttggataagaatacgtggaatgtgtttatcttcggtgacggcaaggacaaaaccgtcgtcgtcggtagccggaacttcatggacggcacgccgactttcgaaaccgccaccttcggtttgatggaaaagcatgtggcatgtggcatgtggtttagtgcgtctggcgagcatgtgaaagctgatccactctcgcaaaattggctgcctgccacctctttcttttattattatgacccaccaagcatcatgctgttttgtgcatcatgcatggcctcccatgtgaatgtctgcttcactttcacatatgtaatatcctcactatccatacatgctgtcttgagttag

SEQ ID NO: 52463 - DNA, 1137 bp, Glycine max
  Peptide Sequence Number=SeqID_169241
atgagcatgtatgggaaaagcaaagacaacccttttgcagatgatttccctgacccactttgcaagctcaacctgaaggaaacctctgagtttgtcaagtcattgcctttacctttgccaatgccaaatggcagagctgaaagcagaggccactctgtttcacagcagaggaggctactagattctccctccacacccggtagaccagttttcaccttcagctctggccttcctagaaagagctttccttccaaatgggatgatgcagagaaatggctcatgagcacttcttgccatgactcacctgctcacaacaacaccactttgaaggtttcagtttcagactcctcaaagatcacaaccagacaacaacattgtggtgatgatgttgttggcttcaagcagcaaatggaaggtttctcggagaaatcaagggtcacagaagaaagggtttcgtccaaagctgtaccaaacttcccttggtctccttctttggaccaccaccataacacactcggttctttcaatggtgttaaagacattgtactaaaagataagttcacagacagcatagagcctgtattgccaaatttgagatatttagagccggctaaagaagggttcttgtttaggaaccaaggtggtggagcaatgcaagatgcttgcacagaagtggttcaacatagagacattgggactgagatgactcctcttggaagttccacaacttcaagatgccacaccccagtcaagatttcatcgccgcctcgccacaacactcctgcaagtaggtcaggaccattggccttggctagcagtgcctgcactcttgatgttattcagcttgaggagtgccatttttccaagctgcaactaggaacacagtatgatttagtccctttaaattggagctcaagtgaggaggaagaaaaggaaatatctaaaagcttgaggcacaatggtagccacaaggctgattcagactgcattgctgctgcatgggaagaagaggagaagaccaagtgttgtcttaggtatcagagagaagaagcaaaaatccaagcttgggtaaacctccaaaatgctaaagcagaggccaggtcaagaaagcttgaggtattttattgccattcatag

SEQ ID NO: 52464 - DNA, 369 bp, Glycine max
  Peptide Sequence Number=SeqID_169242
atggaggttgaaagaatttgtggctggggaggtccatggcatggcactgtgaatttgatagagagtgtgggtcaggggaaagtgaccgtggaggcagagggaacagaacagaagactgaacaaggaaaaagtgtgttagacttggttggaaccggggtctataataataagtacaccaatgacttgactcacatgaaaggagccaaaaacacagttctgtcctgtgtcttcactcttcaggccactatgtgctgtgttgtgtgtcacggctcacaaaccctccttagtcttactctttcttttcctatctcgaggacatggatgggaagaggaagggaacgaaagagtacatcatcaacacaagagtga

SEQ ID NO: 52465 - DNA, 5370 bp, Glycine max
  Peptide Sequence Number=SeqID_169243
atggatgcagtggacaagactttctctgagcttgtcagcattgtcaaatcatggcttccctggcgatctgagccagtaaatgtgtctagggatttttggatgcccgaccagagttgtagagtatgctacgagtgtgattcgcagttcaccttatttaaccgtaaacaccactgtcgtctttgtgggcgaattttctgtaacaagtgtacaacaaactcggttcctgccccatttagcaaccaaaggaattcctgggatgagttggaaaagattcgcgtttgtaattattgttacaagcaatgggagcagggcgtagttgctttggataagagtattccggtttccaatctggataacagtgcttcaggatcaacttcaagtgtggctagcagtaaaaccagtgccactgcaaacagtagtaatattactctttgctccatgccttattcagttgggtcttatcaaccaatgcaacagggttctgttctgaacctgcataaatcacctgtgaaggaaaaagaccccgatactgatagggaaggtttatcagcaaatggagggaggagtgatcttgtagcagacctgggtgatccattaccaaagcaatatggattctcaataaacaggagtgatgatgatgaggatgagtatggtgtatatcggtcagattctgatatgaggcattatcctcaggtgaataactactatgaacgagctgagcttgatgggataggcaacattgatggctcacagaaagtggatcatgatggagaaagcattaatgcaaaactcccttcaaactacagttttgacacacagggtttggaagaagccccagttattgccaaaattgaagatgaaccttatatctgtgatgaaaatgaagccccttcctcattgtatgtttcagaggatgttgatgctgaacctgttgattttgaaaataatggacttctctggctccctcctgaaccagaagatgaagaagatgaacaggaagctattttgtttgatgatgatgatgatcatgatgggaatgccaccggagagtggggctatctgcgcagttcaagcagttttggaagtggtgagtatcgacacagagataggtcaagcgaagagcacaagactgtaatgaagaatgtagttgatgggcattttagggcattggtatctcagctgttacaggttgagaacttacccgttgaagataatgacaaaaacagttggttggagattgtcacgtctctgtcatgggaagctgctactttgttgaaaccagatatgagcaaaggtggtgggatggacccagctggttatgtgaaagtcaaatgcataacatgtgggagccgcattgaaagtgtggtggttaaaggagttgtttgtaagaaaaatgtggctcaccggcgaatgacgtcaaaagtggataaacctcgcttgttgatccttggaggggctctagagtatcaacgtgttaccaacctcttatctagtgtagataccctattgcagcaggaaatggaccatctgaagatggcagtggcaaagatagcttcacaccaaccaaacatcttgttggtggagaaatcagtctcacgatatgcacaggaatatcttcttgcaaaggacatatctctggttctcaatgtcaagagaccacttttggagcgtgtagcacgttgcacaggcactcaaatagttccttcaattgatcatctttcgtcacaaaagttgggttactgtgaaacatttcgtgtagaaaagtttcttgaagacctaaatagtgctggtcagggtgctgacaaggatgaattgaagaaggtaaagcatgtggttcagtatggagtttttgcagcttatcatttggctttggagacatcttttcttgcagatgaaggagtctccctgccagaaattccattaaacagtctggcccttccagataaatcatcattcattcagaggtctatttcgacagttcctggttttggtgttgctgacaatgaaacacctcaaggacaagaacctgacactgaaccacagagaaccagaagtctcacagttgctgatctagcctcatcaacctgcagtacagggccatgtgtgtctaatggtgcttttcaatctatgccacttggatcaagtatcaaccattcaactgccttgtactcctccattgttgcttcaggaaaatcaattccagaatcgcaccgtaataagcttctttcatgcactagtagagacacaaatgaaatggactccaaacaacctgttgtggaagaaacttctagagcggacaacacagttgtcggggatgatcctactgtagatgaccttggatcttcagagaaattatatcaaggcatgtcagctgacactccacaaaattggaacagcaaaatctctaaaaaccagttaagtgggtcaggatctctatctccaatagatgttcaaaaccatcccgagaaccttggaatcacaaatgaagagccagttctcataaaagaagagtttcctccatctccctctgaccatcaaagcattttggtgtcattgtcctcccggtgtgtttggaagggaactgtatgtgagaggtcccatctctttcgaattaaatactatggcagctttgataaaccattgggtcgatttctgcgggaccatttatttgatcagagttatcaatgccattcttgtgaaatgccatcggaagcacatgtgcattgctatactcatcgacagggaacacttaccatatccgtcaagaaactaccagaaattatcctacctggtgaaagggatggaaagatttggatgtggcataggtgcttgcggtgtccaagaatcaatggctttcctcctgctacacagagaatagtaatgtctgatgctgcttggggtttatcatttgggaaatttttggagctcagtttctcaaaccacgctgcagccagcagggtggcaagctgtggtcactctttacacagagattgccttcgtttttatggatttggaagaatggttgcttgttttcgatatgcatcaattgatgttcactcagtctaccttcccccccacacacttatatttgattatgggaatcaggactggatacaacaagaatctgatgaggtggtcaatcgggcagagcttttattctctgaggtactcaatggtcttagtcaaattgttgagaaaagatctaatgcagtccaagtcagtaatggccacaaatcacctgagttaagacgccaagttgctgaactagaggggatgttgcaaaaggagaaactagaatttgaggaaactcttcaaaagattttgaaccaagaaaagagaaatggccagcctgggattgatgttctggaaattaatcgattgtggaggcagttactttttcaatcatatatgtgggatcaccgccttatttatgcagccaacttagtccattccaacaatgaatctggttcatgcagtccaatttcagaggataaggagaaacctactgatgaaaatcagatgagcattaactctatttatggtgatctaaagcttaacgatagccccagccatggaggaggaagtgttgtatttgatggaaaattttcacttgatgcagtgcatcaagaaattgacatggccaaaaataaaaatcatgagaaagatgccgaacataatctttcaaatagcaaaagcataaatgatcaatccaaccttttagaacctgaattgggtgttcgcagagctctctctgatgggccattccctgtcattcctagtttgtctgaaacactagatgcaaaatggactggtgaaaaccactcaggatatggaattcaaaaggataacagttctgtaaatcctgatatacttatggcagatgctttgacaaccagtgcacaaaaagaaatatattatctaggggatcgtacagaagatcaaaaaggtcatgataatatggaagactcttcaagctggttgggaatgcccttcttgaacttctatcgccaatttaacaagaacctttttgctagtacacagaagtttgataccctagttgactacaatcctgtttatgtatcatgtttccggaagcaggaactcctgggtggggcaaggctgcttctgccaattggtgtcaatgaaactgtaattccagtatatgatgatgaaccctcaagtattatagcttacgccttaatgtcaccagaatatcatttgcaattgactgatgaaggagaaaggccaagagaaggaaatgagttcatttcatcatatttttctgattcaggcaccttgcagtcattctcatctgttgatgaaacagcttttgattctcagaaaagttttggatcgatagaggaaatgatattttccatgtctgggtctcgtaattcatcaatattggacccaatgttatatactaaggctatgcatgctagagtttcctttggagtagatggtccccttggcaaggtaaaatattctgtgacttgttactacgccaagcgatttgaagccttaagaagggtctgttgtccttcagagctcgactatataaggtctctgagtcgctgtaagaaatggggagctcaaggtgggaaaagtaatgtattctttgcaaaaactttggatgatcgatttatcatcaaacaagttaccaaaacagagcttgagtcattcattaaatttggtcctgaatacttcaagtacctttctgaatccataggcaccggaagtccaacttgcctggcaaagattcttggcatataccaggttacatcaaagcatcttaaaggagggaaggaatcaaggatggatgttttggttatggagaatcttctgtttaggaggactgtgacccgactttatgatcttaaaggatcttccaggtctcggtataatgcagatagtaccgggaaaaacaaagttctactggaccagaacttaattgaagcaatgccaacttctcctattttcgtgggaaacaaagctaaacgattgttagagagagctgtctggaatgacactggttttcttgcttcagttgatgtgatggactattctttactggttggagtggatgaagaaaagcatgagttggttattggaatcattgatttcatgaggcagtatacttgggacaagcatcttgaaacatgggtaaaagcttcaggtatccttggaggaccaaagaacacacctccaacagtaatatctcccaaacaatacaagaaaaggttcaggaaagcaatgaccacttactttctcatgcttccagatcagtggtctcccccttctattattcctagtcattctcagtctgattttggtgaagacagcacacaacctaggactccagctgaatga

SEQ ID NO: 52466 - DNA, 207 bp, Glycine max
  Peptide Sequence Number=SeqID_169244
atgcatcccattccttattcagctggtccacctagaacctctaacacttgggttaatcccaattctaagtcaacaggctcagttcataatcagcccagtgccatgctcacaaacttagcctctcatgggactgctccagctggctccacttggataccagattctggagctagttttcatgttattggtgattctcaaaacatttag

SEQ ID NO: 52467 - DNA, 471 bp, Glycine max
  Peptide Sequence Number=SeqID_169245
atgtcccttctttcctccggtggcttctttgggcgcagaagaaacgagccaccaccccatcaaccaacatgggacccctaccaagcccaagagcaccacccaccccccttcatgtcgccagtcctcgacaccttccacatagagtggaaggagaccccggaggcgcacgtctacaaggcgcacctcccgagttacaagcgcaacgacgtgcgcctcgaggtcgacgaggaccgtgtgctctgcatcgtctgcgacaagagcgtcgagaaggaggagcagcgtgaaggctggcaccgcgtcgagctctctaacggacagttcgttcagcgcctcactttgcctgagaactccatggtggaccttgttaaggcctatatggataacggggtgctcactatcaacgttccgaagaaacaccacagaggggtcaataaccgtgttagaaacattaacatctcttctcgtccctga

SEQ ID NO: 52468 - DNA, 246 bp, Glycine max
  Peptide Sequence Number=SeqID_169246
atggtggaggcagagggtggaggagtctttgtggggttcgagggtgagggtgtggaaggagtcgacgttgacgtgctggttgggttggatgatgcggccatggagacagagggtggaggagtctttgtggaagtcacaacaatggtacaagtaggagacatacacaaggaagatatctttgtcgatgctaacttagatctcagtgacgaaataaggcgcctagacatgacgagaattcacagttga

SEQ ID NO: 52469 - DNA, 939 bp, Glycine max
  Peptide Sequence Number=SeqID_169247
atggtagagttggagaggcgtaacttacacaaatgcctcgccaatctccaagatagaagcatagatgtagctgtggtgaaggagttttatgctaacttatacaacctggaagaccagagccctaagcaagtgagggtaaaaggccatttaatcaagattgatgctgacagcctgaataccttcttagagaccccagtagttttggaggaggatggccatccttggaagcttctgaggaaagatctcaccactcttgctcatacatggagtgtcctctcctacaacaacctaactcccacttcccacacctctaaccttaatatggacagagccaggttggtttacggcttagtcacaagcatggacatgaatattggagccctaatctctgctccttccacttctaccactcctacaccagctcctcccacttctgccacccctacaccagctacccaggactctcagctctttgaagccatgcttcagagtattcatcaggggaaaattttattactgcagagcttgcagttggtagctcctccagggtcccttctgtcagtagagcagttcattgagaaggtaacctggcttggaaccttgccttctgctgtaagagagggtgaaggccccagtgctcaggctaccatccctggagcttttgattttttaggtgcaggagtagagatgaggctattcttcctgagccaattgtgccagttatacatgagactgttgaagcaggtagcagatcctcttacaccagtacatgagagacaagcagatcctcctacacctatcatggagatgccagaagaccttaccacgccagtcctgagactgtcatccactcctccagctaccccagttttacatctaacagatgaagagggtatgcaggacacacagggcacacaggaccagtcacaggaattctaa

SEQ ID NO: 52470 - DNA, 553 bp, Glycine max
  Peptide Sequence Number=SeqID_169248
atggataaatactacaagcagcaaacaagaaacaacacatcatgtcaatccacgaagcaaccagatccatctaataaagcaatagataaacaaacaagagaaaacggtacctggaacaaaccttgcacgttgaagcgaaactccaaagatggaagggctatgattggaggcattgtaatagaaattcataatcaacgccttgacgaactcatagtaaagcggcgaaacctccaagtcatcctccacgacgaaagcgaactcgtgatcggaattgggccaccaggcctccagccactaggcctgcaggcccacattggccgttctgtaatgcacaaccttatccccaaacttccaatcgaagccatcgacgaactccagaattcgatgcgcttggaggagcttggggtcgacgtgggaagcgttgtcgggggcgaaatggtcaatgtggagatggaggtggacgcggtcggcgaggtagtcggcggcggcgagggagcggaggcagcgggagagcgaggcgaggcggttgaaggcgaggagcttgatgaggaaa

SEQ ID NO: 52471 - DNA, 1296 bp, Glycine max
  Peptide Sequence Number=SeqID_169249
atggattatatggttgccttagtagttgcactctgcttattcaatacatctgtacagtttattgataatattactggtttctggctgcagccgtggaaagagttcaggctgtggtatgatgagaacaaggcaaagggcaatcgtccatttcttgagggaatggtgactacaggatggtataagaaaatgggagagagaatttgggcaccttggttcataaagtttattcaatcccgtggttatttcaatatctacacaaatcttctgcatgagagagcactaagcgtttctcacagggatgctggagtaaactacgggaaaactgctggacctgattctaaattactagaggaaaaagaagtacatcctggaaaggttgtcactaacctggaagaacttggatcgttgcttcactctctgcagaaacagagtagtgtcttcttagtaaatctttttggggtatcggatgctatagcaagaaacttactatgccactttaagaggctagatatcaggaattatatacttatgggccctccatctggctccttatttgatctggcaaggaggggacatcctgtaattaacgttgaccaatttataagtagtgttggattgtctaaattcacttcgcatggttcgagttttgagaccatcaagggcattttgacaaaggcttatgtagttaagaagtgtatcgagaataggtataacatgtgggttatggatgggagcatgcttctcacttcagacctcttgtctgagtctgaacctcccaatgatgacttctttgttgcaaacaacttggaagtcttttatgctaaaagctcaacttttaatcagaaaatctgggttgatggctttgtgtccagggttgtagccatggcaagaaaagattctgcaacccatagtagcttaagctttgtgtatgttgtaacaaaactattggaacagaatggtgcgaggattagaagagttgatgagacttcttttgccgcaaagattggctctggtagtgaaacttctcttcgggataagaagttggtatattggtcaagtgagatggagctgaattcaattcagaaatggctcgaagagttcaatttgtggagcatagacagtgttttgtcttgcaccgcggtgcacagtccagaggagtataaaaggtgggggagaggaaaggcgagacgagggattgaatggagaaccagaagacatcggcgtactacaacgaccattgatgttcctgtgaaccttgttatagactctgcgcgcggtggtgtatactatggatga

SEQ ID NO: 52472 - DNA, 297 bp, Glycine max
  Peptide Sequence Number=SeqID_169250
ccaaatttcctcttattagcattggaatttggtcaagaaagcagcaattcttcaatctgcagagagagaaaccctgctgatttgaatgtcaagctactcaagcctttatgtgatgagagaaaatttgaccaagcaagcaattcttcagtaacacctcagaatgcaatcattgaggggcttgatttgaatgtcaagccttcatgtgatgatcaaaattctgatcaacaagtcagttcttcttcaacgcctttgaacgaagaagaggaagagaagcttgatttgaatctcaagctttga

SEQ ID NO: 52473 - DNA, 321 bp, Glycine max
  Peptide Sequence Number=SeqID_169251
atgcttccaaagttcatcataagccccttcaaggtggaatcccaagaagggaagcatgtgaacaagagaagaaaacatgtgagatcatttgagagtaccaacatggacgttggtttgagacttctccctcaaattacaagctcaaagaacacgtcaaatgtcctcttgaaatctgcaatgagaaagacaaaccaacaatccatccctcaagacttttgcttccttaaaacttgcaatctatgcaataagcagctcagtccagacaaagatatttacatgtacagcatcttgggttgggagatcaaggcttctgcagtgtag

SEQ ID NO: 52474 - DNA, 1818 bp, Glycine max
  Peptide Sequence Number=SeqID_169252
atggaaaaaacagaaatgttgaagggagaggtgcaagaaaacgtggaaaaggtgcagcagcaagcaccaaatgagccaccaccaccatcaccaccaccaccaccaccaccaccaccaccaggagacaacaagtcattccgttgctggtattgtaatgccaagttggattctaacaacgccgtgcgcagacatatgaaattccaccaggaacaaatagaagcagaaatgatgcgaattcatattgaagggggtggatcatctcatcaacaacctttggtttcttattctgaagcatcatcatcaagttcgaggtctctgccacatcctggaaaccaagcttatggtgaatcaacatcacctcagactcctcagttcctaagtgtaatggctcatcaagtgatcagtggatcttctcatcaacctttggtttcttattctgttgggaatcatggccaagaaagaatcaatacttcaatattatctcaggctcggaatactgccatgcatcagttccaaagtttatcggatcaagaatttggcccagaaaattcttcaatatggcacctggctcggaatattgccatacatcatcggcttcagcttttcagggctcaacggaatactggatcatctcatcaacctttggtttcttattcatctcagaattttggccaagaaaccagcagcaatgcttcaatattacctcagactcagaatatttccatgcgtcagttccaaagtttaatggctcaagggatcagtggatcatctcatcaacctttgctttctaattctgcagtgccagttagagtacaaggacttccaagttcaaggtcacatcctaatgggaattttggccaagaaagcagcaacaatgcttcaatattacctcagactcagaatatttccatgcatgagttccaaagtttaatggctagaggtatcagtggaccatctcatcaaccttttctttctaattctgcagtgccagttagagtacaaggacttccaagttcaaggtcacatcctgatgggaattttggccaagaaagcagaaacaatgcttcaacgttacctcagactcagaatatttccatgcatgagttccaaagtttaatggctagaggtatcagtggaccatctcatcaaccttttctttataattctgcagtgccagttagagtacaaggacttccaagttcaaggtcacatcctaatgggaattttggccaagaaagcagcaacaatgcttcaatattacctcagactcagaatatttccatgcatgagttccaaagtttaatggctagaggtatcagtggaccatctcgtcaaccttttctttctaattctgcagtgccagttagagtacaaggacttccaagttcaaggtcacatcctaatgggaattttggccaagaaagcagaatttcttcaataagacctcagattgcaagcatagggagtgcatctcatcaacagtaccacaactcacatcaacctttggttacatcaagttcaaggtcacatcctagtttatcttatgaggggagttctggacaggaaagcgattcttcagcaataaggcctcagaatgcaagcatagagtggaggtgtgataagaggaaatttggccaagagagaagccctgctgattcgaatgccgacaagcgactcaagcctttatgtgatgatagggaatttgaccaaataagaagttcttcagtaatagtacctcagaatgaaatcactgagggagaggggcctgattatgatttgaatgtcaagccttcatgtaatgatgagaattctggttaa

SEQ ID NO: 52475 - DNA, 2745 bp, Glycine max
  Peptide Sequence Number=SeqID_169253
atgattactcaaacaatcataaaaagaacaacaggggaagatgtgaatcccgaatccgcatcatcgcttccctcaatcttctttcttgttcaatcttcatcttccaatcccaatccatccatcgcgttagggttttcacagttccagttcccttctcccgcaccgccattgccgctcccttttatcctcgatcggcaactctctgcgtccaagcgatgcaacgcaccgtcgcaattccttcgtagtttcgcgaaacggcgtttttcttcggtggaggaaacttcggaactgagccgcgtcggagtccaatcttccgcgctcggaatttcaccgtcgttttttttctctctcagtgttcgcgtgtgtgtctgctcggtgctgcgttttgctcgaacgatgtttccgtttcattctcaaggaactccgaaacacacttgcactcttctcgctgtgacctgcagaacaagttccgctgagcacaaactctcacatgctcagcgcacatatcctttccctgagttagtttccgcggggcgtcttgaggttcaaactctttgcagtccggagaaggaacagtttcggaaagttctggagtcgtttcaaccgaattttgtttacttgcgaggagaccagctagagaatggggaagtaggttcgctggtttggcagggtgtggaattatccacttgtgaagatataacagagctctttggttccacattgccaacggctgtttatttagaaataccaaatggagaaagttttgcagaggctcttcatcttaagggaatcccatatgttatattttggaagaataccttctcttgttatgctgcctgccattttcgtcaagcatttctttcagtagtacaaagttcatctacacatacatgggatgctttccaccttgcacgtgcctcttttgaactttactgtgtccaaaacaatcaagtacttccttctgatagcgatgatgctagtagtgagatggggccacaccttcttggcgactgtctcaaaatcaatgtcgaccctccagagatcgatgaagaggatgatgacgaaagttcctcaggaagtttgcctgccataaagatacatgaggatgaagtgaacttgagatttctcatctgtggtgcaccttcgactgttgatgagtcattgctgagatctttggaggatggactcagagctctcttaactattgaaatacgtggttgcaagctccatggcaagtttagtgccccaccaccacctcttcaggcagccgctttttctcgcggagttgtgaccatgcgatgtgatatatcaacctgtagttctgcacatatctcacttctggtatccggcagtgcacaaacttgttttaatgatcagctcttggagaatcatataaaaaatgagataattgagaagagtcaactagttcacgcacaactcaacaatgagggaaacaaagagaacatctgtgaacctcgcagatctgcttctattgcctgtggagcatctgtatttgaaatttgcatgaagctacctcaatgggctttgcagattttgagacagctagcacctgaggtttcttatcgaagtttagttgcacttggcattgctagtattcaggggttgcctatagcttcttttgagaaagatgatgctgaacgcttactgttcttctatcaaaactgtgagaaagatagctgtacaaacaaaaataatataatttttagcagtccccctggttggttgaaaccaccccctcctactaggaaaaggtgtgaaccaagacaagaggctagccctggtcttcatgaaggtgtctttgcagggcagggtggtgtttgtaaattaaatgaagaggaaaaggacagaaaaattgtcaatgggattagcatgccgttaactcctgctaggcagagattaaaagtatctgcaatgaggccaattcctcacattcgtcgccatagaatgacacctttttgtgggccttctgagacagatggttttgatggcactcaggtagaggctattttgccacttgttgcccctacgaagcgtactagtattggatcaacatctggaacacacagaaaatcattttcaagtgcagctcagtctaagcaggttatttcattgaacccattgcctcttaagaaacatggttgtggtagaggcccagtacagacatgctctgaggaggaatttcttaaagatgtcatggagtttctgattctccggggacataatagactgattcctcaaggagggcttaccgagttccctgatgccatactcaatggaaaacgccttgatctctacaatctatataaagaggtggttaccaggggaggatttcatgttggcaatggcatcaactggaagggacaaatcttttcaaagatgcgcaattacacaacaaccaatagaatgactggtgttgggaatactctcaagcgacattatgagacctaccttttagaatatgaattagcacatgatgatgtggatggagaatgttgcttgttgtgtcacagtagtgcagctggtgattgggtgaattgtggcatatgtggtgaatgggcccactttggctgtgacagaaggcagggtcttggtgcatttaaggattatgcaaaaacagatgggctagaatatatatgtcctcattgtagtgttacaaatttcaagaagaaacaaaatgttgctaatgggtattctcaagggtcaatgtcttcacgacccctttga

SEQ ID NO: 52476 - DNA, 1606 bp, Glycine max
  Peptide Sequence Number=SeqID_169254
atgaatgtgattgcaacaagaacagcaaacaagaagaggggagagattgagatgaaagaagttgagcagagaaacaggcgtcacgtgaccttctccaaacgcaaactagggttattcaacaaactcaccgagctctctgttctctgccaagtagaggcagctgtgatcatcacctcgcaaaacgggaagttctattcctgcggctaccccgaccctgacgctgtcgttcgccgctacctcactggagggcctccgctgcggcgcaaccctgcagacaatagggggcaacatgacttgcttgagaagcaaaggctggaatatgaggctattcagaatcagttgaaagaagagaagaagcgtctggaagaaatacaagggacgcgaaataacaatggtttcttctttgctgccccttggtggaaccttcccgctgaggacataggtttcgaggatcttcaacagttcaagacttctttggaatgcttgaagtttaacctaattggggcattgcaagagaagcagatgaattcggttccatcaatgcaaccttctacggttcccccaccaatgccatatactgtggttccaccaatgtcatctactatggttccaccaatttcacagttttttagtgcgcagcgtttcagtagaaatcaagttcaaggtgatgattatcggaggagtggtgctatagctagtactagttcgtcgacgtttgcttcaagtggttttggaagccaggaaaattatagtacgcagggaacttcaacggcatctatgactttgccctctactcctgaagatcatcatctcttagttgatgatttctacttttcagccctttatgatgctgaagaaatatttccaatctcagatgagaaatatgcagaagagctacaactacaagaagccctttattcctctataatctcaagtactactaaagttaaaaacgaagttatccaagtgaatgttgatgttgacggtgacactcctttgagaaccctcaagaagaaacataaggagatcggtgaatcttcccaagtctactgtggcatttgcatggatgccaaatctggtgaagaaattttcaggaaccgaaactgttctcactctttttgttctgattgtattgggaaatatgtgactgcaaagattcaggagaatatatcaacggtgaaatgccctgacaccaaatgcaaggaagttgtagagcctcagtactgtcggtcaattatccctaaggaagtgtttgatcgatgggaaaatgccatttttgagaattcggtgcttagatcacaaaaattttattgcccttttaaggattgttcagccatgtatatacgtgatgcaggggaagttgtgacagtttcggagtgtccatattgtaacagactgttttgtgcacagtgcaaggttccgtggcattcagaaataggttgtaacgagtttcagaatttgaagaagtacgagcgagagagggaagatttgatggtgatggaacttgctaagaataagaatgtggcaatgaattttgctatgtctgtggatccacttggagttgtcaacactataactgtgaacctctttaagaaatatgctggac

SEQ ID NO: 52477 - DNA, 2331 bp, Glycine max
  Peptide Sequence Number=SeqID_169255
atggctccatttggctccttggtcattctcccctttttgttgatagcaacagtgacttgttctacttcagagaaggaaaatagtaaaactttcatagtccaagtccaccaccaaaccaagccttccatattccctacccacaaacactggtacgactcctccctctcttccatttccaccaccgcttctgttatacacacctacgacaccgtttttcatggcttctccgcaaagctctcaccttcagaggcacagaagctgcaatcactcggccacgtcatcactctcattcccgaacagcttcgttcccttcacaccacgcgctcccctgagtttctcggcttaactaccgccgacaggaccggcttgctccacgagaccgatttcggctcggatctcgtcatcggagttatcgacaccggaatctggccggagcgccagagcttcaacgaccgcgacctcggccccgttcccgccaaatggaggggaaagtgcgtcgccggacaaaattttccggccacttcctgcaaccggaaactcatcggcgccaggtggttctccggcggatacgaggccaccaacgggaagatgaatgagaccactgagttccgctcgccgagagactccgacggccacggcacgcacacggcgtccattgccgccgggagatacgtctcgccagcgtccacgttagggtacgccaagggcgtcgccgccggcatggcgccgaaggcgcggctcgcggtgtataaagtctgctggaacggcggttgctttgactccgacattctcgctgccttcgacgccgccgtgtccgacggcgtcgacgtggcgtcgctgagcgtcggaggtgttgtggtaccttaccatctcgatgtcattgctattggcgccttcgccgccgcctccgccggcgtttttgtctccgcctccgcgggaaacggtggtcccggcggactcacggtgaccaatgtggcgccttgggtgaccaccgttggtgccggaaccttagacagagatttcccggcgaatgtgaagcttggaagtggaaaaatagtacctggaattagtatttatggtggaccgggtctaactccgggtcgaatgtatccaattgtttatgcgggtgttgaacaatttggcggtggtggtgatgggtattcatcatcactttgtttagaaggttccttggatcctaagtttgtaaaaggaaaaattgttgtgtgtgatagagggattaattcaagagctgccaaaggtgaacaagttaagaaaaatggaggagttggcatgattttggccaatggtgtgtttgatggtgaaggattagtagctgattgccacgtattacctgccacggcggttggcgccactgccggggacgaaatccggagttacatcgggaattcacggacgccggccacagcgacaatcgtgttcaagggaacaagactaggggttaggccagcacctgtggtggcatcattttcagcaagagggccaaaccctgtgtctccagagattctgaagcccgatgtaatagccccagggttgaacattcttgcagcttggcctgatcatgttggaccctctggggtaccctctgatggacgcaggactgagttcaacatcctctctgggacttcaatggcttgtcctcatgtttctggtttggctgctttgttgaaagcagcccatcctgattggagtcctgcttctattaggtctgctttgatgaccactgcttacactgtggacaacaagggtgatcccatcttggatgagtccactgggaatgtttcttcagtgtttgattatggtgctggccatgttcaccccgtcaaggccatgaaccctggcttggtttatgatatctcctctaatgattatgtgaatttcttgtgtaattcaaattacaccaccaacactatccgtgtcatcactagaaggaatgctgattgcagtggggctaaaagggcaggacattctgggaacctcaattacccttcattgtctgcagtgtttcagctatatggaaagaagagaatggctacacattttattaggactgtgaccaatgttggggaccctagttcagtgtacaaggtcactgttaagccgccacgcggaacggtggtcaccgtgaagccggacaccttgaatttcaggagggtggggcagaagctcaactttcttgtcagggttcaaattagggctgttaagctttctccgggtggttctagtgtgaagagtggcttcatagtttggtctgatgggaagcatactgtcacaagtccccttgttgtgacgatgcagcagcctctggattag

SEQ ID NO: 52478 - DNA, 300 bp, Glycine max
  Peptide Sequence Number=SeqID_169256
gagactgctgcgtcgagacatccgcctccccctcatcatgaggagttcgtcgagccacccatccctgaggtttcagtcacaaccgatctccctacgcattcagtggttcactgtgaaggatgtcaggggatggctcaggatttaggagcgattgctgaggatttggagcgggtcatcaacctcaggatggtcactgagggcactaacatacatgacatcatgactcgttgtctgatgagagctagaggtgacaccgtagatggaagtcttaggccacgccagagacgccgcatagattag

SEQ ID NO: 52479 - DNA, 426 bp, Glycine max
  Peptide Sequence Number=SeqID_169257
atgaaacaggttattaggggccatccagagttgaagtatttggtggggatggacgtggactctctagcacacgacatcgcccagcctcgtcttgatgccgttttgaacgctggtgtcaaagcgattaccgttttgaggaattttagagacgtcaagtctgtgcttagagaaatcgctgagctacacttgttgggggttgacgccatcttaatggacttgggaatgtcatctatgcaggtggacgatcctgcgagaggattcagtgtgcttggtgatggaccccttgatatgcggatggatcctcagtctctttgctatgttagtatggttaaatccattccaagacatacttctatgtctaaatggtttggcttctctagacagggatgcatgttagagggaaagtatggagtttataaccattga

SEQ ID NO: 52480 - DNA, 708 bp, Glycine max
  Peptide Sequence Number=SeqID_169258
atgaatcttgaagggaagacaaaagatagtataaaatctcgttttgatctagagtgtatgggtattcgacctgggcttcatgcaaccatggttgaagaagtggatttaaaggttcctgatggttattcatccaatgtttctcgatgcatagatgtccaagatggaaaaatatccgggatgaaatgtcatgattcccacgtgtttttacatcgttatctcccacttgtaatatgtggtgttctacggaaggaagtttatgaggcaaggattgttgggccagtgcaatgccgttggatgtatcctattgaaagatacctacgtaggcttaaatcgtatgtcaaaaacaaggcccgtccagaaggatctattgctgaaggatatattgcacaagaatgtttgcatttctattctaggtgcttacatggagttgagacaagattgaatagacctggaagaaattatgaaggtgatttagataaactagaaatttcaaagttgaaaattttttcacaagtgggcaaaccattgctcaggaaaaagtatgttgaattgagtttagtagaatgcatgcaagcaaggatttatgttcttcaaaattgcgatgaagtatcaccatttattaaactacacaaagaagaattagagaaagcaaattctcaaaatatggaacaaagtgatgcaattctaccccccaagggcattggatag

SEQ ID NO: 52481 - DNA, 186 bp, Glycine max
  Peptide Sequence Number=SeqID_169259
gtgaaggagacattctcaccacttgtgtttttgcagtctttcatcttgttcttctctttgttgtaaaggaggttttcggactatggaaagctaaatcctctgttggatcttcccttggaaactggtctgattctaaagtccttgatagaacgggactaagttgttgtgctatcacgaggaatcggg

SEQ ID NO: 52482 - DNA, 414 bp, Glycine max
  Peptide Sequence Number=SeqID_169260
attatggaaactagaggtttaggtcgtgtcttaagcagagttataggaagagccttggagagagaggataatcatcatttagatgatgttccccagcagcgaaggcccacaacatccgcacgtaggcaacaggaagttgccgctattgttgaggatgttcctcacgtggatgacgtagctgaagaggagcatcctgaattaaagttatcctcccatggaaggaaagttcaaaaatttgggaagcctgctactgaaattaaagggctagttgctgtcacaggattaagtcctttgatcgcatgttcattgaacactgacgatcggggacttatattggctttttttcgagaagttgcacaaggagacgagcagtttccatcttctagtaggagaggtcatcatcaccctcgatga

SEQ ID NO: 52483 - DNA, 885 bp, Glycine max
  Peptide Sequence Number=SeqID_169261
atggagattgcactaggcaatcacttcgcgtggctccagactcattggtggaggatgcatgaacgacaatcaattcatggggctccgaataaaagtggagaatggagaattgcactaggaaatcacttcgcgtggctccagactcattggtggaggatgcatgaacgacaatcaattcatggggctccgaataaaagtggagaatggagaattgcactaatcaatcacttcgcgcggctacagactcattggtggaggatgcatgaacgacaatcaattcatggggctccgaataaaagtggagaatggagaattgcactaggcaatcacttcgcgtggctccagactcattggtggaggatgcatgaacgacaatcaattcatgggtctccgaataaaagtggagaatggagaattgcactaggcaatcacttcgcgtggctccagattcactggtggaggatgcatgaacgacaatcaattcatggggctccgaataaaagtggagaatggagaattgcactaggcaatcacttcgcgtggctccagactcattggtggaggatgcatgaacgacaatcaattcatggggctccgaataaaagtggagaatggagaattgcactaggcaatcacttcgtgtggctccagactcattggtggaggatgcatgaacgacaatcaattcatggggttccgaataaaagtggttggcaggaccgaatgaggaagctgggtgtttcggtcttttcctctttgtttatgtggggcgggatatcgccagtcgagaatgactttgaatggcaattcgaaaggaagaaccaccaaaaatgggttttcctttgcccgcagtcacttaccttgccgaaaatttatctggtttga

SEQ ID NO: 52484 - DNA, 403 bp, Glycine max
  Peptide Sequence Number=SeqID_169262
tacctccattgaagaccacctgcaacatttggagcttgcttttcagactcaagttgagtatctggggcacctggtttctcaaaggggtgttgaacccttagccgcgaaggtagcagctattcaacagtgggtgtctcctcgaacaacaaaggccttacgcagcttcttaggcttggccggtttctatcacaggtttatacgaggttatgctacgattgcggcccctttggtcaaggcaaccaccattgacccttttcaatggtcgtccacgacccaatctgcttttgaccagttgaagctcgccttgtccaccgctccggttttagcactcccagattttcaatctccgttcaccgtcgagacagatgcttccggcattggaatgggtgtcgtgttgtcttag

SEQ ID NO: 52485 - DNA, 150 bp, Glycine max
  Peptide Sequence Number=SeqID_169263
atgtgtgaggttctcaaggtacctttcctccaaatagtagagaagttgagcattaaggaaaaaaaaactttgaagccaagagcattgagggaagaaggataccctatttcccttgagcaggaccattttggcatctaccgtgtgacttag

SEQ ID NO: 52486 - DNA, 612 bp, Glycine max
  Peptide Sequence Number=SeqID_169264
atggtaggcaaagatttgggaagtacgggcaacccccattttgtacaagtccaaaacaagcatgctttcctgccatatggtttgcctccgaactatactccacccaatgagaatgttaataactccactcccatactcattgagagccaaaaacctcaatctgatcatgcacatgtctctcaacccatgggggggacacatgaaatgccccaccataatctagtcaacttcgagccttgcctcaaatacgccaccgaagggcaaatagttggtggtgagcccctaccaaacacttcagagggccctcattttcgcccacaaccgcaacccttgcattttgtggtgggaagagcccctcctgctatggctgaaaacagaaagttggatcggatagaggaaaggctaagggttgttgaaggaagcagagattatgcctttgctaacatggcagaattgtgcctagtgcatgatgtcatcatcccttcgaagttcaaggtgtcggagtttgataaatacaaggggacaacttgccccaagaatcacctgaaactgtattgttggaagatggaggcgtatgcgaaagatgaaaaactgctgatgcatttcttctaa

SEQ ID NO: 52487 - DNA, 321 bp, Glycine max
  Peptide Sequence Number=SeqID_169265
agggaaaggctaagggctattaaaggaggtggagattatgctttcgctgacattgcaaaattgtgcctagtacctaacgttgtcatccctccgaagttcaaggtgccagatttcgataaatacaaggggactacttgccccaagaatcacctgaaaatgtactgtcgggagatgggggcgtacgcgaaagatgagaaactgttgatgcatttcttccaagaaagtcttactggggcagccatcacctggtatactaatctagaactttcccgggtccattctaggaaggacctaatggtggccttcattaggcagtattag

SEQ ID NO: 52488 - DNA, 570 bp, Glycine max
  Peptide Sequence Number=SeqID_169266
atgctgaggaaatacaagcagatagtcactgctgttgttgtttatgatgctaatggtgcacttgagaagcctatcactcaaaatgatgagattaaagaatatctagattgcagatatatttctccgtgtgaagctacttggagaatttttggttttccaatacatgctagaaaacctgttgtggagagattacattttcatctgtcagggcaacacagtgttctttatgaagacgatgatgatatagatgatatcctatcaaagccaagcatttcaaattcaaaattcttagcttggatgaatagcaacaaatgtttttcagaagatagatcatggaacctcagaaagaaaggcaatacaattggcaggctaatatgggttccaccaaccactggtgaattattttatctaagaatgatgcttactacatgcaaaggacctacttcatttgaggatattagaacagttgaaaatgttctataccctacatatagggaagcatgctttgcaatgggttttttgcaagatgacagagaatttgtggaagcaatcaaagaagctaaggactag

SEQ ID NO: 52489 - DNA, 260 bp, Glycine max
  Peptide Sequence Number=SeqID_169267
atgagtgatgcaaatggtgagatagaacctagtacgaatagagtggagtgggagttgcgggtccttgtttgtagggactgttacgacaattcagtggcggtttcaaggcccggctaccctgggcaattgcccaggctctggctccgccactggtctgaggaccaagcagggcaagaactgaagcttccagacttgttgaacagtgatgctgttagagaaatccatgctaatatcgaaaaagaatgggattttcttcaaag

SEQ ID NO: 52490 - DNA, 2099 bp, Glycine max
  Peptide Sequence Number=SeqID_169268
tcctcttggtgaagaagaaggacgggacttggcgtatgtgcgtggattatagatcccttaacgccgtaacggttcgagaccgattcccaatccccaccattgatgagttactggacgagttaggcaacgcctcgtggttttccaagcttgatctcaagcaaggattccaccaaatccttatgcacgaagctgatgttgagaagacatcttttcagacacaccaagggcactacgaatacctcgttatgccctttggtttgtgcaatgcgccttccacgttccaggcaacaatgaaccttctcctcgcgccgttcctgtgtcgtttcgcggcagtgttcttcgacaatatactcaatcaattagaatatcttggacacatagttttcggcaagggtgtaacccctgaaccctccaaactccaagctatcaccgaatggccaattccgacgaccgccaaggagcttcgggcattccttggtcttaccggtttttaccggaagttcattcagaaatatgcagcaatcgcatctccactcactcgcctcttatgtaaagattcatttgaatgggacactgaatcacaagctgcttttgatcacctcaaatcggccatgacctctgccctggtgttagctctacctaacttcaatgaaccatttacaatcgaaacagacgcgtctggctccaccatgggagctgtgctcatgcagcagggacatccactcgcattcttcagtaaaaacttcaccctgcgactactacacgcttctacctatgtcaaggaactccatgccattatcgccgccgtccgcaaatggcgtcaatatctccttggccgtccgtttacaatccttacggatcacaagagccttcgggaactcctacctcctgattccggtcaactgcttctcctttcggtgccaccactggatttcctgcatgacattcaacacgcgctcgaagctgatcctaccttccaggagcttgtacgcaacattaaagacgatccttcagccttcttttgggaaggtttacgacatgacgttaagaagttcattcgcgagtgtaaggtatgtcaacaacataagtctagcaccaagcgcatggctggtcttttacaaccattgccagctccgacgggggtatgggaagatatctccatggacttcataacccatcttcccccttctcatggcttcaccgttatattcgttgtcgtcgataggttctccaagggggtgcatctggcggcattacccatgggattctcagctttcaaggttgccacggtgttcctcgatatcgtatgcaaacaccatggattccctaggagcatcgtctctgatagggaccctgtgttcctcaacaccttttggaaggagttgtttcgcctctccggcactcgccttcgcctcagcatggcgtaccacccacagtctgatggacagactgaggtgatgaaccgagtccttgaacaataccttaggtgcttcgtgagctctcaaccatcaacttggttccgctatttgtctcttgcggaatggagttataatactttattgcactccagctcgggattaaccccattcgaagtcatatatgctaaaccaccgcctgcgataccacattatattcctggatcaacaaataatgaagctgtggagtcactggttacttcgcgccaagctatacacgttaaactgctgaaaacactacaaaaggctcaggattccatgaaaaaatacgcggatactaaacgtgaagaagtcacattttctgaaggtcagtgggtctatgttaaacttcatctggcgcgccaacgttcagtcaccggtgccacccattcaaagctatcgaaatgctactttggacccttcaggatcttggcaagagtgggagtagttgcgtatcgactcgatcttcccgatgaagcacgtattcatccggctgggcaacccccagaagacacctcctgggaaccatggaaggaattgcaagtagtttaccaccttgaggacaaggtggtgttcgtgggaggtggtattgttagcaaccacgctgcctccattgaagatgaaccccacaccacgataaggcca

SEQ ID NO: 52491 - DNA, 255 bp, Glycine max
  Peptide Sequence Number=SeqID_169269
atgacgatgaggccaatttcgcacttttcatcactttctctctattcttccccaaatttgcaccattcaagtcactcctcttctagctcacaatgtctttcttcctcccttgtgctaaatgagttgccctcagattttgaattaaacaatggtgtcattggattgacatggaaagcgaaagaccaaagggattcaactaacagttctatgaattacgattttggctcagtaataagagctgaagcacactgttga

SEQ ID NO: 52492 - DNA, 264 bp, Glycine max
  Peptide Sequence Number=SeqID_169270
atggtgacaattgtggtgagaacgactataatgacaatggcaatgatggtgggcaacgatagttgtgaagccctttgtagagcttctacgtcgtcttcattgttccctcatcaaaagatcacgagtccattgatgtgtcttatgcctagatctgagagatctgaagtgaggataagtggtccaaatcctatatgggtcatcaaagtggttggtgctatgaaggtggtgatgtgcgtgatagagaaatggaggatatgggtctag

SEQ ID NO: 52493 - DNA, 333 bp, Glycine max
  Peptide Sequence Number=SeqID_169271
atggagattgcactaggcaatcactttgcgtggctccagactcattgctggacgatgcatgaacgacaatcaattcatggggctacaaataaaagtggagaatggagaattgcactaggcaatcacttcgcaatcacttcacgaggctccagactcattggtggaggatgcatgaacgacaatcaattcatggggctccgaataaaagcggagaatggagaattgcacttggcaatcacttcgcgtggctctagactcattggtggaggatgcatgaacgacaatcaattcatggggctccgaataaaactggagaatggagaattgcactag

SEQ ID NO: 52494 - DNA, 558 bp, Glycine max
  Peptide Sequence Number=SeqID_169272
atggctcatgcagattcaaaacgtctgcttgatgctgaagacgtatgggatggatttgagtgccaaaacttgagaaagcaagttgtcaaagcatcaggcagcacaaggatgaaggtaggccacttcttttcttcgtccaattctcttgttttccgtcttagcatggctcgtcaaatcaaacatgttaggtgtagattggataagatagcagctgatgggaacaagtttggtctagagaggatttctgttgaccacagacttgtgcaaagaagagaaatgacttattcacatattgatgcttcaggagtgattggaagggataatgatagggaagaaattatcaagcttttgatgcaacctcaccctcatggggatggtgatggagataaaagtgtgtgtgttattcccatagtgggtcttggaggcatggggaagactacacttgcaaagttggtgttcaatgataagaggattgatgaacttttccaattaaagatgtggcttctacctcagctccatcaattgctcttgctcaccatgaaagcattaacaacttag

SEQ ID NO: 52495 - DNA, 870 bp, Glycine max
  Peptide Sequence Number=SeqID_169273
atgtcttccaggagctctcacttggacaacagaaagcaaggtcactttgccatgttcaggagcgccctcaatgctccatggtcgaaagatacggccaaacttgcattgtgggtccgcctgcttggtgaagctcgttacaagcctggcattaacgaatttgcaggaagagagtggaagctggaagccggtcaactggtaacaaccactacggttctggcaagaaaacttcgcgatcaggatgggaaggaaaagagcccgaaagctgttgagagaatgctcaacttcttctgcaaggaaaacatgatcaccaaggaaggaaacccttttggattagtaatttccatcacaaattactgcgaatatcagggcatttcaggcgtcgaaccctccgtcgtgccatccgtcgaacccaaatccagtaatggcgctgctttgaagcttgtagccgtcgaggggttcgtcgaaccatccgtcgaacagaacaagaaggtacttaacaagaataataaaaccccccttaatcccccagagggggtggaagctctcgctcttgattgtctggattattacaacagtctggcaggggcaagatgctcatcgcctgaagctttcgtgaaagtccttagcactgtgaaagccaaaggaatttgttactcagttgatgatctcaagctggtaatcaaatgggctgttacctgttgggatgcgagaaagaccccaccgaagccgaataacatctgccgaatgactcgattcgatggctacctgtcagacgctcttggttgggctgatggtcagggaagcaatccagcagcctgtcctcatgcagaaatcatcgcgctgtggaacgagaaattcccagccaaggct

SEQ ID NO: 52496 - DNA, 330 bp, Glycine max
  Peptide Sequence Number=SeqID_169274
atgatgattggatgtggaattacctggatgttgtggaagcttgggaggattgatggggacccgacgttgagaggaacgaggataagggctacgtgggagtacgtgagctcagttggaggtgggcaacaggggatggaagctaagagggcttctggtaatcgattaccaggcttagaaatgagggcagcatgttttggaggccctggtaatcgattaccaggctgtgtaatcgattacacagaggaacatgccactggtaatcgattaccagttaggtgtaatcgattacacagtgcatttttgcaggtttcatgtcctgaggctgtgtaa

SEQ ID NO: 52497 - DNA, 632 bp, Glycine max
  Peptide Sequence Number=SeqID_169275
atgcgggtggaactagagacaaaggacaaagtcttagagatggccagaatcaaagaagaggccaccaagctccaagcatctagaagatatagtacaaaggctcaattgggagggcccattcagggtcgtatcaagcctagacaacaaagcatacaggctacaggacctagatggtttcaacgaggctccaaaggcttgtcaaacccaaggtccgcccttggtgagtctcccttctccaaaggctcgtcaacctcgaggtccgcccttggtgagtctcgcttctccaagggctcatcaaacccaaggtcttcccttggtgagtctcgcttctctaaatactcgtcaaagccaaggtctgcccttggtgagtttcactcttccaaaggctcgccaaacctaagtgaaaaacttgaggaatgtcagggaatcattagagattccgctatcgctgctggaacacatgtgagcctgcttagaggtgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaacttttaagtgaaag

SEQ ID NO: 52498 - DNA, 477 bp, Glycine max
  Peptide Sequence Number=SeqID_169276
atgaagttccctaccttgacgggagagatcgtgactgccaaggcagatcaaaagcaagcacgacagtgctatgctgaaagcctgaaaatggcaccctatcctcccaccagggaggatggtggcatggtctatagaactttcagagttcgatcttcagcccccaagctcaacttcaaagcctcaaacaatcaggttgagtacgagacacttatagtaggcctaaacctagcaaaagaagttagggccaagaaactaaggttctacactggctcccagcttgttcaggggcaagctgcaaaaagatatcaacccaaggaaatagtgttgatcaagtactatcacattgccaaaactctcattgacaacttcaaatgctttgagaagtactgcatacctacgaagagaaacaccagagtatacctactctccaagatggccagcaccaaaaagatcaggcatctcaagaccatcatctag

SEQ ID NO: 52499 - DNA, 465 bp, Glycine max
  Peptide Sequence Number=SeqID_169277
atggcaggtgaggtccttattgagccgtgtgcactgctcgggtttaagtccaagatgctacttgacaagctcttcgatgggtttgggaccttgtcgcaacctaccctcagcgggagggcgacgcgagggcttacgagtgcatcttccaaggaaggaaaacgtgtggagtcgccaccaacatttattcgatggtttaagtccaagatgctacttgacaagctcttcgatgggtttgggaccttgtcgcaacctaccctcggcgggaaggcgacgcgagggcttacgagtgcatcttccaaggaaggaaaacgtgcggagtcgccaccaacgtttattcgatggtttaagtccaagatgctacttgacaagtgtcataccctaatttcgtccggggattattacttgatgacatgcaacctttggttagccgctttgagatacttggcgtcctttgttgcacaataa

SEQ ID NO: 52500 - DNA, 99 bp, Glycine max
  Peptide Sequence Number=SeqID_169278
atggccaaaaggtgcagtgcaggattgagttattttgattcttggtcatggggatcaagcattgctttctacaagatgagaatgcatgtgcttccatag

SEQ ID NO: 52501 - DNA, 342 bp, Glycine max
  Peptide Sequence Number=SeqID_169279
atgaagaaaacgcgtggagtcgccaccaacgtttattcgagaccaaaaaggggtctccgaattttgaaagtaagggttcgggagttgtttacgcatggggaagagagaattgttaaggcgttggaccttgaaacgatctcaagtgatgatgaggacatgaccaagagcaagggcaaggatccacttgaaggacttggaggacctatgacaagggctagagcaaggaaatccaaggaagctcttcaacaagtgttgtccatactatttgaatacaagcccaagtttcaaggagaaaagtccaagcttgtgagttgtatcatggcccaaatggaggaggactaa

SEQ ID NO: 52502 - DNA, 297 bp, Glycine max
  Peptide Sequence Number=SeqID_169280
atggctgatgaaacagaatcactagtttcgtttcctgaagctcataaaggtctcatggctgatgcttctagctcaaattttacccctcaatttgattatattacagaagattacaacatgggatttacccctcgtgaaaaagttatcaccctatggacttctgctgttataagacactatagagtaaaccatgaaagtcatgtatccaacaaccaagacatgatagcaagagctgaaacatatataggagatatagctagagcctgttgggaatctttcaaacaaactttcccataa

SEQ ID NO: 52503 - DNA, 213 bp, Glycine max
  Peptide Sequence Number=SeqID_169281
atggtcttctggttttcctgcacaatgtggatgaagaagaaatgccttaaagagggatccattggtgaggaggccagatctggccattttcattgtcatattcgcactcgtccggggcaaggtgacaaggttgaaggagaggcggtggaaggtgcggcgcaaacagcggagggtgttgaggggatgagggctttgatagcagggttaagttaa

SEQ ID NO: 52504 - DNA, 1398 bp, Glycine max
  Peptide Sequence Number=SeqID_169282
atgctgcgcccactgatgggcggccagtggcagaatcaggcgccggtgctgcgcattccctattatcgcgcgatggaggcgctggatccgctgcagctcaccggacgcgccgagcagcatctggtacgccagattttttccggcctgacgcgctttaacgcggatgatgtcgagggcgatctggcacatcactggcagcacgatgcgcagggccgcgaatggtatttctggctgcggccactcctcagctggcacaacgacgaaccagtgcaggcggcacagctggtccagcagctgcaacgtatcatgcagacgccgcagggcggccgtctgctggcggcggtggaacacatcgatgcgccacatccgctggcgctgcgtatccggctgcgcaccagcgattactggctgccgcagcggctggcgcatcagttttgcctgctgccgcatccggaacatgccgatatcggcagcggaccgtggcgcctgacgcactttacccgcgagctggtgcggctggagagccatgcgcgctggcaccatcagcgtccgctgattcaggtggtggaatactggattacgccgcagctgttcgatcgcgggctgggcaccagctgtcgccatccggtgcagatcgccattggcgatcccgacgagctggacacgctgcggccggtggatcgcagcatcagtctcggtttctgttacctggcgccgcgtttctcggctcgcttcagccaggcgcaggccaaaacgctgctcgcgctgattcagcacagcggcgtcattcagcagttgccgctggatgaaggcttaattacgccaaccgcagagctgctgcccggctggccgctgcccgccccacaccgcccggaaggcacattgcccgcaacgctgacgctgcattatcacctgcccatcgaactgcacgtcatggcccaggcgctggtgccgctgctggcggcacagggctgtaccctcacctgcgtatttcacgacgtcaaaagctggcgcgacgacatcgatctgagtgacgccgacatcatcatgggcgaccgtctgattggtgatgcgccgcagtttaccctggttaactggctggaaaatgatgcggcctggcaaccgctgcgtccggcggtactgcaggcaccgctgcacgctatcgcccgtcaggccagtccggcactgcgcagcgccgcgattcatcaactgtttcagcagttaatgcgcgacggccatctgctgccgctgtttaactatcgctaccaggtgtttgctccgccaggcgtcgaaggtattcagcttaacagcatgggctggttcgatttcacccgcgcctggatcccgccgcctgccgcaggcggtgctgttcagcccgcgccggagccagtaccatag

SEQ ID NO: 52505 - DNA, 477 bp, Glycine max
  Peptide Sequence Number=SeqID_169283
atgtttaaaaaggaatgtgagacctttaaagaatacgcacatcggtggagagacctggcggcacaagtggcccctcccatggtcgaaagggggatgatcaccatgatggtagacaccttgccaatgttttactatgagaagatggtaggctacatgccttccagctttgcggacttggtattcgctggggaaagaattgaagtagggatgaaaagggggaagttcgattacgtttcctccacaagtacccatgctaaaagggtcggagcaactggggcaaaaaggaaggagggtgtcgcaacgtgcccttttgcgggcgggcgacgcgtgactcgcgggatgcgtgttccacgaaaggaatatgcgcggagtcgccaccaatgtttatttgaggaaaacgtcggaaaaaccgaaggaaaaccggtcaaaaagaaaattctaagttcgggagttgtatttacgcttgaggaaggttaa

SEQ ID NO: 52506 - DNA, 348 bp, Glycine max
  Peptide Sequence Number=SeqID_169284
atggctccagacaaaacccaactacagaatatgagcaagcgagagcatgagtcatttaaggagtatgcccaacggtggagggatttggcggcgctgtcggtgttttactatgaaaagttggtgggctacatgccctctagcttcgcagatctagtatttgcaggcgaaaggattgaagtaggcctgaaaagagggaagttcgactatgttgcccctgccggtacaagtaacagaagattcggagcaactggggcaaagaagaaggaaggggatgcccacgcagtgatttcaacacctacctggccgaagccccaacaaacccctcacaacacttaccaatatgcctaa

SEQ ID NO: 52507 - DNA, 2055 bp, Glycine max
  Peptide Sequence Number=SeqID_169285
atgactgaagaagttcttgatagtatttgtggacagttacaggtgtcaaaacagtgtgacgacattaaagatttgcgcaagatgatgaagatgctcatggaacagaaagacatcatgtataatgatgccaataatgcatctacggaacagaatagtgggttggaggatgaggagtccgcgacggaatcagagcctttatcaacatcagaggatgaagcgagtgagtctgagacggattcaatactgaattcgtcacgccattattgggcgaaaggggtgaaaatgccaatgtttgaaggggagaatccattaggttggatcacggaaatgccttgcactggttccagtattggaggcataagacgaagcggaaaagagataagcacaaaaattcgtccccacaaaccgaaggatctgtcaagtgccatggagttggtggctgatttcaaggaagctgaaaaagaagggaatccagtggttgagttgcgtagtcgtgggtttcattttcaacacaagggaggaatgtggatacatagtgttggaggatccgtaacgaacacctttcacaacacccaacgtcagaatcgaactctaagaggggatgtgcgtagctcttcgaacgtaatggctgcaaatcagagaccatttgttgctggtcacaagtgccttgaaaaaaacctcaggttgcttattttggcagaggatgaatggattaataatgaaggggagattataagattggaaggggagcttgagaatacagttgacaatacaggagaaacagaggtggagtatcaatggatggacttattcgtttgctcagccggtggatttactcaaccacaaacaatgaaattggaagggttgattcagggtaaaagagtgttgattttgattgatagtggtgcttgccacaactttatttctcaagaattagtgcagcaactgagtttgaaagtgactcctactcaaaccgatggagtgagattgggtgatggaaacaggaaaaatgctcaaggctgttgtgagcagatggagttgggagatgtcaagttaaattggaaatctttgaccatggagttcaaacagcaagggaagttggtgaaaattcaaggtgatcctaaactgctaagaactaaagtgtctctgcaatcgatttgcaaacatacagatgttgaattggccatgtttctatgggtactggatactgcggatacacaagaaacagtgcaatatggagtcgatcatgccatccctatcagaacaggaactgatccaatcaatgtcaggccttatagatacccttatctacagaaaaatgaaattgaaaagcaagtcagtgggatgcttgaggctggaattataagaactaacaacagtccttactcgagccctatgattttggttaaaaagaaagatggaagttggcgattttgcaccgactacagggctttaaataaggtgactatccctgacaagtttcccattcttgtcattgaggagttactagatgaactaaagggagctcggtactttgccaagattgatttgaaggcgggttaccatcgaatacgcatgaaactagaagacattcacaagacagcgttcagaactcaccaagggcactatgagtatgtagccatgccttttggcttgtcaaatgcgctagctaccttccagtgtgcaatgaactctacactacaaccatttcttaggaaatttgttttggttttctttgatgacatattgatatatagagcatcatgggaagatcatttgcaacatttgaggactgttttggcaacactggttcagcatgagtttactgccaacctaaagaggtgtaattttgggcagcaagaaattgaatatctaggtcacattatttctacaaagggattggctatggatacaaggaaaattgaggcagtgcttcaatggccgttacccaaatcagtcaagagtttgagaggatttttagggttggcggggtattacagaagattcattgaaggatatggaaagattgctaggcctcttaccaacttgctgtag

SEQ ID NO: 52508 - DNA, 252 bp, Glycine max
  Peptide Sequence Number=SeqID_169286
atgaacacttctgctcatgctaaagaacaggatgacaacaaacctctatggaattatgttacaatattaagagttcttggtagtggaaattttgaaatcaaagataatatgtgtgaagacattacaaaagatgaatttggatcacgtgatgagaatggaattgttgaagttgctaatttatctcttgatgaaccagaattagaagttgtgtttttcaatgaagatgaccaagaaggaagtggaaggacttag

SEQ ID NO: 52509 - DNA, 171 bp, Glycine max
  Peptide Sequence Number=SeqID_169287
atgatttgggaaccatgtgcaaaattagtcatggctacagctaggtgggtactcaagcatccagtttatggcattgtgatactaaggcttgggatttacacaagacgacgttccaaaatgaaaactctacacggttccggaatttcaacaaacactattgacaacaacgaa

SEQ ID NO: 52510 - DNA, 660 bp, Glycine max
  Peptide Sequence Number=SeqID_169288
atgagagggctacacgccttcgccttcagaggactacacgtccttaccttcagagggctacacgtcctcgccttcagaggactacatgtcctcgccttcgtagggctacacgccctcacctttagaggactacacgtccttgccatcagagggctacacgtccttaccttcagatggctacacgtcctcgcctttagaggactgcacgtcctcacctttagagggctacatgccctcaccttcagaggactacacgtcctcacctttagagggttgcatgtcctcgccttcagagggctgcacaccctctcctttagagggttgcacgccctcactttcagaggactacgcgtcctcaccttcagagggctacatcccctcgccttcagagggctacacgttctcaccgtcagagggctacacgccattgcctttgtagggctatacgccctcaccttcagaggactacacgtcctcatcgtcagaggacgaaacatcctcttcttcagaggaccaaacatcgtcatctttagaggactacacgtcctcaccgttagagggctacacgccctcgcctccgagggctacatgtcctcaccttcagaggactacatgtcctcgccttcaaaggacaacacgtcgtcgcatttgccttcgtag

SEQ ID NO: 52511 - DNA, 1657 bp, Glycine max
  Peptide Sequence Number=SeqID_169289
atggggaccaaacctgaccaaagaacaccaagaagctggagcaatctgaagaagttaatcctcttgaaaaggtttgtgaatgcattagagaagcaccaaacagcggaagagaagaagaatgctgaggaatggatgcttgactatgcacttcaaaaggttgtttctaaacttgcacctgctcaaagacaaaaagtgacacttctagtaaaagcttttgaaacaattctgccatttcaagttgctgaaaatagtccacggttttctccaacaatggaacctcaagcaaatctagttcaaccccttgacaattcctcaaatcacagcgaggaagaaacatcattttcgcatgatagcagtatggaactgacagaaaatactagtgatgatccaatgccagaactgcacaatcctactacgctcaaagaaagatgtcttgagtctcttgactttcctggaaccgagacagtcaagaatatgcctgcctttggagctactgaagaagacttgagtggaaagcaaagtttagctggcagttatgataatgaggagaagatatcaagtgacagtgataatatttatcttggagagatcaaagatactacctcaagttccttaaatgagccagttgaaattataagaagcagtcatgaggaggctctaaccaatgaaacagtcaatgatgttccagaagatttgctatccagtgtgaatacagaaaatccagatatcaaatctgagtcacctggaagagatgttgaaaccaagaatctgaatggtgataatggggaaaaattttccatgtccaaaagtttagtcctagaaggtttagttagatcactcagatctaatttgattggtttaggagcacctgtaaacgaaccaactgccaacgacagaaaagaaggaattgaaaatgttaaacaggaaactgagactcttgaagagttccctacaaaggaacaatatgaagctcatattagtgctgttgtagaacctgagacccctgtagagaaacataataacacaggattgtggtacttggtgtataagcacatggcatcaaatatggatgaaaacaattccgagtcactaattgatggggcagacaaaaatgagtcagggtttgatgggagcagaaaaagaggagcttccttctctcatgaaagtacacccgtgactgatcaagagatgaaatttaaggaccatgtcgtagctgatccagaagttgcacaccaacagaatgaagccatcaagatggtagaagaagcaattgattcaattcttccagatgatcaggatgacttatcagacaaggaatcactcaatgacagcacaatttcagacaactccaaacaatccaacagaactgaaagagtatacagtgaaggcctgaaccaaaaagaagaaaagatggaatccgggaacagaatgatccaaaaacaagaagaatcagcaccaaaggagcaaaacaaaacaaaccagaaaatgtctacaagctggagcaatcttaaaaaagtgatcctgcttaggagattcatcaagtcattggaaaaagtaaggaaattcaacccaagagggcctagatatctatctctagagcctgattcagaagctgaaaaagttaacttaaggcatcaagacgtggaagaacgaaaag

SEQ ID NO: 52512 - DNA, 261 bp, Glycine max
  Peptide Sequence Number=SeqID_169290
atgacatgggtgaagtgcaacacatatgagtctgctaaggggaaccctatcatcgtaggttctggagctttactaaagaatgcaattgattgggcctctaggcccccaaatgtttgggctggcaaagctgctgcaattgtaagggccggtgcaaaatttaacgatgatggtgacttaattgatgaagaggccaaggataagttgaagcaagttcttctctccttgcaagcatttactctaagacttcaaggcaaaagctaa

SEQ ID NO: 52513 - DNA, 510 bp, Glycine max
  Peptide Sequence Number=SeqID_169291
atgcagtggaatctgttgcaacttttgactaggatgtgtttgtcacagggcttgggaggggaatcgataaggagcgagatgcgaggtgtcgttagggtggaacaattgctggtcgtcgggatcaaaaaggtcaacgtcggatcggatctcagtgaggatgtgcttggtctcctcgatgagattctagttgacaacgtcattgtcggaggagccaaggttgacacaaatggtgccgcggaggacgaggatggtaacgaagccgtagataatggtgatcttgatgttgttgaaagtcttctggatctgccggtcatagggaaacacgttttcgtcgtggctttgcgcgttgtaggttggcaagcccacgctagtgctgccctcacaatggagcccaacgaatccccaacgccgatgatatcgtcaggtggagtcccgaagctttcacatcctgtgcgacctgaacttcaaaggtatcctttggttgttcttacgaaagtagtcaaggtctag

SEQ ID NO: 52514 - DNA, 564 bp, Glycine max
  Peptide Sequence Number=SeqID_169292
atgagaatgagtaagggaaggaaaccccaacaaggtgtctcccaagtacccccaaaaaaacggtttcatgaaaatcgtcgttattggatgagagactttttgcttgtaaaagagaacaaaaattggcttcaccaaaaccctaagtaccctaatttcgtcagaggtaaacctcgcatcttgctccttattggttcccctcccaagccctctgataaccctattgaaaaccattaccttttcaagtcgattaagaataagattgattactgtagattacacgaaattgaaattgtgtataatttggctcatttggatgtggaagttgtagggtattgggctaagttacctatgattcagaggttgatgttgtcacatcctgaggtggaaaagatttggtggatggatagtgacgtttttattattgatatggtgtttgagcttcttatgtctaagtatgacgagcataatttggtgcttcatggttaccctgatttgttgtttgagcataagtcttggattgcggtgaatacctatattttacaatttaagcattcttttagttga

SEQ ID NO: 52515 - DNA, 798 bp, Glycine max
  Peptide Sequence Number=SeqID_169293
atggggcaggttgtgtcaactgaggctagagccatgtacaatgtggatttggctggcttgacattttggagtcctaatgtgaatgtgttctgtgaccctagatatgttgttatgtatgtccgtggcttagaaaaagtggaggatgaaacaagtgctaaagcggataggcttaaggtttcaagttgttgtaagcattacactgcttatgaccttgacaattggaaaggctttgatcgcttccattttgatgcaaaggtattgttgtatcattactctaactttggcagtgtttgttgccacataattgggcttgttgcaagtgacaaagcaagacttggaggactcgtaccaacctccgtcaatagttgtgtggtggagggccacgtgaatgggattcctacatgtgctgacccaggccttctcaaatggataattagaggccagaggggtctagaaagatatattgtttcagattgtgattcagtggaagtctattacgatgtaattcattacattgcaactcctgaagatgcaatggctcttgcactgaaagtagctttcaacatgaattggggcgattttctaaaaaaatacactgcaaatgctgttaacttgaaaaaaagtagatgtagcaactgtagactaggccttgccttggtgtacaactacatagtcctgatgagattgggcttctttgatgaccccaagtcacttccatttgcaaaccttggaacatccgatgatagcaaacatcacaaaggaagcaagtgcatacctgggagtgtgcttgatggctag

SEQ ID NO: 52516 - DNA, 231 bp, Glycine max
  Peptide Sequence Number=SeqID_169294
atgaagaaggaaaatgttgaagttcttgtcgagagtgaaaatcgagttcaacgcgttgaacccgcgaatggcgtcgtgtatggagtttctggcgcaatgcaactcgcggaaggcgaaggagtggaactcggcgtgcgaagtggaggtgaagcgcgtgcgccgccagagataacgatgacgttggttaacggcgtagaggaagtgttcgacgcgacggcgacggcatcataa

SEQ ID NO: 52517 - DNA, 156 bp, Glycine max
  Peptide Sequence Number=SeqID_169295
agccatgttcaaagtggaggctatgagtatggctattatgtcatgcattggatgtgtaacatacggtttggtgatggcacaccattagacagggagaccataacaacaattcacaacaaatgggcagcttattttgtaaaagttaaagacaactga

SEQ ID NO: 52518 - DNA, 398 bp, Glycine max
  Peptide Sequence Number=SeqID_169296
gaacgaggataagggctacgtgggagtgcgtgagctcaatttgaaggtgggcaactggggatggagaccttggggacgtcagatcgcgatgacaacgcagttaatccatgatcgcgtggtgatggagtgcctagagggagtttgggagaccctcgaaggcaatgagaggtgccgattccgtggcacgattcgactcactgctacttcattagtgtcatcctctgaagaagatcctgaagaggacccagaggagttacctcctgagcttgctgtggatgctcttgactttccagaggatgatgaggacccactccctgatgtggattctccagaggatatcatgacagcatctgaggcagactctacagaggagagcggccctggagggacagcgaata

SEQ ID NO: 52519 - DNA, 376 bp, Glycine max
  Peptide Sequence Number=SeqID_169297
attcctccagaaggctgttgcttctggaggaagcaaccctgctcgcctgggagagctaggttttcgaccgttcttcgacgttcttcattcgttcttcaccattcttcagtcttcaacgggtaagtacctcaaaccaagcttttcgattcattctatgtacccgtggtggtccacatttggtttcatatggcctcacgaaaacgcagagcggtgcccacacaaggaggggaatccacctgggattcctctcgcttcacttctgagacagcttgacacagtcaccaaactcctagagaagcagatcgatgtcaccttggtcaaagaattctactccaacatctatgacccagagggcggtgctcaaaagtactgcaag

SEQ ID NO: 52520 - DNA, 270 bp, Glycine max
  Peptide Sequence Number=SeqID_169298
atgattacggctaataccctccctcaaacgcggtcgaggttgaaggcagagtttggttcgaaaatgcatgagaatagctttggacacgagcttagtaaacaaatcaacaacttgatcattggtaggaatgtgtataacagtggagggaaggcaagtgaaatgcgaaggtcttgcaagagaaagatgaaggccatcagttgtcgggaggatctcaatgccaaggaagtgatgaagaggccccaagtccttcatggagaattcagattgtag

SEQ ID NO: 52521 - DNA, 1854 bp, Glycine max
  Peptide Sequence Number=SeqID_169299
atgttaccaatcgtttcatgctacatgctttcatggttaaattctatctgcacactaagccacacacttatagaaccaagagcttgcatgaatgattctgaatggaaagcaaatgattccaatagcgtggctttggagaagttcaaaagagacagcgtttatattgacaaaaatggcagattaaggaacttcaatcacaaaaaagtgtcaaggaaaaaatgtggttctttgagaggacgaggatggaaatacggttctgggtttgttgatgggatttttcctgtgctgagtccaactgcacagcagattctggactatgttgaaaagggtgtggagagtgagagcatttggggttctttggacatgcttcctcccactcttgatgcatgggatgatattttcactgtggctgttcaacttcggatgaggaaacagtgggattcaatcatttcgatatgtagatggatactgctaaggagctcctttaagccagatgtaatctgctataatttactcatagaagcttttgggcaaaagcttctatacaaggaggctgaatccacatatctgcagcttcttgaggctagatgcattcctaccgaagatacttatgcccttcttataaaggcctactgcatatctgggctgctagaaaaagctgaagcagtctttgccgaaatgcgaaattatggccttccctcaagtgcagttgtatacaatgcttatataaacggattaatgaaaggaggaaattctgacaaagcagaagagattttcaaaaggatgaagaaggatgcctgcaagccaactactgaaacttataccatgttgataaatttatatggaaaggctggtaaatcctttatggccttaaaattgttccatgaaatgatgagccatgattgcaaacctaatatttgcacatatactgctctggtgaatgcatttgcgagagaaggactatgtgagaaagcagaggaagtgttcgagcagatgcaagaagctggacttgaacctgatgtatatgcttataatgccctcatggaagcttacaggttgttaagaaaaaatcaagaattttcttctcccaacagtcgtgcaggttatccttacggagctgcagaaattttttcactaatgcagcacatgggatgtgaaccagatagagcctcatataatatcttggtagatgcatatgggaaagcaggttttcaagatgatgctgaagctgtttttaaagatatgaaaagagtgggaataacaccaacaatgaagtcccacatggttcttctgtctgcctattccaaaatgggcagtgtgaataaatgtgaggagattcttaaccaaatgtgtaaatctggtctgaaactagacacttatgttctcaacagcatgctgaacttgtatggacggttaggccaatttggaaagatggaagaagttctgagagtgatggaaaaaggatcatatgtagctgatattagtacatacaatatcttgataaataggtatggtcaagcaggatttattgagagaatggaagacttgtttcaattgcttcctagcaaaggtttaaaacctgatgtggtgacttggacttctcgtattggagcctactctaaaaaaaagctttacttaaagtgcttagaaatatttgaagaaatgattgatgatggttgttacccagatgggggaacagctaaggtacttcttgcagcatgctccaatgaagatcagactgagcagaccaatccaaaagacaaagtccagttccttgcaataagctccacaatcatccctactatggccacctgcttgagaaaaggggggcaaacccttgattccactatatga

SEQ ID NO: 52522 - DNA, 846 bp, Glycine max
  Peptide Sequence Number=SeqID_169300
atggttgttactttactcggtgaatatcacatcacatgggttgattcatggaggcttaaaggtgaagagatactgcttatgcctgaactgagtttgttatgtaaaaaaataaaaatgagagggaaaaaaaatcagagggtgagagaaagcaggttcgtgaaattcagagctcggtttgttgtggtgaggagagtcttggtttctattgttagatccacaaatgtgttaaaagtggtgaacagtaatcagggcggggaaggaaaaacccatcctcgccccattgccatgcctacaaaccccataatttcactgaatcttattgaagatgtttctcacaaggtgaacctaccccctcttttgctgcaaacttgcatttcatggactgagtatgaccgaggagtcaacaccttttctcctgaaggccgtttatttcaggttgaatatgcaatcgaagccatcaagctgggatcaactgcaattgggttgaagacgaaagagggtgttgtccttgcagttgaaaagcgcatcacttcgccgcttctggagccaagtagtgttgagaaaattatggaaattgatgagcatataggttgtgcaatgagtggattgattgctgatgctcgaacacttgttgagcatgcacgggttgaaactcagaatcataggttctcatatggtgaaccaatgactgttgagtccacaacccaagctctttgtgatctagccttgcgttttggtgaaggtgatgaagaatccatgttatgctacatctatttaggaaaaaggtctcgaccatttggagtatctcttctcattgctggtcatgatgagaatggacctagcttt

SEQ ID NO: 52523 - DNA, 141 bp, Glycine max
  Peptide Sequence Number=SeqID_169301
atggtgggtgatcacagcggaagtgaaagcgaggtctcgggaacaaagtctgactgtgataccatatttttgttcataaacattaaacagaatcggtactcagtagaggtactccacatcactaaggatatatgtctttga

SEQ ID NO: 52524 - DNA, 1626 bp, Glycine max
  Peptide Sequence Number=SeqID_169302
atgttgcctcctattgctttcgatatcaacggtataaaagataagctctccaatcagttccgcccttggcaacgctccttccaattctgggttcgagccattgacatttacaccggatacaaggtgtttcaagtgagagtgaatttcgtcaaagatgcgcagaagcaggaagcaatgtgggagaggcagcacgagcttgccgccgataagattttctccatgtgctatgaccttggaggtttcttcctcaagattgctcagattattgggaagcccgatttggccccggctgcgtgggtgaaacggcttgttacgctatgtgatagggctcctccaaccccttttgatgtggtgaagctagtgctggagaatgagctgggacagggtattaatgatgttttcgacaggttcgatgtcgaaccccttggttctgcttcaattgctcagctaaaaggagagacatacctgaaaaataagggatacatggtttacctattgctctttgtaaaactcaggtggatcagccatagggctggcatggtggttcatagagcaagactgaaaggtgatacaggtgatgttgttgtcaaggttcaacatcctggaattcaggatctgatgatgacggatatccataacttgcaagcgtttgcattgtacatgcaaaaaacagatatcaaatttgatctatattcagtgactaaggaaatggaaaaacagattggatatgaatttgacttcacaagggaggctaatgcgatgcaaaggattagaaagttcttgtatgaaaataacaaaaagtctcctgttttggtgccgcgagtaatacatgatatggttactagaagggtcctagttatggaatatattgatgggattcctataatgaacctcggtgatgaaatagcaaagaggggcataaatcctcatggcaaagttgcaacagcagctaaacagaaaattcttcaaagcttgactctagcatatggtcaaatgattttgaaaagtggattcttccatgcagatcctcatccaggaaatatcctgatttgtaaaggatcagaggcaagtcatcagctatatttgttttctaatatctccttaactgttatttcatctctagactatggacaggtgaaggatctcccagatcagttgaggcttgcctatgctaatctagttcttgcgattgctaatggtgacccattaagagctgcagagagctatagatttgatggctttctgaattgccctcattataccaagacaaaagaaactggatttggctcttctaaagtgaggaaggagcttggtatagaaacctttaccaaatgtgaaaacgagctacaagaattgtttaaactagcacaaacaatgtttgatacaaaattgcctccaggagtggtaatgctgcaacctttctcagaggaatcttcaattaaaaaaattgctgttcagtcttttccagaagaactgttttctgtacttcggacagtgcatctactgaggggacttagtgttggacttggaatcaattactcttgtgcagaacagtggagacccttcgctgaagaagctttgtcccgagctggcagattaaaaggtggcactgtgactcttgcttaa

SEQ ID NO: 52525 - DNA, 792 bp, Glycine max
  Peptide Sequence Number=SeqID_169303
atggaagctgtgtgtggaagtggaagcagtgtttgggtcacatcctcccttacacgctcacccaagatcacactccctctattccgcgccagttaccagcacctaacagcatttccttcacaatcccttcttttctcctatcacccttctcgctatgctaatgctagaaccctccgcgccagaacctcctccaaacccattttccttccccacttaattgcttctctggaacaagttgaccagacttacattatggtgaagcccgacggcgtccaacgtggcctcgtgggagaaattatttctaggtttgagaagaaggggtttaagttaactggcttgaagctcttccagtgctcaaaggaattggccgagtggtttttcttattgttgggattatggggttcaggtaggaaaggaggaaaaaagagagatagaaggctcccggcttactgtgactgtttatggttccaggagcattacaaggacctaaaacaaaagtcatttttccctaagctgattgactatattacttcaggtcctgttgtgtgtatggcttgggagggtgttggagtagtggcatcggcacgcaagcttataggggctacagatcctcttcaagctgaaccaggcacaataagaggagaccttgctgttcaaacaggaaggaatgttgttcatggcagtgacagccctgagaatggcaagcgtgaaatagctatagtttctgccatgcattgctttggtgacaagtttgaatttccaagaaaaatttatggaattgacccatcttag

SEQ ID NO: 52526 - DNA, 1173 bp, Glycine max
  Peptide Sequence Number=SeqID_169304
atgactcgaccggttagaaaaaaaagtgtatttggaggaaggaaggtaaaggaagcaaacgcaagagcaagagcaagagcgaaagcggcagagaagatggaaggagaagagggttctcagcagccacagttggtgctcgcggacaagctattccttctccggcaacccgatgtgcaagacattgacaaggttcgctacaaagaggatgtcttcactcatgtcaaggaaaacgatatggtccctctgtacgaaaccctagtcgctgattccgtgttggacttggatcgtgcccttttggactctatgcgcgctaaaattgacgacgagctcaccaagctcgacgaaaagattgctgatgccgaggaaaacttaggagagagtgaagttcgtgaggctcatttggcaaaatccttgtttttcatccggattatggacaaggagaaagccttggaacatctgaaggtaacagaaaccaagacagttgcagttggccagaaaatggacttggtgttttatacattgcagcttggtttctttgacatggattttgatctcatttccaaaagcatagacaaagccaaaaacttgtttgaggaaggtggtgattgggaaaggaagaataggctgaaagtgtatgaaggcctgtactgcatgtccactcgaaatttcaagaaggctgccaacattatatcattggatagagtttccctaaagcaaaaggtagtagatgctccagagatcttgacagtgattggcaaaatcccatatctttcagagtttttgaactccttatatgattgccaatacaagtcttttttctcagcatttgctggcctgacggagcaaattaagttggaccgctatctgcatccacacttccgttattacatgagggaggtcagaacagttgtttattcccaatttttggaatcttacaagagtgtgacaattgaagccatggcaaaagcctttggagtgacagtagatttcattgatgtggagctatcacgttttattgcagcagggaagcttcattgtaagattgataaagttgcaggtgttcttgaaactaatcgccctgatgctaagaatgctctttaccaagcaactattaagcaaggggacttcctgctgaatcggatccagaaattgtcacgtgtgatagatctttag

SEQ ID NO: 52527 - DNA, 189 bp, Glycine max
  Peptide Sequence Number=SeqID_169305
atggagaaggtgtcgtctttgagaatcttggacggagaaccgtctaaggtgtcgagggacgaagtggatgctctgattctgccgaacatttccgatgcagcaactcgcttcgggtcggggcaagctgagattggattggtgttgactgctgagggactcaaaatcactgactgcaccatgaaaaagtag

SEQ ID NO: 52528 - DNA, 519 bp, Glycine max
  Peptide Sequence Number=SeqID_169306
atgaagctaaagcttggtgcgcgacgcgatacaagtgaggttacaaatgattcttcagttaattcaccttgtgcggaagaagcaaatctcaagccagatttaaatcctgcaacaagcacttcttgttccgagacaacgatgatggacacagagtctgataactcttcacctagggttagtgaccacgtttctagtgggaactcggaacagcgaaagcaaagcaacgtttccattctatatttcttcaaagttcaggataccggacacgccggtgtgtcctcttccgaagaggcaacggcatcaacggggaatggaagttctgaatctatctcatcaacttctgttgaatctgattacagaggtgaagtggaagttattgaacctagaaacggcaagaatcattctaattgggcatctgtggtttattattctctcagccatggtgattggactggggtccaatcgcatacttcgccttccttgaaccatagagctgccatacatggaaataacagttaa

SEQ ID NO: 52529 - DNA, 441 bp, Glycine max
  Peptide Sequence Number=SeqID_169307
atggttgagcaggactcgagtcataatggacccttttttctagggaggtttatggaatcattgcactattactcttcaatttttgactcgttggatgttatgctgccaaagtatgacactaagagggcaaagatggagcagttttactttgccgaggaaataaagaacattgtgagctgtgaggggccgttgagaatggagaggcacgagagggtggaccagtggagaaggagaatgagcagagctgggtttcaagctgcacctataaagatgagaaggggtgtttggtttttggatggaagtcgaggcctattgttgcagtttcttgctggaaatgctgagctgaatcatcatcaatctccactgtcccagcagtttaaaagttggtgtctgggatcaatgtcaataaataacagtttcatgcgagctgttgtgtgctag

SEQ ID NO: 52530 - DNA, 2019 bp, Glycine max
  Peptide Sequence Number=SeqID_169308
atgacgaaattacccttcatagtgagtgatgtaacctttgggaaggaccaggaccaggaccagccagccactgcatgcaacaacagaagggaagagaagaaggacctcactcaacccaacccaagttggccaaacacagcacatagagtttcagaatacttttttgccttttccatgtcagtgaccctaaatgaggactcaaattgcatgtgggttttccagaattctgatacagttttggggttcaaggagaaaaagaacactctctcaggtgaagcagaagaagatatggcggcatcatcttcctcagcgtcgctctttggatttagagaagaggatcagaatcagatgaagcaacaacattccctgacaccatcttcatcaacaacaccagctgcacccccaccccagaagaaaaagagaaaccaacctggaacaccatgcaatttttgtttggcatttttccatggtttatatgtgaggtgtgcaacaaagggttccaaagagagcaaaacctacagctacacagaagaggacacaacctgccttggaagcttaagcagaagactacaaaagagccaaagagaaaggtttatctgtgtcctgagcccacatgcgttcaccatgacccttcaagggctcttggagacctcacagggattaagaaacactactctcgcaaacacggtgagaagaagtggaagtgtgacaagtgctccaagaagtatgctgttcaatctgattggaaagcccattctaagacttgtggcaccagagaatatagatgtgactgtggcaccctcttctccagctttgttttcttctgggttggctagatgcatgtgttcagtactgtgctcttgcaggcgtgacagtttcatcacccacagggccttctgcgatgcactggctcaagagagtgcaagacagccacctagccttagcggcggaggaattggcagtcatctgtacggaagcaccaccaacatggccttaaacctatctcaggtcggttctcaaatctcaaccatgcaagaccctaacgcccagcccaccgagctcctccgcctgggcgccgcctccggtcgaaccggccagttcgaccacatcctcggttcacccttccgaccgtcgaaccaacaacaacaacaacaacctttcttcatgtcctccgaacccaaccaaacctaccaccaccccgaccaaaacaaacccttccaacaagggttaatgcagttgtctgatcaccttaacaacaacagccaccacaataattcacccttcagccttccctttctctccaacaacacaagcaacgcttcgttctctgaacacttcaacaatgccaatggaggaggaggcaacaacaacaacaacaacaacaacgagggcactaactacttcgcaacttcaagtgcaccttctctcttcagcaacagtgtcaatgccagtgccttatctcacatgtccgcaactgcactgcttcagaaagcagcacaaatgggtgcaactacgagcaacggcggcaccgcttcgctgttgaaaagcttcggaagcgcgtcctccagcagcggcggcggcggctcgaaactggtgaatgctgcaaactacgtcagtggcatgttcggagggaataatcacgtgaacgaacagagtaacagtaacctccaagacctgatgaactcgttcgctgttggtggaaactcttccattttcgaagatgggtttgaagcatatgaacatagtaacaataacagtaatagggacccaaaagtgcacgcaatgagtggaagtagcagcagcattggagggtctgataggctcacccgcgattttctgggtgttggtcagatagtgaggggaatgagtgggagtggaggagttgcgcagagagaacaacagcagcaacatggcttcaacttgagttctttggaggcagaaagatataataataatagcaataatgctgcgccgtcatcagggcaagcttttggaggtggtggagggaattttcagtga

SEQ ID NO: 52531 - DNA, 204 bp, Glycine max
  Peptide Sequence Number=SeqID_169309
gggatgaggtgcttcgataaggggaggcggagggcagagagagcgacggagaagtcctcatcaccgggggggagaggatttagtggatgccgttctggaggggtggaaggagagagaatggaggaaagaaaaacaggaaatataactacagcctcaatctccttgttatttgttggcgccattacccaaaaggtttctgcgtaa

SEQ ID NO: 52532 - DNA, 150 bp, Glycine max
  Peptide Sequence Number=SeqID_169310
atggtatttcattacttagtagtgaccaaatatacagacaaaggagcaactagtcataatccagaagcatcgaaagacacacttggaagcacaagaaaagaaaagggtggcatgtgcgagcttgaaggcaaggggattcaaaccacttga

SEQ ID NO: 52533 - DNA, 173 bp, Glycine max
  Peptide Sequence Number=SeqID_169311
atggtgttgggatctggaggggaggagaagggttgggcaaaggccactttgatctccctaaccagatgattaatttgagtgagggtgtgccatgggtgccacaccttgtcttggaaaagctccatgttcctagacttccaaatgatccaagtagccgcgacgaagttagataa

SEQ ID NO: 52534 - DNA, 660 bp, Glycine max
  Peptide Sequence Number=SeqID_169312
atgggggatttggagaagaagcaagagagggcaatggaggaagaagtcaaagagaggttggtggagggtgtggcggttttggactttgacatgctttgttccacagtggctttgcgagctgcacatggaaaatggggaaagctgggagctgaagaggaagaagaagaagaagaagaagaagaaaaggaggagggtggtgagtttggtggtgttctgaggatgtgggagggtgaagttcttgattgttttgatgatcatcgcatagctattgaatccacgtgttgtccttgctaccgatttgggaaaaacatgaagagagctggttttggttcttgctatattcaggcagcaatttattttcttcttgctgttggtgcctttcttaacttcattgcctttgctgtcacgagacgtcactgttatctgtacctgactgttgccttcgttgtttctgttggagcatatttaggattcttccggacacgtttaagaaagaaattcaacatcatggtgactattttctgtaacattttccttgtttatgaatacaatgttgttagggtagtgatagttccatggacgattgcgtttaccatttcgcctgtccttgtagtacattatgtcaggtcatttttgaaatctccttcccttctcaattaa

SEQ ID NO: 52535 - DNA, 1140 bp, Glycine max
  Peptide Sequence Number=SeqID_169313
atggcgataggaacaatggttcgggaagagaaggctgttatatatgtcaccagtcagtatttgactgagtctcctctgatgcctgtaatagaaggttacgatgaagtccattttgaagtggagctggttcactttattcagcatttcaccagcacgatcagtgaatccgtccacgtgtcatgtcgccagtcagcttggcgaaatagggagtgcatgtcgccagtcagcttggcgaaacagggagtgcatttcaccagcgagcttggcgaaacggggacagctttgaccgaaacacatgttggtacatgcaggctacattcagaagcatgctgtagggatgtagccttttcagaaggttttcagagcgccacgttgaaggctacatccctacaacacgcttctgaacgtagcctgcatgtaccagcatgtgttttgctaacaccaccaacgaaacatgcacatgatggtcacgtgaaagctgctgcatttttcgatatccccaatgtcgtgaaagctgtgcatgtttcacgtgattttccaatggattgtccccttcatgacagtctgcttcgcgttcattacaagggtactgttctcaatgaagaaaagagggtattctatgatacaagggtagacaatgatagtcagccattggagttctgttctggagaagggcttgtaccagagggatttgaaatgagtgttcgtttgatgcttcctggagagatagctcttgtcacatgccctcctgactatgcttatgataagtttccgaggttgctgacgaaaatccattgtcattctgttctattcctatgctttattgccatacttcctccttttatgactaggccattaaatgtccctgagggtgctcatattcagtgggaaattgagcttctaggttttgaaacgccaaaggactggactggattggactttaaaagtataatgaatgaagctgaaaacatcagaaatacgggtaacaggctgttcaaagaaggaaaatatgaacttgccaaggcaaagtatgaaaaggctgggagagttgatgcccagaatttgaatccttgctactcccttcccaagttcctcaggtcaagacctatagttgtaattgagaaaaatgatatcagctaa

SEQ ID NO: 52536 - DNA, 1158 bp, Glycine max
  Peptide Sequence Number=SeqID_169314
atggatgacatttttgactttcagaatatcatgttggaccaaaataatggcgttcaccatttggaatatgacgtctaccatggccgtaacgttgtggcgattcatggtggccatggtggatgcaacaggataatgtcagggacatggatatgcactgcttcctcaaaccctactaagttagaagccggggctgttggtcaacctcctattggtgctaaggggaagcccaagaagaaggatactagaaaggggcccatggatctctatactcaacttcaatctacagcttcaaagaattgggataagttgctacaagtaaacataagggagctttgtgataaaaaagctacagaaagggtataccaatctatagcacaattttggtaccaagctaggttatccttcaacatgatcaagttgcaaagctttcaagacatgctttgtgaagttaggcattttggaaagcatttgcgacctccaagctatcatgacattaaagtaatacttcaaaaagaggtggggacaatgttgatgaagtccattgatgcttctaattttgtgaagatcgttgacaagctatttgagttgcttgattctattgagattggagaagaaaaagttgcccaagttgtaacaaacaatgggagtaactatgtttatgtttacattctcaaagtgatggctcctctaatgaaagtgtttcaacttgttgatgatgcaaacaaatatagggacgcgtttcaaatcattgataaaagatggaatgttcaactttattctccattacatgcaatcaatcactttttgaatccagagttcttctatgacaactctcaaatagaatttgatggtgaggttgtaaggggattgtatgaggtcatcaataagttggagggagatttagagatggagaaaatcatcatgagggagttgctatcttatacaatgggggctgttggataccatgttgacaaacctgatcaaccttacatgtttcttgtggatgaagttgtaatgccaccgtccgcaaaacctccagctattgtgttaatgacttgtcgagcaggtgtgagtgcctttcgcagtgctcacatgattcttgagctaagtgcttcttcaagaactctttcacgattggtgtttaaggctatgtactag

SEQ ID NO: 52537 - DNA, 399 bp, Glycine max
  Peptide Sequence Number=SeqID_169315
atggggacaactagtagcaaattgagtgctaaatcgagatgccaaggtgtcgaacaaatcaatggaataaaaaggaagctttggaaccaactcaatgtagggccctttaatgaggttcgtggtgtcatcatatttgtcatcgacagacccttccaagaagggaggggagcatccatgatgcctttgacaaaagggtacaagccgctaagttttcttatgtctgattggatgacctccatgttgggtcttgtcattggttttggagaagtgcttgctaccaccgaaggtttccttccatgttcgttttgctccttgttgctaccatttcctatgggtggtaggaaatttcaactcagccccacgatgggtgccaaaacgtaccagtctaggggtactgag

SEQ ID NO: 52538 - DNA, 1275 bp, Glycine max
  Peptide Sequence Number=SeqID_169316
atgacgtcacactcccactacccacccgacctagacgccgactccgtctcctcctccccacgctccgaccacttccacgacgcgccgccccgtgtccgcttcatgtgcagcttcggcggcaagatcctcccccgcccccacgacaaccagctccgctacgtcggcggcgacacccgcatcgtcgccgtctcccgctctatcactttctccgcccttattcttaaactctccaaactctcaggcatgagcaacataactgccaagtaccagctcccgaacgaggagctggacgcgttgatctcggtcaccacggacgaggacgtggagaacatgatggacgagtacgaccgcgtcacacacaatcagaacccgcgatcggcgcggctccggctcttcctcttccccgaaggagaagactcccgcgccaacagcatcagctcgctcctaaacggctcagccaaccgcgaaaactggttcctagacgctttaaacggcggcgtttcgggcctcgaacgtggccgctccgaagcctcctccatggtctccgaagtacccgattacctcttcgggttagacaactcggaagaaattacaaatcaccaacaccaacgcgacccgcgacccaaacccgttctccaagacagcgtttccgttacggatccgggttcacccgccccggttgtctcgtccccttattgttccacgtcatcagcgccgcacgtgccttctctcccgaaccttccccatgttaaaaccaaacctttaaacttaaacccggttcctgatacacacttcaaggaaaatcaacccgaacctgaaaccgagcctcaaccgaacctctatctaaatccaaataaccctgtcattcactatcctccagaagctgcttattcggtaaatccggttccggttttctatgtttccggtccggttcgaccgggaactgttccggttcctatgcaaaccccttacccctacgttcaacaaccatatcatgctgtgatgccacctcaggttccaatcgggtaccatcatttggttccgggttcgggtcaattatatggggcgggcgtgaggcacgtgaccccactgcaaccttacagcccctccgccgcggtggttcatgatggtttgaagcagcatgggtatcatcccgtgccgaataccggttcggttccggttcacccggttacaccgatgacgggttcggttgaaccgcagagaggtggagcggagtttgtggcgggtcggggccccagctcgttaaataactga

SEQ ID NO: 52539 - DNA, 141 bp, Glycine max
  Peptide Sequence Number=SeqID_169317
atggagatcagatcacaagtgaaagccagaaggacgatgaagtacatggggactctgatggaacaaattcagaggactcacatgaagctccacctgaggcacaacgaacgggagtcattgaccgataattacagggattga

SEQ ID NO: 52540 - DNA, 2841 bp, Glycine max
  Peptide Sequence Number=SeqID_169318
atgtcgaaaactccgaaggagaaagacgcggaggagcctctgccggaccacctccggtgcgggcgcaccgatgggcggcaatggcggtgccggcggcgagtgaaggagaatctcaagctctgcgagattcactacctccaaggtcgccaccgccagtacaaggagaaggttcccgagtcgctgaagcttcagcgcaagcgcaaatcaaacaacgacgaagaagaggaacccgagcctgacaacaacaacaacaacaatgttctcgacgacaatgtcgaatctagggcacggagaacctcgagaatcgtgaagaagaagcgcatgctttccggggattccgatgatggttctccggcgaggaagaaggcgctgaagcagggcgatatgcagctggagctcttgaggatggtgctgaagagagaggctgagaagaagaagagcaagaacaagagaaataataacaacaagaagaagaacaataagaagaaggagaataagaagaagaaggaggaaaaagaggaattgtgttacactaaagaagagttgagaagagaattgcccaacggtgtgatggaaatctctccggcttcgccgacgcgtgattacaacaatgtgggttcgcattgtgatgtgaaagttggtgttgatagtaaaactgttgctccgcgttactttaggtccaagaatgttgatagagtccctgcggggaagttgcagattgtcccgtatggatcaaagggtaagaggaagaaatgtcattggtgccagagaagtgagtctgggaatctcattcagtgtttgagctgtcagagggagttcttctgcatggattgcgtaaaagagcggcatgtccagtttgttgtggaacttgcacttgtaaggattgctcagcaagtcaatgtaaagacagtgaaagaatatttgactggtaagagcaaagttgatagaatattgcattttcattatttgatctgcatgctccttccagtactaaagcaaataagtaaagatcagaacattgagctagaagcagaagcaaaagttaaagggaaaaatatttctgatattcaaatcaagcaggttggatttggctacaatgagaaaaactattgtcaaggaaaagcttctggagaaattaactcatctgtgttcaagcgacctggtaaaatgaaaccttgtggtgctaatgagagccataacttggatgagaaagccacatctagtggcaatttaactgatacttcaatgttgcccgagtggaaaaatggtaatggcattgatactctatcatgccctcctacagagcttggtggttgtggtaaaagccaccttgagttgagatctgttttcccctcgagttggatcaaagagatggaagtaaaggcagaagaaattgtttgcagctatgactttcctgaaacttcagataaaagttcgagctgctcgttgtgttttgacactgatcacagtactaacagatacaagcagttgcaagaagcagctctaagagaagattccaatgataattacttgttttgtcccacagtgatggacatcagtggtgataactttgagcactttcagaaacactgtggaaaaggccatcctatagttgtccaagatgcactccgaagtacatcaaacctcagttgggatccactgaccatgttctgtacttatcttgagcagagcattacaagatatgagaaaaataaagacttgcttgaatcttgtttggattggtgggaggtggaaattaacattaggcagtactttactgggtctgtcaaacgtcgtcctcagagaaacacttgggatgagatgctgaaactaaaagggtggctttcttcccaaatattcaaagagcagtttccagctcattttgctgaggtaattgatgctctaccagttaaagaatacatgcatcccctgtccggtcttctgaatttagctgcaaatttgccacatgggagtgcaaaacatgacattgggccatatgtctacatttcttatggctctgctgacaaagaaactgattcagtgacaaagctctgctatgactcatatgatgtggaacagaaattgaatggaataccattattgcatggtccagaaacagagcgaaaaggctcacggagtatggttgaaggaatgaactttttccggagagtcaatagaacatcttgcatctcaactgaagctaaaaaagtttctagtcagagcatggacagcaatggggaatgtgatttcatttctgattctgattctggatctgctttacttctccttgggactgttcaaactgctgaattgtcagaacacgataatcctagaaatccctttaaaagctcaaaaagacataaaaataagtttactgagcatttgggtgcccagtgggatgtctttcgcagacaagatgttccaaagctcatcgaataccttgaaagacactatgatgaattttcttatacccatgactatcacaagaagatggttcatccaattctagatcagagcatttttctagacagtactcacaaaatgagactaaaggaggaatttaagattgaaccatggacttttcagcaacatgttggacaagctgtcgtcattcctgctggatgtccataccagatcaggaattctaagtctagtgttcatgcggtattggaatttgtgtcccctgaaaatgttaccgagggtatccagttgttcgatgaggtccgactattgcctgaagaccataaagcaaaagcagacatgctggaggttaagaaaatggcgcttcatagcatgaatacagcaattaaagaagtacgtcaacttacaagcaaaacatga

SEQ ID NO: 52541 - DNA, 222 bp, Glycine max
  Peptide Sequence Number=SeqID_169319
atgggttacaattttggcagtggtagtttctggcggcgcgcggtgaaggaggttacaatgcaagggtgtttgcggcttgttgttgcggcggaaggaggatgcgatggcagtgatggtgatgatgaggaggatgaaaatcatgcttgcactaaccgtttctgtgaatcacaatgctttggaagggattcgagggaatcacagtaccaaggggaagaggagtaa

SEQ ID NO: 52542 - DNA, 1884 bp, Glycine max
  Peptide Sequence Number=SeqID_169320
atgatatttgtttgcagatatttgatgcttggaaacgtagggaaagttgcccaatctattctcagaacccatggaagaagatatttggaagcgagtagaaatgaggcctttaactcagttggaccaaatattaagcactgcaagatgtacatgcaatataagtttccaagtgaaggacgtagttcattcttgtggcactggacaagagaaaactttcacaaaggctgttcttttagaaacttctctgtaatttcggctagtaatgtagcagcatataattgtcgaatagcttggaagtttctgtacaaaaaatactcttccaatggttataatggatttacctccataaatatgattgctcaagcagtgagcctggctttgactcgttcttatttgctggttcctggttttttggcatttgctagtggaaagctagcattggctcagccaaatggggcagacacagaattttacccatctcagaatgctttgtatatgcatgcacaagatgggtatggttacatgtttgcatttgtattcattgtagtggaaagccttgtcttgttagcgagagctatctatctggccatattattctctccaagcatactgatggcgccacttgcagattattttggaccagagttcaggaaaatgtggctatcagttgttcattgcacactagaaaaagcaggtccagcattcataaaatggggtcagtgggctgctacccggcctgatctgtttcctcaagatctatgtactaagcttgccgaacttcagacgaaagctcctcaacatagttttagctacacaaagaaaactatagaaagagcatttgggcgaaaaatttctgaaatttttgagaattttgaagaagtgcctgttgcatctggaagtattgcacaagtgcatcgtgcttctttaaaatatcgttaccctggtcagcaagcaaagcccctggtggttgcagtgaaggttagacatcctggtgtgggagaatctatcagaagggattttgctattataaatttggtggcaaaatcttcaaagttcatacatgcacttaattggttaaggttggatgaaagtgttcaacagtttgcagttttcatgatgtctcaagttgaccttgcaagggaagctgctcatttgagccgcttcatttacaatttccgtcgatcgagggatgtctcttttcctaagcctgtctatccacttgtgcatcctgcagttttggtggaaacctatgaaaatggagaaagtgtatcacattatgtagatgaacttcaaggacatgaaaggattaaaagtgctcttgctcacattggtactaatgcacttttgaagatgcttctggtggacaacttcattcatgcagacatgcatcctggaaatattcttgtacggaacaagcctcacaaacggcttttcaaatcaaagccacatgtaattttccttgatgtaggcatgactgctgaactctctggcagtgatcgggtaaatttattggaatttttcaaagctgttgcccatcgagatggtcggacagctgcagagtgcacactcaagttatcaaagcaacagaactgtccaaatccgaaggcctttgttgaggagatggaagaggcgtttactttttggggcactccagaaggtgacctggtccatcctgccgagtgcatggagcaattgcttgagaaagttaggcgtcataaagttaacgttgatggcaatgtttgtactgtcttggtgaccaccttggttcttgagcgcaagcttgatcctgggtatgatgtgatgaatactctgcagacattactgcttagagctgattgggctaagtctctttcctacacaattgatgggctcatggccccttga

SEQ ID NO: 52543 - DNA, 1125 bp, Glycine max
  Peptide Sequence Number=SeqID_169321
atggaacaaaaacatcatgagaaagggagtacactacttgggaacgatttgataggcctattgggtgatgagggagtgctgcaagggcagagaaggcaaatacacaccaagggggggacgtctagccaagaagtggtgcaagagttgtgtgttcatgaaggcaatgacagtgtgactacacctagaccatcaccctcttgttgggggctgggaggaggtgtgaagtggagtttcatcaagaatattattctcaaggacaacattcagtttgggggctgttgtatctgtggagtgaagactttttcactttgcataatttgcttcaaggagatggatttgaaaaggaggctctggaaggatttgaaaagcaaggagtctagcacatgtgatatgtggtgcatcatgggagattttaattgtgttagaagaccttgtgagagaacatggatattgattgtggtcctaaacctaataaggactcttgattgttggatggatgacaaaaactttgagaagttcatggcagaatcttgggagcaacaaagggtacaaggaagaggggctttcattctcaagcaaaagttgaaggttatgaaagcttgcttaagggggtggaatcataaccactttggggacattcaccaaaacattgctataattgaaagagacatgaatgatcttgaaaaaaaaaaggagaggggattgcaagaagagttttggagaaatgttttgtatagggaatcacttctcaagcaaaagtcaagagcaaagtggcttagagaaggttatctaaattcaaaatacttccatatcatggctaattggaggaggaaaaatatgattagagggatgatggggagattgggcttccatgaaaaatggatcaaatggagtcaaggaggcttgaggcaaagtgacccacctgcccctttcctctttctcattgtggcagaagggttgagtggacttatgagggaggctacatccaaaaggtttttctctgttctaatcgtgggaaacaaaaaggtggaagtcaacttattgcaatatgccaatgacaatttttgtgggagaaatgaatctccaaaatgtggttatggtgaagagtatcttgagatgttttga

SEQ ID NO: 52544 - DNA, 102 bp, Glycine max
  Peptide Sequence Number=SeqID_169322
atgggtggtaggaaatttcaactcagccctacgatgggtgccaaaacataccagtctaggggtactgaggtacttgcgaaggcactccgatgctcaaattag

SEQ ID NO: 52545 - DNA, 264 bp, Glycine max
  Peptide Sequence Number=SeqID_169323
atgagacttagcaaggaagaagcccaaggtatggccagccacaacaactatgaagattcccaaattgaaggacataacaacgagcttgtctctgtaaaagaaaaaaatgcgaaagacacagtagcttgcatgaaccaaccctccttttataggattagtcccacacttgatgttgggctagttggagacaacctcaacaatcattgcaaggaaaaacacaaccaagacactacaagaaacaaggttttataccaacaactttga

SEQ ID NO: 52546 - DNA, 153 bp, Glycine max
  Peptide Sequence Number=SeqID_169324
atggatacctcagagccctacactggggcaatgaaaggcaccatgcataaatctcaagcgaacctaggggttcccagctacaaggtcatggcgaaagataacaattggtacctcaaagcctcacactggggcaatgaggggcatcgtgcatga

SEQ ID NO: 52547 - DNA, 210 bp, Glycine max
  Peptide Sequence Number=SeqID_169325
atgtgggttttccggcagtgtagggggttctgtgggttccagcgaggacaatgtgggtttttcggtagtgtaggggtgtcgagagagtggttttcggcagatttcaggcgggaggagaaagagaagagcgattttagacaggaggatgacaaagagaagagggagggaaaggttttcgagcgcgcgcagcttgtgaaatctcaattttga

SEQ ID NO: 52548 - DNA, 778 bp, Glycine max
  Peptide Sequence Number=SeqID_169326
atggccacattagtagcacagcaaaaagcggctgcttttttccttgcaatctctggaaagaatattgataccgcggcgttagattactactcgcagaaaattgaaacttctgcactttctctggagcaagttgcgcaaaaattcattaccggcacctcaagcctgaacggtctgacggcttctcaaatcgtaaccaaggtctacaccgcagtgaacggcagtgcccccagcagcagcgtgcttgccgatcttttagcgggcaaccccaccacggcatccgttgttgccaaggtgattaacgacgtacttagctacagcggttttgattcaacgctgctgacagcacagagcaatttcgaagctcaagtcgaaaaaaccctgttccctgtcgcgacagccgcatcgtcggccggcgcagctgacgtacagggtgttttccatgtcgtgggcttaacgcaaactcaggacggcattacctactggggaaccgtattggcgcagggcagcaaaacgctggcggcggtcgcacaaaccttcgtgaacaacagcccgctgaaaacgttaagcgatagcgatttcatcaacgccatcttccaaaacagctatgaacgcgcaccaacttcggccgaaagcagcagctatctcgccttgctgagtggcggctcgactcgtggcgacgtcgtagctcaagtgatcgcagcactgaagggcaccgttgccgccggcgataccacggcccaacagcacttccaggcggcgacgcacgtgtggcaaccgg

SEQ ID NO: 52549 - DNA, 249 bp, Glycine max
  Peptide Sequence Number=SeqID_169327
atggagctaacacgtggccttggagacgccagcagcaccagcgccttgcctttgtgcttatgtggtgctggaggcgcaagcaacaatggcgtgttgaggaaggcgccagtcaaactggcgtgttgggtgcagcagagacgcgcaaagtgcagtgctgcagcagtgctgcaggaagcgccattggaagctgcgggttgcagacaggtgggaggcgccatcacgaggagcgctttgctcctttatatgtag

SEQ ID NO: 52550 - DNA, 551 bp, Glycine max
  Peptide Sequence Number=SeqID_169328
atgggtagatcaccttgttgtaacaaaaatggcctcaagaaaggaccatggacaccagaagaagaccaaaaacttattgattacattcagaaacatgggtacggcaattggagagtactcccaaagaatgctggtttgcaaaggtgtggaaagagttgccgtctccgttggacaaactatctccgaccagatataaagcgaggtcaattcacttttgaagaggaagagactataatacagctacatagcattcttggcaacaagtggtcagctattgcttctcgcttacccggaagaacagacaatgaaatcaagaattactggaacacccacattagaaaaaggcttctaaggatgggaattgaccctgtgacacataggccaaggcttgatcttttggacctatcttccatcttaagttcaaccctctacggttcaacacaaatgaacatccaaagacttcttggcactaacacagtggtgaaccctgagcttctaaagttggcctcgtcacccttcccctctctgcagcaacgccaacaccaaaacat

SEQ ID NO: 52551 - DNA, 672 bp, Glycine max
  Peptide Sequence Number=SeqID_169329
atggagatacatgacaaacagcatagaaaattctctttgcttctattgccttttcctgtgtctactggagaaatacttatacggacagtatcacagagatacatgcttgttttgtacgtgtacatgcatgtttctgagttcatatatgagccgggcaaacaggttaggagtgccatcaggattaaaaacaccagtaaatctagcgtagctttcaagtttcaaacaactgcacccaaaagctgtttcatgcgtcctcctggggctatccttgcacctggcgagagtatcatagcaacagtgttcaagtttgtagagcaaccagaaaataatgaaaagcctgaaaaaagtggactcaaatttaaaatcatgagcttgaaggtgaaaggatcaattgattacgtccctgaactgtttgatgagcagaaggaccaagtagcagtggagcagattttgcgagttgtttttctagatccagagcgtccttgtcctgctttggaaaaactgaaccgacagctggctgatgctgatgctgcccttgaggcacgtaagaaacctgcggaagatgcaggtcctaaaattatcggggaagggctcgtcatagacgaatggaaagagaggagggaaagatacctcgcaaagcagcagggtgaagtggttgtagattctgtatag

SEQ ID NO: 52552 - DNA, 138 bp, Glycine max
  Peptide Sequence Number=SeqID_169330
atgtgtttgggtatccctacctatttcctagtatcccttaaccatttaggttctctcccttggaaacgttgtgccagacataccttaaaccgcgttgttgttgtcaaagttgaagaggttgtggtggcatggcgttga

SEQ ID NO: 52553 - DNA, 306 bp, Glycine max
  Peptide Sequence Number=SeqID_169331
atggaggccatgaaagagaaaatgaccacaatgatggaagccatgatgactatgaggaaaatgatcgaggtcaatgcaactacaattgccgctcccagtgccgttgctgagatggacctgattcccccatctagccataaccaaataattcatccaacctcaaatatggtaggtcagggaggcaaagaattgggaagtatgggcggcccccattttgtgcaaattcaaaacaagcacgccttctcgccatatggcttgcctcccaactatacaccacccaatatggtgcatgctcctgatgagaat

SEQ ID NO: 52554 - DNA, 327 bp, Glycine max
  Peptide Sequence Number=SeqID_169332
cctttgtgccaccgtgtgccatgtctgcacctccgcaccaccgtgcaccaccttctcgcgtcaacctagggtcaccatgtggaatggtaagaaaggtttgaacgacgacatttttggtgtagtcaatgatgatttggcgactggcggggaggaggtggttggtggagtatcaatggcaggcagagaggagtccgagctagtcgtaggtggcaatgatggtggggcaaggggaaaaggtgtggactttcttttagcagttgttgaagtagccagtttggacgagggcgttgtcgagtgcttgggtggtgcagggaagagggagaggag

SEQ ID NO: 52555 - DNA, 1704 bp, Glycine max
  Peptide Sequence Number=SeqID_169333
atgggtgacgaagaagtattcgccggagcttcgggtctccggcgagcggtggagctaatcttttccgtgctctcactctcgcactcgattcgcgtcttcgccggaaaatggcagctgattcgggccaagctggaggagctccacggcggtctaatcgccgccgagaacttcgactccggcgacagcccgtcgctgtcgaggctggcggaagcggtggcggtcacctcgacggagtgccgcgatctttgccggcgctgcgtggacgtgtcctacagcgggaagcttctgatgcagagcgatttggacgtggcgttcgcgaagctcgacgcgcacgcgaagaagctcagtgagatatacaagactggaattttaacaaatgggttcgcgttggtggtttcaaaaccgaaccttggcgcttcaaaagaggacatgaggttctacgtgagggacttaacgacgaggatgaaggttggggatttgggtatgaagcggcaagcgctgaagaatcttctggaagttgtggtggaggatgagaagtacgtgaaggtgattgtggatgttggtgacgtggttcatttgttggtggggtttttggggtctaacgaggtggagattcaggaggagagtgctaaggttgtttctgttgttgcggggtttgattcctacaaaggggttttggtttgtgcgggtgtgattgctcctttggttaaggttttggattgtggaagtgttttagggaagattgcggctgctaggtgtttggtgaagttaactgagaattcggataatgcttggtgtgtttctgctcatggaggggttagtgtgttgttgaagatatgtggtggtggtgattgtggtggtgatttggttgggcctgcttgtggggtgttgaggaatctcgttggtgttgaggagattaagaggtttatggttgatgagggtgctgtggtaacattcattaggcttgtgaggtccaaggaggaagcgattcaggtgaattcgatagggtttattttgagtattgcttctggggatgaattggttaggcagatggtgatcaaagagggagggattcgcgctttgttgcgtgttttggatcctaagtggtcttattcttgtaaaaccagggaggtgacaatgagggctgttgaggatttgtgtttttgttcgcctagttctgttggggtgttgatgaattgtggttttgtggatcagttgatatattatgttagaaacggcgaggtttcgattcaggagttggcattgaaggtggcgtttaggctgtgtggaacatcggaggaggccaagaaagcaatgggggatgctgggtttatgccggagtttgttaagtttctcaatgcaaagtcattcgaggttcgcgaaatggcggccgaggcactctctggcatggttatagtgcctagaaatagaaagaggtttgtgcaggatgaccataacatagcccttcttctgcagttgcttgatccagaggaggggaattcaggtaacaaaaagttcttaatctctatattgatgtccttaacgagttgcactagtgggaggaaaaagattgttagttccggatatgcaaaaaacatagaaaaacttgcggatgctgaagtttcttctgatgccaagagacttgtcaagaagctatccacaaaccggttccgcagcatgttgagtggaatctggcactcgtga

SEQ ID NO: 52556 - DNA, 156 bp, Glycine max
  Peptide Sequence Number=SeqID_169334
atgtggtgtctggttggtgagaagagacagtataccgtatactgttcgacttggaactgcagtggagattacgttacagcttgccacactgccttccgtgaaagtggcgccaattgcaacggtaaaaagtttaacacattttaccctctcaattaa

SEQ ID NO: 52557 - DNA, 348 bp, Glycine max
  Peptide Sequence Number=SeqID_169335
atggtaatagccagagctcaagctcaaagcaaaaaagtaaagctgccccatgtcatgacaatccccactaaaaaagcattaaatccctacctagaagatgaactttcccagaatttatggggtgtgttggggaaatcaagagggcacatgcctcaattcaggggtcagcgacccgaatttggcatatatgttaggtgtaaaatgccattcatatgccaaagccataccacggtgactttgagtggagaagaagcgaaattcaagacagtagaaaagtttgaaaatgtcttagctttcaagagaaaagtagatatcaaaaataatgtcttcatgttcatcaactcttaa

SEQ ID NO: 52558 - DNA, 1548 bp, Glycine max
  Peptide Sequence Number=SeqID_169336
atggcgaacgaattagtagctcgtgcctcacatgccccaacatctgagttactttcccggaccatctttgctgtatttgacactatcaaagcagccaatgaggttgtgattcacaaggaaaatttaaagagattctctgttcacttgaagaatgtctcactcatattgaagtctttatcgaagcaagacatacacaattccgcgagcttggaaaatgctatgaatggtctctaccgagaggttggtgttgctaagcagctttttgttgagtgcaacaatagaagtaaggtttatcttttaatcaattccagaaagatcgttacacacttgaattgttgtaccaaggatatcggtcgtgcagtaagcctcatccctttggcctctttagacattaactctgatttaaatcaacagataagtgagttatgcaagaaaatgttggatgctgagtatcaaacagctgcagcagatgaggaaattttgaagaaaattgagacagcgatacaagagggaaatgttgatcggtcgtatgcgaatcagttgctaacctgcattgcagatgctataggggtccccttggagcatggtgcattgaagagagaatttgaagagctgaaaaatgaaatggaaaatgccaagtcaagggtagatgtggcagaagctctacatatgaagcagattattgcagtgcttggaaaggctgattttataacttcagcacaagagaaggaaactaggtattttgagaagagaaactccttgggagagagaccattgatgcctcttcagtctttttactgcccaatctctctcgctattatggcggaccctgtggagacttcttccgggaagacatttgagagaagggaaatagagaaatggtttgctgaaggaaacactctctgtcccttgaccaggttgcctctagatactaaaatcctaaggccaaataaaactcttaagcagtctattcaagagtggaaggacaggaacacaatgattaccatttctgccatcaaatccgaacttgaaacaaatgatgaagagggagtggttcaatccttagaaaagctacagaagctttgcttagaaagagaggttcaccgagaatggttaaaaatggagaattacattactgttcttattggacttcttagttctaaaaatcgtgaaataaggaagcatgttctactcatcctgtgtatgcttgcaatggataatgcagacaacaaggaagatattgctaaagtggataatgcacttggattgattgttcgctcactttcacgtcaagctgaggaacgcaagctggcattggtgttgctgttggagttatctaaatgtaaaatggtgtgcagtctcataggaagcattcaaggaagcatacttctcctggtatcaatgataaatagtgatgatgttgaagcagccaaacatgcacatgagctgctggtgaaactctctgttcttgatcagaatgttatagagatggcaaaggcaaattatcttaagcctttactgctgaaactttctacaggtattccataa

SEQ ID NO: 52559 - DNA, 186 bp, Glycine max
  Peptide Sequence Number=SeqID_169337
atggggagctatggaggtagtagcagcaggggtttgtgtagttacaagctggctggtgctgagtgtgaggaacttgagatgcaccggtctcaggcttgcgatcaggtgcatctaaaagtgcaaggggagcagcaacgtgggatgcttgttggtgttggtcaacagcagatgagggtattgtgctga

SEQ ID NO: 52560 - DNA, 213 bp, Glycine max
  Peptide Sequence Number=SeqID_169338
atgaatattgtcacagggccaaaagaagacagacatctcttgactggcctccacactgttgctgatgtttattgtggtgattgccgtgaagtgttgggttggaagtatgaaagagcttacgaagcatcccagaagtacaaggaaggaaagttcatacttgaaaagtcaaaaattgctaaggagaactggaagttcttaccttcaaccatttga

SEQ ID NO: 52561 - DNA, 1329 bp, Glycine max
  Peptide Sequence Number=SeqID_169339
atgactgaaatcataaacagtgtgaaaattgttgattacatttttaatctttcttttggatttcaaaatctcaactcatggaatttgactgaacttgacatacaagagaatggtattgaggataagagtggcaattggttgagttgtttccctgacagcttcacatcattggaagtattgaactttgccaatctgcacaacgatgtaaattttgatgcactcgagaaacttgtcagtaggtgcaaatcattaaagactttgaaggttaacaaaagtgtgacactagaacagttacaaaggcttattgttcatgttcctcagttaggtgaacttggtactggctccttttcacaagagttgacatcacagcagtgctcagatcttgaaagtgcattaaaaaattgtaaaaatcttcacaccctttcagggttatgggtagctacagcacaatatctcccagttctgtactctgcatgcacgaatctaactttcttgaattttagttatgcacctcttgacagtgatggccttactaagcttcttgttcactgtcctaagcttcagcgcctctgggttgtggacactgttgaagacaagggactggaagctgttggatcacactgtccattacttgaggagctgcgtgtttttcctgcagatccctttgatgagggcattgttcatggggttactgaatcagggtttattgcagtctctcaaggatgcccgagacttcactatgttctctacttttgccgtcaaatgaccaatgctgctgttgctactgttgtccaaaactgtcctgactttactcatttccgactctgcatcatgcaccctggtcagctagattacttgacccaagaatcaatggatgaggcctttggagctgttgttaagacttgcactaaactccagaggcttgcagtatcaggttatctgactgacctaacttttgagtatataggcaagtatgcaaaaaacttggaaactctttccgtggcttttgctggaagcagtgattggggcatgcgctgtgtgctggacggctgtccaaagctgagaaaactagaggtaagggactgtccatttggcaacggagctcttctgtcaggcttggggaagtatgagtcaatgagatcactgtggatgtcagactgcaatttgacaatgaatggtgttagattgttggcccaagaaatgcctaggttgaatgttgaagtcataaaggaagaaagctatgagactcatcaggctaaaaaagtttatgtttatcgatctgttgctgggccaagaagggatgcccctccttttgttctcactctctga

SEQ ID NO: 52562 - DNA, 657 bp, Glycine max
  Peptide Sequence Number=SeqID_169340
atgtccgacgcttattggagatacgccgccgagtcccggcaggccccctcttccatcgccggcaagcgctctcgttccgactacgatgtttctggcgttcatgacttgcccagttactttccccatgacgatgatagaggagggctccgagtaattagagatactgaatcccttgatgcatcttatgagcgttacctccgtagtgcgcaagtttcatcatatggttcgggacagtctactagaaccattggtgggcgaattcccaatcgtgctattgatgattcacatgttgccaatattgggggagtcgacaggggaacaaatgcaaaagacaaaatgccgggattaagtagtggaagggctgaccattctcttccaccagatgctaccagtacactgtttgtggaggatatttttcgtccttttgttggctacaaagaagtcagacttgtcagcaaggaatcaagacaaccagggggtgatccactggtactttgttttgtcgattttatgagtccagctcatgcagcaactgccatggaagcattgcagggttacaaatttgatgagcttgaccgcaactcggtcaacttaaggtttcaatttgctcgctatcctggtgcgaggtcaggtggcgtgcatcgtggcaaacgttga

SEQ ID NO: 52563 - DNA, 1056 bp, Glycine max
  Peptide Sequence Number=SeqID_169341
agcttccaggcattgtgccaatctttctatggcctccgcatcagaaagaggttgagacagatatcagcagctaaagttttggtccacttgttggagcttaatacccaaccagtgcaggtcaattccttgaagcttttctattgcttgacagaagacggtgatgatggcaacatctcatcacatataactgaaagattcatcaaagtcttgcttaccatcattgaggcctctgatgacgctgaagcgatggttactgctatgggtatcatctctaaactaccacaggagtctcacatgactcagtggcttctagattctggggcacttaaaactattttgacttgtcttaccgaccaacataagcatgtctcacacaaaaaacaagtcatagagaattctgttcaagctctttgtcgttttactgtctcaacaaatttggagtggcagaagagagtggcattagaaggcataatcccagtgctggtgcagttgctgcattccggaacaccctttacaaaacaaaatgcagccatttcaatcaagcagttttcagaaagttcatatcgcttgagcgagccaataaagaagcctagcattttcaaatgctgccttgtagccaaagaaactggttgtccagcacacttaggcacctgctcagttgagtcttcattctgcattttgcaagctaatgccttggagccccttgtgcgcatgcttgcagatcaagatgatggaacgcgtgaagcttccttaaatgcactgctaactttggttgatagtgaagcaccacagagtggaagtaaggtacttgcaaattcaaatgctattgcaccaatgatacaactatcgagtgttccaattccgaggttgcaggaaagaattctaatagctttagaaagaatttttcaactagatgatgtgagaaataagtacaaagttgtggccacgatgcacttggtagaaataactcaggggaaagatagtcgaatgagaagtcttgctgccaagtgccttgctcaattgggtgaacttaataaacagtcctcttatttttag

SEQ ID NO: 52564 - DNA, 621 bp, Glycine max
  Peptide Sequence Number=SeqID_169342
atggaggcaaacaccagtgcgagaagcgcggttgcgtttgcatctcctctctctctctctctccaatttccctgtcacaaacacagattcacttcgaaactgaacgctgcagcagaagatgttcaaaaaatttacatgtcaacttttatttccagattttctggcgaagatgtgtctgcacagaaccaagtgaaggcatctgttcaacgaaaaatacgacaaagtattgctgaagagtatccgggccttgaacctgttttggatgatatacttcccaagaagtcccctcttatagttgctaaatgtcagaaccatctcaatctggttcttgtgaacaacgtgcctttgtttttcagtgtccgtgatggaccatacatgcccaccttgcgacttctccatcaatatccaaatataatgaaaaagttacaagttgaccgtggtgcaattagatttgtcttggcgggtgcgaacataatgtgtcccggtcttacatctcctgggggtgttttggatgaggatgtaggggcagaatgccctgtggccatcatggctgaaggtaaacagcatgctcttgctattggctttacaaaaatgtctgcaaaagacatgaatgttgaatga

SEQ ID NO: 52565 - DNA, 423 bp, Glycine max
  Peptide Sequence Number=SeqID_169343
atgaagttgctacttagcaacattctgcccagcgaccgcagtgccgatctccccctgcggaaggattgcgcctgcaagacacccagtggacccgaagaagtccaacagggtcctagggtttccagctctgattacgggcctctgtcatttctacggagtgcccgtcgcccccagcaagggatcgtgcccgcaagacactcagtggacccgaagaaggccaacagggtcttggagttgccagccctaattacgggcctctgtcggttctacggggtgcttgtcgcccccagcaaggtcatcaggccccctactaatcgagctttcatcaagaagtattgtgcccccaggtgtctagctcaagacgttaaagaagcgctactaggaggcaacctagtaccttttgaatctatgcttgttatttga

SEQ ID NO: 52566 - DNA, 324 bp, Glycine max
  Peptide Sequence Number=SeqID_169344
atgacggttccaaagtcagaaaagatagaaggacaagctgaaactaacaagaaacaaggttcctctcggtgtggggtttcaacggagaacatcgacagtttgtggtggctaatggtggctgtgggtggtggagaaagtgcttgggatgttagaaatggctttggaagaaagaaaggagaagaaatggtgtttttcctaagctacacgaaagcaaagcctgaaaacgctcaagtgagaaatggtctcggacatggaaacgtcttgcatactccagatagcttctcaaggatcccgacggtcagatcagggacaagtgtcatgtga

SEQ ID NO: 52567 - DNA, 426 bp, Glycine max
  Peptide Sequence Number=SeqID_169345
atggagcaggactacctcttggactttgaggactacttcccttcgatgattgcacgcatgggagcggaagggttcattggagagctctgcaacgggttccgcttgctcatggacgtgaataagggcctcatcaccttcgagagcctcaagctcaactgctacctgctcggcctcgacgtcatggacgacgagctcgcctgcatgctcatggagggcgatttggacggcgatggcgctctaagccaaatggagttttgcattctcatgtttaggctcagctcttgcttgtgcactcctcacggtggtggtggtggtgatggtggtagtggtggtagtggtggggatcccatgttgatgaatgctgaccctgctgattctcatccttctcctcctctccgttttaatttctcttactcaattgcatag

SEQ ID NO: 52568 - DNA, 399 bp, Glycine max
  Peptide Sequence Number=SeqID_169346
atggagtcggtcattgcatctcatgcaattaaaatgcaaaccttcaagtgtttcatgatctatgaagcacggacacttcagtcccttgccgtatccgatatccgactcgcgtccgtgtcagtgtctgacaccgacataacacccgtaatacattctatatttgggacattacaggtgtccacgtgtccgtgtttgtatcgtgtccggtgtccgtgtttcatagttcataacagataccaagaagctagcactgtatcacagttggaatcaacgaatcgtggaacaaggcatatgcatgcgtgtaacagcagaggtctggctcagtgtggcttgttatatagtgttaggaggggtactggaagcttatgcgttttgcataatgtagctgctgcaatttag

SEQ ID NO: 52569 - DNA, 831 bp, Glycine max
  Peptide Sequence Number=SeqID_169347
atggacacagctcagtgggcacagggtattggagtggttaaacaacctactatggaaggaggttcaaagcctcctcctcctcctatgttggagagaagggcaaggcctcaaaaggatcaagctttgaactgtccaaggtgcaattcaaccaacaccaaattctgctactacaacaactatagcctctctcagccaaggtacttttgcaagacatgtagaaggtattggactgagggtggttctctcagaaacgttcctgtcggtggtggctctagaaagaacaaaagatcaaccccatcagcgccaccaccatcatcagcatcagcacaagcaaagaagcttcctgatctcacaacacctaatttccctcaatctgcttcccaggaccctaagatccaccaaggccaagaccttaacctagcatatccaccagctgaagactacaacactgtgtccatgtcaaagctcattgagttgtctgccatggagcttctcaagactgggattgctgctgcttcctcaaggggtttgaactccttcatgccaatgtataattcaactcatcatggatttcccttgcaagactttaagccaccacatcatggccttaacttcagtcttgaggggtttgataatggtacttatgggggtcttcatcagggaattcaagaggatcctactactggtggtgcacggatcttgtttcctactgtggaggatttgaagcagcaggttccaagcacaaatgagtttgatcatcagcagaatagaagtcaagagggttcagctcatgggtattggaatggcatgttaggtggaggatcatggtag

SEQ ID NO: 52570 - DNA, 237 bp, Glycine max
  Peptide Sequence Number=SeqID_169348
atggcgatcgtgaatggtgccaccatagtcacgcatgacgatggtgccattgcacatagatttggggtggtagaggaggtggtgacacgattgatgggtcgtggttgggtggcatgcgttggttgcgcatatggagtcgttgacgtgactgatgaaggtggtgggagagaagaagaaggacaaaaaggaaatattaaacaatttagaggagcaccaagcaaaaatggggtgtgttaa

SEQ ID NO: 52571 - DNA, 859 bp, Glycine max
  Peptide Sequence Number=SeqID_169349
attttatgcaccaacagcaccaaaacctttggctattgtgacggctcttgatgagtcacatgtgcaaggcactgttgtatgtgccaagagcaatggaattcagattaggatccgaagtggtggccatgactgtgaaggcctttcgtatgtttcggacgtgccctttgttgttcttgacatgtttcattttggatcagttgatgtggacattgaaaatggaacagaatgggttgaaactggtgcaacaattggtgaggtttactatcacactgcagagaggagtggtgttcatgctttcccaggtggggtgtgccccactgtgggggctggtggccacttcctggtggtggctatggaaatctcatgtgtggataatatcattgatgcaagattggttgatgtaaacggtaacatacttgacagaaagtcaatgggggaagatcagttttgggccataagaggaggtggtgggggaagttttggtgtcattcattcatggaagatcaagtttgtttttgtgactccaaaagtgactgttttcaaagtgatgagaaacttggagttggaagatggtgcaaagggtcttgtttacaagtggcaattgattgcaacaaaattgcatgaagatcttttcataagagtgatgcatgatgtggttgatggcactcaaaatgccaataagaagaccattcaggttacttttattggtttgttcttgggacaaggtgatcaaatgttgagtttggtaaatgagagttttcctgaattgggtttggagcaaagtgactgcattgaaatgccatggatcaactccaccctttattggttcaattacccaattgggacccccattgcttga

SEQ ID NO: 52572 - DNA, 1113 bp, Glycine max
  Peptide Sequence Number=SeqID_169350
atggagtgtttttcttttttcctaacatccctaatgctcatgctgtctaaatcaaaccattcatctcttgcctctgaaatcatatacaccccacaaaagaatgccactatcattcaactccaccttgaacttgcacgttcacaacaagaggttcaaaacgcaaacctcaccaaagcctctggccatcataactgctcaagtgagactcatgtgcaagccacagttaaatgtgccaaatcaaacgacattcaagtcagaatccgaagtggtggccatgactttgaaggcctttcatatgtctcagaagtgaattatgtcgtgcttgacatgttttctcttcatgaggttgatttggacatagaaagtggcatggcatgggttgaggctggtgcaacacttggtgaacttaattaccaaatagcaaacaaaagcaatgtacatgctttcccagcaggggtgtgttcttctttgggcactggtggccacttctctgggggtggatatgggaatttgatgagaaaatatggtctttctgtggatgacatcattgatgccaaattggtcaatgccaatggaggaggtggtggggccagttttggtgtcattgttgcatggaagattaaactagtcccctgtgcctccacaaggactgtgtttggagtgaaaaaatccataaaagaagatgcaacagatgttgcctacaaatggcaacttgtggcaccaaatttggacaaagatcttctcacaagggtccaacctaatgtggtcaatggaacagtgatagtctctttcataggccagtttttgggcccaattaaaaggcttgttcctttggtgagtgaggcattccctgaattgggtttgaagcaaaccttgctaccaacacctcaggagccaccttcaatatacttcaagagcaagtcagattttgtggaaacccccatcccaaaggaggctctaaagtccatttgggatttgatgattaaatataacaacatttggatgcaatggagcccttatggagggagaatggctgagatatctccacaagcaaccacttttcctcacagggcagggaacttgttcctcattcagtactctgttttggactga

SEQ ID NO: 52573 - DNA, 213 bp, Glycine max
  Peptide Sequence Number=SeqID_169351
atgtcagattatgtgaagaggcccattagagaaactgctcttaagtccattatgattaaaagtaatcgttacctaaacatttcaaggtcattctatgaatttatgactccatatgtttcacattcgccaagggaggcatttctcaattatagggaccttgatataggtgccaatcatccaagtaatgcaacaaacatgaacattgctcaatga

SEQ ID NO: 52574 - DNA, 632 bp, Glycine max
  Peptide Sequence Number=SeqID_169352
gactacacgtccccgccttcagagagctacacgtccccaccttcagagtactacacgtcctcgccttcaaagggctacatgtcctcgccttcagaggactacacgtcctcgccttcagaggactacacgtcctcaccaagagaggactacatgtcctcgcctttagaggactacatgtcctcgccttcagaatgctacacactttcgccttcaaagggcaacacgccctcaacatcagaaggctacccgccctcgccatgctttcagagtacaacacatcgtcgccatcagaggactacacgtccaaacctttagagggttacacgccctcagctttagaggactacacgtcctcgccttcaaaggactacatgtccttgccttcagaggactacatgtcctcgccttccgagggctacatgtccttgcctttagaggactacatgtcctcgccttccgagggctacacgtcctcgccttcagaggactacacgtcctcgccttcagaggactacacgtcattgccttcagagggctacacgtcctggtctttagagggctacacgtcctcgccttcagaggacaacacgtccaagtcttcagagggctacacgccctctgtcataccctaa

SEQ ID NO: 52575 - DNA, 1104 bp, Glycine max
  Peptide Sequence Number=SeqID_169353
atgcatgaaggagagtctatacatgatttctgttggtatccttacatgtcttcatcagatctggtgaccaatgtttttgcgactactactcgcgaccatccgattcatttatgggatgctacctcgggccagttacgttgcacatatcgggcatatgatgctatggatgaaattacagctgctttttcaattgcttttaatcctgcagggactaagatatttgctggatacaacaaatgtattaggttgtttgatttacatcgccctggtagagattttgaattgtattctacagtaaaagataaaaaagaaggccaaacaggtattatatctgctatggctttttctccatttccttctgggatgctagctttgggttcttacaatcaaactactgctatttatagggaggacaacatggaacttttgtactttttgcatggtcaagaaggtggaattacacatgtccagttttccagagatggaaattatttatatactggaggtcggaaggatccttacatactctgctgggatgtgcgcaaatctgttgattgtgtctacaaatcatcagaaaacaccaatcagcggatactgtttgatattgacccttctggaaagtatcttggtacaggtggccaggatggtttagtacatatatataatctccaaactgggcagtgggtgtcaagtttcgaggctgctttagacacagttaatggtttctcattccatccatttctaccccatgctgtatcatcctcaggccaccgaagatttgtaattccagatgatggcaatgaagaattttgcttgactggtcgtgaaaactgcctctcaatgtggactttctgttgtgattcaatgatggagacagatttgaagaacgatggcagtttcaataatcagtctgagagtttattggagattagtgtcaaaagtggtaaaaggaattcgatccagcaactaaccctttatttctgcactttacggcaatattttatgctgaaaaaagtcacatacattattgatcactttataaggtcggtggaatctggaggaaagaatattatggtgacttgtacaaactcaacggatgcataa

SEQ ID NO: 52576 - DNA, 252 bp, Glycine max
  Peptide Sequence Number=SeqID_169354
atggaaagttcgaacgaaatatcgaagagagagggaaaaacaaaaactagccgttggaaggggacacgtggcggtgtgatagaggatggaaagaaagtggtcaatgacgtggtgcttggtcggccgtgtcggttgttttcagggtgcgagttccgtgtacgtaaccgcgtgggtgtatcttggaccgtcaccgcagtggatcacagcctgttggggaaacacgtgtgtgatggcttgcttgatcaacggtga

SEQ ID NO: 52577 - DNA, 624 bp, Glycine max
  Peptide Sequence Number=SeqID_169355
atgtcggtggcgaagaagttgattagatgcgtcatccttgacttggacggcacgctgctcaacacagatggcatcgtaggcaacgttttgaaggttatgttaggtaaatacggaaaggaatgggacggaagagaagctcagaagataattggaacgacgccgtttgaggccgctgctgcggttgtgcaagattatcaacttccctgctccgccattgaattcctctccgaaatttcgccactcttctctgaccagtggtgcaacattaaagcacttcctggtgctaataggttggttaaacatttgaagagtcatggagttcctatggccttggcgtcaaactctccaagggaaagcatcgaagccaaaatatcctatcatgatggatggaagaattctttctctgttataattggtggagatgaagtaagaacagggaaaccttcccctgaaatattccttgaagctgctaggaggttaaacatggagccttccagctgtcttgttattgaagactctcttaatcacatattggctgaggacgactgtcatgttgatagattgtccagccaatattacatgctttttacttgtggggatggtggcaaatttttgaggaagtga

SEQ ID NO: 52578 - DNA, 312 bp, Glycine max
  Peptide Sequence Number=SeqID_169356
atgaagacagtcatgtatcacactccagaagcacacactagtcaagaatgcataagtgcttggacaacactaaatgtaaagttctttccatttgtgatccttgacaaagtccaagtcataggaactcaaagaagacaaatgcccttgtcgaagaaccagcaaacattcactaagataacacctagcaccaatagatctatcttaacgagtccttcaacagacacaaggtgcatgttggctgacagtggagaaaaagtagagatgaagaagacaaatcaagaaagttgtatgaaggagattgagtccaagtag

SEQ ID NO: 52579 - DNA, 264 bp, Glycine max
  misc_feature (228)..(228): n is a, c, g, or t
  Peptide Sequence Number=SeqID_169357
atggccaaatctaccatcaccagttttgctctgatattctcgtctcttctcattatggtgcttatagctgaaagtggatcaactccaaccgttgcagacccaatatgtaacactgttcatggtgtggaagaagctgaaacttgcaccagcatcgttcaaagtttcaatctagatgagcgccacttcctcgatatcaatcccaatatcaactgtaaccttatctttgtnggtcagtgggtgtgtgtggatggccaagtgatttga

SEQ ID NO: 52580 - DNA, 609 bp, Glycine max
  Peptide Sequence Number=SeqID_169358
atgcgggtttggagttgttggaaagtatcagtatctgtcatggtcgatgggggaagattggagccttcgaaaggggtctcgcatttgaggccaaaccgcgtgctaaccatgggtgaaaagagaggccgcaggtgtttagagataacctgtcggtttgaaagctcgactgctaagggcgaaacatctatgctcctatgccaaggcagacatggagggctgacgtgtgtactgaagtgccacgtagcttcccacgtgtattttgtggaccctagacaatataataatagtctgattgatatgtataatctcaattttgatgatcctattattcatgctaatcatgttgcggcctgtggtgcaatctcaaaagacagaaaaggcacctttgtccaagcttttcctagaaggttgggccactgctcgatagttgaagttgcattgtgggcaatattttatggaatgaggatgcttgaggagcaaggtattcacaatttatctatcaagtctgatagtaaggatgttgtgaggattattcaaaattatctaggaaatggaagccactttcaagagctagcaagcgaaatttggagcttgaagaacgctttctaa

SEQ ID NO: 52581 - DNA, 1389 bp, Glycine max
  Peptide Sequence Number=SeqID_169359
atggaaaccgacgaatcctctcgcgtgattccctttcagcttcaattcgataaacccctcgcttctcagatcaaaattgcggagtggaatcccgagaaggacttgctcgccatggtgactgacgattctaagatcttgctccatcgtttcaattggcaacgcttgtggaccattactccaggaagatgcataacatctttgtgttggcgtcctgatggaaaagcaattgctgttgggcttgatgacgggacattgtcactgcatgatgttgaggatgactttggtcacacttccaaatatgaagatagaacctctcgtttctttcctcctgctccaagagttcctcggatgcctggattggtatctggggataatggcttcatggatgatagcgaagattcatttcaggagctgtcaaattcttctcaccaacgattcaacatcctatgcagtgcagataaagatggaaacatttgttttagtatatttggcatcttccctatagggaaagttaacatacacaacctcacttttcctactttctgtgatggttcagaaatgagtaatggagtttcaaatgctttgatacacaaggttgctttatcaaaagatctttgtcgtttgatagtcacgtgctcaggagaccttgttaaagttggtgatgacttgggagaaattcaaatggttgggaacaatgagcatggtctgcattgcttagcactgaacacagctatattttggaataggaaaaatgagcttcaccaggtagctcaacaagcttctaacatagaggatttgactgaggttgttcggacatcattatcagttatgtgtaggcaatggtctgatgccatgaacacatttcaggagaagttcagatctttgtctactctgataataaatcatggacttgattcgtcacctcaagaggagtttctgagccttttgggtggtgcaaggactagcccaccagttcatcaatttctcgttaacactcttggagaagtgggtgttaagcgtatttcaaaggttctctccggtgcaggcaaagaacttcaacgtattgtcttggaccacctccaggtcatttttgccttcctaccatgtgttaacaaagtaggcattgaaggcaagcctgctcctagcacaatgatttgggacttcagaggctgtcacccagtggccagcttgaaggagctcaagttcaatcctgctgtagaagtgattggattcagaataggagaactaagagggctttcaagatggcgtgcacgctatcacggcattggcttggatgaatcacttattaacaatgcaacagaaaaggctggtatgctacttgtacaagttgaacgatttatgagggttctttcatctgttgtgcagcag

SEQ ID NO: 52582 - DNA, 385 bp, Glycine max
  Peptide Sequence Number=SeqID_169360
atgggtcagctccagcaacaagcgtttcacaaagcttacggtaaaatctgggacctagccatggcagaagtctccacagtggccattgcctccctcacccagtattatgatcagcccgttgagatgcttcacctttggggacttccagctatcacccatgatagtccaaatctcggcacaggaattagactgcggaaagcaagtcgaaaatggggcggttggaatactgagaaaatgtttggagtcctctttccgaatgtggatggtttggtggacctagcagcaatcaacgcttttctcgcctatcataaccacaaggaaagcccggttgtcactatgttagccgacctatatgacaccttcgaccgaagatgtgagaagagca

SEQ ID NO: 52583 - DNA, 201 bp, Glycine max
  Peptide Sequence Number=SeqID_169361
atgacaaaatcaataaagatgctgaataaaggctcagatacgcttgatgaggtgctgcagcttggaaagaatgttggaaaccagagaggacttggactgtcgttcatgcatcctccaccattgagtctggagccccacgaattgattgccaagctctgttcgttgatcctctatcatcaaagcctattcgcagccccttga

SEQ ID NO: 52584 - DNA, 957 bp, Glycine max
  Peptide Sequence Number=SeqID_169362
atgtcagaaccaagtgaccagcttctaccatataacagtgaacttgttattgtattcctgaagtttctctatgaacaagatccagttaaacaattgctggaagtatcagaaacagaatatgaagttgaaattgatttggaaacaatgcagagagttagagaattagttcagtttgggggatttgctgacactgaatatctaaggagaacattggttaaagaatttcagctgatggaattaaggtcagctttgcatcatgatttgcagattttagctcactgcccagcagctctttcgtcaatttttgaagctgatagaatgggtcacttctttaaagaggcttttgaaatgccttttaccacaatatcaagaaagatactttgtgaggatatactacctctgtttcctcttccatctttgccaaaatcatcttcttccatgtggattcccacttcagtatcatattatgaggatccctctagagcttctgtgccaccttactcttgtcaaaaccagtttattgattacatatctttccaagtacctgatgagtgtttctcagatattgtaaattgtatatgcatagtcagaggattcatgcatgactcagactgtctaaagaaggggtatagttctttggaagctgtactgttatgtgttcctgttgattatcaatgtgtggatctgtctttgtacaaggatagtcaaatcgtcctgttactaaacaaagctactaatacatcagaaagtgctggagatggttgtatgatgattctgcaagattctgtcgcttacctgaatattggggatgagaaatctcgcaccattcgtcattctgtaattgctcccttggcagttagtgcatcaagaggcgtggcttgtgtatttgctgcaacaaagcgtgctctagtctacattttggaggaagatgaagatgaggtctcggatgtagaatag

SEQ ID NO: 52585 - DNA, 663 bp, Glycine max
  Peptide Sequence Number=SeqID_169363
atggaagcggagacagtgcaagaacagcgcaaaggcgcgcagctgaagaagagggctctgaagaacaaagctttgggcatcaccttcaacgagaaagatctcaatgactatgtcaccggctttcacaagcgcaagaagaagagaagaaaggaagcccagaagcaacagaacgaggctctgcgccgcaaacgcaacgacgaacgcaaaaggaggaagttggaaagagaacatgttcttaatggaggcgtgccacctgatgaaattgatgagggccaagaagaagttgaggagcaagttgaatctattgctgaaatgaagacatacgagaatgatgatctgaaagtcactgttgtaacaagtgagatcaaccctgaagacgaaagttatcctagtgagaggaaggaggcagcagtgatccctcaatctgttgtgtctgataaaaggcaaggggtacccataagtaacaagaaatctttcaagaaggttgcaaaacagaggtctcggccaaggccatcaagtaagagagataaaaagaaaggaaagaagcgaggcaagaatgcagtaatttggctatacctagaagtgagaactcatgcttgcatattgcaggatttggacgtgtttcgtttagttggttacctacctggttcctactgtccatga

SEQ ID NO: 52586 - DNA, 354 bp, Glycine max
  Peptide Sequence Number=SeqID_169364
atgaggcccggaagaatagaaaatgaaaatagaagcgattctctagaaaccaaacatcagctccacgcaaagcaagttgttcagtcacttgatttttcaaagtacgatgggattgtttgtgttagtggagatgggatcttggtagagtgggttgtaaatggactgcttcagagccaggactgggacactgcaataaagatgccccttggagtagttcctgcaggtacgggaaatggcatggcaaaatctcttcttgattcagttggtcatccttgtacagtacccaatgctgttcttgccatcatacgaggtctggttgctgatattgatattgagtctgaaaagtatatataa

SEQ ID NO: 52587 - DNA, 1023 bp, Glycine max
  Peptide Sequence Number=SeqID_169365
atgcacggaagggcgcgagagaagcgcggtttggattcggcttccgctgaagaaggtcagcctgatcggaaacgacctgccttggctagtgtaattgttgaagccctgaaggttgacagtctgcagaaactttgctcgtcactggagcctattctacgcagagttgttagtgaagaagttgagcgtgctttggcaaaactaggccctgccaagcttaatactggcaggctatcccttcccctctttactggtgggaaagtggagggtgagcaagggacagccatacatattgttttgattgatgcaaattctggccatattgtcacatcagggccagagtcatgtgtcaggctagatgttattgtactagagggagatttcaataatgaggatgatgataattgggacgaagaagagtttgatagtcatattgtgaaagagcgggaaggaaaaagacctcttctaactggtgatctgcaagtcacactgaaggagggtgtaggaacacttggtgagcttacatttacagacaactctagctggataaggagtaggaagtttagattggggctgaaagttgcctcaggttgttgtgaggaaatgcgtatccgtgaagccaaatcagaacctttcacagttaaggatcatcgtggagaattatacaagaaacactacccgcctgccttgaatgatgaggtctggagactggagaagattggcaaggatgggtcatttcacaaaaggctaaataaagctggaatatatatggttgaagacttcttaagacttgtggtcagagaccctcagagattgcggaatattcttgggagtggcatgtcaaataagatgtgggatattcttgttgagcacgcaaagacttgtgttctcagtggaaaactttacgtatactatcctgaagatgcaagaaatgtgggtgttgttttcaataatatttatgaattaagtggcttaattgccaacgaccaatattactcagctgattctctctctgagaatcaaaag

SEQ ID NO: 52588 - DNA, 423 bp, Glycine max
  Peptide Sequence Number=SeqID_169366
atgaccaccttcagtcaaggccaactcttaaggagtttcaaaatcaagaaaacactaaatgaactcagagccaacgtctccatactacatctcaagatgaaattcccaaccttgataagagagatcgtgattgtcaaggcagatcaaaaacaggcccaacagtgctatgctaaaagtttgaaagtggaaccctatccttccattagggagcctgacaggtctcaccccacaataggtggtggcacttgttggatttcccctacagttactttttggtccactttctctttatacaaatatgttaaagggaaatctggtttgccgaaaagcgcaccgtatcgtcaagtatttaaaattaaaagggataaatccaagtatcgaactttgggaactagccttagacagggtcaaattcaaaaataa

SEQ ID NO: 52589 - DNA, 225 bp, Glycine max
  Peptide Sequence Number=SeqID_169367
atgtctggcattactgaatatgctcacaaagacagagaatttgttatcaagttctctgccatggagatctataatgaagctgtcagagaccttctcaatgcaggtgctacttcactaagaattctagatggtccagagaaatggaccgttgttgagaaactcacagaagatacactgacagagaggagacagttgcagcaactcccccttttgtttggcagttag

SEQ ID NO: 52590 - DNA, 772 bp, Glycine max
  Peptide Sequence Number=SeqID_169368
atggtgtcaattgtcagatcccccttgtggtgttgtgatattagcagtgtgaagaagaacccttctctttgcgcgtgtcccgttctcttctccaatcctcctccatccccactgtgtgatctgatcctaaatcctatagccatgactaccatggaggttaagctatggaatgacaagcgcgagagagaaatgtatgacaactttggggagctttatgccattatcaaagccactgagaggcttgagaaggcctatgttagagatataatctcaccccaggaatatgagttagagtgccagaagctcatagctcatttcaaaaccttagcttccacccttaaagacaccgtgcctagcattgagcgatttgcagatacttacaagatggagtgcccagcggcgattaaccgtcttgtggtttccggtgttcctgctacggtggagcatcgtgcgactgtggctgcctctgcttccacctcggctgctattgtggccgagtgcgtgcagaattttattacttctatggattctttgaaacttaacatggtggctgtggatcaggtgcacccgttgctctcggacctttatgcttcactcaataagttgactatcctgccacctgattttgaggggaaaacaaaaatgaaggagtggattgcgaggttatccaagatgggtgcagctgatgagttgactgaacaacaggcgcggcagcttcactttgatcttgagtcttcttacaattcctttatggcagccctgcccaatgctg

SEQ ID NO: 52591 - DNA, 921 bp, Glycine max
  Peptide Sequence Number=SeqID_169369
gttctcactgatcttcctcagcacaaaactgtaattggttgtaaatgggtgtataggattaagcacaaatctgatggctccatagagaggtataaagtcaggctagtggcaaaagggtatactcaggtggaaggacaagactacctagacactttctctctaatagctaaactaaccacaatgagatttttactagctttaactgctattgataagtggcgtctcaagcagctagatgtgaagaacgctttcttacatggtgatttaaatgaagaagtgtacatggtcatacctcacgatatgcaagtggctaaaccagggcaagtatgtaagcttcaaaggtctctatatggcgtgaaacatgctagtaggcaatggtatgcaagattatcatcttttctgatttctcatggatacaagcaatgtacttctgactattctttgttcattaagcatggatgcaaaacaatttctgttttattggttgatgttgatgacattgtcttaaagtatgtactggatattctcaatgatgctggcatgcttggttctaagtcaatttctacaccttgtgattacaccaccaagttgcatcaacactcaggtttggagtttggaccgagacgaaagatccaccgtgcccgtaccactgtttctgtcgtgtctgtccctagcccaacaatacagcagcaagaaaagactgcaccaagacaaggtcaaaaccgtccaaacggtgcaagagccagtggcatgatcaatggtggaagaagcttcccaaggagattctctgggcgtccaattccaaagcgtggacaagtgaaagttggaatagttgtggggcttgcaaactctgttgcttccattttctctcgcagcagagccaccagagggtgcgctacacctactcaccttgctcactag

SEQ ID NO: 52592 - DNA, 276 bp, Glycine max
  Peptide Sequence Number=SeqID_169370
atgacgccacgtaagaaagaaacgccatgcaggtggcaacaattaaaggaaggtcaagatagtcaacaaatggccaatgattcaaaacccacgaccacaagagagtacatagatgaacatagagaaaagaaaggcaaagatgggtatgcgagtggtggtgatcacaagaagggatttaatcaacgacaattatttgtccaacaggaacatcgctggccgtttgattcccaagaggggccaagtgaagttgggaattgtggtgggcttgtttcatag

SEQ ID NO: 52593 - DNA, 795 bp, Glycine max
  Peptide Sequence Number=SeqID_169371
atgcttccagattctgctcaaggtgatcttgctgcggtttgctcttgggctgatgaggttggccatacttaccgctatcgttggtgtagcgctttacattatgctgacacgccggatttcaagtgtaactatgaatacttcagagactgtcatgattcttacagacataaacataggtgtgttagtggagcaatatacaactatacaatgcaacttaaatcagctgatgcaagcacttcatctgaatttaactataatttggcagaggcacttatgttcttgtcacattttgttggggatattcatcaggtgtgggatgacttgattattcagtctgctctaaaaacattctatgattctgatctttctattatgatacaagccattcaaaggaatattacacttagcatgcaaatttgcctacagaaatgctacaccaggaagcactttggaagaagccaccattctgtacctattggaagtggtgtgaatgtgattggcaatggggctccttttgagacgtcatgtaagtcagtaagtggcaacacctttgtaaaagaaataattggtccctcaagtagtagaattgaaagagaaagatgtgagtatgaagtttaccttccttggatccgatctgagggaattcccgaaactcaatttgtagaatcccaattgacgcctgcacacattttggaaagtgattccgcaataacaggagcttgggaagatagagacttgagagctgaaatcgttgcatttgacacggaacctccaaaactatcgaagtactactag

SEQ ID NO: 52594 - DNA, 156 bp, Glycine max
  Peptide Sequence Number=SeqID_169372
atggttttcctcataattttgcttccagatgaggaagaggaagccaaattggctttgcatggttattctcctggacataagttttacaagtctcaaggttcgaacatcaacaatatcagtgcagaaaaggaggaaggtgatagctcaacccaataa

SEQ ID NO: 52595 - DNA, 495 bp, Glycine max
  Peptide Sequence Number=SeqID_169373
atggctggtcgctatgacagtaaccccttcgatgaggaagaagttaaccctttctctgatccatctgtaaggggaaaagcatcaagccagtcaaacttcagtgggggtgcattttacaccacaaatcctggaagtgttcccgctgccactaattcaaggcttccacctcttaagccagaacctgttgattataattatggctttggtgcgacagttgatatacctcttgattcatcaatggatttgaaaaagaaggagaaggaacttcaagccaaggaaactgaattgagaaaaagggaacaggtggctaacactcctagagaagtgagacggaaagaagaagctgcttcacgagctggaaatgttcttgaggagaaaaaatggcccccttttttcccaataatccctcatgacattgctaatgaaattcccattcctcttcaaaaattgcaatatgttgcatttaccacattggtagggaagccaaccccctaa

SEQ ID NO: 52596 - DNA, 1263 bp, Glycine max
  Peptide Sequence Number=SeqID_169374
atgatttctgatactttctgttacagcaagcagtttgtgatgaagattgagactctaaagtatcaaagttaccaagaagagatagacaaacagtggaatttcagggaagatgaaaaggcatcttctgaaacttctggaaatctgaagggcttaccacggggtataatacaagctacttcagattttgagttaaggcctttatggtcgccaagtagtttgaggtcaaaggttagtgtttactccaatcgcaacttgctggcagttccagttggtattaaacaaaagcataatgtagatgccatggtgcagaagtttcttccagacaatttcacaattattttattccattatgatgccaatatggatggatggtgggatcttaattggactagcaaggccatacacataactgctcaaaaccaaacaaagtggtggtttgcaaaaagatttctacatccagatatagtttctatttatgattatatctttctctgggatgaggatttaggggtggaacatttttctccatcaagaccaattttggccaggtctgacgggccaggctgggccaagaaatacatacccataggagatttggactgggcagggcaaagcccactttccatccttttggcctgccaggccaatccaacccatttgacagctctcatgcacaataagctctatatcatccttattagattaataagatacattgaaattgtgaaggaagaaggattggaaatatcacagccagcccttgacccaaattcaacagagatacatcatagaattacagttagagctaggactaaaaaagttcatagaagagtctatgaactcagaggcagtactaggtgttcagaggcaagtaaagggcccccatgcactgggtttgtggaaggtatggctcctgttttctctcgatctgcctggtattgtacttggcatcttatacagaatgaccttgtccatggatggggagtggatatcaaaataggatattgtgcacagggagatcgcactcaaaatgtgggagttgttgatagtgaatatgttgttcacaaggcaatacaaactctgggtggtagtgatgatccgactaaagtttcaaatcggcaaaggacaactccgaaacacggtgtggcggccttcgatcaacgagttgaggtagattgcaaatcacattgcttacattgtaacatgatcagatacgaagacagtcaacatgggaacttgaagtcttcaaagagcggtggatag

SEQ ID NO: 52597 - DNA, 705 bp, Glycine max
  Peptide Sequence Number=SeqID_169375
atggctttctggcaacttgaaaacgacaaagccaatgccatgagaaggttccaaagaaaacgaactctggaaaccatcttccacttgttcaaactctgtgccgcaatcttgctcttctcccactgctcctctttcttccccaatatcaccctccaaacattcccttatctctaccattttttactaccacttttccgcaactctttttacgcatttcttctcctaaacgccatcatcctcttactattcacactctccaacaacgttggtgcctccaaagacgccctcaaccagtctcgcctcatcgtaaccgcaccgcaggaacaacctcggaccgttgattcttcccacaaaaaaatcaccaccactatttgtggttcatcgtctccggttttcgaggaaactgtcagggcggttactgagaccaccactaccacgacgtgttgttgcacgactgtgacgacgacggagggagagacggtttcggtgtcggagaagaagtgttaccggagagttcagtcggagagttatgagcggcggatggcggtggctccgccatcgttgcagaggcaattgcggtgcgtggaacagttgagtgaagacgagttcaaccgcgcggttgaggaattcatcgctatgaataagagaatgcagaaagaagagcacataagatcacagaaaactgggtattgggcgtcaaattaa

SEQ ID NO: 52598 - DNA, 441 bp, Glycine max
  Peptide Sequence Number=SeqID_169376
atgtcgaaatggacactttcaatcgacaaggacagtgtcgatgacactgtatacaaaaagtacgacataagaaaagagcaatgggcccaattttatcaaagccgcagagacccttcgtgggaggatgtgcaaaaaaaggcacatgccatccagaaacaaaatattgtccctcacatgttgtctcgtgggggttatgaatatctagaaaacaaaatgatggaggagaagaaaaagaaaaaactagaggaagttgctcaatccggaagcagtgacactgtgattgatccttcatctcccatcagacgacacatgaaatggaagacggccagcaccaagaaaattggccaaataatgtctaaggcaacaaaggaaattgctgacaagattgattcattggaggagcatgcctcacatggttcttttgtcgcccatggacgttag

SEQ ID NO: 52599 - DNA, 261 bp, Glycine max
  Peptide Sequence Number=SeqID_169377
atgggaacttggaaacttgagggaaacaactatctcaatttttggaagattggaaacaggttcggaatgtttcaaacatggtcaccatttcacattgttgccacttgccatcgtgggaaaaagcttcatccgggaaaatcaaatgcaatattcagtcaagagcactgctttgggactggtatttgtctgcgtgatgaacataggcgaattagagcaaaaaacatcttgggaatttggcagcccagatctctacgtgcataa

SEQ ID NO: 52600 - DNA, 852 bp, Glycine max
  Peptide Sequence Number=SeqID_169378
atgagacaccgcggcgacgcagagccaccgccgcaaccccaatcttcaccgtcaaattcccttcctcatcggaagaagaaccgcaagcgcagagccaccacttccgtttcctccgaaaccagctaccccaatggccctgaccagctcaacactcacattcatcacgctactgttgtgtgccaggacaaacctaaaccggaagagagtaaatccgctgtcgccggcgaaggtttccgtttcggtgagctaaggcagagaagcgtgaacggtcgcgatagtttcggagaatcggcggttacagccgttggtgacggttacgtgacggaagttagttcggttgcaacggcaacgtcagagagggtggaatcgttggagttaaagcgtgtcttggcaaatgattcgattccgaagaggtcacctgtgtcgtacgttttggagaagttgtaccatggaaattctgtgtggagcacaacaactattggtgatgaaaagggacgagaaagagtgtatgacactatcttccgcttgccatggagatgtgaattggtatttgcttatagatgttggtttctttgtctgcttcaattcatttctgtcattattaactatcatgcccatgaggatagcgatgaccatttggaggcttctgaaaacaagagttgtgaattaattaagctttgtccatctagtgcaatctttttagcattcagtttcagaaatcgattttcagttttacactctgaccttataatgctcatggcaggaagttcaagaggccatctacaattgagttgtcagattttggctgttttcttattatggcttgtggagtcattgttttgcagcaaatag

SEQ ID NO: 52601 - DNA, 978 bp, Glycine max
  Peptide Sequence Number=SeqID_169379
atgtttatcattaatgctggtcctggttttaagatactctggaacacggtgaaaacatttcttgatcccaaaactacttcaaagattcatgttcttggaaacaagttccagagtaaactgcttgagattatagatgagagttgcacttgtgtagatcaaggtggttgtatgaggtctgataaagggccatggcaagacccaaacattttaaagatggttcttagtggtgaagtgggatgttctaaacaaatagtaacagtttctaacgacgaggggagggtgattgaatgtgacaagatatcttttccaatgattagaggtagcgatacatctacaggagaatcaggatctgaagttgaagatatagcttctcccaaagcatgtgggaattgtataagccctatgttaactcctgtccttgaagaagcaagaatggttggtaagactagtcatgctggcaatttagttgagcatgttcccacggttgacaaagccattgatgttggaccaaaggaaaaacaagcaacacctcgaatgttattttgttcaacagcgggtttcattttggccctttatacttttgctcgatcaatagcatttcgtgtcactaagggaatacggtactcagattctgattctgccagaaatatacttaacatgactgttgattcaatatccatggaggaatctcgtcctgattcatgtgctcccggcagattcacaaagacaaacattccctcgtctaccttaaaacgcattggtgagcttgaagagaaagttgacatgctgcaatcaaagcctagtgtgatgccacatgagaaagaggagctgctcgatgctgctgtttatcgtgtggatgcattggaagcagagttgatagctacaaagaaggctttatacgaatctttgataagacaagaagaacttatggcatacatagacagtcaggaaagagacaaattcaaggcaagtcaatga

SEQ ID NO: 52602 - DNA, 723 bp, Glycine max
  Peptide Sequence Number=SeqID_169380
atggcatcactaatgagcacaatatgttgggcactttggtgcaaaaacaagtcctctatcggcattcctccgggaaatcgaggattgcccttcgtaggagagacacttcagttcatggctgccatcaacagcagcaaaggagtctatgagtttgtccatgctcgccgcctccggtatggaaaatgcttcaaggcgaagttgtttggggagacgcacgtttttatatcgagcagggagtcagcaaaagtgattgtaaacaaggagaacgagggagggaaattctcaaagagctacataaaatcaatcgcagagctgcttgggcgcgacagcttgctctgtgcagcacaacagcatcacaaactcatacgcgcccgtctcttcagtttgttctcaacagattctttgtcttccttcgttcaactctttgattcactcgttcttcaagctacacgtacctggacctgtggatctgttgtcgtcatacaagatgaaacactcaagctggcctgtaaggcgatgtgcaagatgctaataagcatcgagagtggccaagaattagtgacgatgcataatgaggttgctcgtttgtgtgaagcaatgctagcattacccgtgaggttaccctggaccagattctacaaaggccttcaggctcgaaaaagaataatgaacatattggagaagaatataagtgaaagaagaagtggaattgcaactcaccat

SEQ ID NO: 52603 - DNA, 1333 bp, Glycine max
  Peptide Sequence Number=SeqID_169381
gtcccttgagtcaaagcttgaaacccttcaggctgggagggatgagaaaagagatgattgccatgttgacaatggctcggctgaaccagagttacatgttccttctcagaaattggatagagtcgacacttctgcaaaagagatgtcaaaggatgggttatctgctgggagtttcacacatgaaaccaagacaaactggactcatgaatgccaggttccggcaacatcttgtgaatatgtgaggaccaagcctgaagtttcagcgtctactgaacaggagaaagttttaaatgtagataagtcaactcacactgtatatgaaggacagggagggtgtttgaaaaaaccgagagggaagagaaagaggaaggattgtggcagaagtattaatgaagtaagtgcaagagaaagtgatttttcagctgatgtgtgtaaagaaagttctatcagcaactgtggtgagattgtcaaatcttctggtatgaatgaggagaatgcaaacttgaagaaggctggaattaaagatttgatggaggtcttagattcttttttgacagttcaaggtgcttctgccttctcttataagcatgatagccagaagcgaggaaaatacgagcaattgatccggcagcacatggactttgagaccataaagtcaagaatctgcaacggaacaatcaagtccgtggtggaacttttaagagacttgctactactgagcaacaatgctctagcattctactccaagaacactcgggaatacaaaactgctctacaacttagagaccttgtcatcaaaacattgacagagaaactggagtgtgctagcacatcacctgtgtgtgatccttctgcaaaagtcagaagcacgtgtttcagcacatcgcctatgcgtgattcttcagtgaaagtcagaagcatttgttccacttcgcttgtgcatgatccttcagtgcaagtcagaagcatgcgccctggtaatcgcaagattgttgcaaaggtagctggtggcagctgctctgctgaaagggtctcagttggagttaagaaagctaaaaaagtggattctctaccagctgaaagggtctcggctgcagttaagaaagctaacaaagtcgaatctccaccttcagtggaatccgtcaagaaagcttttggtggtagagcaaaaaaggttggacgtgaaagtgcagctcatagtcatatactgtcgctttatacgacttttctatccttgaaattttttgaaaattgtagcaagaaaaagaaagtaacctgcaagagttgggtggaggcccccatctccatgatgcaaattgaagagttaccatga

SEQ ID NO: 52604 - DNA, 444 bp, Glycine max
  Peptide Sequence Number=SeqID_169382
atggaggccatgaaagggcaaatggccacaatgatggaaggcatgatgagtatgaaaacaaatgatggaggtcaatgcgactacagttgttgctgcaagtatcgccacagaagtggacccaactcactcatcgagcctcaatcaagtaaatcctccagtctcggatatggtaggtcagggaggagaagcattgggaagtacagcttgcctcccaactatacaccaccaattgttgaacacagtgccaacgagaatatcaatgactccactcccatactcattgagagccaacaaccccaatctggtcatgcacatgtctctcaacccatgggggaggcacatgaggcaccccaagaccataatctagtcgactttgagcctcacctcggatatgccgctgaggggaaaacattttgcggcatacctgttagttgtcttatatga

SEQ ID NO: 52605 - DNA, 171 bp, Glycine max
  Peptide Sequence Number=SeqID_169383
atggtgacgtggagcacctggcaggagcttctcctcggtggagcggtttcccggcacggaatccgagattggaccgtcattgccgccgaactcaagacccgaaccgtttcaccatgcattttcacacccgagtcaattgtcatatcatccccttcagtgatgtgttgctaa

SEQ ID NO: 52606 - DNA, 258 bp, Glycine max
  Peptide Sequence Number=SeqID_169384
atggccacattgtactacgcaatgtcctttcctaatttcaggcgctcggggatagggggtcatatgcccttcttgtttgaccttgctcgtgagatggcatttctttttgaactatcaaactccagtgccgccttggagtttgatagtcaccggttccagagtgccgagcaccagcagcgctttgagaccatcaagggatggtcattccacagggagaggcatgtccagctcagggaagacgagtaccctgacatctag

SEQ ID NO: 52607 - DNA, 1365 bp, Glycine max
  Peptide Sequence Number=SeqID_169385
cagcgcgacgatgtgcggcatctcgtggttggcgctgatccgcggctacggcggcctgggcgtgttcggtgccttcatgggcgtgctggcctgggcggtatcgccctcgctggccgcgtggatggcgccggtggtgatcggcatggtgctggcggtcccggagaacatcccgccgccggtgctggtacgtgctgcgcagctgcgccgggaagccgccgaacaaccgccgctgaaaccggcgtctcgccgcagtggtcggtgatctggctgcacggcctcggcgccgacggccatgacttcgcgccgatcgtgccggagctggtgcgcccgcattggccggcgctgcgcttcgtgttcccgcatgcgccggtgcggccgatcacgatcaacaacggcgtaccaatgcgtggctggtacgacatcgtcggcatggacttccgttcgcgcgccgacatggctggcgtgcaggaatcggtggtgcagctggatgcgctgatcgcgcgcgagatcgagcgcgggcatcgcaccggagaagatcttcctggccggcttctcgcaggggggcgcgatcatcctgaccgccgcgctgtcgcgcaccgcgccactggctggcctgatcgcactgtccacctacctgccggaagccgagagcgccaagcgcgtgccggtgttcatggcccatggcagcagcgacccggtgattccgcaggcggtggccgtacacagcgcgcaggccctgcaggcgatgggcctggaggtggaatggcacagctacccgatggcccaccaggaacgcctgggcgctgcctgagccatgtcaccggccagcgccccgccctggatgccggaactgtgccgcctgccgcggctggcggcgatgctcggcctggccgaactggtggtggtggtgctggccctggccccggatggcagccgccactggaccgtgggcgaactgctgtcggccagtggtttcgcgctgtggctggcgctggccgtaacggccagcctgtgcctgctgcggaacgcgttgtcgaggttgccacaggtcctgggggcggtctcggccatcgcactggcgacgctgatcgcggtggtctgcgcgggcatcgtacatgccctgtacgcggtgcttggcgacaacttcgcccgcggcatcagcttctggcgcttcacgctgggcagcgccgcgacgacggcgctgatcacggcgttggccctgcgctacttctatgccaacgcacgcgcacaggccgacgcgctgcaggcgcggatccgcccgcatttcctgttcaacagcatgaacctgatcgccagcctgctgcatcgcgacccggtggtggccgagcgggcggtgctggacct

SEQ ID NO: 52608 - DNA, 525 bp, Glycine max
  Peptide Sequence Number=SeqID_169386
atggctccgaaaaagctttccatgaagaggtctaggagagacaccgcggctgaagggaccagtgccgcccccaagtttgatagccaccgtttccggagcgccgagcaccggcagcacttcgaggccatcaaagaatggtcgttccacagagagaggcgcgtccagctcagggaggatgagtacacaaattttcaggaggagatagctcaccgacattgggcgtcgctggtgactcccatggctaagtatgaccctgaggaaggccaggagtgtgagttcattcagaggaggaacagggccgacgggttcgacgaggaggccattgcccaactgttatgcacaccggggcaggatttcgcccggaccgctacagggaggcgggtgcggatcatgcgcactagcatgaccaccctgacccagacgtggatgacattgctactcagcaatgtcttgcctagcgatcataactctgatctccctttgccaaagtgtcagttggtatgccaccctccaggcaccctctag

SEQ ID NO: 52609 - DNA, 333 bp, Glycine max
  Peptide Sequence Number=SeqID_169387
atgatgttgttagtaatccattgttgttttcgggatgggaggaggctaaaagatatttggatgtggatgcttacgttcaaggatgttgtttttgggattgttgtggagggaacctttgttgagggaataaaggaagaggttgtactctcccctacgcatgctctgtcccttatagctgccggagaaggatgcactgatgttcttatggtaattgctaaattaacagatggaaaggaaactcatattccttatcgagattcaaagctcactcgattgttacaatcatcccttagtggccatggacgaatttctgttagtgcaatttctctttga

SEQ ID NO: 52610 - DNA, 315 bp, Glycine max
  Peptide Sequence Number=SeqID_169388
atgtcattgcctggcgctgttcatgcatcctccacccagcgagggggagcgccacgaatgtcattaactagggctgttcatgtgtcctccatcttcgagtctggagccccgcggatgtctttgcctagcgctgttcgccaattctccattctccactttttctcggatccccatgaatgtcattgcctggcgctgttcatgcatcctccaccaaaagagtttggagctatgcttcatgattgcctaagtgtggaccctctagtgcaatcctccattctcctcttttttcggagccccaagaatgtcattgcctag

SEQ ID NO: 52611 - DNA, 513 bp, Glycine max
  Peptide Sequence Number=SeqID_169389
atggagacggagaccagtaaggagcttgaagaggagctgataatgtatatgaaggaggttgtggaacaacatgaaaaaggctttcaaaaggtcgtcagtcaggtcgggttcttcaccaaggaccttgacttagttctttttgaccctttcaaggatgtgatggacgatgttctgcttgacaaggaagatattgcagttgaggaggaggttgtcgaggagcaggatgctgatgctaccaatcaaggccttggtgatgtaggaaggaaggccttggtggtcatgtgtgaagtaaagaggagtaagctgaccgaatgggtgccttgggttttgaaagaatgtgtaccaagggtggaccttaggggctcacaaagggtaaaccttgggtttaacgagccttggaccaagcacatgtttgccatgggttttaacaagcatgtagagctacatcaaggcttaccaaggatgggtcttgggtctaatgaacctgtgagactcaccaagagtggatcttgg

SEQ ID NO: 52612 - DNA, 1959 bp, Glycine max
  Peptide Sequence Number=SeqID_169390
atggggaagggagggcattgcttcttcgagaagcttcggaggtgcgttcggacggtttttttcgtggtggcattggtggcgtcgctctcggtgacgtcgctgccggtggtcgtcgcggtggtggacgtgttggtgccgtgcgttttgatcccgaacttcacttgcgtcatgtgttacagcatcaaggatcattttcaccgttacgctttcaagagttccttcacggatattcctctcatttccgtcataagatcccttatcattctctgtgtttattccgtttgtgatggtcctgctctctcacatggtccttaccttggaactgtgactctgtgctcctttctgtcaattgttctcctttcggtcaaagcttgtgttttcaccgtaaattcccatattgaagcggaggcttcggtttccctcaggaagcatagactccatttgaagaagccatggggaatgcctgtcttgtttctttcatcagttgtgtttgcccttggtcatactgtggttgcttatagaaccagctgcagagcacgcagaaagctcttgtttcatcgagttgaccctgaagctgtcctattgtgcaaaaatgttttctctggctatccaaaggtcccacgctctccaactccttctgctgggagaacccccaaaagtgactgtgagatgaggcgaagaccttttgggacagctcgtgatgaagaactgcttgttagattgcttgcaaactcagacagcttattcattacatgccaaggacttacactccatcacaagctcagcttgcctggttcgcccccgcatacattgtcgtcaatgtcctgcgttgaccccaattctagttgcagcacttcatcaatggctgcaggtttagcaaaatctaataaacatttgccaagtacctctccaaatatccagccacagctatacagaagctatagcaatcaattccatggctcatctctacatgttcctctattggatggtcctatgaattctattatttctgaaaatatccctgtttttcacctagatggtgtttgtgaagatgaaactagtaaattgaattttcaatctctgcagcaagatttagagagtattgatcaattaggtattgttttagtacatgggtttggtggaggagtcttctcttggaggcatgtgatgggatctctagctcggcagagtaattgtacagttgctgcatttgataggcctggttggggattaagctcaaggcctcgccgggaggactgggaggaaaaagagttgcctaatccttataagcttgaaagtcaggttgacctgcttttatcattctgttctgagattggattttcttcagtggtgctaattggtcatgatgatggagggttgcttgccctgatggctgcacaaagaattcaaacatcaatgaattatttcaatgttaatttgaaggggattgtattgctaaatgttagcttgtcgagggaagtggttccatcctttgcaagaatccttctgcatacctcacttggaaagaagcatttggttcgccctctattaagaacagaaatcacccaagtggtgaatcggcgggcttggtacgattctaccaaaatgacaccagaagttttgactctctacaaggctccactatctgttgaaggatgggatgaggcgcttcacgagatcggtaaattgtcatctgaaaccatcctttcggctaaaaatgctgaatcattgttacaagctgtaggagacattccagtgttagtcattgcaggtgctgaagattcccttgtcactttgaaatcctgtcaagctatggcctcaaaacttgtcaattctagattggttgccatatctggatgtggccatttaccccatgaagagtgtccaaaggcattgcttgcagctatatcacccttcatcaatagactcctgtctgcatctgactcgcaaagacaataa

SEQ ID NO: 52613 - DNA, 1701 bp, Glycine max
  Peptide Sequence Number=SeqID_169391
atgaaacgtggctaccaagaatctcactcaacctcgttaggtccaccacaatccagagctagacatgatcctcaagcggatgaatggggttatatagggaaagttttgaggctttttgaattggtcattggtagtgcacactttcttgaggatgaaagcacgaagatatttgctcggaaagtagctgatcattacagtgcaagatccaaccaaactttggaagaacgggaggctagtcctataattcacttgaagaaactcaataactggattaagagcgtcttaattcagctttatgctcgtagaggagatgcagtactcgacctcgcctgtggcaagggtggtgatcttatcaaatgggacaaggccaaaattggatattatgttggtattgacattgctgaaggctcagttcgcttggacaaagttcttgcagatgatgctccttttgatctttgtagttgccagtttgcattgcattactcatggtctacagaggtccgcgcccggcaagcattggccaatgtgtcagctttgctacgcccaggaggcattttcattggaactatgcctgatgccaatgtgattatcaagaagcttagagaagctgaaggattaacttttggaaacagtgtctattgggtgcgttttgatgaagaattttctgataaggatgctgttgattgtcctgaatggattgtccccttccacatattcaagtcattagctgaagagtatgactttgagcttgtttttgcgaagaactcgcacgaatttgtacacgagtatatgaaaaaaccagaatttgtggagctcatgcgaagactcggtgcattgggagatggcaaccaagatcaaagcacactctcagctgatgaatgggaggcagcatatttatacatgtcatttgtattgagaaagcgaggtcaacctgacaaaacccaatcaagtagcagaaaggaccgagggtcgatgcatatttcagaggaagacatcatgaaaggcgcgaatcccatgattttgttcaaaccttcatcagctatgcgattgtctccttgtgcgaacaccacttcaatgagttccggatcgggttcacttttgtggttccggaagggtcttcggatccatgacaaccccgctctcgaagtcgcttcgcgtggagcctctcatctctaccctgtctttgtcatcgacccgcatttcatggaacccgacccgaattcttccgcacccggatcctctcgcgcgggtctgaaccgcatcaagttcttgctggagtgcctcgttgaccttgacctcaacctcaagaaccttggctcaagacttttgattctcaagggtgaccctgctgaagttgtcattcgatgcttgaaggagttgcatgttaaaaagctatgctttgagtacgacactgaaccgtattatcaggctctggatgttaaagttaagaactttgcacttgctgctggaattgaggttttctctcctgtaagtcatacactcttcaatcccacggatatcatagagaagaatggagggaagccgccgcttagttatcaatcgtttgtcaagcttgctggggaaccaccatcttctctctctactgtgtactcttcacttcctccagttggcaatcttggaagttgtgatatttctgaagttccaacaatcagagatcttggatatggagatgctgaacag

SEQ ID NO: 52614 - DNA, 1374 bp, Glycine max
  Peptide Sequence Number=SeqID_169392
atgggggcgatcctctctcagaatggccaccctttggcgttctttagcaaaccattcacccctaagctccttcgtgcttcgacttatgttcgtgaactgtttgctatcaccacgaccgttaagaaatggcgccaatacctcctcggccggcacttcaccattatcactgatcatcgaagtctcaaggaattacttacccaagtcattcagacaccgaaacagcataagtacctggcccccttgatgggatacgattatagcattcagtatcgcgctagcattcacaatcaggccgctgatgcgttatcccggcaacaggaaccctcctctgtgttcatgattttatcagttccctccttaacttttttggatgagcttcgtcgtcaagtggacaacaactctgactactgtcgccgccaacaagagatcatcgaaaatccaactcaacaccctggttttttcatgacacataacctcgtgttgactgtgggccgtatttggttacctcgaggcggccatgccaaaattacagaaactttggcacggatttcagaaaacctcaactggccaggtttacgggaagatgttaagcagtttgtcaccaactgccaggagtgccaagtaactaagtatgaaacgcagaagacggccgggctcctatgcccccttccggttcctcatcgcccctgggaggatctttccttggattttatcctcggtctgtcttcctatcacggcaacactactattcttgtcgtagtagatcgattttccaaaggtattcacttaggcatgttgtcgacagcccacacagcgcacatggtggcatcattattcattgaaatggtggtcaaacttcatgaaatccctcgaagccttgtatcagatagagatccactcttcattagcaggttctggcaggaactcttcagggccaaagacacgcaccttcgcatgagctctgcttaccatcctcaaagtgatggtcaaacggaggctctgaacagggttgttgaacaatatttgagtgccttcactcaccggcgacctcacaggtgggggaagctcttaccatggattgaattgtcacataatacttcgtggaatgcgggaacaggtactactccttacgaagtaacatttggacggaagccgttcaatttcccggaatacatcactgggacatccaacatcgaggcggtagaaaatttgttggttgacagagacgcgacttttcaaacaattcgcaaaaatcttctgaaggcacataaagtgatgaacagacaagctgatagtaagagacgtgaggtgcaatatcaaatgggtgattgggtccttcttcggcttcgtccctaccgacagacatccatgtga

SEQ ID NO: 52615 - DNA, 1305 bp, Glycine max
  Peptide Sequence Number=SeqID_169393
atgcagaagttcaaattgcttctagtgctattcttcgctacttgccactcctctttgtccatcacagatggacgagttcgaaggcggattcaagtcgggattaataatctcatctccaatcccgaacccaacttttgctgttggagaaaattcgaacccgactcctattccaatcaaaatcagggtgggtccggaacggacctcatggattcgggcccattgtcatgcctaacctcagttcttcttcacctttcaaaatgtttaagtttgttgccaaatggagacttcgaggttggtccaaaaccatcagagttgaaaggttcaatagtgactacccccaatggcattccacattggacaatctcaggaatggttgaatacataaaatcagggcagaagcaaggtgacatggtgctggttgtgcctcatggtacctatgctgttaggcttggcaacgaagcttccattaagcagaagatccaagttgtgaagggcatgttctactcattaacattcagtgcctcacgcacttgtgctcaagaggagaagctcaacgtgtcagtggtgccatccaatgagaagagtgattggggagtgtttcccattcaaactatgtatggaagcaatggttgtgactcttatgcatgtgggttccgagcagattaccctcgagtggaaattgtgatccataaccctggcgtggatgaggatcctgcttgtggtcctcttattgattctgttgccttgaaactcttgcactcacccaaacgaactagagacaatttgttgaagaatggaaactttgaagagggtccatatgtgtttcccaaagaatcttggggggttctaattccacctcacatagaggatgcctacagtcctttgccaggatggatggttgagtctctcaaggctgtgaagtatattgattctgatcactttgctgtgcctgaaggaaaaagagctattgagcttgtagcagggaaagagagtgcaattgcacaagtggtcatcacaataattggtaaggtttatgaccttacttttgttgtgggcgatgccaacaattcatgtgaaggttccatggtggtagaagcatttgctggtaaagatactatccaagtgcaatatcaatctaagggtaaaggagggttcattagaggcaagcttcgattcaaggctatgtcaacacgcacacgcatcagattcctaagcacattttacaccaccaagagtgacaacactggttcactttgtggacccataattgatgatataagattgcttagtgtgcgttattcttaa

SEQ ID NO: 52616 - DNA, 342 bp, Glycine max
  Peptide Sequence Number=SeqID_169394
atgaacaatctcaagagcaaatcacaccttactaaacaaaaaaggatgaacaacaacttacaaaataaatccttcattagaaatggggccttcaccagaaacagagttccatcaaatcatgctttcactggacctgggagaagagcaaattgtgacttagaggctaaagcaaagcgtgatctccaattgagaaataatattgtgattcgtgattgggggctgaagaaaatgacaacttcaaggctggatcaaattgagggtttggtgtggttttcacgagagtttaacatgttagaggtaaaggttattccattaaggaaagacacaatcaatgtatcttga

SEQ ID NO: 52617 - DNA, 516 bp, Glycine max
  Peptide Sequence Number=SeqID_169395
atgttgcggaggcttctctcttctcacctcaaaaccctagccgccaccgcttcttcttccactccccgatctgcttccgccgccgccagattcgccgctctctctcgctcctcccgctacttctcaacccagtccgaggatgctactgccatcaaaaagaaggttgaggatgtaatgccaatcgctactggtcacgagcgcgaggagcttcaggctgagctcgagggaaggaatattcttgaaatagaccatcccgaaggtccattcggcacgaaggaagcacctgctgttgtcaaatcttactatgataaaaggatagtcggatgcccaggaggtgaaggtgaggatgagcatgatgttgtctggttttggctggagaaagacaagccccacgaatgtccagtgtgcgcacagtattttgtttgtttttgtggggagagaatcaatgaatcattgtttagtatgtcttgttctgatacttttgacagttgtggagttgaatgccaagatatttaa

SEQ ID NO: 52618 - DNA, 822 bp, Glycine max
  Peptide Sequence Number=SeqID_169396
atgaaagacaagaagtgggtggcaaactttgagaaacccaagggtaatccatctgcatttcttaagccagcaacaactgttttatcaccttatctgaaattgttgtggcgagaattcttttacacggctgcttttgggactccaaattttgataggatgaaaggcaataggatatgcaagcagattccttggaaggatgatgataaactgctggaggcttggagggaggctaggacaggatttccttggattgatgctatcatggttcagctacgcaaatggggttggatgcatcatctggcacggcattctgttgcatgttttctaactcgaggcgatctgtttgttcattgggaaaaaggacgagatgtcttcgagaggcttctgattgattcagattgggcaattaataatggaaactggatgtggctttcttgttcatctttcttttatcagtataatcgtatttattctccaactacatttggtaagaagtatgaccctaatggcgactatattaggcattttctcccagtcttaaaagatatgcccagggagtacatttatgaaccctggacggctcctaaaagcattcagaccaaagcaaattgcataattggcaaagactacccaatgccagtggtttctcatgattctgcgagtaaagagtgcagaaggaaaatgggcgaggcatatgcattgaataaagaattaaatggtttggttagtgaagatgatctgaaaaatttgaggaggaaattagatgagagtgaagggcaagaggctggagctaaaagatataagcaacagctgattggctga

SEQ ID NO: 52619 - DNA, 233 bp, Glycine max
  Peptide Sequence Number=SeqID_169397
atggcgatgatgatcaccattgattgcaatccttcaattaaatctggaataaattctggaaagatggagagacattgtttagaatacactctggcctttcaaaatcctgtggcctatgatgctcatttgcttgagctaccaattctgttagacaatgcaagtgaagtagagacagaattgaatgacaacttgttaatctttggaaataatttaggtgtgagcgtaatggcgag

SEQ ID NO: 52620 - DNA, 600 bp, Glycine max
  Peptide Sequence Number=SeqID_169398
atggcgacatccttgtcaaacatgttcttgaagggaatcgcagctcgttctctcagcagacccttaaatgggttgttttattgcacaagatactcgactactgtgtcaaatgattctgacacgcatgatgacttcaagccagctaataagcttgagaattctggcatttctttgtcaaatgttattgagcaggatgtcaaggataatcctgttatggtttacatgaaaggtgtgcctgattttccacaatgtggatttagttcgcttgctgtaagagttttaaaacactatgatgttcctattagtgctagaaacattttggatgatcctgaccttaaaaatgctgtaaaagccttcagaaatagaagccatcttgggcctatgttagaccctctcgtctctgaacatctgagccacaggcttgccaaatctctggaaactagtcagcctgcaaatgtctacgcatgtttgtgtaactggccaacatttcctcaaattttcatcaagggagagtttattggtggatcagatattgttctcaatatgcaccagactggtgaattgaaggaaaagcttaaagatattacttccaagcagtga

SEQ ID NO: 52621 - DNA, 192 bp, Glycine max
  Peptide Sequence Number=SeqID_169399
atggtgaaggacaaattaaagaaacatgttctcactgctttcactcctaatggggattatgtggctattctgtctgccaatgaggtggccaagattgattgggatcatagacatgtggtggtcctggaccatgtagtaattcctccttcacttcatgttttcataagaccaatttcgctaaatggtacctga

SEQ ID NO: 52622 - DNA, 768 bp, Glycine max
  Peptide Sequence Number=SeqID_169400
atgatagtttccttggtccatttggaaggtagtagaactgctaggagaagcttggagtttgggaagacacatgtggtgaggccaaaaggaaaacaccaagctactatagtttggctgcatggtcttggtgacaatggtttgagctcttatcagctgctggaatctcttccacttccaaatataaaatggatttgcccaactgctcctacccgtcctgtaaccatacttggtggtttttcttgcactgcatggtttgatatgggagaactttcagaagatggtccagatgattgggagggtttagatgcctcagcatcacatattgccaacttgttgtcaacagagccagctgatgtgaaagtaggaattggaggcttcagtatgggtgctgcagtagctcaatactctgcaacttgttttgccatgggaaggtatggaaatggcatcccttaccctgtcaacctaagagcagttgttggactcagtggctggcttccaggatcaaggagcttaaggaacaaaattgaagtgtcacatgaagcaagaaggcgagctgcttcgttacctgttttgctgagccatggaatcagtgatgatgtagtcctctacaaatacggagagaaatcagctcaatccttaagttcagcagggtttcgatacattacattcaaatcctatgatgggcttggtcattataccgttcctagggagatggatgaggtctctaattggcttagctcaaggctggggcttgggggatccacatga

SEQ ID NO: 52623 - DNA, 492 bp, Glycine max
  Peptide Sequence Number=SeqID_169401
atgagcaggccaggagactggaattgcaggtcgtgccagcacctgaactttcagaggagagactcatgccagcgatgtggggactcaaaatatggagatagagttgttgattttggtggttttggaggaagaggagggtcctcatttggtttaactggctcagatgttcgccccggcgactggtactgtgctgctgctaactgtggtgcacacaactttgctagccgctcaagctgcttcaagtgtggtgctttcaaggatgacttggctggaggaggctataacagttctgacatcttgcgctccagagcttttggtggcagtggaagacctggatggaaatctgatcaggatgcaatgagcacaactttgctagcagaatggaatgttttaaatgcagtgctcccagggacacgtactagaaaaaatgagtttatcctagcaagaaaggctacattaattaatggagatgctgcaagatttctttattaa

SEQ ID NO: 52624 - DNA, 756 bp, Glycine max
  Peptide Sequence Number=SeqID_169402
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggactcaaagcatgatagcacgcagagactaacatcgtcttctgcgtcttgtcgccaagtctcgatcgcgtccaaagacacacaaagacaaattatggtcattctgcgccttttgtcatccagaggcggcgagcccgatgacatgtggagacaaattgtggtcattccgcatacctttttgtcattcggagacgatcgagtccgatggcacgcagagacaaattatagtcattctgcacctttagtcatccatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 52625 - DNA, 498 bp, Glycine max
  Peptide Sequence Number=SeqID_169403
atgaagaccgacatggaagccatgaaggagaagataacaataatgatggaagcaatgatgagcatgaggaagatgatcgaggttaacactgctacagttgtttttgcgagtactgccactacgatggactcgattcaccccaagcatttccttccaccatatggttttcctcccaattatacaccacccactgttgtatacgctcctgggcctcttgctataattgagaaggaaaaatttgatcacatagaggaaaggctgagggccattgaaggaggaggaaattatgcctttgctgacatggcagagttgtgcttggtaccagacgtggttattcctccaaagttaaaggtgccagattttagtaagtacaagggaaccacttgcccagagaatcacttgaaaatatattgtaggaagatgggggcgtatgcaaaggatgaaaagttattgatgcatttcttccaggagactcttgttggggcagctattacctag

SEQ ID NO: 52626 - DNA, 648 bp, Glycine max
  Peptide Sequence Number=SeqID_169404
atgagcattgagcagatgagagttgtttgtgagggagcgaaagctcttggaatgaagctggttggagataatttcatcggctacaagttctgcgacggacgggataacttgcgcgatgcagctaatgaattgcttcagtcatttttccctggggaattgcttcaggatgatgagcacgaatacacgcagcgcgtttattttcttggcgaacaccgtgatgaagattacagccatgcaagatggtgcggaaatgactacgcttcaaaaaacaagaacagcaaatattgcagccgaaaatgtctatgggcagcaaattcaaatcgcgtcccatacaacaaaggagcgggcaaaggatggactgataggcgcgggtacagatggataaacgtcattatcaatggaaaatcggtagccaagcgcgaacacaggcatgtcatggaaaaacatcttggtcgaacacttagccctgatgagcttgttcatcataagaatggaataaaaactgacaacaggattgaaaatctggagttgcaggtttggtcagagcataccgcgcatcatcacgaaaactcatccagacctgatctaactaagaagaagatgcaagttgtagctaattacagatatcagttagaaagggaaagagag

SEQ ID NO: 52627 - DNA, 438 bp, Glycine max
  Peptide Sequence Number=SeqID_169405
atgacacctactaggcaccctctggacctagagaagtccaacagggccctggggtttccggctctaatcacgggcctctgccagtcctacggagttcctatcacccccagcaaggtaatccgaccgccgatcacccgatccttcatcgagaagtactgcatgcctaggcagacgcagggtgacgcacatcaggacgcgggcgcaccgccaccacctcagcaggccgattcggatgggccactgggcgtggagtgcctcaatcaacaggggcagggttccgccccttttgtatgccctaccctggaacagtttggggctgaggtcgcatggcctggagactggcctgatgcccaggcaggggaggagcctgcaggatcccccggtgaggcggatgaatcccgtatggatgaggatatgactgacctactcggtttctag

SEQ ID NO: 52628 - DNA, 138 bp, Glycine max
  Peptide Sequence Number=SeqID_169406
atgggtgcaaaggataaatcaatcatgcacaagtcgttctctcatcgacttatggctaatgagtaccttcacaatcaaactgacaaactggctaacattttcagtcatacttctaattacatgctcattctcttctaa

SEQ ID NO: 52629 - DNA, 624 bp, Glycine max
  Peptide Sequence Number=SeqID_169407
atggcttacattcttttgtatgtggatgatattatcttgacagcttcttttgatgctattcgcaagtctatcatatcccttcttagttcagaatttgctatgaaggaccaaggatcgttgagttatttcttgggtatagctgtaactcatcatgcatgtagtctattcttatctcaacggaagtatgcaatagagatcattgaacgagctgacatgtcatcttgtaagccatctcccacttcagttgacacgaaaccaaagctcaatgctaattccagcacaccatatgccgatccatctcattatcgaagccttgcaagggcttttcaatatctcaccttcatgagaccggatattgcttatgctatgcaacaagtgtgtttattcatgcatgacccgagggaagaatacatatacgctctcaagcgcattgtgcactacattcaagatgctgattggggtacatgcttagatgctagatgctccacatcgagttattgtgtgtttcttggtgataatttaatttcttggtccgctaaacggcaagctacgttgtcacgatctagtgtggaggcgaaataccgaggcattgctaatgtgacttctgagtcttgttggttatga

SEQ ID NO: 52630 - DNA, 510 bp, Glycine max
  Peptide Sequence Number=SeqID_169408
atgacaaaggtcccatttatttgcagtgttccatgtagatttggaatttgtcagacaccattagaagtgacatcttctcagtttattgcaagtgagttcttccctcttttaatagtgaagactcttctctaccctggagctcttgcagaggcaatttgcaagcagaaaaccatcccaagctacagaaatcttctaaacttgcaccagttcaattcaagggcagtctctgctgcatcagatctccaacgcctagaggttctgggaggaagctacttgtctgtgggaggagcaatcacaagtctgataaaaccagggagaatgagcctttttagaatacttattcttatgtggggtctgattagagagtccattaagggaaaatctggtttagctcatgcaaaagttatccacatctattcagccctgtatattgcactaatctcagcattcttctccattagaaaggatgtccgaaagataattcgcacttcactcgaaagcacgttgtga

SEQ ID NO: 52631 - DNA, 240 bp, Glycine max
  Peptide Sequence Number=SeqID_169409
atgactgactccaacaaattctatccaactcttgttgtctccaacatcaagaactatatctccatcaccctagagatggaaaacgtccaatatgcaacgtggggggaactgttcaagattcatgcactttctcacaatgtcctccaccacatcgtcccaccgaagaaaggcaaggagaaggtgcctaaaatcgatgaagaaaaggaactatggttgacctttgatgctacgatcctttaa

SEQ ID NO: 52632 - DNA, 351 bp, Glycine max
  Peptide Sequence Number=SeqID_169410
atggatggtttgcaaagatctgaggtgtctttcaggagacagggttcatcagggcttgtttgggacgacaagttattgtcaggggaattgaacaaagtgaacaacaacgaagaccaaaagggtggtggttctggtggtgaccttaaccttaaagttagaactacaccacccaacaccaccatccagagaagccgctccaacggcggctaccgcaccggaaaagtctcgccggcgatcgagcctccctctcccaagctctctgcttgcggcttctgcagcgctttcgggaaaacaagggaaaagggccgtgctaagcatcgatcaaggaattttgatctctgtacaaagtaa

SEQ ID NO: 52633 - DNA, 549 bp, Glycine max
  Peptide Sequence Number=SeqID_169411
atggaggccctgcacttgcaccgcgtgcttctcatgcctgtttcccaaaaaacctcaatctttttgcgcgccagtggcaccccattatccacacttgcaaggccaccattgcgttggagctctcaaacttgcagtgccagagcagggtggtttttgggtcttggagcagacagcaagaagaccaatttacctgataccgtcaaagccggtgaccccgttctgcacgagccagcccaggatgttgatcctaacgaaataaagtcggagagagtgcagaagattattgatgacatgatccaggtcatgagaaaggctcctggtgttggtcttgctgctccccagattggaattcctttgaggataattgttttggaagatacaaaagagtacattagttatgtctcaaaggaagaggctaaaactcaagatagaagaccttttgatcttttggtctgttactttaatacatcattcattagttctcttgaggcaggtgatcctgaatcccaagctagagaagaagggcaagaggactgctctgttttttga

SEQ ID NO: 52634 - DNA, 306 bp, Glycine max
  Peptide Sequence Number=SeqID_169412
atggctaaggtttcgtatgcttcagaaattggaagttttatgtatctaatggtttgtatgaggccagatattggccatgcagtgggtgttgttagcaggtttatgtcaaatccaggtaaagcttattgggaagcacttgagtggattttgagagcttctcctccggttgctctattaggattcccatatgttagagacaaggagaaaggattgaagcctccatttcatggtcctacgtgtgatgcatctttctctgttaccaggtattcttttgtaaatcccaatgttgaaggtgtgcggaattaa

SEQ ID NO: 52635 - DNA, 240 bp, Glycine max
  Peptide Sequence Number=SeqID_169413
atggctgcagaagatgtaaagcttttggaagatgcaaatagaagattatttaacaaacccaagggtatgaaggatgaagattgggctctactcgacagacaagccctcagagtcatatgtttgacgttatcctgcaatgttgctttcaacattgcaaaagaaactacaatatcgagtcttatggcagctttttcagcatgtatgaaaagctgccaacctcaaacaaagttcattttatga

SEQ ID NO: 52636 - DNA, 462 bp, Glycine max
  Peptide Sequence Number=SeqID_169414
atggtgaaaggaatggacccagagagtttatttttaaaaaggcgcatggcttccaaattgaccaagttgcctatggaagctgggattggtccagttagttcattcaaggatatatataatccactaagctttgacaaatttccaatggtgaaaggaatggacccagagagtttattttcttcaaggagcaaggagtccaaatggaccaagttgcctatggaagctgggattggtccagatcatggagtccaaattgaccaagttgcctatggaagctgggattggtccagaatggacccagagagtttattttcaaaaaggcgcatggcttccaaattgaccaagttgcctatggaagctgggattggtccagttagttcattcaaggatatatataatccactaagctttgacaaatttccaatggtgaaaggtatggacccagagagtttattttcataa

SEQ ID NO: 52637 - DNA, 1518 bp, Glycine max
  Peptide Sequence Number=SeqID_169415
atggtgttcatatttccaacgcttctgtccatgaagctccaaccacttttgctgcttcttgtgatgtacttctgtgcatttgctgcttcttctgagattgcttcagaagcaaatgctttgttgaagtggaaatccagccttgacaaccaaagtcgtgcttctctctcttcatggagtggcaacaatccttgcatttggctcggaattgcatgtgatgagttcaattctgtttccaacataaatcttacaaatgttggattaagaggtacgcttcaaaatctcaacttctcattacttccaaacattctcactctaaatatgagtcacaactccctgaatggaactattcctcctcaaattggttccttatccaatctcaacactcttgacttgtccactaataacctctttggtagcattcccaataccattggtaatctctccaaactcttgtttcttaatctttctgacaatgatctctctggtactattccttctgaaatagtacacttggttggtcttcatacattgcgcataggtgataataatttcactggatcccttcctcaagaaataggtagattgatgaatctgagaatacttgatattcctcggtccaatatctcagggactatcccaatctcaatagaaaagttaagcattttgtctcatctagatgtcgaaagcaacaacctttctggcaacattcagctgagaatttggcatatgaacctaaagcatttgtcatttgctggtaataacttcaacggttccatccccaaagaaattgtgaatttgaggagcatcgagactctctggctttggaaaagtgggctttctggctccattcccaaagaaatatggatgctgaggaatctaacatggcttgacatgagccaatccagtttcagcgggtctattcctcgtgatattgggaagttaaggaacctaaagattctacgtatgtggaaaagtggcttgtctggctccatgcccgaagaaatatggacgttgcgtaatttagaacaacttgacatacgcatgtgtaatcttattgggtcctttcctatttcaattggagcactggtcaatctaacacttataatgctacacgaaaacaaactttttggtcacattcctcatgaaattgggaagttggttaacctccaggttctagatctcggaaataataatctttctggcttcattcctcctgaaattggttttttgaaacaacttgatcgacttgatttgtctgataactttctctctggtgaaatcccctctaaaattggagcactggtcaatctaacacgtataaggctacacaaaaacaaacttttaggtcacattcctcgtgaaattgggaagttggttaacctccagaatctatatctcggaaataataatctttctggcttcattcctcctgaaattggttttttgaaacaacttgctcgacttgatttgtctgataactttctctctgcctctctggagcaatcccatcttccatag

SEQ ID NO: 52638 - DNA, 189 bp, Glycine max
  Peptide Sequence Number=SeqID_169416
atggtgtacaatttattgagaaagattcaagcaaagacagcatatgctaaatcttgccttctgaaggatgctcaaatcctgaatctacaatggctcgaagaagctctggtttcaacaggaagtctcgaaatcccgaactatggatgccaacataacccctgcaccacaaaaaatgtacatgcgaaatga

SEQ ID NO: 52639 - DNA, 1335 bp, Glycine max
  Peptide Sequence Number=SeqID_169417
atggtcgttttctctgtgaaacttttcttcagcattctcgtcgtctccctctcactcctcttccttctcgcactgctattgccttcttcccttttctctcaaattcacatttatggagaagcctccttaggggaggtggatatatggagtgttcggagactcgtggaatggagaccttgcaattggtggctacaaggccatcaaacagaaatgtctgtgtggggattcgaacccacgacctctcctcccttcatccttctccaaccaatggaccttatatctcccatagggatagctattggtgtcatactctaccattacaaactaatggatatatcagagtggattgctatggggggctcaatcagatgcgaagagattggttttgcagatgtatatgatgtagactactttataaagcatatgaatggctttgtcaaagttgtaaaagagttaccaccagatattgcttcaaaagaaccagttcgaatagactgtagcaaacggaaagggcaatttgattattttgaaagtgttcttccttctctgttgaaacacaagtacatttctatcacaccagcaatgtctcaaagaagggacagataccctttgtatgcaaaagctgctctgtgtcaagcttgttacaaggcattgcgtctcaccagatccttggaaatgaaagcctctcagcttctagatgcaatacctaaaccatttttgtctcttcatcttcgttttgagccagacatggttgcttacagccagtgtgagtacccggacctgtctcctgcttccattaaagccatagaagcagcacaagtggacagaaaaccatggactggagagttagcccgtgtttggagactacgtgggaaatgcccacttacacctaacgagacagctttaatacttcaatctctttccatcccactaacgacaaatatatacctggcagctggagatggtttgatggaaatcgaagggttgatagatacctatgccaacatagttactaaatcaagtcttctcagtagagaagacttcacaagcatgcatggcaacacaaaagctgctttggattattatgtatctattaacagtgattcatatatagccacatattttgggaatatggataagatggtttcagcaatgagagctttcaatggtttgtacaagactctattttttagcagaagaggttttgcacaattaacctcacagggtcttaatggaaaggagttgaagcaagcactatggaagcttcacagagatgattttgcaaagggaagaggctctgctctgtctgagtgtttttgcgaattcaagttgtga

SEQ ID NO: 52640 - DNA, 1191 bp, Glycine max
  Peptide Sequence Number=SeqID_169418
atggatgtcatttgccaagcgaaatctgggatgggaaagactgctgtttttgttttgtctacacttcagcaagttgatcctgttcctggtcaagttgcagctcttgttctttgccacacaagagaactggcttatcagatttgccacgaatttgagaggttcagcacatatcttcctgatataaaggctgctgttttctatggtggtgtcaacatcaaggttcacaaagaattgctcaagaatgaatgcccacacattgttgttggaacacctgggaggattcttgctctggctagagataaggaccttggtttaaagaacgtgaggcattttatacttgatgagtgtgacaagatgctcgaatcacttggtctctttcttcctcctctctggaaatttgcttatatgagaagagatgtgcaagagatcttcaaactgactccccatgataagcaagtgatgatgttttcagctacactcagtaaagagatccgaccagtttgcaagaaatttatgcaagatcccatggaaatttatgtcgacgatgaggccaaattgactcttcatggtcttgtccagcactatatcaaattgcaagagacagaaaagaatcgtaagctgaatgatcttcttgatgctctggatttcaaccaagtagttatttttgtcaaaagtgtcagcagagctgccgagttgaacaagttgcttgtggagtgtaacttcccatctatctgcatacattctgcaatgtcacaggaagagagattgaaacggtacaagggcttcaaagaagggaagcaaaggattctcgtggcaacagatttagttggaagggggattgacatagaacgtgttaatatagttattaactatgacatgcctgattctgctgatacttacttgcacagggtgggaagagctggcagatttggcacgaagggacttgcaattactttcgtgtcctctactgctgactctgaggttcttaatcaggtgcaatctaggtttgaggttgacataaaggagcttcctgaacaaattgacacttcaacatataatagattgcacgtggaggaagtgcgatttctcgtgcactttttggctgaagtaattctcccccttcaatgtatgtatcgttgtttgaggtgggaatttggtttggtgacagttaaaaacgagttaggtcagtag

SEQ ID NO: 52641 - DNA, 381 bp, Glycine max
  Peptide Sequence Number=SeqID_169419
atggaagcaatcacagagggagtgaacaacatcaacatctctgattcttacaagaagaatcgcattcaggtctccaacaccaaaaagcctctcttcttctacgtcaatctcgccaagaggtatatgcaacagcataatgaggttgagctctcagcactaggaatggctattgctacagtggttactgttgctgaaatcttgaaaaacaatgagcttgctattgaaaagaaaatcacgacatcaacagttgacatcaaagatgattctagaggcagacctgtccaaaaggccaagactgaaaaatttgatgagttgatggcggctgctgctgctgctgctgaagatggtgaaaatggagatgttgaagagcacactgcataa

SEQ ID NO: 52642 - DNA, 153 bp, Glycine max
  Peptide Sequence Number=SeqID_169420
atgggagaattgaaggacactgaggcttacgaggaagagctcatcgactacgaagaagaagaagaaaaagctcccgattccgctaaacccgttactgaatctggcaagaatttttttggtgccattcattgtttgtcatactttcactgttaa

SEQ ID NO: 52643 - DNA, 498 bp, Glycine max
  Peptide Sequence Number=SeqID_169421
atgatccttgcggtgctgtttgccaacgctgagggcaatatcctcatcgaacgttttcatggagttcctgcagaggagcgtctgcactggcgttcattcttagtcaaactaggagctgataatcttaagggtgtcaaaaacgaagagctcctagttgcttgccacaaatcggtttatattgtatacacagtgcttggcgatgtcagcatctatgtcgtgggcaaggatgagtatgacgaacttgcctcggataggctccctgcttttcactttagtttgatggaagtgctgactgagaaggtgtccgaagtgatctttgtgataacctcagctgtgaaggatgtatgtgggaagcccccaagtgagcgccttttccttgacaagtatggaagaatttgtctgtgtctggatgaaattgtatggcagggatatttggaaaatacagaaaaggatagaatcaaaagactgataaggttaaagcctccaacagagttttga

SEQ ID NO: 52644 - DNA, 519 bp, Glycine max
  Peptide Sequence Number=SeqID_169422
atggcggctgataccagcagcagcgcgggttccaaaatcgatagttctatgaaaaaagtcgatggctttatggatgacagcggcatcaccgccaaagccaaagccgcgctggtggacgatgaagcgattaaaagtacggatatctcggtaaaaacgcagcaaggcgtcgtgacgctgagcggttttgtcacctcgcaggaccaggccgagaaggctgtggcgctggtgcagaaggtggaaggggttaaatccgtcagcgacaaactacacgttagagacagcaaacagagttcattgaaaggttatgcaggtgatgcagcaaccaccagtgaaataaaagctaaacttttagcagatgacattgtgccatcgcgcaacgtgaaggtggaaaccaccgatggcgtggtacagctgtccggggaagtggcgaatcaggcccagtccgatcgggctgagaagatcgccaaagccattgaaggcgtgaaaagcgtgaagaatgacctcaaggtgaaatcttaa

SEQ ID NO: 52645 - DNA, 525 bp, Glycine max
  Peptide Sequence Number=SeqID_169423
atgggaagaaaagataaagaacttaggggaagtagcaatggtgtcataggtggctatcataaatggttgaaatctagaacgcaagggatgacttggctccaaaagctaaagggtttgagtgcagaaaaggctaaaatgcctgagaagagtgaaaaggtgcaagccttgaaaactgagctcaaaaagataaaagtagcaaaggagaagctaaaggtggcagtcactagggttaggaaagaatgtgatgagctaaaagatatcaacatgatcgcagctgaagtgctagagcgggaaacgaaaagggccagaaaggaagagtggagtagaaacaagtttcaaggggatttgttaggtagcagtaatgagcttaaacttagaaaatccgagagggaaaaatcaaggatggaaagcatgatgttagaggataagttaaagagttttcagaggtcaaagagatgtttgacagagcagttaatcattcatcaatataaagagaaggtgaacctagctgctagtcacaggtag

SEQ ID NO: 52646 - DNA, 144 bp, Glycine max
  Peptide Sequence Number=SeqID_169424
atgggtgggcgaactcctagagaggtcaaggttaatgcataccttatcgaggtctccctgaatagtcaggtcatagagtatgactatgttaaggaatggagcacatcgctaagaggtgacccgtgtctttcagagactttatga

SEQ ID NO: 52647 - DNA, 166 bp, Glycine max
  Peptide Sequence Number=SeqID_169425
atggcaactcaggctgatgaaggtagagctgaagagaaagtggagggatataaacaacagctggcaactgagccggcactggaaccagtttctgatcttattgaacttgaggaagttgtggaagataaagatgaccaacaggagagagagacacaaataaaagaaa

SEQ ID NO: 52648 - DNA, 549 bp, Glycine max
  Peptide Sequence Number=SeqID_169426
atgaaccctaaaatttcagattttggtatggctaggacatttgagctagatcaacatgaagcaaatacaactagaataatgggaacatatggttatatgtctcctgaatatgctgtacatggatctttttcagtcaaatctgatgtttatagctttggagtgattgtgttggagataataaataggagaaagatcaaagaattttgtgacccacatcatgacctgaatcttcttgggcatgcatggagactatggattcagcaaaggccgatggaacttatggatgacttagtggacaattcagctagtccatctgaaatattaaggcatattcatattggtttgttatgcgtacaacaaagacaagaggatagaccaaacatgtcatcaatagttttaatgttgaatggtgaaaagttgttgcctgagccaagtcaacccgggttctacacgagaattgatcatgcacccatgagagaatcttctgcaagaaatcttgaagcattttcccttagtgaaatgtctaactcagtgttggaggcaagataa

SEQ ID NO: 52649 - DNA, 423 bp, Glycine max
  Peptide Sequence Number=SeqID_169427
atgtaccagagtaggtaccgggccaggcagtgggttgctgcagctcggacgcacctacttcatttggttggttgcactctttttgctaacaagagtgcaacccatgtccacgttgtgcacctacaggaattcagagacctgggccaggcaggggcattctcttggggagcggccgctttagtccacttgtacgatcagcttaatgaggcgtcgcaggcccctacacggcagatggctggttacatttcactacttcagtgttggatttacgagcactttccatcagtccacaggtctgttgttgatgatggttatgctgaggctagcccacgtgcctgtaggtggcttacgagtaaggcccagatgaccgggattaagggagccccttacagagcacgtattgatgccctgacagtgaccaac

SEQ ID NO: 52650 - DNA, 678 bp, Glycine max
  Peptide Sequence Number=SeqID_169428
atgaactctatcgataaaaatccatcgccccgcctgcgccaacagcgcgccgccatcgacggcgccatgagccgcgaccggggccgtttgctgggaatgctctcgcgttgccaggccaagccacaggatgcggcactggccgctactttcgagcaggccttgcaggcgtcggtgcagcgccggatgacgcgggcgcaacagcagccgtccattactctggacccgcagctgccgattgcgcgtgaagccgacgcgatcatcgggctgatccgcgaccaccaggtcgtggtgatcgccggtgaaaccggttcgggcaagaccacccagctgccgaaactgtgcctggccgcaggccgtggccaggccggcatgatcggctgcacccagccgcgacggattgccgcacgtgcggtggccagccgcgtggcgcaagaactgcagagcgaactgggccagctggtcggctaccaggtgcgcttcaacgacaaggtcagcgaagacagccgcatcaagttcatgaccgacggcatcctgctggcggagatcgccagtgaccgttggttgtcgaactacgacacgatcatcgtcgacgaggcgcacgaacgcagcctcaatatcgacttcctgctgggctacctgaagcagctgctgcgcaagcgcccggacctgaagctgatc

SEQ ID NO: 52651 - DNA, 558 bp, Glycine max
  Peptide Sequence Number=SeqID_169429
atgacaacatactacggtgttggtggccttggggaaaatatggtgagtgttgacaaagttatagaaggtgacgctgaagtgcccttcccgacatcagagattcaatatgtcaagcaggctcttcaaacattcattgcatggccaacaaatcttgtgaaaaaagtgtcacatgaggagtcccatactagtccaatgaaacttcctgaaatagatgaaagggggacgaatgattttgaagatgatccattgcgtcaactgattaagagcctatattacatgtttttggatgagtggagctcaactttgggtcatgcttccgtgtatggattccttgagccacaatcgatacacgatgcaaaggaccgacgtgctgaatgtgagcattacttacaggcatggctcaaggaatctcaacgagaggggccattggcaactggtagtactgtgtcctgtgaccaatgttgttgcatggttttgttcgttactgcaatgaagacaacaaacacaactgcgaatggtacaaataatcaaccaactcctaagtggagtgaagtcaag

SEQ ID NO: 52652 - DNA, 1889 bp, Glycine max
  Peptide Sequence Number=SeqID_169430
ctgggtgccatgcccggcattgatggaccgcgtaagtttgcgctcaacggcgaagcgccggtggcgcaggcgcggcagacgccgcaagggcaaacgccgctgctgtcagtgaagaacctcagcacgcgcttcagcattcacgaagggctgttcagccgtaaaaccggtgcggtgcacgccgtggagaatatctcgtttgatctgctgccgggtgaaaccttgtcgctggtcggcgaatccggctgtggcaaatccaccaccggccgctcgctgacgcggttggtgcagccgaactccgggcagattgcttttgacggcagcgacgtgctcaccctctcccggcaagaactgcgcaagctgcgctgcgccatgcagatgatttttcaggatccgtttgccagccttaacccgcgtatgtcggtcctggaagccctcaccgaaccttttttacagcatcggctgggcagtaaggccgctgcacagagcaaagcggccgaactgatgacgcgcgttggcctgcccgcaaccatgctgaaacgctatccgcacgaattttccggcggccagcgtcagcgcatctgcattgcccgtgcgctgatgctcgatccgaaaatgatcattgccgacgagtcggtttccgcccttgatgtcaccgtgaaagcgcagatcatcaatctgctgctcgatctgcaacacagcctgaatctgtcgtatctgtttatctcgcatgatatggcagtagtggagcgcatcagccatcgtgtggcggtgatgctgctgggagagattgttgagattggaccgcgcgcgtctatttttgagaatccgcagcacccatacacacaaaaactgctcgcgtcggtgccattgcccgatccggcgcgccgccatttaaaacggcacgtggacgtcagcgagctgaagagcccggtgcgcgccaatgggtttgtgccggaaacacggcattatcaggaagtgagcgccggacactgggtgatgcggccagacaccacggcgaaggaaatcaacgtgacacgtcataaccattatggtcagcccatcggttttgccttaccggactggcaacccgccagctatccgccagcagaaaatctgtcagggcgcttttgtcagcttgcgccattgcagttgagccacagccaggcgctgtttacggcattttcactcgccccagacgatcgcgactggacctggctgggcgtcagccggccacagtcattgattgagatggagagctggattgagcataaaatcagcgatcgccagctggtgtgttatgccgtcatggacaggcatcagcgtgccgtgggcgtggtttgttttgcaagtattgatatgcagaacggcgcgatagaaatcggtcacatcacctggtcaccgctgatgcagcgtaacgtcatgggtacggaagccttgttcctgttgctgcgccaggcatttgcgctgggctatcgtcgcgttgcatggcgctgtgattcgttaaacctggcttcacgccgggctgccgagcgcattggttttacctttgaaggacgcttccgccaggccatgacgcgcaaacagcgcaatcgcgataccgactggctctcaatgattgatggtgaatggcctgttgttcagcaggcacttacagcctggctggcaccagacaatatggatgataacggggcggcggtgtcgctgccggtcatgccggtcttcagtcgcgtgccggcgctggataattttatccagcaacaccgctggcatcatgccgccgataatcacgctctcggcatcaaagatacactccagcatgttaataccctggcgcagcggcgtaagtacggtatcgatccagcgatcaaacagtgccggatcaacctgca

SEQ ID NO: 52653 - DNA, 498 bp, Glycine max
  Peptide Sequence Number=SeqID_169431
acttatcaaggtaatccttgtggcgtctaccctgacttatcttccttcactggaagtggcgtctacccagacttatcttccttcaccggaagtggcgtctacccagacttatcttccttcaccggaagtggcgtctaccctgacttatcttccttcaccggaagtggcgtcatccaaaagctctacagcctgtatcaagcgatccgccccacttatcaaggtaatccttgtggcgtctaccctgacttatcttccttcactggaagtggcgtctacccagacttatcttccttcaccggaagtggcgtctacccagacttatcttccttcaccggaagtggcgtctaccctgacttatcttccttcaccggaagtggcgtcatccaaaagctctacagcctgtatcaagcgatccgccccgtaagattcacatcatctggtatcagagctttggctcttgatacaggttctatcttattctattatttttctttgtaa

SEQ ID NO: 52654 - DNA, 276 bp, Glycine max
  Peptide Sequence Number=SeqID_169432
atggcacacagcgtgcttgctccgtgcccctattttaggaacctacattggagagagctaaaggggctttttagtgataattcccaaggtggtcttatctctcttgatggtctctggagtggagtcgccaactgtcgcaacctacccttcggcgggagggtgacgcgagactcacgggtgcgtgttccaaaaagggaatacgcgcagagtcgccaccaacatttatttgaggaaaacgtcagaaaaaccggaaaagacgtggtctacgaactttaa

SEQ ID NO: 52655 - DNA, 210 bp, Glycine max
  Peptide Sequence Number=SeqID_169433
atgaaggaattgttactggggtctttaagtgagaaaagctgtgatttgcttgggaggattgatggggacccggtgttgagagaaacgaggatatgggctacgtgggagtacgtgagctcagatggaggtgggcaacaggggatggtgggtttatgtgcgctttgtggatgtggaaaacttgttgtgcaccatcgcccgaccgccacctag

SEQ ID NO: 52656 - DNA, 279 bp, Glycine max
  Peptide Sequence Number=SeqID_169434
atggagaatgaaaggttaggggaatgggggagagagcatgaagatgaggaagaacttgagggaataaagggaagacattggaaagaagaggaaatgagggtcaagtcaagtttctatagagtaaatggtgcattaccaacatgtaaaattcctcttttgcctactcaccaaatttttctcaaccctcttgttccccacattcaaaccgaacaaccccacgatgatcaaccctcatcatcgaactaccttgatgaggttcgtgctggatttatggcctag

SEQ ID NO: 52657 - DNA, 749 bp, Glycine max
  Peptide Sequence Number=SeqID_169435
atggcgatgcagcacgaagttgagcaccatcggatagccgagcgccttgaccgccttagccatggccagcttctgctgaaacgccttggcggagcccgccagcgcggcgttcagcgtttcatcgctggcctgaaaactgatctggatatgatccagcccggcgtcggcgaaggtctgcagcttcttctcggtcaggccgatgccggaggtgatcaggttggtgtaaaagccgagcgcgcgcgcggcggcgatcagctcgggcaggtctttacgcaccagcggctcgccgccggaaaaaccgagctgcacactgcccatcgcccgcgcctggcgaaacacctcgatccactgcgcggtggtcagctctttttcctgcgcggcgaaatcgagcgggttggagcaatacggacactgcagcgggcagcggtaggtcagctccgccagcagccagagcggcgggttcaccgccggcgcgcgagcttcagtcacggaaggtcacccatttttgttcgcggtagccgcgacggaagacgggggtgtgttcagggttcagcgtcattacaccagcctctggttgtgccatacccgcgcggtggtcacgctgtggtaaggcgggcggttcagggtataggccatgctcatggcgtccagcatgctccacagaatgtccagcttgaactgcaggatctccagcatgcgctgctgtttttctacggtgtcgcaatagtccagcgccagcgccaggccgt

SEQ ID NO: 52658 - DNA, 2292 bp, Glycine max
  Peptide Sequence Number=SeqID_169436
atgggcaacggcacttctcgtgttgttggctgtctggtgccatttaatggcaaaagtggggttgatttggagtttctagagccattagatgaagggttaggccattccttttgttatgtgaggccatctatttttgaatctcctgccattaccccatcaaactctgagaggtttactgttgattctagtacccttgattctgagacattgagtggttcgtttaggcatgagagcattgaagagaggcctggtaagaatgttgcggaaaccacgttcaaaacaatatcaggggcttcggttagtgccaatgtttccactgccaggactggtaaccagaacgcattactagctagcgatgttctggagcctgctgcatcgtttgagggaacctcgtcgttcgctgcaatccctttgcagcctgttccccggggttctggacctttgaacggtttcatgtcgggacctctggagagatttgcttccggtccgttggataagggcggcggtttcatgtctgggccgattgagaagggcgttatgtcgggtcctcttgatgccactgataagtccaacttttcagcaccacttgcccgtggtcgtcgaaggccacacctccagcgcctcatgagaagtgtaagtggtcctatgagaaacactttttctcggactttttcgaggcactccatgggtggcagttgggtgcagcgattattccttcatccggtgtctcaactagcttggaattccaaagaggcaaagtttcgaccggaagtttctagaaactgtgctgaagttggatcgtccgaattggagtataaacatatacaaaatttgcagtgggcacatggtaaggctggtgaagatagggttcatgttgtgctttctgaagaacaagggtggctgtttattgggatatatgatggttttagtggaccagatgcacctgattttctgatgagtcatctttataagttcatagacaaggaattagaaggattgctctgggattatgaggataatcccgttgatccacttaaacctgaagtccttgaaaatggaaatgatgtagttgctctagaatgtggtagggaggaaatgtcagatgctcatagcatttcaaatgaagaaagttcttgctgtttagaaaattcttgtcccataatggtcaaggatcaatcatctaatagtgagatagtggaggtaaatgctgaagttaaggtaaatattgaacagaaaaattgtggaagtcccagtattgtacatactgttcctgcatctgttccaattggacaattgagtggtcaaggcagaagaagtgtgcgactttatgagctacttcagatggaatcttggaatgaacaggtgtcagaacaaggcaaggattctgtggttcctgcggaaatagcacaagagaggcagatgagattctgctcacctgatggtaaagaggatagatctagacatccagatgaaggtcccactacttcgggggaaaatggaggtgctgggtttaattcgacctaccaggagccaatagctcctttttccgtttcaggacaaaggcagaattcaagaaagtcattcattggtacaaaaatcagaaaaatgtacaggaagcagaagtccttgcgtaagaaactttttccttggagttatgattggcatagggaggaaacttgtgttgaccagaaattagttgaatcctcaggacccattagaatatgcaagtctggagtaaatcataatgcagttttaagagcaatggctagggctcttgaaagaacagaggaggaatacctgaaaatggtggagaataatatggacaaaaatccagagcttgccttgatgggatcatgtgttttagtgatgctgatgaaggatcaagatgtttatgttatgaaccttggagatagtcgtgtaattttggctcaagaacggccaaatgatcgtcatcctaatccgtgtcttatcaaagatgacatgaggcataagaatcgatctagagagttgttagtgggcatggagttggatagaatttcggaggagtccccagtgcacaatataaataagcatgttaacaagataaacaaaaacagagagatatccatgtgcagactgaaaatgagggctgttcagctttccacagatcacagcacaagcattgaagaggaagtttttagaataagagcagaacaccctgatgataatcaggccatattcaatgatcgagtgaaaggacaattaaaagtgaccagagcatttggtgctggattcctgaagagggtcagttga

SEQ ID NO: 52659 - DNA, 765 bp, Glycine max
  Peptide Sequence Number=SeqID_169437
atgggaaagttcattttgagtggtcttatattgtttgtggtgtttttcactacagaacttggagtatcatcagctgtttggcagcgagctcatgcaactttctatggtgggagtgatgcctcaggaacaatgggaggtgcatgtggctatggaaatctctacacagatggttatggtataaaaacagctgccctgagcactgttttgttcaatgatggaaaatcatgtggtggttgctataggatagtttgtgacgcaaggcaagtgccccaatggtgcctcaggggcacttccattgttgttactgccacaaatttctgcccaccaaacctcgcactccctaatgacaatggtggctggtgtaatcctcctagaccacactttgacatgtctcaacctgcctttcagacaatagccaagtacaaagctggcattgtaccaattttgtacaggaaagttgggtgcaaaagaagtggaggcatcagatttaccatcaatgggagagactatttcgaattggtgcttataagcaacataggtggagctggagagatttcccgagtttgggttaaagggtccagaatgaatgattgggaatccatgacgaggaattggggtgctaactggcaaagcttgagatatctgaatggtcagagtttgtctttcagaattcaactccgcaatgggaagactcgcacggcaaataatgtagcaccgtccaattggagattcggccaatctttcaccagcaatgtccagttctga

SEQ ID NO: 52660 - DNA, 447 bp, Glycine max
  Peptide Sequence Number=SeqID_169438
atgatgtatgaatggatttgcatgcaaggaggaggcaaatgtgacagaagcagatttcttctttgctgggctagcgaatcccggagttatcaacaacgcaacgggacttcaaacccacctcacacacatcctcgtgccaccgagattctgttcgtgttggaaggagaacttgacgtgggtttcatcaccacagccaacaaactcatctccaaaaccgtaaaagaaggtgaagtgtttgtgttcccgaaagctttggtgcactttcagaagaacaatggggataagcctgctgctgttatttctgcgtttgatagccaactccctggcacattctctatagttgcggttttgtttaattctaccccaagtgtgcctgatgatgtgctcacacatgccttccagattgatactcaagacgttgacaagatcaagaacagtctttcctag

SEQ ID NO: 52661 - DNA, 408 bp, Glycine max
  Peptide Sequence Number=SeqID_169439
atgggatcgaaccaagcaccctcttttaagaaaatgttctatcctgtcaaaatcaagagtctagaagtagccagtttgcaagagctagcgcagaggatggatcaacttcaacgtcaagccttccgcaagacatggaaaaatctggaatttggctatgatagaaacagaaatagggtggttgagataccaaggaagcacttggaagataaagcaaaggctttggtagatcaaggagagtggacttcattcgctgatgttctagcactcttggtgtttgggattgtcctctttccaaatgtggataggctagtggatctagcagtgatcgatgcttttctttcttatcaccacagcaaggaaagtctggtcattgttgttttggccgatgcttatgacacattcgattga

SEQ ID NO: 52662 - DNA, 282 bp, Glycine max
  Peptide Sequence Number=SeqID_169440
atgcggtgcaaagaaaggataaggagcttagatgaagcagcaatggctgaagttcctgaagagagcgaagaagtgcaagccttgaaacagaacttgaaagaacacgagtggtcaaggaaaagttcaagacgacagccatcagggggctttatggggcagcaacagcgaactcaagcttcaaagggccgaaaaggacgagtcgagggtggaaagtatgatattagaggacaagttgaaggcttgtcaaaggtcgaaggggagcttgaccgaatagttgaatag

SEQ ID NO: 52663 - DNA, 138 bp, Glycine max
  Peptide Sequence Number=SeqID_169441
atggctgaggatcctggtgtgcttgaggttgttaaacaattggataaggcttgtacagaggcagggttcttctacgtgcatttcgatatgcaaaagagggattggaacaaaaggattattaaccgtgtggcaaattga

SEQ ID NO: 52664 - DNA, 343 bp, Glycine max
  Peptide Sequence Number=SeqID_169442
gccacaaaatcctccaacattcaaagttcttatggaggagtatgttagtctctgcagaggcatgccttttcctcctcccctctttttctttccatcataccttgcaaggaaaattatgcgtggaatcgctttagcattaggtggatcgcccaatgaatttgaaggtcaaagagctggggatccattttgggtaatgcggctcattggttacccaggtttattgacattacttaatcaagatgacgatgtaaacgcacttcaggtgagaaacctgtctggtgaatggataacagcacctccagttcctgggacatttgtatgcaacattggtgacatgctaaag

SEQ ID NO: 52665 - DNA, 786 bp, Glycine max
  Peptide Sequence Number=SeqID_169443
atgattaaccaagcacaaattgcgaatgggaattatttacaaatgactgggaggtgtcctcagcgcattgctaaacggggatactatggcgccttcttgatggataaccttcctctggtgaaatctctggtagaaaaattggctgttaaccttcaggttcctgtttcatgcaagattaggctctttccaaatttagaggacactttgaagtatgctaggatgcttgaggaggctggttgtatgcttttagctgttcatggcaggacaagagatgagaaggatgggaagaaatttcgagcagactggaacgctatcagggccgtgaagaatgcagtcagaatccctgtccttgcgaatgggaacataaggcatatggatgatgttagagactgcttggaagagactggtgttgaaggggtgctttctgccgagacactgcttgaaaatccagctctctttgatggatttcgaaccgccgaatgggtgtctgaaagtgaaggaaccaatctggatggaaaactggaccaggcagatctgctaatagaatatttgaagctttgtgaaaaatatcccgtgccgtggagaatgattcgttctcatgttcataaattgttgggagactggttcagccttcagcctcacatcagggaggaacttaacaaacaatctaaactgacttttgagtttctttatgacatggtggatcgacttaggagtacaggtactagaattccactttacaaaaatactgaagtggaacatacagcaggcagttacccagattaa

SEQ ID NO: 52666 - DNA, 180 bp, Glycine max
  Peptide Sequence Number=SeqID_169444
atggcgtgtggtgtgcgacgcgtttggggttgtaagggagggatattaatcctctacatgatgttaccggcaatagcagtctgcgaccgaggcataggtggagaattgagaagcgaagccttcatcgaatcctatggcaggcgtcacgttccaccattgaggttggagcaatgtctatga

SEQ ID NO: 52667 - DNA, 243 bp, Glycine max
  Peptide Sequence Number=SeqID_169445
atggtgggctatacaccttcaagctttgctgatttagttttcaccgacgaaaggatcaaagtagaggatgagaaggagggagaaacccatgctgtgccattcctatacgaccaagttccccaccagctcaacaccatcattactcagccaatatcagccattctcattacccaccacccatttattcataaaggccatccccaaatcaacaacaaaacccaccttccacacaaccaatgctaa

SEQ ID NO: 52668 - DNA, 234 bp, Glycine max
  Peptide Sequence Number=SeqID_169446
atgaaggtgggtgatgatgcgttagaaagaggaaaagagaaaaagggtagggtgggaattgggttatttggatggtctagaatggctcttgtgggaaaaccgatggcaaagtcaaaatgggtgggtgtggaattgatcagttctagcactcagaaagggccctaccttgttagagtaaatttgtcttttgcaaactttgcctttgccttaacgtcaactctgttacgcggatag

SEQ ID NO: 52669 - DNA, 203 bp, Glycine max
  Peptide Sequence Number=SeqID_169447
atggcgtgcaacctttggttgaccgcttcgaggtacttggcaccctttgttgcacaatacgtgaagttccgagacatgccgaaaatcaaaaggaagctttgttacgcaatccgtgaaattccgcccacttgggccttccagattgttcctccagaaggcggttgcttctggaggaagcaacctggctcccctgggcgagctgg

SEQ ID NO: 52670 - DNA, 906 bp, Glycine max
  Peptide Sequence Number=SeqID_169448
atgtggtataatgaaagaatttcaaaagataaaaatacaacaagtccaaaattcagcttatgttgtggagatgacaaagttgaacttccattattacaaagtcccccgaagtatcttgaacgacttatgtttgatggtaatgcaagtgatagtaaaaattatcagtgtaacatacggacatataacatgatgtttgcctttacatctgctggtattaagctagacaaatcaattaatgaaagcagaggacctcctacaattagaattcagggtcaaccatgccatcgaataggcagcttattaccaatgcctggaaaacaaccgaaatttgcataccaacatgttgtaattcaaccagagattgtttcaactttaagtcaaatgctggatgagcacaatgtccatgcaaaaagtttcagaatggccagggacagattgacagatagtcaactagataatgtaaaattgagattgatagctgcacgtgagaaagatggtcgtacatacaatctcccaaatgtttctgaagttgctgccctgattgttggtgattttgatccagactcaagaagagatattattgttgaaactcaaaatggagaattacaaagaatccatgaattacactctagctatctaggactccaataccctttactcttcccttatggtgaagatggatatagacctgatatacttcaccgttctatatctagcagcagaaaaatgaagagaaatcgtctaacgatgagagagtggtttgcttatagactgcagtccagatcaaatgaagcacaaactttgttgcattctagaaaactattccaacaattcatcgttgaagcatacaccatggttgagtctgaaagacttacctacatcaggaacaataaaaaaaaaacttag

SEQ ID NO: 52671 - DNA, 195 bp, Glycine max
  Peptide Sequence Number=SeqID_169449
atggtcagaagtcgagacaagttgacggtagaaatcaaccaaggtacaaagggacggatgcaagtgggggatagggtgaccaccctgaccgatcgttgtcccttcccggcgctagacaagcagagaacgtcgctgcatggcagcccagtatcctttgaattcacagtatttattactattatttgttttaaataa

SEQ ID NO: 52672 - DNA, 504 bp, Glycine max
  Peptide Sequence Number=SeqID_169450
atgagtcaggttactgttcgtcacgcaacgcccgaagatgccgccgttctgacgcgtatctatagccagccggaaacccaggcgggcacgctgcatctgccgtatcagtcaccgtcactctggcaggagcggctcgcgaatccccgtccccatgtcaccatgctggtggcctgtattgacgggctggttgtcggtcagctgacgctggaggttatggcggtggcacgccgccgtcactgcgccactatcggcatgggcgttgatccggcattccatcggcgcggcgtgggtaaagcgctgatggcggcgatggtggatctgtgtgacaactggctgcaggtcacgcggattgaactgacagtgtttgcggataattaccaggccatgggtttgtatcagcagtttggttttgagattgaaggtaccgccagaggtttcgcggtccgcgacggccagatgatcgatacgcactacatggcgcgtctgaaagggaatgcgcgatga

SEQ ID NO: 52673 - DNA, 798 bp, Glycine max
  Peptide Sequence Number=SeqID_169451
atgagtcaatctcttgcttcacataagagtggacccttgggtactagtaccctcgtcatcagagggctgctcacactcgcctttagaggactacacgtcctcacctttagaggactacacgtcttcacctttagaggactacacgtcctcaccatcagagggctacacgtcctcgccatcaaaggactacacgtccttgccatcagagggctgcacgccctcgccttcagaggactacacgtcctcaccttcagaggactacacgtcctcacctttagaggactacacgtcctcgccatcagagggctacacgtcctcgccatcagaggactacacatcctcgccatcagagggctacacgccctcgccttcgtagggctacacgccctcaccttccgaggactacatgtcctcacctttagaggactacacgtcctcgccttcagaggacaacacgtcctcgccttcagaggacaacatgtcctcgcctttgccttcgtagggctacacgccctcacctttagaggactacacgttctcgccttcagaggaatacacgtcctcacctttagaggactacacatcctcgccatcaaaggactacacgtcctcgccattagagggtcacacgccctcgccttcgtagggctacacgccctcaccttccaaggactacatgccctcgccatcagagggctacacgtcctcgccatcagaggactacacgtcctcgccatcagagggctacacgccctcgccttcgtagggctacacgccctcaccttccgaggactacat

SEQ ID NO: 52674 - DNA, 241 bp, Glycine max
  Peptide Sequence Number=SeqID_169452
atgcagaactatcaacatgcaaagagatctaattctgcaaaagccaggatcaataggaaacgtatcatgcagcagaaacgacatcctcatgctcagtcatcttcacaaccaacaattaactgcacttcggaatatgataaaagtgtaaattctgaatccacacaaggttcgggctctaattttttaactgcctatgaggattgtcaatctccaactaatcaacctgtaatcaacactgaag

SEQ ID NO: 52675 - DNA, 354 bp, Glycine max
  Peptide Sequence Number=SeqID_169453
atggcctcctatgatagtgagcttgttcttgactcatttttttctagaagtggtgtctttaatcaccttttctcctttttcattctgctgccattgatcttcatgaagcaaaatactccattgatgaagaagatccaaggcctacaagctctacatggagctacatcagctgagtctatgaaactaaaaaggaggacgttgagtcctattaaagtaaaaaggaggaggttgagtcctatgaaactaaaagggaggacattgagtcctatgaaactaaaagggagaacgttgactcctatgaaactaaaaatggaggacgttgagtcctatgaaattaaaaaaggaggatgttga

SEQ ID NO: 52676 - DNA, 297 bp, Glycine max
  Peptide Sequence Number=SeqID_169454
atggttgcagacgccattgatcaagtcaaggttggtattgaggaggttaaagatgcaaacactcccattcctgtaccaactgaagaggttaagttagtggagcagacatttaacatgttccttgcttggccgacacatctcatcaaacgtttatcagaacaagttttgtgggatgcaaccatatttggggtgtttaatggcaacttccctttgtacatgaagcatgaagatctgtctgaaatagcacacggtggtcaatgtctcaacatctctgttatacaattgtggattctgtaa

SEQ ID NO: 52677 - DNA, 234 bp, Glycine max
  Peptide Sequence Number=SeqID_169455
atgacgtgcgaccattctttggtcctcgtgaggtgcttagcacccatcattaggcaatttgtgaaatttcaggacgtgccgaaaaaccgaaaaatattgatgcacaatccagatatcatcctcttaagtaacaacattgtggcggtagggactaccagcgataatgccacaccaaaagaggaaaactctaggttaggcttcactgttatcaagcgagtcggagacccagcatga

SEQ ID NO: 52678 - DNA, 774 bp, Glycine max
  Peptide Sequence Number=SeqID_169456
atggttcttatgagcacgtgggaggacttggatgatacctcgtctcatgaagatgatgaagaagctaacatatgcctgatggcagatacaacttctgaggggtttgaatcagacaaggaagatgagattgagacaagtgctggcgaaaaagctacccttcttaagaactttcaagagttggaaaacgaactgaatgatcttcaaaaggatttgaaagaactgaatgaacttcatcataaaatagaagaaagatacaatctttggagagaatgtgcacaagcacaaaaacattatgaagacctcaaaataagtaaacataatctttgggtggaatgtgaagaacacaagaaatctgtgaaattcttgaatgatgagctttccaagaataaggaatgtaagggtcaacctcaagatgttgtcaaacttcatgaggaaataaaaaccttaaatgtttatgttcatgatgaggacaccattgtatgctatttttatggaaaaactggacacatgacgtccatatgcaacaattttcctaagaagcattcacccaatccctttatgaataacacaaaaggacccaaaaagatttgggtacctaagaaaacggttattcctattgcaaatgtccttgatagcaagaagcagcgtctgtcatgtgtggatgttagtgatagagggctatccaaagagtgtaaggacctagaagcatttcatgggttgaaaggtccaatgacaaggtccaaagccaagcttctactagaagagatggcctag

SEQ ID NO: 52679 - DNA, 101 bp, Glycine max
  Peptide Sequence Number=SeqID_169457
atggatggtttctatacgaaaatcaccgtgtgcgaggtgcgtgaggaggctggcttcctcgacggtgacgtgttgattttccccgacatgatcaaatacag

SEQ ID NO: 52680 - DNA, 831 bp, Glycine max
  Peptide Sequence Number=SeqID_169458
atgggcgaagactctcagctcgccctaatcaccaagggcttagttgttgctaaacaacaaaagtttagcaagactaacctgaaagctataaaggtttctttagaacaaagtctaaagaaggctcctttggtggacctggacactattaataagaggaaacaaaaaaggctagccaagtccattattgatgaagaccaaggtctaaataggtttgatatttcaagaaagattcagaagatcatggttgagcaaccaaaaaaaaatctaaaaaggatgaagaagaagtggagcttcttgcatgggagcagaggaaaaaaacatgtgactaatgcatcttctcctatgcatccatcggccatgagctcagtcccacaaaggttgaaagaccaaagtgagactaatgaaaatgatgaggtctttaaattgcgggtgtccatcatctcctctgctattccaagacgtatcaagatgaggatgaccaaggccaacccaaagattagggataaagaatgggcaatttcatttactggaaacaaggaggattcaacctcttcaccatcagatagagagtccatagaggatactcctatctctcccctctgcaaacatgcaccatccgctcaaccacatcgacctccatcaccttctcatctggatagattaagaagggttgctccaagggaacccctaatagaggctcagagagataggagagcaacatggaacaacctaaggctaaacttgaagcttaaggaaaagcttgaagaagttttggcttttacttgcctaactcctttgagtggcatttgtatttgttgttatcttgattga

SEQ ID NO: 52681 - DNA, 854 bp, Glycine max
  Peptide Sequence Number=SeqID_169459
atggaagcctttcgattcactcccattttcttcagtgatgccattcctttgtgcataggtggaagttctaaacttgctttaactggcccttttcttttgttctttaatttgaaggggggtttggaggaatcaaatgttgatagctttttcgaagatgttttggtgaatggtaaaccatggactgctggagttccggaggtgtttagtggttcacatgtttatgtgtgtgctcatggaagtcgtgacgtgagatgtggtgtttgtgggccagttctcatcaagaagctgaatgaggaaattgagcttcgatgcttgaaggatcagatatctgttactgcttgttctcatattggtgggcataagtatgctgggaatgtaatcatatactgcccaggtgcagatggaaaaattatgggtcactggtatggctatgttactcctaacgatgtttctgatttgttggaccaacatattgcaaagggagaggtcatcaaacgacttttgaggggccaaatggggccatctgttgcagaagataagggagcagatgaccagaaagttgctaatggagaggataccagcaagggcaagactaatcatgttgaaagtgacaatctgagcaacaaagaaaacatgggtggttgttgccaaggtgttaatggggtttcttgttgcagaagtgcaagtgttgagcaaaacaacgagattgaagaaacacctgaagcacaaaagaagggtagcaaaatctgttctaattggcctcaattgcagcagcgtgatattctcacagctgttggtgtgcttggagctgtagcagttgttgctgtggtttacaaactttacagaagggcagg

SEQ ID NO: 52682 - DNA, 1284 bp, Glycine max
  Peptide Sequence Number=SeqID_169460
atcaaccgtcaaaataaagaattggcggtacttagaaaaaattacgcagaagttttagtgaatgcttataaaaacaagggagtacaaaacaaagtaacctttattctttctgctaaaaaccttggagaagctattcgtagagttcaatatcttaaagaatattcggactatcaggataaaaaagcggctgaaattacagacgctgcaaatcagatcaaaaaaacaattgcccaaagacaaaaatcggttgcagataagcaacaacttttgatagatcaacaaaaagatctggctactattaatgtggaaagagctcagaaagagcagcttgttgaggattttaagaaaaatgaatcgaaattaactgctgaattaaaacaaaaacaagttcaatctaaagctcttgaagggcagatcagaagcatcattgcagaagaaatcagaatagcaaaagcggaagaagaagccagaagaaaggctgaagctgagaaaatccgtttagctaaaattgcagcggaaagagaaaaagcaagaatagaagctgaaaatagagcaagagcagaagcacttgaaagagaaagaaaattagctgaagctgaagctaaaagagccgaggagctagccgcaaaaaaagctgaagaggaaagaaaacgtacagaagaagcagctagagcagaggctaatgcaagggatgaagctcggaaaatagccgcagcaaaagcttcttcggaagccaatgcaagggcaaaagaagcagccagcaaactggcagccgcaaaagcagctgaggccgcattagaaaagagaaaagacgacgagaaaaaagcagcagaaaccaaagcgatgacgaattttggagtttctactgcagcaggcaataattttgctgaaaacagaggaaagctaggcttccctgttgacaaaggccagatcacccatcgtttcggaagacaaccacaccctgtttttaaaaatattacagaagagaataacggaattaaaatctccgtaccatcgggtacacgggcaaaatcagtattcccgggatctgtatcttcagttctggctaacagtgacggaaccaaaacggtaatgctgaaacacggaaattattttacgatttattcaaatctgggaagtgtcaatgtttctaaaggccagcaggtttccgcaggcaccattgtaggtactgtaggacaagactttgatgggtcttatacccttgatttccaagtatggaacggaactacacctgttgatccattagggtgggtttcttattaa

SEQ ID NO: 52683 - DNA, 510 bp, Glycine max
  Peptide Sequence Number=SeqID_169461
atgaaaataggcatactttgctatccaacatacggcggaagcggtatcgtagcaacagaactgggaatgtctcttgctaataaaggctatgaagtccatttcattagttcagcccttcctgcgagactcgatattaccaatcctaatattttttttcatagggtaaatgttcaaacttatcccctgtttcaatatcaaccttatgatattgcactgagttcgatgatctacagagttgttaatctgtataaactggatttattgcatgcacactatgccattccatatgcttatgcagcgtttacggctaaacagatgctacaggaagataataacgacattcctttggtaacaacacttcacggaacagatattactttggtaggacaacatcccagctacaaacatgctgtagagttttcaatcaacaaatccgatgcaattacctctgtatctgaaagtttaaaaaaagacacgctacagtttttcaatattaaaaaaccaatccag

SEQ ID NO: 52684 - DNA, 205 bp, Glycine max
  Peptide Sequence Number=SeqID_169462
aaatcgtttgtgctgataatcacttgggtatctccgcacgtcacctgacttcacgggtcaggatgacagaaagcggggtggtcgaaaagagcaaggcttttgctcctacgtatcctccatttgtgatgaggaactcagacctacgcgtggataaccgtaaggtgtcttcgcatgctaccggactcttgggtcatgatagcaaaag

SEQ ID NO: 52685 - DNA, 621 bp, Glycine max
  Peptide Sequence Number=SeqID_169463
atggcgtccggccaggcgggttggcgcctctgcgccagccaggcgcgcccggcggtcagcagcagcaacaggagcagcagaacgataccgaccagtcgctggttcagccaggcgtaccccaccaacagcgccgccggccccacggcattcagccagggagtgagaggagagggcgtcagcgtgagccgcagctggcgtttaaacggctcgtcatcggcgtgcagcgggctgtgcaacagccagttcagcagcgccgggcgtttgggcgttaccgccggagatggacttctcattacagcctcgtcaataaggtcgctcttgcggcggcctgaaagtctggtcggatcaggaataactttcagaataatgaacctgctggccgcagcgggggctgtcgccgcgcgctttccggtttacggtggacgctttcgcgccgctgtcatgatggttgtaacaggggcaacccaacgccggcgtgatggggcgttatcagcatattcttcgccatcgcctgttgatgatgggcgtgttggcactggcgatcctggggtcgctgctgctggatttcaccatggggccgtccgggctgtcgctgtcgtctttatggcaaacgctgcttga

SEQ ID NO: 52686 - DNA, 467 bp, Glycine max
  Peptide Sequence Number=SeqID_169464
atggcgaagaatatgctgataacgccccatcacgccggcgttgggttgccccttggcgtcagtcatgggatcgctgcggctcacgctgacgccctctcctctcactccctggctgaatgccgtggggccggcggcgctgttggtggggtacgcctggctgaaccagcgactggtcggtatcgttctgctgctcctgttgctgctgctgaccgccgggcgcgcctggctggcgcagaggcgccaacccgcctggccggacgccatgctggtgacggtgttgctgtggatgctgctagtgatcgcgctgacgctgccctacctgctggcggcgccgctgtcgcgcgtgcaaaacctgttcgtcctggcggatctcacgccgctgtggctggtgctggcccatggcatgatcgcgcgctaccaccgccagcgggtacagcacgtcacgctggcttgggagaagcagcagg

SEQ ID NO: 52687 - DNA, 132 bp, Glycine max
  Peptide Sequence Number=SeqID_169465
atggtggaaaagtccttagagcaaaatgttacaggtgtctgttggtggagaatcacgctttctaaccttttgctaaagcttctatcgcaacacttaagcaaggtaggatggccaagaggtgaatctagatag

SEQ ID NO: 52688 - DNA, 222 bp, Glycine max
  Peptide Sequence Number=SeqID_169466
atggttcaagagttggagagaccccccttacctcttgatgaacccacaaaatgtccaagatcaatcaacaatgaacactctatgactcaagtttcaatgcttcaaagggaacttaataatgagcaagaaggaaagattaaaaagaaagaacaagggaatacgtgtacccaaagtgaatctcacacagagttgcattacattattgctcgatacacagtgtaa

SEQ ID NO: 52689 - DNA, 456 bp, Glycine max
  Peptide Sequence Number=SeqID_169467
atgaagctttcaagagatgtgatggaaagtggtttttccccatttccatttgattggaccaatgttccccggcgaatgcgaactaagaggaagagtaaattcaatggcaaggaagtgctttctgaacccaaggaagcgcattctaaaccaaaggaagaactctctagacccaagagaaagctaaacagcggagtttttgatatttacttgaaattttgtcacaagatagaaagaggcgctttatgtactctcaccgcttatggtttagcctttacaggggaaatgctagttgcttcttcttctttgcgagccaagcgccaagcttcgtcttcttcttttccgcgaacgaggcttccggaagacccgttaggggttctttcggaacttccggaagaagctgttccggaaacattccggaatccggaagaattccggaagaagggttcttccggatga

SEQ ID NO: 52690 - DNA, 546 bp, Glycine max
  Peptide Sequence Number=SeqID_169468
atggaagttgatttccttacaaaggggattcatattaatgtttccgatgatgagaaggatgatattaaagtgcttaggcacaaaaggaaggaaatattttcttcgggtgagcgtcgtcgtaaagagggaaaaacttctaacaaagatatgttagacaaaattgaagttggtaatttatgtgatggtaagaaagtcagcatagaggaagcggttgcaatgttcttgattataatatgtcataacttgcgtcatcgggtagttgttgaacggtttcaacattcattgcacacggattgcattggtgccattgatggaacacatggacgacaaacgattcaagggtatttttggatggtttatctcccaaaaataatttcccaaagcctaatggagatcaattctatttggtcgactctggatttcctaacatgtcaggctatcttgcacctttcagaaggaacaaatatcatttgtgagattttcgtgaaggatgtggacgtccacgtggaaaagaagaattattcaattacagacactcttcattaa

SEQ ID NO: 52691 - DNA, 738 bp, Glycine max
  Peptide Sequence Number=SeqID_169469
atgagatgtcaggcccagcggtggattgtagcagctcgtgcttatctgttgcacctcgtcagttgcactctttttgctaataagagtgcaacatacgttcatgtggtacacctagacgcttttcacgacctgggtcagagtggtggttatgcttggggagttgccacgctggttcatatgtatgatcagttagatgaggcttctaggaccaccacacgacagattgcgagtgctggatctatgagcacttccctagtgcaccagttcgtgacagatgatacataccaggagacctccccacgtgcttcctggtggttgacgtcaaaggcgcacatgaacggaatcacaggagcaccttacagggcacgttgtgatgctttgaccatcacatatgtgtcctggttgccatacactgagcatcggggggttagggcctttgagctgatttcatcattccagggtcagctaagatggggtcctatggtggtcacagctcgaccggagagggtgtggtttttccgcatatctcacccattcatgataccgatccaggtaggtgaccagcctagagatgcactagccgcagaccctgaggagtacatacagccgtccagcccccaggttccagtgacatttgacccgcctcgacatgcagtggactgcctgacgattgccagagggggagccagtgctgatggaagtgtcagggcacgtcagagacgccgcagagagtattga

SEQ ID NO: 52692 - DNA, 192 bp, Glycine max
  Peptide Sequence Number=SeqID_169470
atggtggggctccggttctttctttcaaatttaatttgcgataagatcttcattataaaccactatcatgaccgttatcatgacctccatcgtcgtcacagtcatgttggtgacaacgacgatggtcgtgacaacgatcacgataatgatggtgctgacgtcgatagtaataatgatgacgacaggtcatga

SEQ ID NO: 52693 - DNA, 772 bp, Glycine max
  misc_feature (662)..(662): n is a, c, g, or t
  Peptide Sequence Number=SeqID_169471
atgacacaccttctaatctcagattcgagtcgccttggatcggccatttcaagtgagtccaacagcaacatgcattgtgatctggtagttgattgcaagctctcaccaaaaatggcagaggatcaaaaggctccagtgacccctacaacattgggaattcaaatgaatggacaattatgtccctctgcgaaggttatttccggaagaccattcttccaaaagtcttctggaagacccttttccggaaaacttccggaagacacttcttccggaagaaggtggacttccggaagaactctagaaaacgttccaaaagaagtgtcttccggaacttttccggaaaaagggtcttccgaaatacttcctcttcttccgggagaagaaggaagtagttccggaatgagaatgttgaatttctggaagaagttcttctggaagttactattctcaattccggaagaagtggttccggaagtgttttccagaacaacttctttcggaagtagacatagtaacttccggaagaagttcttccagaatatggacgaagatcaatggaggtatgactatgcaatgtcacaagaagttcatatggattatgattatgataatgaagaagaatgtggggtgaatgaaccacatgtcgattgttcaaatgcttntaatacgtctcaggtattcggtactcgagatgatgttttgcaatgggctggaacagttgtccatgaaaatgaatttgttgcagtgattatgaggtctgacacatatactg

SEQ ID NO: 52694 - DNA, 432 bp, Glycine max
  Peptide Sequence Number=SeqID_169472
atggctcgctactccttcctcttggcccttctcctcctcctcttcgtcatcgtggccagtgctactgacgacatcctgatccgtcaggtggtgccggatgccttcagtgaagcagcggagaaggaggatgagaaccacctattgaacgcggagcaccacttcgcgagcttcaaggcaaagttcgagaagaagtacgcgaccaaggaggtgcacaaccgtcgcttcgacgtctttaagtccaacctacgcaaagtgaggcgcatgccaagctcgacctctccgccgtccatgatgtcaacaaattgtccaatctcacttcgccagttcctcagtctcaagccgttgcgtttctcggtgaacgctcataaggcacccaaggattttgattggcgagacaaaggagcaatcatatttgccttcaaggacaacctg

SEQ ID NO: 52695 - DNA, 750 bp, Glycine max
  Peptide Sequence Number=SeqID_169473
atgggtttggatatggatgccctcgacaatgttggcaaggaggagggcaccgtcactgagtcggacgataatggagatctcgatgttgaagtcgatgtggttgggcagtggggatccttcttgcccttcagctgtgccttcccgatccacaactgtggcatcgtaggcaacgcgaagggcaggaacaacgattacggtagcgcggtctgcatcgtcagaggtgatgacgctgccgttgtagggaactggcttgtggtacttggagcgatgatggtgtttgagggggggtatttggggattgggattggtggttgtggagtggtggagaaggtggtggtgggatctaggggtggcgatgagaatgttcgagaaaaagacgatgtcaaagacgaaaaagaagaagaggaagaggaagaggaagagaaagagaaagagaaagagaaagagaaagagaaagagaaggagtatgagattctctcagatccaaacaaatggcaaatatatgatatatatgacatggaagggttgacctttggtttggaacttggtccaaagcttaatggagctgaagagataaaggcagagctccagagattgaagaggatgagaatgggagaaagtggcagcgcattttctacccttcaatacaattctagccaatatgtctttgccatgctattgaatggagaggaaggtgatggagctgctagtgttgcgtttaggcatcaacttttaaaagttcgtcagtag

SEQ ID NO: 52696 - DNA, 429 bp, Glycine max
  Peptide Sequence Number=SeqID_169474
atggttaaggattatgaactagttttagttaggttcattgttgttgttattgctacagtggaggtactagagtcaccaaataatgtgacacgaatgaagcataggcaaaggagtaatagttccttttataaaggaggtcatgtggaccactttgtactaagcccttatgtaggacatattgccccacaattgtgggaaggaatgaacaaaccaccattgaaatctgttagtattacaaaggctgatgccatgcctatagatccatatgttttgaggtatggctttgggttggctccttttgcacgtggatggaagccctattcccatatacctctttcactagacgagaccatgattgtgataggactattgcttaaagttaactccaaaatggcatatttagctacagacaatgagacaaatgtgtag

SEQ ID NO: 52697 - DNA, 291 bp, Glycine max
  Peptide Sequence Number=SeqID_169475
atggagatcaagaaggatcgagtccaaaagaagcttttcttatgtgaaaaggaatacattcagcccataatttccttgtccactacaaaggataaagctatcattttttgcgacaatctgagggcaatttgttttgccaaggatcaagtccatcatgagatgactaaacatattgactaccacttcatctgtactgagaagaggattatcatccaaaaagttgatacgaaagagaatccaggtgatatgtttacaaaatctattcctcaaatcttaaacccaacaacttga

SEQ ID NO: 52698 - DNA, 390 bp, Glycine max
  Peptide Sequence Number=SeqID_169476
atgaagaaagagaaggaaaatttgctcaaggtttttgacctgtttgagaataatcccatccatgttgcaacttgttccaacaacccacaactcctcaaagagttgatggagttgatacctatagaagataggtggcaagctatgtgcaagagaaatcatgaaggaaacactattttgcatgtggttaatgtaataatttgttttggaattgacaagtcaaatattgaatgggtactaatgggtgagagtgagagcttgcaagaaccaaaacaagacagccctttcaaggcaatggctggagatgtgcaaatggcatatgttgtgtttgagcttgaagaggaattgttgcaacaacaatcatcactaaaggaaaaaaaaggccattgctag

SEQ ID NO: 52699 - DNA, 117 bp, Glycine max
  Peptide Sequence Number=SeqID_169477
atggcaatgatggcaataaagattctattcaccatcagcaccaaccaattgattgacagtaaggttaccacactactctggaatcatggtatccaaattatccagcttcaagtctag

SEQ ID NO: 52700 - DNA, 165 bp, Glycine max
  Peptide Sequence Number=SeqID_169478
atgacattctctgctggttttgcctatttggagggaaaaggtgtaaataatgtggtttcacatcaacaagaatgtcaaggcaaaatgattgaatctgcccattgggctttaaaaaggctaagcataatagccttggagacctatgtagtatttgggaagctatga

SEQ ID NO: 52701 - DNA, 159 bp, Glycine max
  Peptide Sequence Number=SeqID_169479
atggactccgttccgtttcgcgatggtaacatacacaccattctcgactcccgttatcttcactctccactggatgttaatcatagtttgcacactcattcctcgctgattcggaggctttctcaagaaagggagttagaggttcgtaacgtatcttga

SEQ ID NO: 52702 - DNA, 195 bp, Glycine max
  Peptide Sequence Number=SeqID_169480
atggcttccgggactcccagtattttcgaagcaggattacttctggaggaagcaacccagctcgccagggcgagctgggcggcaattcctcccccttttttccctataaataagcaaaagggggctattctaaggatccctcctcccctggctatgcatttcagctgttttgggtggaaaaaattgtttccgtga

SEQ ID NO: 52703 - DNA, 861 bp, Glycine max
  Peptide Sequence Number=SeqID_169481
atgcgccatgatccgctcaatccggtggcgccgcactgcagcagccgcggcttcccgttgtctgcgatacatttgccggcggcgccggatcaatcagcgtggcgggcgttggacgccgggcaagcattgcccgccgcgtctgagcgtttgcagcacttcttttggcacagcgaacgattggctaaccgacgcaacatctggctgtacgccaccggcgcaggggaagaccgcccgttagtcgtactgctggacgggcaattttggctgcatggcataccgattttttccgcactggacgccgagacgcttaacggaaggctgccgtcggcgctttatctgtttatcgacgtgatagacatggcgcggcgtgcggaagaattggcctgcaatgcggctttctggcgggcggtgcaagaggagctgctgccgcaggtggcggcgcgtgcgccttacagcgacgatccgcagcgcacggtggtggcggggcagagttacggcgggttggcggcgttgtatgccgggttgcattggccgcagcgtttcggctgtgtattgacccagtcgggttctttctggtggccgcacattgaagcgatgattaacccggctgtggagtatgacgccgacgtcggctggttgactgaacaggtgcggcggggcttgtgcgccgcgacgccgctgcgcgtctttcaggaagccggtgaaggggagagggatattcatcaggtcaatcgccaaatgcatcgggcgctggtggaggcggggcatcgggtcgattatcgcgtgttcgccggcgggcatgatgccgtctgctggcgcggcggtttgctcgacggattgcgggcgctgttggctccctag

SEQ ID NO: 52704 - DNA, 1497 bp, Glycine max
  Peptide Sequence Number=SeqID_169482
atggcggcggcggtcggccgcttgaccggcaaggccggggtggcgctggtcacctccgggccgggcagctccaacctgatcaccgggctggccaccgccacttcggaaggggacgcggtggtggccttcggcggggcggtgaagcgcgccgacagcctgaaacagacgcaccagagcatggataccgtcagcatgttccggccggtgaccaagtattgcgccgaagtgcatgccggttcggcaatttccgaggtgatcgccaacgcctttcgccgcgccgagttcggccggccgggggcatcgttcgtcagcctgccgatggatatcgtcaatgaaccggtcagcgcgccggtgctggccggctgccgcttgccgcgcatgggggccgcggcggcggacgacattcaggcggcggtgaaactgatccggcaggccaaatgcccggtattgctgctcggcctgcaagccagccggccggagaacagcgaagcggtgcgccatctgctgtaccgcacccatatgccggtggtcggcacctatcaggcggcgggggtgatcgacgtcaaccacttcgcccgtttcgccggccgcgtcggcctgttcaacaaccagccagccgatcagctgttgcagaagtccgatctggtggtcagcgtcggctatgatccgatcgaatacgatccctgcatgtggaacagccacgggcggctgaaactggtgcacatcgacgtgctgccggcggatatcgacacctgctatcggccggacgtcgagctggtgggcaacatcagcgccacgctgaacatgatgaccgaaacgttcactgaggcggtctgcgtgccgccggaggtggagctgatcctcaccgatctcggccgccaacgcacggaactggcggagcgcgccgcgcgccgcggcggcatgccgatccacccgctgcgcatcgtcaaggagctgcaggacatcgtcagcgacgacgtaaccctgtgcgtggacatgggcagcttccatatctggatcgcccgctacctatacagcttccgcgcccgtcagctgttgatctccaatggccagcaaaccatgggggtggcgttgccgtgggccatcggcgcggcgctggtgcgccctggcgataaagtggtgtcgatctccggcgacggcgggttcatgcagtcgagcatggagctggagaccgcggtgcggctgaaaaacaacatcgtgcacgtcatctgggtcgataacgcctacaacatggtggagatgcaggaagtgaacaaataccagcgcaaatccggcgtggagtttgggtcgatcgacttcaaggcctacgcggaatcctgcggcgcggtcggtttcgccgtgcagtcggtggacgatctgcggccgatgctgcgcaaggcgatggcgatccaagggccggtggtggtggccattccggtcgactacgccgacaactataagctgatggcgcagatgaacttcagccagatgatttaa

SEQ ID NO: 52705 - DNA, 828 bp, Glycine max
  Peptide Sequence Number=SeqID_169483
atggcacttgatttacaatgtccatgttcttttttacctatagatgtcatttggattttcaatatatttattggttttgtgaataaagccaaatttgagttagagcctcagcacatggcaagtgcagaggctggtgcacctacagggtttggtggttctgtacaacactcttcatcaaacaggagggattatgatgatggtgggtcaccaaagaggaaccttagtttggatggtttacctcattttgagaaaaacttctacattgagtcaccagctgtaagggcaatgacagatgctgaagttaatgagtaccggcagcagagggaaataactgttgaaggtcgagatatcccgaaacctgtcaagtcctttcatgatgctggttttccagatcctggagatggaccaattgtgttagttttggctccaactcgtgaacttgccgtccaaatacaacaagaggctactaaatttggtgcatcatctaggattaagagtacatgcatctatggtggggttccaaagggacctcaggtgcgtgatctccggaaaggtgtcgaaattgtaattgccactccaggaaggttaattgatatgcttgagtcaaatcataccaacttgcagagggtcacataccttgtattggatgaagctgataggatgttggatatggggtttgatcctcagctacggaagattgcctcccagattcgtccagatcgtcaaactttgtattggagtgctacctggccaaaggaggtcgaacaattggcaaggaagttcctttataacccatacaaagtaattatagaggctcttctgatttaa

SEQ ID NO: 52706 - DNA, 201 bp, Glycine max
  Peptide Sequence Number=SeqID_169484
atggtgacgcggtggtggacggaggctgtgccgttagggtgtgtcgcgtgtgactgcgtgagcatgagtcgtgttttgttttgttttcctggtaaaaaacccgtgaggagaacaagtgttcttgctacaatggtagtaaccacaatatatgaaaatgataacttaaaagaaaaaaaagatcgagaaaatatcaaaaagtaa

SEQ ID NO: 52707 - DNA, 285 bp, Glycine max
  Peptide Sequence Number=SeqID_169485
atgtatgggagtaaagctagccaacttgtgaaagaatttgcaagtggagaaaaaggtcagcttaccacatacaataatgacttgattcgagaagtagttgcagagtgtactcaacatcaccttgattttcagtccttgataaggaagtcccacatcgcctgcctcaattcttgggatgtagcttatgcatctgttggacaacatcacttagggccaattgattttaagctgaaatctaacatgctattagagtctatagcccatcttggttcttgcctattctag

SEQ ID NO: 52708 - DNA, 591 bp, Glycine max
  Peptide Sequence Number=SeqID_169486
atggatctaaatctgaaattgaccttgactgatggtgatttaatccctgatccttctctatataggagactaattggacaaggccttttctttcctgctcaaaatttcttacacttgtcagcttatgctgatgcaaactggggaaactatttagacacttgtaagtctacaactggattctgtgtatttcttggtgatgcactgattttatggaagcctgtgaagcaaggtactgtcccaaagtcctctactgaatctgaatatcgagcattatcatcagtggctagtgaagttgtacagctcaagcgtttgctaggacattttgaagttgatattggatcaatcatgttgttttgtgataacaaaccagccatccatttgacttcaaacccttcttatcatgagagattgaaatatatcgacatagactgtcactttattcgagaacttgttcagtcaaacatcttcaagttgattcatgtcaagactcaacatcaaatagttgacatattcaccaagcctctacctacttcctctttcaccaatttcattcgcaagttgggaatcatagagaatttaaaagttatttga

SEQ ID NO: 52709 - DNA, 360 bp, Glycine max
  Peptide Sequence Number=SeqID_169487
atgacatacaacactacaacatctggtggtgccctcgtgggctgggcacgttcctctctgggtcggctacctctcctatccgcttctctacaaggtctactttcttcttccttcagaccgggccaagcctttagtttaagtaggtttgggctaggtcgttgtgctcctgccacgtcttggcaaaaaagtaggctgatgggcaagcctcctcctgccgcaatggtaagcgttttggagttcaacttatatgagataatgttaagaatcactttaaactttgttattgatattcttagtcaaagtgggtttgattgggatagcacgatatacatgattaatgttgaaaatgtaaatgcatga

SEQ ID NO: 52710 - DNA, 189 bp, Glycine max
  Peptide Sequence Number=SeqID_169488
atgaaatgtggcataagagtagagatattgttggatatacaaagctcagaggaatgtaatactgtgtgttacagcatgtcttctctactggtctatcagccgcatttgcaagtatcagaaggaaatccagagtctggaggaaggggagaagagaatcaagtcccactagattcttttagtcatgattag

SEQ ID NO: 52711 - DNA, 321 bp, Glycine max
  Peptide Sequence Number=SeqID_169489
atgtctgatgaagttgacatggatatggatgataccgttaaaaatgaagattgtagcaaaatctttacaactatgaaggtttttgatactcgagatgaattattgaaatgggttcggaaggttgtgtttgagttaggggtggcaaatatagacataaaaaaagatgcaaaggcggtcactaggactagaaaatgtgattgctcttttaggttgaaaggaagaccactaaagactagtgaaggatgggtacatagggttctgtgtgggtcacataatcatgatattgccaagacattgatcggccatccatatgttggttga

SEQ ID NO: 52712 - DNA, 213 bp, Glycine max
  Peptide Sequence Number=SeqID_169490
atgtacctgacatggagagttggaagaggaaagcaatggaacctctatcgtagttggaagaacaattcagttggaacctttggcgtagttggagcctttagcactggaaaacagccgtctgttactccttcagcttcaccaatcatttgttgctcaagtttccaaattgaaggcaaaagacgaaaccttgctcaaattcaaacaccactttga

SEQ ID NO: 52713 - DNA, 414 bp, Glycine max
  Peptide Sequence Number=SeqID_169491
atgtcttgggatatgaagagacgtctccgcgggttagtcgatggtcaaataagtaatgagctgaccaccaaaggagttaggtggactccatatgagacacataggactcatcatccgtttaagaatatatccttattctatggatatattcgtttaggcccagatttgcaccttcaattgccagaaagggttgacgataagtggttgaacgtgcataatcacttgatccagctgacaatgggtgcagttaagctgcgtatcgttgatcataggttggttacccaaggcactgatgcatattgtgggactaaaaaggaattagcattaacgcgtggagtaactgatgatggtcctatgaaaactagtagggcactaggtggcaccagaggtgggcgtggcagaggacgacattga

SEQ ID NO: 52714 - DNA, 846 bp, Glycine max
  Peptide Sequence Number=SeqID_169492
atggattatcagagttgctaccctaacaaggacagttatgcaattttgatgaagggattgtgccaagacaggaggttacatgaggccacccattttttgtattcgattttttggaggatctcacagaaaggaaatggtgaggatattgtcatctatagaactcttttggatgctttatgtgatgctgaaaaatttgaagaaactgaggaagtcctgggtaaaattttgaggaaaggactgaaggctccgaagcgatgctataaccgacttgatcttggccagaattcggatggtaaagatatagaaagcgctaaacgcatgattcatgaagctttgatcaagggctcagttcctagtttggctagttgtaataccatggctattgatctgtacagtgagggtaagatagatgaagctgataaggtcatcgttgaaatgcaagaaagtagaggctttaaaccaacacatactgtctttgaagcaaaagtagctgcattgttcaaggttaataaagtggatgaagcaatcaaggtaattgaggagaacatggtgaaagtcaattgtctaccaattgctaaagtcctcgtactcaagagcttgaacaaggtgtctagcaaggttggttgcacaggcgacatagatacttatgacattttgctgaaaatgctttgcggtgagagaaggtatcttgaggcaagccaactcctggagaaaatgtcaattaagtcatactggccttgtaccaaaagttacaattcactcattgagggtctttactccttaggtctgcaatatgaagcgattatgtggttggaggacatgataaaccaggggaagcttccttaa

SEQ ID NO: 52715 - DNA, 474 bp, Glycine max
  Peptide Sequence Number=SeqID_169493
atggcgcgtacaaaaagagttagttttgatggtgatgatgacaatgatagacgcaatagaacaacaatgtctgaacgaaggcgatgtctagaagctcaacaggtggaccctttgaagatcgagcatgttgaccaagaacgtggtgagcttaaattagtatcacatgggagaaagttgcaattagagattacgctacatgagcagatacacaatgcgatcaaggagtctggtttattcccgttgactacatgcagttatcagacaatatacaatggactcttgtctacttttgctgggagatggcacacagagacaaacaccttccatctatccgtgggagaaatgatggtaacacttgatgatgtgacatacttacttgacattctcattactggcgctttttacaattgtgaacatatggataaggaagcagcaatttccgtgcttgtggaaatacttggagttggatattag

SEQ ID NO: 52716 - DNA, 168 bp, Glycine max
  Peptide Sequence Number=SeqID_169494
atggatagtatgatagaacagacgatcgagcatgacattcagctagagcatgggctattacatttgcctgtctataaaaaatattcaactgagaagtttggcttttccgttcagtcaacttggaaagtgtgcaaaccaactttcagtgaaaatccaaacacactataa

SEQ ID NO: 52717 - DNA, 1383 bp, Glycine max
  Peptide Sequence Number=SeqID_169495
atgagcaacatcaataccgccacgcgccggcgccagtggattatcaccggcgtggccgccggggtcatgctcgcgctgggcgggggcatctgggcgtattcacagcacctggctgccctgaagaacccgcccccggcgaaggccgccgacctcacgggcacggggctcgtgaacagccgctttaccggcgcggtgtccgagtcggtgctggcgcagcagcagaataaaacagccacgctggagaaggacctgtccacgctgtccgccacggtcagcgcgcagaacgacgccctcagccgcaagctggagcagattggcacggcgctggataaactgcagagccaggcggaaaagccgccggcgcagatcccggcagccggacagggcactccctctgccagcagcccggtttccggcgggccgtccggtccggcgcagtggagcatcagcaaccccggcagcggcccggcagccggacagggcagtcagttctaccccgcgcaggggcaggggttctaccccggcgccggcacggtgcgcccgggcggcctgagccgcgacacctttacctacgcctcgctcaccgacaaaaagacgaagctgccctggataccctccggctccttctccgaggcggtaatgattgagggcgccgacgccaacgccagcgtgaccggtcagcagaatacctcaccggtggtcattaccctgcttggtgacgtctccatgcccaacggcaagacctggaacatggaccagtgccgcgtcaccggcgaaatgtacggcgatatctccagcgaacgcggcgaagtgcgcaccaaaaacatcagctgcatcctgaagaacggcaagcatatcgacatgccgttcgacggtcacgtgtccttccagggcaaggtaggcatccgcggcaagccggtgatgcgtaacggcgtaatcgtcgctaacgcctggggcgccggaatgttgtcgggcttcggtgagggcatcaagtccgccgccacgccgacggtagggctcggtgcaagtgcctcggtcggtgccggtgacatttttaaacagggcttcggcggcggcgccagcaaggcggcggacacgctgagccagtactggattaagcgcgccgagcagtatcacccggtgattgatatcggtgccggcaacgcggtgaccgtggtgttccagcagggcttcaggctggaaaccatcgaagacgcggaggccgaaaaggcacagaaagaggcaccgcagccggtggtgcagcagaccgcggcgaaccagccggtcagcagcggcggcagtaacagcgcgccggtgttaaaccccgatgaagttctgcgtcaggccagccagctgcgccttggcgacaccattctccagtga

SEQ ID NO: 52718 - DNA, 1071 bp, Glycine max
  Peptide Sequence Number=SeqID_169496
atgacaacttacatcatcaacagaacaccaagctcaaatctgcagaaccagtcaccatataagttgctatatggtaaagtaccagtctatgatttgataaaggtgtttgggtgcttgtgctatgcagccactgcccctgctcaaagacataagttcactcctcgggccactaaatttgtgttccttaagtatccgtttggttacaaaggatacaagctctatgatttagacaattataaattccttatatctagagatttctatcatcaagaaattcgatttcttgaatggcgtcaagccatgaatgaggagattcaggcccttgaaatgaacaacacttgggttgttcaacctctaccacccggtaagagaaccatcagttgcagatggatttataaggtcaagtatagagcaaatggctcccttgatagatacaaggtccttcttattgcgaaagggtacacacaacaagcatggatcgattttttggacactttctcacctgttgccaagctcacgacagtgagagtgcttctttccattgcagctcacagaaattggaacatgttgcagcttgatataaataacacatttctcaatagtgatttgattgaggaagtatacatggacatgcctcttggttatcttgtcaagaatgataacatggtttgtaaactcacaaaatctttgtatggtttgcatcaagcttccagacaatggtttcacaagttctccaccaccatccttgatcaaggatttcagcaatgccctacatatcactctttgttcaccagagggagtggagcaactctagtcacattgctggtgtacgttgacgaaattatcgttgctgggccagatcaaaagttgattgctgaaatccaactaatgcttgccaaacacttcaaaatcaaagtgattgatgatctcaagtattttctaggcttggaaattgccaagtctcctcgtggcatccatctttgccaacataaatatactttgcaactcctgactgacaccgactttgcagcatcaaagcctcaatctgtccctatggatcctaattcatag

SEQ ID NO: 52719 - DNA, 534 bp, Glycine max
  Peptide Sequence Number=SeqID_169497
atggacgatccatatgatccttacatcatcataatgttgatagtcctggagaattggaactcatggaaacgagcaatgctcatgactcttggtggaagaaacaaactcagatttgttgatggaacaattcctccacttgatcctaaagatcctttgcatcatgtgtggctccgtaacaacaacattgttgcatcatggctcatgaattccatttcaaaagaagttgctgcaagtgtcacctattcctcaaatgcaacaacaatatggaaggatcttgaggatcgcttccagcaaaacaatggacctcgcatccttcaactaaaacatgatttgtcaaattgcttgcaaggttccctctctattttgcagtattacacaaagatgaaatcgatctggaaagaactcagtgagtacaagcatgtacatcattgtcactatggtggtgttcaatcactcttagatcactttcattttgagtatgtcctgaaatttttgctaggcctcaatgaaagttacagtcagattcatggctag

SEQ ID NO: 52720 - DNA, 609 bp, Glycine max
  Peptide Sequence Number=SeqID_169498
atggcctcccgtaaatgccgtgccgtgcctataccaggggaagcgtccaactggtactcttcccgctttacctcagagattgcttggcacaggtaccaagacaacattcagtttcggaacatccttccagagaggaatgttgaacttgggcctgggatgttcgatgagttcctccaggaactccagaggcgcagatgggaccaggtgcttacacgcctaccagagaagaggatcgatgtggctctggtgaaagagttctgttcgaacctttatgatccagagtaccacagtcccagattctgcagggtgcgaggacaggtcgttcactttgacgctgacacgattaacaacttcctcggcaccccagtcatcttggaggacggggaggagtacctagcctacaccagatacctcagcactcaccccgatccttacaccatcgccgccacactatgtactccaggggggcgttttggcacgcttgatctacggcctggtgagccgcatggatatggacgtgggcagctttatatctcagcagatcagtcagattgcccagtccagcacctcgaggctcgggttcccagcgttgattacagcgctgtgtga

SEQ ID NO: 52721 - DNA, 273 bp, Glycine max
  Peptide Sequence Number=SeqID_169499
atgcatggtcagatgctgaggtccattcacatcggacaacagctcatcatggagaacatgcacaggctgtccttacatctgcagatggacccaccgctcatcactctagaggcttatcgtcagcaggttgcctggccaggagaccagccctccactaacaggggggcagagcattttggagccgctaaggatcctgcggtcaatgaagacctcattgctgacctagctaacgctgactggggcccatgggcagacttgggcggaggcagttga

SEQ ID NO: 52722 - DNA, 258 bp, Glycine max
  Peptide Sequence Number=SeqID_169500
atgcccaataatgtgaatttaatgtgtttcaacattagtttcagtgtcttcctaagcgaggcttgtgcgcttagcgagaatcatgcgctaaatgaggcactcagtccgcttagcgagatgggagaaactgagaagcatctgcatgctcagaacgtcatcagctcgcttaggaaggagtttgtctcttcccgcactaagcacgccgagcctgctcagcggatattcactaactcgcgcttagcgcgaaaatggcgctaa

SEQ ID NO: 52723 - DNA, 511 bp, Glycine max
  Peptide Sequence Number=SeqID_169501
caaaacggtgccttggaatacagagcttggaggcaagctcctgagggtctgtgcacgtccagcagaaaagaatgtaagaagtgtactgctcccttggctagataattggtggcatctccaggaaggcattcaaagaagcgacgtcgaacttgatcagcttcccccacacactgacttgcttgggggatttgtcttcgggatcatacaagtttgcataaaattccttgaccaaggccatatctatgtgcccatccatcttgggtttgatggacttcaaaccaatgttggtgagaggtttgactccttggaacatcaagtggacacacgattcgaggagataaactcaaggattgcaaaggttgaagaagatgtcaccttcattcgcgactgctttgatttacctccaccaccaccatcagtttgtcatcatcaaaaagagggagatcgtagaagcaagcttcatgatgatgaaccaagcaattttgatgatgccaaaagcccaagtgattga

SEQ ID NO: 52724 - DNA, 288 bp, Glycine max
  Peptide Sequence Number=SeqID_169502
atgaagagctttgtgaacttgattgggggcatcttgaagaaggaagagccgtggccgttggagagagcagccatcgttaattgggtgtctgcaaataaaagcagtagagacaagaagatcaaaggcaaacgtgtttttcgaaaaagtgagaatgggacctcttttatatatacagagttacgcacacttaactccgagacaagaacaaccagtcgacagagaaaagaattttataacctttttttcctaatgacgccttatctcttaatttattgggttaaaaactaa

SEQ ID NO: 52725 - DNA, 210 bp, Glycine max
  Peptide Sequence Number=SeqID_169503
atgcaatgtttgtggagtttgctaaaagaagttgttctatctttaaggtgtaacgtgtggcacgagcttggacccggtttactgcatgtctcagatttagcaaagacattaaggatggttggtgttgttagaggatttagggatgcatatgggaaggtcctgctgagagaaaacaatgctacacacatggcgtcggtggatagaaaatag

SEQ ID NO: 52726 - DNA, 249 bp, Glycine max
  Peptide Sequence Number=SeqID_169504
atggctacctgcatttcctatcttccctcgttgttccatttggcattctgttgtgaaaccattgcgaaatggttactgagtactagtttaggtgggtctgagcaaaaagctggtccatatattgtctgccttgctttttttggtttcttggccaattttcaggatagcaactcccctaaggctagctactttgctgcttttgttcctctggtcaactgcttgaggcttttggtcaatggtgcatattag

SEQ ID NO: 52727 - DNA, 261 bp, Glycine max
  Peptide Sequence Number=SeqID_169505
atgaatatcgtgactgacgatgcttcaaaccaaatgataaatgtctcggagcttatgctgcagcaaacaagggttcagtctattgttgctaagttgtcattaatactctacctaccatatgaaaactatttaacaaatgggcatttagactctaccataaactggattcctggcttaaagaacatcactctaagggaccttgttggcatctatcgtaccacagatccaaatgatatacttttggactttgcggtggaataa

SEQ ID NO: 52728 - DNA, 234 bp, Glycine max
  Peptide Sequence Number=SeqID_169506
atgagacaccaacaactagttgaattggcctggggcctagcaaatagcaagaaaaagttcatgtgggtgattaggcctgatttagttgagggtgaggcctcaattttgccaccagaaattgtagaagaaaccaaagacaaaggcctattggtgggtatatctctcgtgaatgggcttttggcatggagatggatagtcataatgttacaagggctgaagtggaaaagcttgtga

SEQ ID NO: 52729 - DNA, 294 bp, Glycine max
  Peptide Sequence Number=SeqID_169507
atggacatgagtagaggctacgcccatgatcgacggatcgtcgtcccatgtccagctctggacaagcgagaagctctattgggaggtagcctagtatcctttaaattcctagttattattactgttgtgtctttaaggattagctcacctgagcgagcaccccctgcacgaaatggtttaaaaagagaaggggagtgcagttttcacccaagaaacttctccccctcacttaagaacgctgcactcacgggattgctggggatggcctttggcctaggttgtgttctgaaatga

SEQ ID NO: 52730 - DNA, 288 bp, Glycine max
  Peptide Sequence Number=SeqID_169508
atgaggtggaaaatgttgtggatgaagctcaagaaagagaagaagacgctgtttgagtctgcatcatcaccccttcaggtcccttatgacccatacaattactctcaaagttttgaccaagggactgcaaaggatgagccagaaaacttctctggatccttctctgttcggtttgctgatccttctacttctagagtacttgtgaagaaaagggtggttcaagacaaggctttggaaacttgtgattttactatctctgattgcaatgttgagtgtgcttacatttaa

SEQ ID NO: 52731 - DNA, 147 bp, Glycine max
  Peptide Sequence Number=SeqID_169509
atgccttggaaaatatgtatggatagtttgacgtgtagcgtaaggaatttctttgcaaaaacgaaagtgggtgcatcttataggatgtcgttcatcgagggaaagataggaaatggctccgaagaaactctccacgaagaggtctag

SEQ ID NO: 52732 - DNA, 285 bp, Glycine max
  Peptide Sequence Number=SeqID_169510
atggctcaaggattgtgctgttatttgtccttaaaagagatgaaacaagcgaccaacaattttgatgagccaaatgtgataggggtaggagggtttggaaagtggctatcaaaagatcaaatccgcaatcaaggtcatgttagtacacccttgaaaggtagctttggatacttggatcctgaatatttcaggaggcatcaattgaccaagaaatcagatgtgtactcatttggggttgttttatctgaggcactttatttgaggaaggtagctttggatacttga

SEQ ID NO: 52733 - DNA, 109 bp, Glycine max
  Peptide Sequence Number=SeqID_169511
gtaccacctcaccgcgctagggaactcgatatacaaaataagtgatcacgagtgggagatagattggtgtggagatcaaattgaagaacacctccgaatcaagtattaa

SEQ ID NO: 52734 - DNA, 279 bp, Glycine max
  Peptide Sequence Number=SeqID_169512
atgaacattgtgggggaagaagatgaacaacagtgcaacaacatgaataggaagatacaaaaaattcagaaccacaagtccacaacacctccatgtcatctctgtggtgctgaaaccaccatggtgccaccaccactccaccttgccgtggtgggaaacacagaggcgaggaaaagagcgcagagaggcagagaggaagacgaagagacgtggaggcaaagaaagacgctcgaggaagatgctacggaggaagatggctacggaaattttgaaaaatga

SEQ ID NO: 52735 - DNA, 1497 bp, Glycine max
  Peptide Sequence Number=SeqID_169513
atggggtcaaccttagccagcttcatgttcttgtggacgatcatgaggcagtactgtccctacggtgttcaacgtttcttcgagaagtacacacacaggatcatgagttacttctacccttacattagaatctccttccatgagtacatgggagacaggttgaagcgcagtgaggcctatgcagctgtggaggcatacctcagtgccaacacatcaaagagtgccaaaaggctcaaagctgaaatgggaaaagatagcagcaacttggttttgaccatggatgagtatgagagagtaacggatgattatgagggtgtgaaagtttggtgggtcagtagcaaagttatgtcaccaacaaggtccccaatgtcttattatccagaacaggagaaaaggttctacaagctcacttttcacagcaagcatagggacacaataactgggtcctatttggagcatgtgatgagggaaggaaaggagattcgtttgaggaacaggcagaggaagttgtatactaatagccctggctacaagtggccaagttacaagcaaacgatgtggagccacattgtgtttgagcaccctgcaacgtttgacacaatggccatggatcccgagaagaaacaagagatcattgaggatttggacactttcagcaagagcaaggatttctatgcaagaattgggaaggcttggaagaggggttaccttctctacggccctcctgggaccggaaagtccacgatgatcgcggcaatggcgaatttgttggcctatgatgtctatgacttggagctcactgcagtgaaggacaacaccgagctgaggaagcttctgattgagacaacaagtaagtccataattgtaattgaggacattgattgctctcttgatcttactgggcagaggaagaagaagggagacaagtcgccgtccgacgacgaggccgataaggatgttgtgggaaggaaggaggccaaggaggaaggagggagtggcagcaaagtcacactctcagggcttttgaatttcattgatgggatttggtctgcttgtggaggggagaggttgattgtgttcacaaccaattatgtggagaaacttgaccctgcactcattagaagggggagaatggacaagcatattcagctctcttattgcacttttgatggcttcaaagttcttgccaataactacttgaagcttgaggctcatccactgtttgatactattgagaggcttattggggaggtcaagatcaccccagctgatgttgctgaaaaccttatgcctaagtccccactggatgatcctcacaagtgcctctcaaacttgattgtagcacttgaggaagctgcaaaagttgaggagatgaagcagagtagtcccatcaaggaggaacttcttcaacaaaatgggtccattaaggaaaatggtgagcttcatggtgacaaagcaatgaatcagtgccagatgtggctcgttaatgatacataa

SEQ ID NO: 52736 - DNA, 687 bp, Glycine max
  Peptide Sequence Number=SeqID_169514
atggcggttgcaattgtcatcccttgtgtgcttatcattgaacacatgagagtgatttccactagaagatgggatttggacttgaggacttgtgggcaaaagagacatttcatccctttctggatgagacctttagacgagaaggagacgagcgcggtgttcgagaagctgttcaaattcgtcggaaacaacctgaagaacatcgtggagaacccctcacacgaaggtcctgattcgaaccctggccgctactgcttccgcctccacaagaacaagatcttctacgccagcgagtccctcgtcaaacgcgccaccaacgtcgcgcgccccaacctcgtctccctcggcacctgcatcggcaaatacacccacggcggcagcttccacctcaccgtccaggccctaaacttgctcgccgccaacgccaagcacaaggtctggctcaagccgcagtccgagatgtccttcttgtacggtaaccatgtcttgaagggcgcactgggcaaactctccgaaaacattgctgccggcgacggggttgtcgtgttctccatggccgacgtgccgttgggtttcggtgtcgccgcgaagtccacgctggattgtaggaagctggatccgaacgggattgttgttctgcaccaggccgatgtgggagagtacttgaggatggaggatgagctttga

SEQ ID NO: 52737 - DNA, 1539 bp, Glycine max
  Peptide Sequence Number=SeqID_169515
atggcaggtggaagtttcgttgattcaaatggagtacggcattatgaaggaaaagtcacagggtttgtgctaattacatgttttgtggctgccatggggggtcttctctttggatacgatctgggtattacaggaggagtgacttctatggacccatttttgatcaagttcttccctgtcgtgtatcgacaaatgaaaggtgaagcagaaagcaagagtcaatattgtaaatttgacaatcaacttcttacattattcacctcttccttatacctcgcggcattgatagcctgcttttttgcttctactacaactagaatgtttggacgtaaaccctcaatgtttattggtggcttgtttttccttattggtgcattgttgaatggcttagccattaacatcgaaatgcttatcattggccgtatattactaggctttggtgtgggattttgtaatcagtctgtaccagtgtatttgtctgaaatggctccagcaaaaattagaggagcactcaatattggctttcaaatgatgattacaattggtatcctaattgcaaacctcatcaactatggtacctccaagcatgaaaatggttggagaatgtctttgggcattggagctgtgccagcaattctgttgtgtataggatctctatgcttagatgaaacacctaattctttgattgaaagagaccaacatgaaaaagccaaggaaatgttgaagaagatccgtggcaccgagaacgttgaagaggaatatcaagatcttgttgatgctagtgaagcagctaaaatggtggaccatccatggaagaacattgtgcaacccaaatataggcctcaactcattttctgcatttttattccaacatttcaacaactcaccggcatcaatgttatcatgttttatgcgccagtacttttaaagattttaggcttcggcaatgatgcttcactcatgtctgcggttataaccggagttgtcaatgttgttgccacacttgtgtctattttcacagtggacaagtttggaagaagggtattatttcttgaaggtggcgcacaaatgcttatttgtcaggttattattggaatcatgattggtttaaagtttggattgaatggtgaaggatcatttagcaaaggagaagcagacgttcttttgttctttatttgtgcatatgttgcagcatttgcttggtcttgggggccattgggttggttagtgcccagtgaaacatgttctcttgagattcgaccagcaggtcaagctatcaatgttgcaatgaacatgctcttcacctttatcattgctcaagtcttccttaccatgctttgtcatcttaagtttggcctcttcttcttattcgctggctgtgtggttatcatgacccttttcattgcgttgcttctacccgagaccaagaatgttccaattgaagaaatgaatagaatatggaaggcacattggttctggactaagattgttcctgatgttgctgctactgtcgctcctggtaaaaaggtggttccatga

SEQ ID NO: 52738 - DNA, 312 bp, Glycine max
  Peptide Sequence Number=SeqID_169516
atgggattgggagcggggttgcttggaggagccttgggtggacttctaattggggacatgatttctgatgctggctatgacgctggttttggagatgtagagtcaataaaccctaattgcggtgtaaaccctagaaggaggaagaagaggaaggatgagacctttggaccagaaggagacgagcgcaatgttcgagaagctgttcaagttcttctacgccagcgagtccctcgtcaagcgcgccaccaacgtcgtctcctccttcataatttaaataaaatgggtaacaggttcgtcttttttgctatttga

SEQ ID NO: 52739 - DNA, 267 bp, Glycine max
  Peptide Sequence Number=SeqID_169517
atgaagattttgtacaggtggatgatgatgttgtctgctgtacaagttaatgacctgaattgtattgatgagcaatctctttctcgtcgtctcattggtctgaattgtattgatgagcaatctctttctcatcgtttcattggtcgacttgacccttgttattttgagcttatttttaaaaataatgaagagaacaagacttccttgttttacataaatagccccagggcaggactcagtattgcgagtaacactaaactcaactag

SEQ ID NO: 52740 - DNA, 1590 bp, Glycine max
  Peptide Sequence Number=SeqID_169518
atgcatcaaccccaacacaatgccaacaacaagaacaaaaacgacgtcgtcagggtcaccaccaacctgaaacgaattctgaagcccaaagcagagatgaaaagagggagaacaggcaagttcgacaatttggtcgcactgagcagacaacgatccattcagattctcatcgccattgcgctcttgtacgtcctcttcctcaccctcgaaatccccttcgtcttcagaaccgcccaacaacccactcacacccgccgtcaactcgttcgccgccaaaacggcgtcgtctccgccttggtcctaaacgacgccgcgttcgattcggagctctaccaatccgcctgccgcgcgggaaagaccgtctgggaggaactaagatcaggaagcccgccgggccccattccgagtcctgagaatcgatccgggccgtgtccggaatccgtttcggtgtccgggcccgagtttctgggccgcggaagtgtgatggtgattccgtgtgggctcacgttggggtcccacgtaacggtggttgggaagccgttaagggcgcaacggaagacgtgtcagttcgtgatggagttgcaggggctgaaaacggtggagggtgaggaaccgcctagggtgatgcatttcaaccctaggttgaaaggggattggagtgggaagcctgtgattgaactcaacacgtgttaccgcatgcattggggtactgcattgcgctgtgatggttggaaatccagagctggtgaagatactgttgatgggttggtgaagtgtgagaagtggattaggggtgatgatgatgatagggatgcagtggagaccaaggcagcgtggtggttgaagagattgatagggcggccaaaacgagtaacagttgactggccatttccattttctgagaacaagctatttattcttactcttagtgctggattggggggttaccatattaatgttgatgggaggcatgtcacctcttttccttatcacactggatttactcttgaggatgccactggtcttactttgagtggggacattgatgtccattctgtatttgctgcctctttgccttcggtgcatcccaatgtttcttcgcagcaacatcttgaattttcaaccagatggcgtgccccgaatcttcctcgctatggtgtggaattgtttgtagggatcctttcggctggaaaccattttgctgagcggatggctgtgaggaagtcatggatgcagcatagctttatcaagtcttctaaagtggtcgctcgtttctttgtagcactgcacccgaggaaggaaattaatgtggagttgaagaaggaagcagaatattttggtgatattgttatagttccttacattgataactatgaccttgttgtgttgaaaacagtggccatatgtgaatatggggttcgcacagtttctgcggagtatatcatgaaaggtgatgatgacacttttgtaaaagttgatgctgttatgaatcaagcaaggaatgttccacgttctatgagcttttatattgggaacattaattaccgtcacaaacccttgcgccgtggtaaatgggctgtgacatataag

SEQ ID NO: 52741 - DNA, 822 bp, Glycine max
  Peptide Sequence Number=SeqID_169519
atggaacctcttctcttcaacgactccacattctcttcagctaacccttctttgtctgagatttggccctctcatttcccctccgatcacactcccaggaagaggcgcctctccccctcgagtgattctgccagcaataaacatatcaagttatcagcaccagaatcccaggatcaaaacggtgcgttgaaggttggtgaagtagacgcgacttccgtggccggtaacaagctacctcaacaaaccccgaaacctagttcttcggagcaggcacctaagcaagactatatacacgtgcgagccagaagaggccaagccaccgataaccacagtctggctgagagagctagaagggaaaaaatcagtgagaggatgaaaattcttcaggatttagtccccgggtgcaacaaggtaattggtaaagcatttgtgctggatgagataattaattatgtccagtcactgcaacgtcaggttgagttcctttcaatgaagcttgaggcagttagttcgagattgagcatgaagcctactcttgaatgttttccttcaaaagaagtaagtgtattgacaactcccaggaaatgcccagtgctggttttaacatatactgatgtttcatacatggtaacatggataaggaaagaagaatgctcaagtgaaccctgctgtcaagtatatttacctgattctagggaatgttctgtttgcactcaggccggaataatatttggatcacaaccggccaagggatatgctcaaggatcacaaatgggatggctgcatatgcagatagctggtggttttgagaaagcaacataa

SEQ ID NO: 52742 - DNA, 723 bp, Glycine max
  Peptide Sequence Number=SeqID_169520
aaagcacaaagaagaatcaatgtgtcacccgggaattccttttgtgaaccgagaagggttgatggtgcatagaagatggcttgtgtcatcaccactggcaaggcagattcatgatggtggcagctctggagagagtggttcggtgcagcgatgcgtgtgctctccgtcgcagcatccggggtcgttccggtgccggttgcatcatgtcaatgtcaaacggaatcacacccttagcgatatcttcgagcaagtagaacgcatcgtagataacctcaaatccgtcgatggtgagcgtggcgtcaacgtaggaggagccgcgcgccctgatgctgccgccgccggcggttacgaagccgagctggcggccgcggtcgagaatgggcctcgggttggttcggatcccgatgcggtcgagtcggatccgagcgagacgaatctccgggtcggaggggtagaggaggaaggcggcgccagcgacgaggaggaagaggaagagtgccgcggagtagatgatgcagcggcggcgacgacgctggaaatggggacggtaggaggggagcaaaacgacgacgttttggggggttggagggaaggggcgagtaagagacgaactcgtccttcccgatcatcttcgaagattgtatggtactttcaggagacaaacaatgattgggtacgaggtgcaaggggaggtggtcggatatatgagatgaagttgagtgg

SEQ ID NO: 52743 - DNA, 864 bp, Glycine max
  Peptide Sequence Number=SeqID_169521
atgaaaactggtagcgaaaacagtaatgaagaaaaccaacccgaggaaatcagtggcttttatgtacctcatcacaaaccactaaaagcacatggaaccatcagtgatatgatagttgatgcttctcaaggcatctcatttgtgtgcaacaatattgcagaatatggaggtgaccctaacagaatttacctaatggggcagtcagctggggcacatattgctgcatgtgcaattgtggagcaggcaatcaaagaggcaggtgaaggagaaagtacttcttggagtctttcccaaattaagacttattttggtttgtctggaggaaaactcataagtggaaaaaactcaaaccatagggttgtggttaaaaatgtgatttcaagcccacaagtgtacttctttgttaagtccattgatggggatctccatgctctacgacctgttttgactcaaaccaccaacaccagcataatggaaggggaggaatccctgcaacggttttctccagaagtaatgattcaagatccaaacattggaaatgcgaattctctattacctcctgtagttctttttcatggaactggggattattccataccatcagatgccagtaaaacatttgctgaagctcttaaaagagttggagtcacagctgaatcaattttgtacgaagggaagacacatacagatgtgtttctacaggatcctatgagaggtggcaaagatgatatgtttgaagatttagtagcatatatccactctggtgatgctgatgcccgtgccagagatgcaacggctcccccaaggagacgccttgtacctgaattcatgttaaaattggctcatagtgtcagtccattctaa

SEQ ID NO: 52744 - DNA, 216 bp, Glycine max
  Peptide Sequence Number=SeqID_169522
atggcacatgtgttaaaaaagaagggagtagcacctccacgaagggtggtgcgcctccctaacactgctagtgcaaggctcgacgatgcaagaccaccatcagggcaacgatggcggtatgaaggaggcacgatgacacagacgaaaaaagaaagaagaaacgaaggtgtttacaaaatgtgtgaaaaacccaaaacaaaatgcaataacgaatag

SEQ ID NO: 52745 - DNA, 498 bp, Glycine max
  Peptide Sequence Number=SeqID_169523
atgtcttctctcttccgcgaaaaagcttttctcctctcttctctcttccgcgaaaaagcattctgtcttcttctcttcttctctgcgaggcttctccagcttcatcttctccgcgaggcttgtcttccatttgcattcgagatgaaccttagggtagaggacgccggaaaaaatggcggaagcttggtgacggtgagccttccggaagactcgttatgggttcttccggaacttccggaagaagatcttccggaagatttccggaagaagggtcttccggaagttacccattccggaagaagtgcttccgaaattaacttccggaagaagattcttccggaaacttctggaagaaggttcttccggaaacttccggatgatgttcttccggaagtagtttgtggggcaattttgccacttcactgtttgctgggtgccccaacaataatgctgggtgcacgtaacaactcccaaatccaaaatgctctcacaggctag

SEQ ID NO: 52746 - DNA, 939 bp, Glycine max
  Peptide Sequence Number=SeqID_169524
atgatctcagcgcgtggacccatccttccaacaactccaagttccatttccattgctcgtcaaatccaatcaaattattcaatacagcaattgaattcactcagtgcaaagtgcaataccaaatctaagttgtatttggtgttggacttcattaatggggggcatctcttctttcaattatatcgccagggtatcttcagtgatgatcagacaaggctttacactgctgagatagtatctgctgtttcaccccttcacaaaaatggcatcgtgcatcgagatcttaagcccgaaaacattcttatggatgctgatgggcatgtcatgctaattgattttggactgtcaaaagagattgatgaattgggaagatctaactgtttttgtgggactgtagaatacatggctccagaaatcctactggctaaaggccataataaggatgcagattggtggagtgttggtattctgttgtatgaaatgctaacagggaaggcaccaaaacacaataacagaaagaaacttcaggagaaaattattaaagagaaagtaaaacttccaccattccttaccagtgaagctcactctttgctcaacggattgctacaaaaggatccatcgacaaggttaggcaatgggccaaatggagatgatcagatcaaaagtcataaatggtttaggtcaatcaattggaaaaaattggaggcaagagaactggaaccaaatttcaaaccagacgtgtctgcaaaagattgtacagctaattttgaccaatgttggacagcaatgcctgttgatgactcgccggcacccacgcctacagcagcttggtttagttcttgtcttaaaggaaaaagatttgaattgctttgccttccattcaggtcaacattaacatatttgactagccagggcccaaaggagggtgacaggctatag

SEQ ID NO: 52747 - DNA, 1161 bp, Glycine max
  Peptide Sequence Number=SeqID_169525
atgctggaaagaacaggtttcagctctaaatgggtcaaatggattgaggggtgtttgaaatcagcatccatctcagttttggtgaatgggagtccctcggctgagttcctccccaaaaggggtcttaggcaaagggacccattagctcctttcctgtttaatgtggtggctgaaggtctgaatgggttgataaggagagctaaggaagaaaacctgtataagggtttccaagtaggcatcaataatgtgaatatcagcatcctacagtacaccgacaacacaatcttttttggggaggcaatcatggagaatgttacagcaatcaaaactatcctaaggacgtttgaacttgcctcaagcctaaaaatcaactttgcaaagagttgttttggagtttttggtcaatcacaacaatggaagcagcaggcagccaaatatctgaattgcagattgctggctcttcctttagtttacttgggaataccaataggggcaaacccgaggcgaggacagatgtgggattctatcatccacaaatggaagagaaaggtacctaaatcaatggtggataagttggtgatattgcaacgtagatttttatggggaggcgcacccgaccaaaacaagattgcatgggtcaggtgggagacagtgtgtctaccaaaagaaaagggtggtttgggcattaaggacatcaacaactttaaccttgcattgctcagaaaatggaggtggaaactcatgcaacacaaaggagaactatgggctagagtagtggaatccaaatatggaggatggcggggtttgtttgaagcagatagagcaggacctgaatcagtatggtggagagatttaaaaagagccctcattcatacacaacaggggcagcttattcaaaatggcctgaagtggaagcagcatcaggtcatccaacagatgggaagccacaaggataatggatggaagtggaattttacctggagaaggccgttgtttgacaatgaaattgactgggctatcagttttctaaatgaggttcaatataaggtcattcagcaacaaggatctgatcggtgggagtggattggagacccaacaggccaatattcagtgggaaactatgtcatggaatttttccttatcataaacaaaacaacatga

SEQ ID NO: 52748 - DNA, 252 bp, Glycine max
  Peptide Sequence Number=SeqID_169526
atgcctatttatagaaaaaaaaaggcatttgggacaaagacagctcgcccagacgaactaaggcttagtcctgaagtaattagctcgcctaggcgagttggttacttcatcctgaagtcttttggtggctcaggcgagccagaggatagcctgggcgaggtagggtctaggaaactcaatgaaaagacccttttgcccctcctttttgttcagctagcgagaatgaaaatatcagtgaatgatagtccttga

SEQ ID NO: 52749 - DNA, 852 bp, Glycine max
  Peptide Sequence Number=SeqID_169527
atgaagggcacatcaaaattcatcatgggagcaaccttggtaatggtggtaagccttgccattgttcttggcctcatactagttctactagctgaactctattgttctctcttactccgccgccgccagctgagaagaaaaaccaacaccattcccatctccaccactcaaaccaccacaaccatatcaaatcatgcttcttccccttcacacaccccacaacactctccttctcctcctcccttttgcaatgatttttactcacagggggtcctccaagcccctagaagcttccttttcccatgcaaagatgaaccaaatgcaaccccacgtggcattggacttgtttctgctgtctcatcatctccttcgttagcatcattcttggcaagagctccacctcattctcttcttcagcaacaaaacacacttcaagttagtgctagtggcattaatgaaattccatgtgctgattataataacaagtcttgtggtggtggtgtggagcaccttgtgtacatttccaaccccatttatgagaacgaagaggggaaagcaagcggggcaaatgataccccgtttgagacaccacacacttcaccctctcgtttagcaagaagtggttcttctggggaagatgatgatcatgctggtgctcaaggatcaccaccaccaccaccttcagttacacctcctctcacccctatgaagaagctccctgcagcagaaggttcttctgtttctcttagagatgccacttccttgggtacttcaggaagtgattctcatagcatcaatggtccatcttcttcttcttccttggataccccttgtacttctccttcgtggtga

SEQ ID NO: 52750 - DNA, 372 bp, Glycine max
  Peptide Sequence Number=SeqID_169528
atgtattgggatgtggaggaagaacttactacgatgatagagtccaggcctcttgaaggtcctgggaatcatttgtactcttctctatatcaaagctctctgatccagagggagcagtatggtgtagacaagaatggaagcaagaatgaagatccctgtgttctcaggccacatggggcagtattcaagattgttaaaattaggaggtttcaaccatccatgatccagaaccttgatgaaatctttttggatttgactgaggaagaggtgaggacaaggctgaagctgccctctagtggatcactatcagcagtgacagacttggtgcaactcatagatgaaggacctttgatgcaagaagacaaaaggtaa

SEQ ID NO: 52751 - DNA, 2073 bp, Glycine max
  Peptide Sequence Number=SeqID_169529
atgaggacaccgctgtttagggccgtgtcggtgacaaatgttgacctttttattgatcctttacttgaaatttcaatactcaagcgtctaaatattcttaagttcatgggaccatttcatattttccctcatgtcttttgcagtggatgccctgaggaagtcagggaggctatatcatctctgatgtttgccgctgcaagattttctgatctaccagagttacgtgaccttcgtcaaatatttcaggatagatatggaagttctctagaatgttatgtcaatcaagagtttgctacgaatttgaattcaaagtcttctacgttggagaagaaggttcacttgatgcaggacattgcttcagagtttgcaataaaatgggattccaaagcttttgaactaaggatgtcaaaatgctctgtttttgcacaggaccgcaataattttaagtctaaccacacgagtgatcatgatataccattacaaggcaaggatgctaccccaaaaggagtcaagtttgagagaagtcatgaccatcctaatgacaggcacaaatttcagaatggcaaggaggctgttgtctcaaagggagacgaaaatcatctctgttccaaatccaaccctccaatccctgaaaatggattcaagccactaagcagttacgatgaagtaaatctgaaaagggatagccatggcaatccgttacctggaagagaagaactttctaaggtgagtgatagaggctattggaaggagggtagtatgctaaaaccaattggatcttcttccaaggatacaagagaggaacaatttgaaggtggttccaatctgcatgatagttgggggaatgccaggcgtgtaaaagaaagccaggacactgctactgctaggaagtctcctggccctgccggatctcgttcaaagaacaatgtgaatgagtcatatgttgttaatcacggtggcctacctgatgttgattacttggagagaaaaaatccaaaggatgaaacttttagagtaaagcccttctacaataatgcgaatccacctgcttatacaagagaggaacaatttgaaggtggtttcaatcagcatgatagttgggggaatgccagacgtgtaaaagaaagccaggacactgcaacctctaggaagtctcctggtcatgcaggatctcattcaaagaacaatgtgaacaagccatttgctgttaatcatggtggcctacctgacgttgataactctgagagaagaactcaaaaggatgaaactcctagggcaaagcccttctacaataatgccatgatcccacctccttatgtaaaacctcattctaaactgaagaacaacaagcatgaaaacaattcagtatattcaaatattgacagtgatgggatccgtacataccctttggtacatgaaaagcctgatgctgctcctacaatggacaggatccaaccaggtttggatgattctgaacgggatttgcaggccactagacatgcaagactgagtaaacatggtcatgaaaaagcactctctgttcaggaagatgctacagaagccgttgtattaaaacaaaagtctacaagacggaagcactcaaaatcaagatctactcaagatgatgccagtaatgaagatgctgaagttgtgagaaaaccaaggagtaggagacgagatgaacaaaaacgtggcctgcaaattttgtttgatgatgagcggcacaaaaacgatgaagaggaaagggtaatagatagattactgatccattatagcaaaaaaccatccataaatgttcctgaaaaaacaagaagaaagtatagaagttgccttgtacatcagatggataactcaaccagagatggacctgatgagacaccagagatggttactcgtccaccaagatcagtttcacttccccgtgaacaaacagaagctgtggaagttaaaaaagtatatgctcgtgctgcttcatttcagcctgagaggttgaacgaagctcggcatgtacatcccaagttacctgactgtgatgatttagctgctaggattgcggccttgagaggaacataa

SEQ ID NO: 52752 - DNA, 345 bp, Glycine max
  Peptide Sequence Number=SeqID_169530
atggaggagatgtccaggttcataaatgaggtccaacaacccagacaaaagcacaacaagagagaaggaggtaccaagatcgaatcacacaagctggacaagcaccaacctatccaaaaaggacccaggtatgagcgttatacacctctaacgactaatcgtactagtatcctcgaggaaacctttaacgcagatgtacacataaagctacctctgccatttcctcccaggctggggtctgataatcacccaataggagtgaaacccgaagggcaccaagaggatcaacacagaaatcatgatactaaaagaagtaggggcaaagcagaagatcgaaagagatag

SEQ ID NO: 52753 - DNA, 663 bp, Glycine max
  Peptide Sequence Number=SeqID_169531
atgccacgatctagttccgccgtgcaccaccaccgtcagagctccgataacttcatgttcgacgctcacggaaggtggttacactcttcggcttacgcgcaggagctcgggactcgatcttcgagcttgaggagaaacgacgatgatcgcgttttaaccagtggcttgcttgatctgcattctttcgataccgagcttttacctgagatgtatggtgttcacaatgagtatttaacgaatcatactattcagggacaaagttttgatggctacgagtcgattctctctggcaacaaacttgtaccaaggtctcggggcttgcctgagagccatctccttaaaagtgtctcagcagataaagagagagcaaacaatgttgccaagatcaaagttgtggttcggaagagaccactaaataagaaggaaatagcaaagaaagaggaagacattatttacatagattcaaattttctcacagtgcatgaaagaaaactcaaggttgacttaacagaatatattgagaaacatgagtttgtttttgatgctgtgctgaatgaagatgtttcaaatgatgaagtgtatgctgagactgtggagccgattgttcctttgattttccaacgaacaaaagcaacctgctttgcatatggtcaaactggataa

SEQ ID NO: 52754 - DNA, 456 bp, Glycine max
  Peptide Sequence Number=SeqID_169532
atggttttcaaccttttctcctttaagaaatactgggacatcattaaaaaggatttatggaggttggttcgtggtgcctttgtgaatgggttttatgaagctagtattgtggaagtgcttattgccctgattttgaaaatttatcatcctaaacaatttaagggcttcaagccaattagcctttgtaatgttacccacaagattattactaaagtcctagtgcatcgtctcagaccttttctggaggagattatcagtcctcttcaggggattttttgcctaagagatgatattctcctatccgctaaggccaaggagcctcaattcgagatgattaactccaccttggatctattttgcatggagcctgagcttaaagtcaacccccttaagtcaaaacttatgttttcgaggatcagcgagctattaagaatatatgtctcaacctcgtgttaa

SEQ ID NO: 52755 - DNA, 1814 bp, Glycine max
  Peptide Sequence Number=SeqID_169533
atgccgcttaaaatgacacttacgctttcacctttctcccccacgctcctcactccggccaccaccctccgccaactcctcttcactaacttcacaccgtctccgaaacgcaggctcctactccaagcacgtgcggcgaagcccaatgtcctcatccccataaacccctcggtgacggtggagaaaggaaagtacagctacgacgtggaaaccctaatcaaccgcctcaccgcgcttccgccacgtggcagcatcgcgcgctgccttgaccccttcaagaacaagctctccctcaacgacttcgccctcgtcttcaaggagttcgcgcagcgtggcgactggcagcgctccctgcgcctcttcaagtacatgcagcgccagatatggtgcaagcccaacgagcacatacacaccatcatgatcacgctattgggcagagagggtcttctcgacaagtgccgcgaggtgttcgacgaaatgccctccaacggcgtcgtccgcaccgtctactcctacaccgccatcatcaacgcctacggccgcaacggccagttccacgcctcgctcgaactcctcaacggaatgaagcaggagagggtttcgccgagtattttgacttacaacactgtgattaatgcttgtgctaggggtgggttggattgggaagggttgctagggttgtttgctgaaatgaggcatgaagggattcagcctgatgttattacttacaatactttgcttggtgcttgtgctcatagggggttaggtgatgaggctgaaatggtgtttaggaccatgaatgaaagtgggattgttcctgatattaatacttatagttatcttgttcagacgtttgggaagttgaataggcttgagaaggtttcggagcttcttagggagatggagtgcgggggtaatttgccggatattacttcttataatgtgttgttagaggcttatgctgagttggggtctatcaaagaggcgatgggtgtgtttaggcagatgcaggctgcggggtgtgtggcgaacgcggccacttatagtgttttgttgaatttatatgggaagcatgggaggtatgatgatgttcgcgatctttttcttgagatgaaagtgagcaacacggatcctgatgcggggacttacaacattctcatacaggtctttggggagggtgggtactttaaggaggtggtcactttgtttcatgacatggcggaggagaatgttgagccgaacatgcagacttatgagggcttgatatttgcctgtgggaagggagggctctatgaagatgccaagaaaattttactgcatatgaatgagaaaggagtagtgccgagttccaaggcttatactggggtgattgaagcgtttgggcaggctgctttgtatgaagaggctcttgtcatgtttaacactatgaatgaagttggaagcaacccaactgttgagacctacaattcgttaattcatgcatttgcaagggggggactgtacaaagaagcagaagcaattttatccaggatgaatgagtctggtttaaaacgggatgtacattcgttcaatggtgtgattgaagcttttaggcaaggaggtcagtatgaagaggctgtaaaatcttatgttgaaatggaaaaagcaaattgtgaacctaatgagctgacacttgaagcggtgttaagcatatactgctccgctggtcttgttgatgagggcgaggagcagttccaagaaattaaagcttcaggaatactgcccagtgtcatgtgctactgcatgatgctagctctttacgcaaagaatgacag

SEQ ID NO: 52756 - DNA, 414 bp, Glycine max
  Peptide Sequence Number=SeqID_169534
atgcaaaaatacgtaaagtggaaatttcaatgctactctagagaatctacgactactttaactataaagaaggttagtgcatttggaggtccatacttcacacaaaaacacctcctgaaaatttcactggcaggacaacacaaagaagctaagtgggctactcagtccaaaaatgaacttgagcagcaacaccataggagagcaactgcagcgggcattgaacatggcagaggaggtggtggcatgtcggctcagagagaaggaggtggaagtacaaatggtcacaagcaagaacgcgaagctagagttgaggtggggttattgtcattggagttgagctgtgatttgcagcaacagtgggctgtaatggccactccaacaaaatatgacatgatgagcacaacattgcaatga

SEQ ID NO: 52757 - DNA, 1719 bp, Glycine max
  Peptide Sequence Number=SeqID_169535
atggaggattccgagaaattgacggcgttgaagaaggcctacgccgatatcatcctgaacacggcgaaggaggcggcggcgcgaatcatggtgtcggagcggaaagtcacgcgctttcagcaggaacttgtttccactaaggaagaggcgcttcggatgcttctcagactcaaacaaatgttcgattctaagagggatcaactggcacttctgcaattgcctaactctccaacttacatgtacatctggtttgagaatgaagctaagttgtttgtgactgtcagtgaagcggagctgatgtcattgaatcagcagaagaagattgaggagcttgaagctcagctccaggaagctgaggaaatagttagagatctaagggcagagttgagagaaacccaggctgagctggagaatgtgacaaaacaccaaatgcaacccctagttgaacaaaacacagaggctgaagttgcagctcaggaaagttttctgcaaaagaacagacttgatccttatgatggatctatatattctgcacctggtttacagtttgaatctgtctctatttctgaaaataggaatccgattgtaaatggatcaaatgatagcagtaagttctgtgggtcacatgatcatacaaacaactgctacattcataatccagattttgcatccatagtcattaggaggaaagagcccaagctctacagaaatggttgcactcagagaatacatgcatttgaaaggagcctttttgatggaaatatgtctgtttcaggaaacttagataatgtacagaatgaaaatttagtcagtgtacatgaagaaggtaaaacaatgactgtatcaactaatgccaaagctgatattatttctgaaaaggagaaaccagatgaacttaaagtggtgaaagcagttgctgaccttgtcaaagttccagttcaaagaaaaaagagaaaatttgggaaaaggaaggctattattaaatccatattacattctaaccaggttaaggaaacaaataaagaatcacatctgtcttgtgccaaagattctacacttgtattggataacgatgacccctcaagggtgagttcttctatggcatgtgaaaatgaagctcagaaggatctaatgtctccttttgctgatgtaccgacagacacaactgcaacaaatgagaaatcaggacctcatagcaatgctgaaaatggggaagtatttgttaaagctggcagtgcttggaacataactaaagatgacaaggaatcgttggataaatcagatttaacaagacaagagagtttgtctgctgaaagtgtggaggttccggcttgtaaagatgttgaggcatctaatgggtcactggataaaatggattcaaaagtatctgatttagatgagaaggtttctaatcgatctacaggcgataagtttaagttcacattctgtagaaagcgtaagaaggaggccattagctgtgatgatgtagattgctctcaagataataccagttcaaagaaaaagtgtggagagaagcaagatgatcatgtggagcctcagaaatcttgcacaatgactgaatcatctcgggacagccgacgactagcacaagttgctcgccaggtagtgttaaataaactacttctctttttcaaacatggtcatagcattgtagaagttatgttgctagttgctgacaagggtgattaccttgactga

SEQ ID NO: 52758 - DNA, 471 bp, Glycine max
  Peptide Sequence Number=SeqID_169536
atgactcgtgaaatattaagcaggtttatactatctttccctataatattcttcaagccttacggaaggtggatcttgttctcgcacctacagttcctgatcagtgattgcaactactatccttcttcaacatataaatggctgacttctcaagtgactattggcacctatatcccttttgctcacttcaaatggccatggaaacttaggatcctggagaaaatcaaaatctttctttggttgataccacaaaaaacacggttcccaatgttgcttgccctcactgttttgagcttagcgagtcagccttgcactgtcttcgtagttgccctcacgctatattggagtgtggttgcggttagggttcctttcttaaccaaggtttctcatctctgtgtcaagaagtggctcaaggagcaactgctgagtgatagaggattcctgtttgtcgctttcgttgtgtggatttag

SEQ ID NO: 52759 - DNA, 1974 bp, Glycine max
  Peptide Sequence Number=SeqID_169537
atggaaccattgcctctcaaagcatcccacgatattttaagattaatgcaccacacataccggaaccaaggtttccaactgtttgttagtttcttcgaaatatatggggggaaactttttgatctcctcaatgaacgaaaaaaactttgcatgagggaggatgggaaacagcaggtttgcattgttggcttgcaagaatatagagtatctaaagttgagacaatcaaggaatttattgagagaggtaattccacaagaagtactggtacaactggagcaaatgaggaatcctctcgatcgcatgctatacttcagctttgtatcaagagatcagctgatgggactgaatcaaagcctacccgacttgtgggcaaactatcttttatagatctggctggaagtgaacgtggtgcagatacgacagataatgataagcagactaggattgaaggggcagaaataaataaaagtttacttgctctgaaagaatgcattagagccctagacaatgaccaagggcatatccctttcagaggaagtaaattgactgaagttctgcgagattcttttgttggtgattcacgcactgtaatgatatcatgcatttcacctagctcaggttcatgcgagcatactcttaacacattaagatatgctgacagagttaagagcctgtcaaaagggaacacctctagaagggatcctctttcttcctcaaaccttagagactctactgtgttgcctggctcttcagttttatctcatgatgataccttggaggatgaaacaacatatgtttccagtgacaagaatcgatttggttggcccaaacagctagaaagggaaccctctcctccgaataatgtggaccgtgttccaagtggtagaatggggggaaatttgataccatctgtgtattctgatccacaaaatggtcaaagaggcagtcaaaaggccagaactgcaaatgaatatgattacctaggaccaacatatgaacaggatagaacgagaaaaacaagtaagagggtggataacaaccaattatctgccgtgggggacaagaggaagatagaatctcgtgttaaacttgtggatgaattgcattttgaggctaatcattctgatcctgacgataatttaaatgccctcctgaaggaagaggaagatctcgtaactgctcaccggagacaggtggaggaaacaatagacattgttagggagttacatttcagagttaagagcctgtcaaaagggaacacctctagaagggatcctctttcttcctcaaaccttagagactctactgtgttgcctggctcttcagttttatctcatgatgataccttggaggatgaaacaacatatgtttccagtgacaagaatcgatttggttggcccaaacagctagaaagggaaccctctcctccgaataatgtggaccgtgttccaagtggtagaatggggggaaatttgataccatctgtgtattctgatccacaaaatggtcaaagaggcagtcaaaaggccagaactgcaaatgaatatgattacctaggaccaacatatgaacaggatagaacgagaaaaacaagtaagagggtggataacaaccaattatctgccgtgggggacaagaggaagatagaatctcgtgttaaacttgtggatgaattgcattttgaggctaatcattctgatcctgacgataatttaaatgccctcctgaaggaagaggaagatctcgtaactgctcaccggagacaggtggaggaaacaatagacattgttagggaggagatgaatttactcgttggagctgaccaaccaggaaatcaactggatgattatatttccaagttgaatactattttatcactaaaggctgcaggaatctttcaattgcagacacagttggctcaatttcagagacgcttaaatgagtataatgttgtcgtaacgtctggtaattga

SEQ ID NO: 52760 - DNA, 960 bp, Glycine max
  Peptide Sequence Number=SeqID_169538
atggaacacaacatcatcgttaacaacaacaacgtgatcgcaccgtttgtcataaaaacctacaacatggtgaacgatcccaccaccgataaactcatcatgtggggcccagccaacaacagcttcatcgtcctcgaccccctcgacttctctcactccctcctccctgctttcttcaagcacaacaacttctccagcttcgttcgacaactcaacacttatggtttcagaaaggtggatccggatcggtgggaattcgcaaatgagtggttcctgcgaggacagaagcacttgttgagaaacatcgcgcggaggaagcacggtggagctgggaggagcaatttcaatttgcattcgcatcatcatccgttgaaggtggaggaattggacgacgaagccatggtgatggagatagcgaggttgaaggaggagcaaaaagcgttggaggaagagcttcaaggaatgaacaagaggttagagacaacagaaaaacgaccacaacaaatgatggcttttctgtccaaggttgtcgaggacccgcaggttctttctcggattctccgagaaagagaaaagaaacacctgggcgagaaaaagcgccgcctaattccgccgccaacaacgacggcagcgacgacgtcgtcgtcgtcgtcctccggcatcaagacggagttcgaagaagacgaaggtaattataatatcatgtcttcgtcgccagagacagggttggaaatcgataataataatatttgttcgcctctggcggcggggtattggggggaacagggttgtcatgggtacaatcgtggcgccgtgacggcgccgttgacggtggtggcgccggcggttccgacgatgggaggagggtatttggggcgtggggttttttttggggaaatggcggcggaggggaatgcggtgccgccttatccgttttcgttgttggaaggtggcttttag

SEQ ID NO: 52761 - DNA, 627 bp, Glycine max
  Peptide Sequence Number=SeqID_169539
atggagagcgggtttgctttggtgttgctctgcatgggaattgaatttcgcttgaaagtcagccatgacttatgtcttcatgggatcgcgaggctcatagtggaggtcaaacttcaaatctttgatggaccaggccatcttccttcctgcaagttcaggctttcgcaaaacctacttgatggggtagttcattttgaccaccacttgatgactcaagaagtagagcttgagtcgccaggccgagcgcttttcagcgtcatagagtatacgactagtgaaatagatagggagttggcctcttgtacaaggactaagctaacgacttcatcagctactgagagatataggtgtaggggtactcctggcctaggttggctcaaaactagtgctgaggaacttgcctccgcctaccccaaaggtacatttttcagggttcatgcacatgtcatatttgtggagttccccaaagacttgttccaggtctaccacgtgttaggttatgctttgagacttgatggccatgtcttcaacatatgcctcgatgtttcgtccgatctgatatttaaagacttgacccatcagtcgttgacaagtggcctcaataacttaagaggaggggtgaattaa

SEQ ID NO: 52762 - DNA, 417 bp, Glycine max
  Peptide Sequence Number=SeqID_169540
atggcttcgagctcgttgagcgttaaggtagggaacttcatcttcagatgtagtgtggaaacaatgatctctcctgttaaggtggggaacttcatcttcagatgcggtatggagaccatggctctgagctcgttgagcgttttcctgcaaatcaaagaaaagaaagattacattacaagggcattgggctgcgaggctcccaacacagggggtttagcctctcatgacaatgagaggctttatactttaggggctgatgtggatagaagaatggacatagatagaggtttttccctatttgagatactcgggcttaagatatattcattagagagctatgagtctccaaggttgtctagggattggtatcccgatgtgtatctctcctttgcttcctactccttttataggcctaag

SEQ ID NO: 52763 - DNA, 534 bp, Glycine max
  Peptide Sequence Number=SeqID_169541
atgggtgacgcgtacaaaatgaaggcccctaccttcactcccttccacttctcctccatcgacgaaaaaatctcgtgcgtcgccgtcgacggcggcctagtgatgaacaatccagcagtagctgtcgtcacgcacgtcctccacaacaagtgcgatttcccgtcggtgaacggcatggaggatctcctcgtcctgtccatcggaaacagagctcaagcaaagagaatgaacaacgccggtgagtgctcgacgtcgacagtggttgacattgcgctcgacggcgttttcgagaccactgaccagatgctaggaaatgccttctgttggaaccgtacggactatgtcaggattcaagacgaggagatcttgcacgccgttcatcgatgggaaatcgtgcttcttgtggaggacgtgcgtgacggcagctgctgtcagattgttcatcaccaggccatcgtcgacggaggagaagtggaagggagtgaagaggccaggggtcgccgacggtgcgaggtgcggtcctcgcaacaataa

SEQ ID NO: 52764 - DNA, 441 bp, Glycine max
  Peptide Sequence Number=SeqID_169542
atggagcaatcatgggagaattggcctcttgatatgggaatggaggaagacagggatctgagggatgaggaggagttcctgagaaacatcctcagtgaaccttctgagagtgagatggtaaccgttgggtcagccaaaaggcctccgaggacatacattttgtcttttgataactccaccataataccagctactcctgaacccacttccagaaaacgcacacgccaaccacaaaatctcaacttagaaccaattaaaccaaaccccaacacccagcctggaaagaggggtagaagctgttcccagactctggatcacattatggccgaaagaaaaaggagacaggaactcacccagaagttcattgctctttcagccactatccctggcttgaagaagattctgctctcatctttcgcctcggtactggaaatggaatag

SEQ ID NO: 52765 - DNA, 186 bp, Glycine max
  Peptide Sequence Number=SeqID_169543
atggaatcgcacgaagacagtacaaatggaggcttcaatcacttatcaatctctctaatgtttaggaaccctatcagaataatcaaaaaaaaaattaaggaatctcagaaaattgttagaaatgctgctatcgctgttggaagacatgtgagtccgcttagagggatccttagagggtcaaattga

SEQ ID NO: 52766 - DNA, 387 bp, Glycine max
  Peptide Sequence Number=SeqID_169544
atggatggtgtatcctatagagtgctgggctatcttcttcttggcactatcagaatattctcccgaaaggttgaatatgtgcttgaggactgcaacgaggttctcctcaaaatcagcaaatttgtcatccacaaagaaggcttaatacctgtggaaaccttgcgtatgcctattaccataccagaaaggtttgagttggatgcttttgagttggatggacttgaagatgctggcagaggccatactgctcctccagaagaaattacgcttggagacaaagaaattgtgtgtagcactgagggattggggttgtttcctcacgagaagctcttcactaatatatgccaaatcaacttctgtctaataaatgctctttctcttcactaa

SEQ ID NO: 52767 - DNA, 144 bp, Glycine max
  Peptide Sequence Number=SeqID_169545
atggtggagccgttcgtttggcttggaagtgggaatgggaggaacagacggttttatcaatgtgcaattgaggagagtgaaggtgaaggtgaagacagaaacgacgtgtcgttttctggttatttaagcgagaacagctgctga

SEQ ID NO: 52768 - DNA, 1836 bp, Glycine max
  Peptide Sequence Number=SeqID_169546
atgtcgtcttcaccgcagaacataaaacagagagtcttcacatgcctgacaaaactctctgaccgcgacacgcagtccctcgccgccgcggaactcgagtccatcgctcgtaacctcgacgcaaccaccttgccggcgttcctctcgtgcatgtactccaccgatgcctccgacaaaccaccggtgcgcaagcagtgcgtacacctgctagggttcctcgcgcagacgcacggcaacatgctcgcgccgtacctgtcgaagatcctcggcagcgtcgtgcggcggctccgtgacgtggactcgtcggtgcgatccgcgtgcgtgaattccattgcggcattgtcgggccacgtcagcaagcaaccgctgaattcgtttctgaagccgttggcggaggcgctgttcacggagcaggaccagaacgcgcaggccagcgcggcgctgtgtctcgcctctgcgatcgacggagctccggatcctgacccggccaggctggcgaagctcctgccgaggttcgagaagcttctgaagcgcgacggtttcaaggcgaagccagcgctgttgacgctcgtcggaagcgtcgtcgccgccggcggcgcgtccggccacgctcagttaaagagtttggttccctgcttggtggaggcgttgagcaacgacgattgggccacgcggaaggccgcggcggagacgctcgtggtggttgctgacgtggagagggatttcttatcggagtttaagggtgagtgtgtgagagttttcgagaatcgacggtttgataaggtgaagttagttcgggacgttatgaatcagatgttggaagcgtggaagctagttcctgatgtttcggatgaagtttctccacctcctaaatcgcaatcttcatccaaagagaatgcaagtgatgggcgctatcctcaggtctctcaaaattcatgtagtcctcgttcaatgatggccaatttgaggaggaaatctactccttttagcagattcagtccagcagatagttcttctgctagcaatgctaagaatacgagtgcttcaagtagtaacaagagaatgagttcatctgtttcccgaaaattgaaccataagaattgggatgctcaaattgccgtggctgatcagggagatcttcaggagagggatggaattgtttcggaaaggagcaaaatggataaaagcggagtttcaaagccagaaacgaaaagggcactgctaaacaaaagttctgaggataaaatacaaaagtatggtgggtccaaagctggatctcgtgtggttccatatcaagaagatgagagccaagactcagttcctgtcagtatcgtctctaaagatctccaaaggaatgacaaagagagtgaagatttatcgctgatccgtgatcagttacatcagattgagaaccagcagtcaagtctacttgatcttctgcagaaattcatgggaagctcacaaaatggaatgcgttctttagagactcgtgtgcatggccttgagttggcattggatgagatctcttatgatttggctatatcaagtggaaggatgactaaacctgatcctcatggtaacacatgttgcatgctacctggagcagaatttttgagctccaaattctggaggaaaacacatggccgggattcaatcacccgattctctagatcaggtggcaccccatcacttgctgccatgaactaccaagccaacagggatgctgaaaccaagttggcaaaccacagattcaggcctgatggaggcttcatcactaatccgctggcagagattcatacaaactcgaggaattttgcaacatcggagatagcttaa

SEQ ID NO: 52769 - DNA, 804 bp, Glycine max
  Peptide Sequence Number=SeqID_169547
atggatagtggagtggaagtgcatgatgtatgctgcacgagtgtcttggaaaacaaatgtgtgaataataacaaagaaagaataaatgacatggttactttccatgaattgatgcgtttattgagggagttagttccaaactttgactacttctatgcgtccttgcacatatacatccattatatttgtcagtttccttcactgccatggaccatggctaatagcatgcaatggaggtggctttggcgcttgcatctcccacaaaggtgcaagatctttctatggctagccttgaatgataaactccccacagcagttcctcacgttgcagattttgcattttcaccttgtcccttttgccgcggacacgagactctccttcatgtgttgcgtgattgccctcgagccgcaagcgtgtggcttcctcttgttgctccccaataccaacgtggtttcttctcttgctctctatgcaattggatggtgacttatcttcagcagccttggtccagtgttaactcggatgatgaggattgtgttttgttcgctgccacagtttggttgctgtggaaggatagaaaaagttgggtctctgatgggtgtggtttttcttcttctgaaagagtgcttcatcgtgtgggtgctctagctgatgattatgggggagttgttgagttggaacactctgctcctagtgcttctgtacgctatgtttcatggtgtttctactggaaccaacctccttcgcagcttcagttgcggtcggtggcagatggttcaaatgtcgtgtctcccaagttgtag

SEQ ID NO: 52770 - DNA, 201 bp, Glycine max
  Peptide Sequence Number=SeqID_169548
atgcggttttggagttattatagagtatcagtatctgtcatggttgctagaggaggattggagcctttgaaaggggtcacacatttgaggccaaaccacatgctaaccatggttgaaaagagaagtcgtgggagctggcataagtcaaggtggacgtggctaaggtgggctcttggacttcgcacgtcagacgaagggtga

SEQ ID NO: 52771 - DNA, 990 bp, Glycine max
  Peptide Sequence Number=SeqID_169549
atggaggagatgtttaggattagaaatgacgttcgacaagccagaaaaaagcacaataagagacaagaaggtactaagagttactcacacaagtcaaacaaaaggcacaagccagacaagcgccagcctctcttaaaaaggcctaggtacgagcattacacacccctaacacctaatcgcactacaatcctcgaggaggctttcaacgtggatgtcctaatgaaactaccttcgccacttccacccaggccaaggtcggacaatcatgcaacaataatgaggcccggaggacaccaagaggatcaccacaaaaaccacaattctggtagaagagatgatgcaatcctcccaaggaggggatccatcaccagagccatgtctaggagactcccagaggattgggccagagatgcaggagaaggtcctaggtcatcttcccctaccttcaagctcttatccatgactttctatggtggtgagcttgttcttgactcatctcctcgaagtggcgtctccaataacctttcctccttgatgaagaagaagatccaaggcctacaagctctacatggagctacattaagaagagacaccactaacaaagacacaagcaacaacctttgcaggaataggaaaatgagctcgcccagcaaatcagagtccatcagtccaacaagcaccacctccacgccattcgggacatcgatatcaactatgtcgacctattgtgtcaacctaccatccccacaaagtctagctcctatcaccttcactgatagagacttcaagggtatcaaccctattaatgaagatgaccccaaggttgtctccatcataattgccaacttcatggtgtacaaagttctcatcaaccagggtagctccactgacatcttatattggaaaacattccataggcttgaagtctcgcctgataccacccaatctcacttcggtccactccttggcttcgcaagagaaagagtatag

SEQ ID NO: 52772 - DNA, 368 bp, Glycine max
  Peptide Sequence Number=SeqID_169550
atggaagatcttttaaagaggtggattgagcatcttggaagaacacgatcagggatcagtcacccaccaccagttgaaactcatgaggaaagtcttgtagaagagcatgattcaagagaaaaagatgaagataaaagtgaggagagaacacaacaacaatgggagaagtgctcacaagtagaaattcaacaagaaagtattctccaagtcaatacccctcctcataaactgattgtcaaggaagaaaggcatggagaacatgataaatccttaagtgtcattctttccttgatcactagcacttctcttgcaatgatatggaaggtgtctccagaatacatgagtttcatggagtttctagctaagag

SEQ ID NO: 52773 - DNA, 381 bp, Glycine max
  Peptide Sequence Number=SeqID_169551
atggtggtttccaaactcagaaatgatgtaaagggcttcgttctctaccgaaaccgcgagccaagttggacggttccactccgatcgatgggttgctctcgttgtggagtttcaacggatgacaacggcggttcgtggtggctaatggtggttataggtgatggagaagaagattggcacgttggaaatggctttgggaaggaggaagagaagaaatggcgttttttccaaagctacacagactacaaggctcaaaacgcacaagtgattaatgccctcgggaaacagaaatttcgtgcacactacagtcgtcttctcaaatatcccaacggtcagatcgtggacaagtgttctatgaagctgcagaccaaatttcgataa

SEQ ID NO: 52774 - DNA, 282 bp, Glycine max
  Peptide Sequence Number=SeqID_169552
atgcctcactttggagagaatgcgattgaggaggccatatgggattgtgataggcaaaagagtctgagaccaaatgacattcacttcaacttcttgaagagattttgggagacaatgaagaaggacattgtgagattcattttcgagtttcatgctcatggaatgctacctagaggtactaatgcttctttcataactcttgtgcctaaggtgattgaagaagctaaaagacaaagaaagaagtgtttggttttcaaggtagactatgaaaaaggcttatga

SEQ ID NO: 52775 - DNA, 299 bp, Glycine max
  Peptide Sequence Number=SeqID_169553
gcaaaattggagacatagcacactactactcaatctctgatcacaatctagccttctttgaggataatggtgagagtaatgatgatgaggatgatgatggaggatcgcatggaagagacactggtgagcatgttgcagttagagcgtcttacatcagacaatttgactggcttcaacagaaaatcctctgctccttcctccaggcacctgccaatatgaatgaactgttaagaaacatgcctagaggaaatactcgttaccaaatagaagcacacattattgctaggtgtagaatatga

SEQ ID NO: 52776 - DNA, 258 bp, Glycine max
  Peptide Sequence Number=SeqID_169554
atgagtataaagagagagacaaaatgcattaatgaaggcaatggtttcgagaatttcagtttaggaaaaggagtcgtcatagaggtgaatcgcagtggtggcgaccaaagtgattccaacatattggagatgtatggtgactataatgaggagctctctatgactacgttcgattcatcggagattataggatttaatcatcggttcaaagagtcgaaaggaagtggtgaagtgagtagtgaaaatgattttaaatga

SEQ ID NO: 52777 - DNA, 243 bp, Glycine max
  Peptide Sequence Number=SeqID_169555
atgtccaatggttatcagttgcacagctggttcacatattccatgcatgttttatttcttagtactgctggattttcgttaatttatgacaaatgtgatgagaatcctaaaactgtccaaatacagggacctatgaccaaacagtcaatggatacccttcaacaaatggtagcaggcatacttagcaaggcccaagtggaaaaggacaaaagcccaaatggagaaggacgaaggccgaagtag

SEQ ID NO: 52778 - DNA, 1101 bp, Glycine max
  Peptide Sequence Number=SeqID_169556
atggcctcgcaatactcacccagtagagatgctgtcagcatgaagggaaactacgttgaagctactgcaaaagcttttactgaagagccttttgctgttgatgtggccattatgggcttgtacatagttggtgacaaatgtacatggctagttgctttgggaaaaatgtatgataatcacaacaccatacataatgtcccttacgcagatgatgtggtgagggtgagtgttgtaacagtttacgatgctgatgctccagtcccttttcctacttcagaaattcactatatgagggtggtcgttaacacattcattggttggccgacacatcttgtaaaacctgtatctgatgaggattcacacaatcgtctgcctaaactggttggagatgttgaaaggtgcaatatagttgcaggagaggatccattgggagaattgattaagagtttgtttgatgtttatcagaagcccgttgagttgccatgggatgggccaaaatttaggattcctaatgtacacacatcctttttcattacaagtgcatatgtaacagaaattatatcaggctacaaatgtttgaacatatctatactacaactatggatgattgcaatgaagacagtaaccactactttggaaggtatgtctgatcaacctgtacctttgtggattgaagcaaagagtcatgttcaaaccggaggttatgagtgtggatattatgtgatacattggatgtggtgcatagttagtggcggtttgaagaatgaatggaataagtggttttctaatggaacaatgttagatgtggaggccatcacaacactttgcaagaaatctcattgtcaacctgagaattttgcttgtcctgttgatagcgctaatgaaaaagacaaatatgaggttggagaacatccagttgtcccatggattcttttttattatagtttagagacaatgaattacaaggtctatttttccaaggctaaagcttattattttggtagtgcacccagtaagtctgaacaactatcaagtattggttggattcttggttcaaccactttcatagactatttacttttgttgaagtcaactaattag

SEQ ID NO: 52779 - DNA, 411 bp, Glycine max
  Peptide Sequence Number=SeqID_169557
atggggcacaccttcgagccgagctggagcacaccactgaaaccgatgtcggttccagggaccggcatcgcggcactgagcaagagcgaggaaagaattggtgccgaccctggtggagctgagcctctcgaactcagagattcggcacctgaccacgctagggtttgtgacaaagaaaaagggagatacaaggcaacaatgagagagaggaaagtgaaggatagtgcccaccaccttggagccaccggcggtgcctgcattgatgatcaagcgaggctcacgagtgcgctttccaaaggaggaaagatgcgcggagtcgccaccaacgtttatttgtggaaaacgtcgggaaaaccgaaggaaaccggtcaaaatgaaaattctaagttcgggagttgtatttacgcttga

SEQ ID NO: 52780 - DNA, 192 bp, Glycine max
  Peptide Sequence Number=SeqID_169558
atggtgtgggtccagaaatttgggaacaatttacaaaacaccgacaaacccctaattgagaaaaaactcatggacgagaaaaggaagacatgcctccaacaagctgagtttactgaagattcaacaatgaccgtcgaccctccttccctgattgcaagacatgtcaagtcgaagatggcccacataaagtga

SEQ ID NO: 52781 - DNA, 189 bp, Glycine max
  Peptide Sequence Number=SeqID_169559
atggttgggccagcaagagcaacacaaagagggattcttctttgccttcgtcaatgcgctactgtgggtgacgttgatgagatggtgggagattgtggcagagatggaagcaggagtagggcaatgctctttttggttgatggtaagagccgaagcagtagaagaaaaaaaggtccttacctattgtga

SEQ ID NO: 52782 - DNA, 1717 bp, Glycine max
  Peptide Sequence Number=SeqID_169560
tcactgttgctgttctgcattagagatggaagagaattcttctctggaacaccattattactaccctcttcctgcttcttctgctgctgcagaagctgatcatcctaataatcacaatgatggtgacaaagaagagacttgtgcagaggaaggtagatctcaatacaagcctaacacatcacagaattatgtttcataccaaagcaataggtctcgcctcaacggatatgcactttgtggtgctatcttggcttccacaaactccattctcttaggctatgatattggggtcatgagtggtgcttctctttttataaggcaagatctgaagatcacatcagtccaagtggaaatccttgttgggtccttaaatgtgtgctccctgatagggtctcttgcatcggggaagacttctgattggattgggagaaggtacactataatggttgctgccgcaacattcctgattggtgctattctgatgggtttggcaccttcatttccattcctaatggcaggtcgtgtagttgcaggcattggtgttggttactccctcatgatctcaccagtgtatgttgctgagctctctcctgctctcaccagaggctttctcacatcactccctgaagtcttcatcagtgttggcattctacttggttatgtctccaactatgccttcgcaggcctcccaaatggcatcaattggagactcatgcttggccttgctgccttgccagcaattgcagtggcacttggtgtgttgggaatgcccgagtctcctcgctggcttgtagtgaagggaaggtttgaggaagcaaaacaggttttgattagaacatcagagaacaaaggagaagctgaattaaggcttgctgagatacaagaagctgctgcttctgctttcttcacaaacattgacaaagcaacaacttcttccagggccagtccaacaacaacacaagcttttagttgctttatctttggatcggctctaacttcttctgatggttcttcaggaatgtggcatggacaaggggtttggaaggaattgcttgttacacctactcacactgtgttgagaattcttgtggctgctattggtgttaacttcttcatgcaggcctctgggaatgatgctgtgatatattatagcccagaagtgtttaaggaggctgggattgagggtgagaagcagctttttggtgttacaatcatcatgggaatagccaagacttgctttgttttgatatcagccttgttcttggacaagtttgggaggaggcccatgttgttgttgggctcatgtggcatggcaatctcattgtttgtgttgggcttgggctgtaccttacttaagttatctggtgataacaaggatgaatgggtcattgctttgtgtgtggttgctgtctgtgctactgtatccttcttttctattgggcttgggcctataacttgggtctactcttcagagattttccctctgaggctaagggcccaaggttccagcttggccatttctatgaaccgtttgatgagtgggattgtgtccatgacattccttagtgtttcagaggcaataacatttggaggcatgttctttgtgcttggtggggtgatggtgtgtgccacacttttcttttatttctttttaccagaaaccaaaggcaagagcttagaagagattgaagctttgtttgaagatcaagcacattga

SEQ ID NO: 52783 - DNA, 732 bp, Glycine max
  Peptide Sequence Number=SeqID_169561
atgttgctaagttccatttccagcaccaagaagttcttccaaaagactgtaaagaacttcaagtctttcttctccccaggtaattaccaaaggcttcccaaagcttctccacacagtaaattctcttattctgtggctgctgcatcatcaagcgccatggacatgaccagcaacacaagctatcaagacatggagaagttgtacaccgatttctctgaccaatgtgagtcagaaaatgagaaagcaattaggagaagaatgaagaagaaagctgcttcttctgcattattgccatcgaagcaagaaagtgaggtctatagtggaagctacattagcttgtccaatgcaaggcatgctcagaagaagaacaaggttgaaaaaaaagaggaaggtggtggtggtggtggcaacaacaagaggagcataactattcaaaagggaaggcagaaagagtcatcatcatcattcatgtctatgtgtatgaaagaacacagatactgcatggtggaacagaagctgagggagttggagatgttggacatgaacaatgtggaatatgtattggacattgaagaggttcttcattactattctagactcacttgccctgcatatcttgaaattgtggataagttcttcttggaaatgtactcagagttgtttggttcatcatctatgtggcatgcttcacctcgcagtgttaactctaggctcaagatcagatatcagtga

SEQ ID NO: 52784 - DNA, 1314 bp, Glycine max
  Peptide Sequence Number=SeqID_169562
atggcttcttcagatcctatcccttcccgtcattgcacttacaaccgcaagcaaaaatccctcggccttctctgcaccaattttttgagtttatacgatcgagggtctgttcatctgatcggcctcgacgatgctgccatccgattaggcgttgagaggaggcggatctatgacattgttaatgtcctcgagagtattgggttgctatcaaggaaggcgaaaaatcagtatatttggagaggttttgtcgcaattcctcacactcttcaggagctcaaggaagaggggttgaaggataattccaatttcttgcgtggttctggaaacgacaacgacaaagtgtccgacgacgaagatgacgaggaaacactgtctaatcccgctactggaagtcaaagcgacaagttgaaccctaattcttctactcttactaaatctctgaaaaatggcaacggaaccaactgttgcattttggtggagttgatctcccttgacgaggctgcaaaattgttacttggggatgcccataatacttctgtaatgagaagtaatacaatgattaatgtaccatgttctttatctgttgacaaagccaaagttagacgcctatatgacatcgcaaatgtgctatcctccatgaatcttattgagaagacccatacgacagatacaagaaaaccagcattccggtggctgggttctgaagggaagacatggaatgagacacttcacaaatcaaacctgaacgagtctaggaaaagggcttttggaagtgatatcacaaacatcagttttgagaggaataacgtggaattgttcacgaatggcgactcaaatccgaatcctaagaagccaagaatggaatatggcagtgggctgggtcaggcagatgaaaacaatttaaaacaaggcacaaaacaagcttcaaagaactatcaatttggtcctttcgctccggcttgtgtgcccaaagttggagcctctgagaataataatctgaagcaggtgcatggctgggacagtcttgcaactgcaaatagccctcagtatcaaaatgaaggcgtgcctccttcgtgtgattttcagagcattcttatgcacatctctcttcgagcaagcgatagccagctgagggataggtcagcttcctccaaccgttatcctacccttgagagaactgtactcgcattacatggaagcatggaaatcgtggtactcagaaattgctgggaagaggtcattacaaattttgtaaatgtctgccagtcgaacatgtttaggaagatggaggatgaaggagaaggaggtaggtga

SEQ ID NO: 52785 - DNA, 306 bp, Glycine max
  Peptide Sequence Number=SeqID_169563
atggatgtgagatcagagcgaagttgtgacgtcagagttgcaacgtgggagtcacgacgttgtgccaaaacgcagagccatgatgtcagagttggtatggtgagagggggtggtgacggtggtttcttaggtttggggttttcttttgttttgaggagttattttgcgttaggaagatggaagggtggaaaggtcaaacatgccaatggtgttgtcaccatgatgggtttgggatgtcaaaagataccgctgaaatgccatcgaaaatcacctccagcgatgatgaatagtggttggtggcgatga

SEQ ID NO: 52786 - DNA, 195 bp, Glycine max
  Peptide Sequence Number=SeqID_169564
atggcaaacgagatgagaccagaagaagtgagggatgggaaaggtgttttggcggagccgagccaaaaatttgaaagttgcgtttggatctcaaacgggggagtcggagggatgggtgaaaataggtccggccagactttgaaagacccgaatctaacctacgatgaatctttgaggcctgatcctggcctatag

SEQ ID NO: 52787 - DNA, 806 bp, Glycine max
  Peptide Sequence Number=SeqID_169565
atggctcgaattcttacacttgatttccaattagattgtctcaattatgagtcttcgaattggtaccatgcagatcttgattatgagaccttcaaattacttcagcttgaaaaaggtgaaagcttcttttcttttgcaaaagatatgactcttaagtctacaaaggcagtattgcagccagcttcaattccggaagatcttgacccgttgagatccaagcttttatgggcttcacgtgtacttcctatgccacttgttggccttcttatcattggaggtgtttgtacagatgtgggaactcaagcatcagaatatcctgaaatagaggcactgtcaaggcttgattttggtgctgccttgaaggtcttcctcgcaaagagacttacatctgagttcacactggtgacagcagatgtagaggagaaatcggttataattggtgagagaaatagagtagcaatagaggccctgagagcagcaatggacaagggacacaataaaattgcaatactatatgggggtggccacatgccagatcttgggaggagattgagagaggattttgatttagtcccatctaatgtacagtggataacagcttggtccataacgaaaaaggacctaaatactgattcatttccatttctgaagacaattgctaaggcctcaggctggccattgaaccgctatcagaccttggcattgctcatcttttcatcagtcttagcattggatctgtggttctgggagctcttctttggcactgcagtgaattgggtttctgaacttggctcagaacttcttcg

SEQ ID NO: 52788 - DNA, 375 bp, Glycine max
  Peptide Sequence Number=SeqID_169566
atgaaatcaaagagaccccaattgataaagaaaaaaagaaaaaaaagaaagaaactagagagcgacctgaaggaaagggcgcaaaagggaccaagggaacctcttcctgtagctgacaagagcagtctgcaactcggcactggcaccaccatcgaccctgcgcttgaaccgcatgaaatcggctatggaattgctcttcaagaactgttccggcgacccattttcatgcggcgtggaaacggaagaagaagaggctctgagggtagcactgggaaggtgtgctctggggaacacaaaaagaggggctcggttggaggaatggaagaagaatggtctgattctggtggtaggggaagaagtggaaggagaatctga

SEQ ID NO: 52789 - DNA, 588 bp, Glycine max
  Peptide Sequence Number=SeqID_169567
atggctggccaatcaccattacttgtgacaaagaccccatttcccttaataggatttggagtgaattatttcagctacagagtacttcagttaacaaatccacatcttaccatccacaaacatccacaaactgatggtcaaaatgaagtggcgaacaagtgtttggaaacttaccttcactgcatgtgttttaggaagcccactagatggtctaaatggttatccctggctaaatggtggtacaacaccaacttccattcttctattcagaccacaccatatgaagttgtctacgaccaagctcctccgatccaattacccttcatgcctggggaagttgctaacccaactgttgacaggactctgagtaaaagggaacaactacaaccttatagacaattcaccatgcgacactcctcatttcataagctgctacctaagtactatgctccctttcaagtgctggaaagaattggctctatgcatgccaattgggagttctactatgatttgctcaagaaatttccctctttccgtcgttcaggacaaggatgtactcgaaggggagggtattgttacaacatttag

SEQ ID NO: 52790 - DNA, 324 bp, Glycine max
  Peptide Sequence Number=SeqID_169568
atgaaatgtgcatacttactcagtctatcaaccaccacaaatatagcttgcttaccatgggagtgtggtaaaccttttataaagtccataccaatagcatcccataccctgttaggcataggcatttgtagtggcgacgtttgcgacagtgagggggtagagtgcaaggaccggaggaagtcgaagaaagtgaaaaatgtgtttagggaactagaggaagggtgcaacattaggattgtgaggttggcgcaaatgatggatgtcatgtctgtggagaagcacattgattcaacttttgaaggaggaaaaggagagaaactatga

SEQ ID NO: 52791 - DNA, 1641 bp, Glycine max
  Peptide Sequence Number=SeqID_169569
atgaacaacatcaacaacaacaggtctcaggatcaacgctcaagacctgccaaggcagccactatccatggctgcgccctctccggcgacctcgttggactccagagactacttcgagacaacccttctcttctcaacgagagaaaccctgttgtttggaattatgtgcataggtttcagatctacttggttttgactcatgatggtgactttagcagccagatatggccaatgtataaagggataggagggtgttatcgactatttatttctttggttgcttccttttgggattcaagttttaaggttttaaaaagggtggggtgtatgcaggcattaatggcacagacaccacttcatgtctctgctggtcacaataggactgagatagttaaatttcttcttgattggcaaggggcagataaggttgagatggaggccaagaatatgtatggagaaactccattgcacatggcagctaagaatgggtgcaataaagccgcacaattgcttcttgctcgtggtgctattgttgaagccagagcaaataacggtatgacacctttacatcttgctgtttggtactcactacgagcagaagagttcttaactgtgaaaacattgcttgagtacaatgctgattgcagtgctaaggatgatgagggaatgactcctttaaatcatctatcccaaggccctggaactgagaaacttagggaactattactttggcatcttgaagagcaaaggaagcagcgagccattgaggcatgcagtgaaaccaaagctaaaatggatgagcttgagaagcaactatcaaatattgtgggtcttaatgatctaaaagtacaactacgcaagtgggcaaagggcatgcttttggatgagaaacgtagatctcttggtctgcatgttggaaggagaagaccacctcatatggcctttcttggcaaccctggaacaggtaaaactatggtagcacggattcttggaaaattactccatacggtgggaattctacctactgataaagtgacagaagtacagcggaccgatttagtcggtgagtttgttggtcacactggtccaaaaaccaggaggaagatcaaggaagcagaggggggaattctttttgttgatgaagcttatagattgataccaatgcaaaagtccgatgataaggactacgggttggaagccttagaggagattatgtctgtcatggacagtggaaagattgtcgtaatatttgctggctacagcaagccaatgaagcgagtaatcacttctaacgaaggtttctgtagacgtgtgaccaagttttttcaatttaatgatttcaactcagaagaactagcacaaatccttcacattaagatgaataatttagcagaagatagtttgctatatggatttaagttgcataccgattgcagtataaaatccttagcagcattgatagagagggaaacaacagaaaagcagcgccaagagacaaatggaggtttggtagataccatgttggtcaatgctagagaaaatttggacctaaggctaagctttgactgtatggatacagaagaacttcttaccatcacattggtagatttagaagcaggccttcagttattaacacagtaa

SEQ ID NO: 52792 - DNA, 579 bp, Glycine max
  Peptide Sequence Number=SeqID_169570
atgatgccacttttcgtatcagctctgggagtgtccggtggccctgacagtatggcactctgtgtgttaactgctggatggaaaactgctggtgctgatgctgtcacgcctgagaatggtggtttcatagatggactacttgcaataattgttgatcatggtctacgagcagagagcaaagaggaggcaaatattgtttctcaccgagtttcaaaaatgggaatcagatgtgagattgcatgctgcgattggccaagtggcaggccaaaacagggtcagttgcaggaagctgcccgtgaaatgaggtatcaaatctttcaagaagtttgtgcccaacaccggattggggtattgcttattgcgcatcatgctgatgatcagtcctacagggaagttcaagcaaaccagggcatccttgttgtgcggcctcttctggaattttcaaaggaagatatgtacaagatatgccaaggaggtagtgagaattgggtagaagacccaactaatcaaagtccattatattgtagtgcacatgcaattgaaaaaatatcaatgtctggagtaaagagaagaaagtga

SEQ ID NO: 52793 - DNA, 369 bp, Glycine max
  Peptide Sequence Number=SeqID_169571
atgaatgaagaatcaaacgctccaaacatcatcattggcctttctgtgaatcatcgttctaacaagtggatgaagacaaacacgaccactgatgcatggggtggcgctactgacaccaaggtttacttgtatgggagtggaaactgcaggatgggtcttcttgttgaggtgtgccagaaaaacaaaaacagtgcccataatgaagaggttaatgcagtagttattatggcgcactattttgctaacagtagcagaacagcttttaacggatcatcaactgaatcagatattggcctttctgtggtcgcaaagtttggatcattatccaatattaatggcgatttggatataacagtggagggtccttag

SEQ ID NO: 52794 - DNA, 390 bp, Glycine max
  Peptide Sequence Number=SeqID_169572
atgactaacataatgatgaagattaacaaagaatcagatgaaatgtgcaacactgttcatgttattgatcagtcatttgccataagatggaaggttgaactagagcctacatggcatctgctacactctagtggcaacatgcactctgtcacatataaccaagatttggcaagcccaactctacttgacagatggatggaacttagagtgttctatgggctcactagaaatcatcaggtcaccttgacccactatggacagagcgttttcctcctcaccatctttgaaagcagctttgaaccaaaaaatttccctaaatggcactccttgtaccaccaagttcctaactcagtcacttttaaagtcctactcattgtagctttttgttga

SEQ ID NO: 52795 - DNA, 651 bp, Glycine max
  Peptide Sequence Number=SeqID_169573
atgcagagaatgctcaacacaagaagaaccgccacagccccaacggcgattccgaccaccacgccggtcgaaatgctcgacgaggaagacgacggaggcgacggagtggtcgggctcgatccggacggaggagagggcgagctccgagacggtggactcggagtgctgccgccactgggtggcgacggtggcgatgtcgacggcggcgacggcggagaagtcgatggcgtggttggagtggacggtggaggagaagcagaaggagtggacggtggaggagaagagggagtcgccggagggggagaggaaggagttgccggaggtggcgaggaaggtgtcgccggcggaggagacgacggagttgccggcggaggagacgacggagttgagggtggcggcgcggaaggtgtggcgggaggcggtgcggagggagtggccggagttgacggcggaggcgcggtgccgttattcgccggcggcgaagacggcgcgggggcagttgacattagcgagaatgattacagaaataaaaatgcgagatcgaaaaacaaagagaaccttaagaaagcgaagaataagccaaccagcgaagacaaacgggtacatgggacccacacgaatgccccgcggacaccttcttcttacaattaa

SEQ ID NO: 52796 - DNA, 237 bp, Glycine max
  Peptide Sequence Number=SeqID_169574
atggaactaccattagcatgcccccggaaccttcaatcattggcaatacttgcattttgccggctgccacgacatcgcggtggtgtagaaacaccatcactgtcttgggcgccgatatcagactggcaaaacattttgctacggtccctccgaatattagtacagtatgacttctacaagtggagatgttactccaccatctccaaaaatcgcaagactcatggcggagatgattaa

SEQ ID NO: 52797 - DNA, 111 bp, Glycine max
  Peptide Sequence Number=SeqID_169575
atggatgatgagaggttgggtccattactactgagaaaaacaaaattctgttgcattcgtgatcgtctcaaaaatacattttgcaaaataagagagatgggtgaagagtaa

SEQ ID NO: 52798 - DNA, 192 bp, Glycine max
  Peptide Sequence Number=SeqID_169576
atgtataagaaactgctaaagaatttgacttcggaggaattgttagttgttaccctccttatggggacaaatgcaagaaggagtttcttgataagtacgaaagttttgcccaacttgtggctaagatttatccttctgagacaatcccgtctgtatatagcggagatgagagaccttttagtttccatgtag

SEQ ID NO: 52799 - DNA, 363 bp, Glycine max
  Peptide Sequence Number=SeqID_169577
atgcagatatttttctttttgagaaatgagaactatgctgcttttcagaatagtttgtatgacctcgccaacattgtgcccactttggccaagttttatcatcaggccagtgaagcctatgaacaagcttgtacacgccatattagcatgattatctactatcaatttgaacgccttttccagtttacccgaaggattgaggacttgatgttcacagttgaacctgaagagttttaccatatgcccaacatgggccttcccctacaccgttcacccatcaatagagaaactaagtcacctgtcactctgttcaagagcgcatctcatcaatcatggcgtaaggggttcatttgtagattttag

SEQ ID NO: 52800 - DNA, 328 bp, Glycine max
  Peptide Sequence Number=SeqID_169578
taatgctaaccttatgctcctcaaacccattctcgcacacagaaacatccgtcataacaacactaagcataacgataacaatgatgagattgtgcgaaggaatgacctccatggccctgaggaggttctccaaagtgtcattgtactattccttacaatcctcaagcactacggagatcttcagcgaggccttcatgtgcttggcgatgatgaagatggtgaagttggtttggtaggagcaggctttgatggcgacctcaaggacattcatgaggttgaagttgtggttgaggaacaacgtgatggtggagacgcacacgacatgatg

SEQ ID NO: 52801 - DNA, 2099 bp, Glycine max
  Peptide Sequence Number=SeqID_169579
ttaaaccagcaactattcgaacggttctcagtattgctctttccaaatcatggggtcttcatcagttggatgtcaaaaatgctttcctacatggtaatctcaatgaaaccgtgtacatgtaccaacctgctggcttccgcgatccgcaataccctgattatgtatgcttgttgaagaagtctctctatggtcttaaacaagcacctcgtgcttggtaccaacgcttcactgattttgttgctaccttgggcttttctcatagtatatgtgataactcattattcacctaccacaatggcaatgacacggcctacatccttctttatgtagatgatatcattctcactgcatcctctgacactctacgccaatctatcatgtctaaactgagttccgaatttgctatgaaagatttgggtcctcttagttattttctaggtatctcagttaccaggcattccagtggtatgtttctctctcaacataaatatgctgaagaaatcattgagagagcttccatgtcctcctgcaaaccggtttcaactccagtggatacaaaagcaaaactcagtggaacctctggcaacccatatcatgatccatctgaatatagaagtcttgctggtgctttgcaataccttactttcacaagacctgatatttcttatgccgttcagcaagtatgtcttttcatgcatgatccaagaacacaacacatgaatgccttgaagcgaatcattcgatacatcaaaggcaccatcactcacggtttacatctctctccctcctcagttgacaaactcaccacatatactgatgctgactgggggggatgtccggacacccgcaggtccacgtccggttattgtgtttatcttggagataatttagtttcatggtctgccaaacgtcaaccaactctttctcgttctagtgcagaggcagagtatcgtggtgttgctaacgttgtctctgaatcctgttggcttcgaaatttactcttagaacttcagtgtcctattgcgaaagccacactagtatattgtgacaatgttagtgctgtctacttatcaggaaatcccattcaacaccaacgcactaaacacattgaaatggatattcattttgtgcgtgaaaaggttgctcgtggccagatacgcgttctacatgttccttcacgctaccaaatagctgacattttcacaaagggccttccgctgcagctattcagcgacttcagagatagtctcaacattcgtcctcctcccgtttcgactacgggggtggaaatagttgatgttcctatgccaccaattgctggagaaagtgtgtgtggaacaagtgggagaagaaagagagcgatgggtgtgagggaggcaaaaaggtttttctcggtggactttcttcaaacaccttacgccacggaaattcaaattagctccaccactctgtcagcacaaatccgtagccactctctctcacttcggaatcctaacctcccgccagaaagaccagattcatctctacgtcgaaactcttcttcaatggaacaaggtattcaatttctcccactcacacgtcacaaacgcaccttctcccttaacactcacacatcgcaattgcaactgcagcgcatgaatctcaccgctgttagagaggtaaatgaagtgatggagaggcacgtggaggattccctcgcgattttgcctccgctcagcgactgttaccgctcgcactgcagcgcttcgtgcgataagctgagtctcgtcgatgtcggaaccggcgctggccttcccggagtagttctggccatagctcgccctgagtgggatgtaacgctgatggagtctatgaacaagcggtgcgtcttcttggagcacgttgtcggtgttatcggttcctcaaacattaaaattgtaagaggaagagcagagagtttagggcagaatccttgcttcagagagcaatttgacatagcagtggccagggcggttgctgaaatgagaatattagctgaatattgtcttcctttggttcgtgtcggtgggttgtttattgctgccaagggtcatgatcctgaggtatgtaacagctattag

SEQ ID NO: 52802 - DNA, 1299 bp, Glycine max
  Peptide Sequence Number=SeqID_169580
atgttggagggaatctctctacgtacccaataccgccaaatcaattttgttcagcatttatataaagtcaattaccccccaacccttttggccacaccctcatctgatctctccatggaacacagcgcatccttcaacaataacagcctctcttcacaacgcagcctcgcttcagtcccttccctcaactcacactctcacctcttcattccttccactacctctcactcgtgcctcaccactctcaaaccccacacttcctcctccgtatacatctcctgccttaccctcgccggcaacttgctctacactggctcctccgacagagaaatcagatcctggaaccacactcatttcatccaaaaaccaaccaccaccaacaacaacgttgtaattgcaggaaaaggtgctgtgaagtccatagtggtccactccgacaaactcttcaccgcccaccaagacaacaaaatccgcgtctggagagtcacaaacctcgaacacgaccagaaccagaagtacacacgtgtggccacactccccacgctcggcgaccgcttgaccaaactcctgctcccgaaaaaccaggtgcgcattcgccgccacaagaagtgcacctgggttcaccatgtggacaccgtctcctccctcgcactgtccaaagacggaacctttttgtactccgtttcatgggacagaacaattaaggtttggcgaaccaaagacttcgcgtgcttggagtccgtgcgcgacgcgcacgacgacgccatcaacgcggtcgcagtctcctacgatgggtacgtctacaccggatccgcggacaagagaattagggtttggaaaaaactcgaaggggagaagaaacattcactagtggacacgttggagaaacacaactctgggattaacgcgttggcgcttagcgccgatggctctgtgttgtattctggtgcatgcgataggtcaatattggtttcggagaagggtaaaaatggtaaattgttagtggttggtgctttgagggggcatactaggtcgattttgtgtttggctgtggtttcggatttggtgtgtagtggttcggaggacaaaacggtgcgtatttggagaggggttcagaaggagtattcgtgtttagctgttttggaagggcataggagtccgattaagagcttaactgctgcggttgatcgtagtgaacaagaccctaattcagaagaaccgtcttttcttgtctatagtgccagtttggactgtgatgttaaggtttggcaagtttttgttcctcttctttcaacttaa

SEQ ID NO: 52803 - DNA, 399 bp, Glycine max
  Peptide Sequence Number=SeqID_169581
atgggtacaataggatacgacataatggtaggatcacacgtaaaagggttgggaggacatgagagaagaagaccaatggaagccccagttagaagagttgatcagatgggggatataccaataattaaaggtagtgacccaaaccaactgaggatggtacaagcttggaagattgaagctcatgaaaatcacaatatcacaaaattaactactgaagggaggagagggggctcacaacgagtttggaggaacgaagttggaacacaagctttgaagctgaagcagaggagtacaaagctcgaaagccttcaaacagaggagatggttctgtttgaagctttggatcccttccaaagctgtcagcttacaaatcaagaagaggagaggctgtttggatga

SEQ ID NO: 52804 - DNA, 945 bp, Glycine max
  Peptide Sequence Number=SeqID_169582
atggactgcaagaattttgagggaagtgaagagagacaggctttgtttcatggagatcaaaataacaacatggcatatattcagcaagcggcaaatgctgccataactggagctattggttcctctggctattcatcgcctccagtatccaagaaaagaaaaggtcaggaactcttcttttggcctacaaccaaggatccatccattagcaagttgggacaacaggtaaaccatgtcagaggtccagcaccttcctcatccttgtcacctgtctcaggtgctcgtgttggaactgccacattaggtccttcaaagtttatgtacagacattatacaaccacagcacctcaaggagctatgctcagttctggttctagtatcaggacaagctgcaaagacacttacagtcaagagcaattaccaagtcaaaaggaaggtcgtgttgagaagactgtggcagatgattgttcgagtgcaaaccaaacagataaaattagccctgataattccagttcagatggtgctgatgtcccaaaagggagaccaatgtctcctgggactttagccttgatgtgtgatgagcaagatacaatgttcatgacggctgcctcccccattgcgccaatggcccatgcttgcaatacatcttcacaatttccttatggacaagaaatgacagaggtctatgctgagcaagaaaggatcgtattaactaagtttagagattttctcaatagggttatcaccatgggagaaataaacggcaaaaatgaattagagagtcaaaaggacccaatcatcaatggcattggaaataccagttctgagatagtgctacagcacggaaccactagcaatggtgttactaaacctgctgtttcacctttggctacaacttcgacatctatgatccctggtaatattgctgaaaatggggagaccaag

SEQ ID NO: 52805 - DNA, 957 bp, Glycine max
  Peptide Sequence Number=SeqID_169583
atggccgcaacaaacaaggttttgatgtctctctgcatagctccaatccctatcattgaagttagaatgggtgtcaacccttcaatgtcttctctaattgctttatacagaaacttcctcctttcaacctttcatcttcatgtgaatcttgattatatgtctcttgaggaacttgttggtaccctcaaggcatcattgtctggagaacaagtcttgagaagttcatccaaagtgctaaaagttgatgattcatctgatgacaaatctgaagaagactcaaatgaagatgagggtcttatgagcacgtgggaagatctggacgacacctcatctgatgaagatgaagaagaagccaatatatgtatgatggtggatacaatctttgaggggtctaaattagaccaagaagatgaggagttggaaaacaaagggaaatatcttcaaatggatctaaaggagcttaatgaacttcataatcatcagaaagaagaaaaatatgatctttggagagatcgttcaaaagcacacaaagattatgaagacctcaatatgagtaaacataatctttgtggaagttcttttgacaaatttggaaatggatatgatgggaagatacatgttcatgatgaggacaccgttgtttgctatgtttgtggaaaaactggacacatggagtccagatgcaaagattgtcctaagaaggctatccttgatagtaggaaagcaatgcctgtcatggtacctggacagtggttgctcgtgacacatgacaagagaaaagtatatgttccaatgcctaactccctatcattgtggaacagtcttaaacacaatgtactgaccataagtcaattatgtgacaatggatatggtgtcttcttcaacaaggaggagtgtgttgtcctacatgatgatgggtcccttttattccctgctaagagaaaaggaaacctctaa

SEQ ID NO: 52806 - DNA, 1221 bp, Glycine max
  Peptide Sequence Number=SeqID_169584
atggtgttgaagatttggtggtgtagtcatgacttatatgggaaacacgctttgagttatctaaatgacttttttttctcaatatttccagctacattcaagtttgagctccaagcactgatttctgcatgccgaataacacgcacatatgttgatcaaattggctatagcttgataggtgatgctgtggttatcaaggatcatgggtatgctgttattgatttacagattctttgtcctttgaaagttgaggatatatgcctgatgaagtttctttccttggtattgcagtttgtatcacaaaggcagaggcaaatcagaggtaatgctttgaaattgctaatggactacattcgtacttttccgtgcaagaattctgttacagcagcaggttgttacctttgcccggatcctggttctagagggttcagagtcttggtctgctgctgttctgatgattgtgctttgccttcaaagattgaatattttgagtcacattctcaaggacaagggtgttgtgttgccaatgagttaggagagattatagaggctgagaagtcatatgcaaatcacttggttctggatgcatcagatgtccactttttggatgtaaatcctgagttagttttgactgaagccaaaaagctaaacataattggtgaatcaacctacaatactgttcttgcattgcagaagcaagaaactgctcacttcaggtctaaaactgaggtcatttctgactctgcttcaaagcatggggttaccccttttagcaaatcacttcagccagggcagttctgttacttgatggatcgattcattctcacatggaaattgaaaactaatactgataatgatgaactttctggtttagttggttatgaaatggatatgggtgaggaaaccagaagcttgtgttgcacatcttgtgtaactggtaataataaagtacctgaggtgcgacacatgatagaatctgattggctgtatcttgctgagttatcaaaatatccactttccaaaaacttccctcaatacgaggttgaatcagtgaatggaactgagcggataatggacagaacatctctgtgtttgcactatgccagtgtatcagcaaaacaagctctccgcttgttaaaatctatcccagttgctgcaaggagaagtcttcctgttctgatcaatcaacaaggacaattgctaagcattccagtaagttga

SEQ ID NO: 52807 - DNA, 1578 bp, Glycine max
  Peptide Sequence Number=SeqID_169585
atggttcgagcttttcatcaccaaatcagcatggagaagtccaagtcttttcatttcaggaagatgtttgagatcccagggaaacatatccatggtttatttgataaggatcatgatgaagcaggtgaaagtgatagtaagatttactcaaaaagctttgagtctagaagctcacttgatcatcatacatttgagattcagttcaatagtgatcatagtccaacagcaagcttgggtattgaagcacctaaaatgcctcccaagccaccaactgaagctgacttgatgaaggaaaggtttgctaagctgcttttaggagaagacatgtctggtgcaggaaatggtgtttcttcagcattggctttgtcaaatgccataacaaacctggctgcatctgttttcggagaacaatcaaagctggggccaatgccctcagaaagaaaggcaaggtggagaaaagaaattgagtggcttctatctgtaactgattatattgttgaatttgctccatcacaacagatagctaaggatggaacaagcatggagatcatgactacacggcaacgaactgatttgctgatgaacatccccgccttgcgcaagctagatgcaatgctcattatagcaatggaacaggacacgctagacaactttagagatcaaaatgagttctggtatgtctctaaaaatgatgagaattctgaggttaacagtaacagccaaaggaagagtgacaaatggtggctaccaaccgttaaagttcccccgacagggctgtcagaaccggccggaaaatggatacagttccagaaggacaatgtcaaccaagtgcttaaagcagccatggcaataaatgctcaaatactatcagaaatggagatccctgaaaactacattgaatctctccccaagaatggtagagaaagccttggtgaatcagtctataagagcattacagtggaatactttgatcctgggcaatttctctcaacaatggacatgtccacagagcataaggtgcttgacctcaagaataggattgaagcttccatagtgatatggagaaggaagatgaccaacaaggacagtaagtctgcctggagttcagcagtgagcattgagaagagggaactctttgaggagagagctgagacaatattgctgatgctcaaacatcagttcccaggacttccacaatcttcacttgacattagcaaaatccaatacaacaaggatgttggacaagccattctagagagctactcaagagtaatagaaagcctggcttacacagttatgtcaaggattgatgatgtcttatacgctgattcggtgacaaagaacccttcattggcagtgagcagcagaaggtattcattggattctgtaccggtggctgagcagacttccccaaactctggggatgagattagcaacttaaaattttcagagacaccaccttctatgactctctcagatgtcatgggttggagttcaaccaatgaagggagtgacttaaagactaactccgcaggagacttagaagagtacgagaaagaaaaatatgaaaaagtataa

SEQ ID NO: 52808 - DNA, 2073 bp, Glycine max
  Peptide Sequence Number=SeqID_169586
atggcgttgcctaaggttgatttcgaggttggagctgatggggttgctgtcatcactatgtgcaacccacccgtcaatgctttggccattccaattatcatggggttgaagaacagatttgatgaggcagctaggaggaatgatgtgaaagctatagttttgactggcaaaggtgggagattttctggtggatttgatatcagtgttatgcagaaggttcaccggactggggattcctcgcatctccctgatgtctcagtggaactagtagttaattcaattgaagattcgaagaagcctgttgttgcagcagtagcagggcttgctcttggaggtggcttagaactggctatgggatgccatgcccgtgttgcggctccaagagctcaattgggtctaccagagctgactcttggtattattcctggatttggaggaacacagcgtcttccaaggcttattgggctgtctaaagctgttgaaatgatgctgacatctaaaccaatcacatcggaagaagggaggaaattaggacttattgatgctattgtgtcttctgaggagttactaaatgcatctaggttgtgggcacttgaaattggagagaggtgcaaaccttgggttcgttcacttcataggacggacaaaattggttctctgtctgaagcacgtgaggtgttgagaactgccaggcaacaagtaaagaagactgttccacatttgcctcagcagctggcttgtgtagatgtgattgaacatggaatagtccatggaggctacagtggtgttctaaaggaggcagaagtattcaaacaattggttgtatctgacaccgcaaaaggtttaattaatgtcttcttttctcagcgggcgatatcaaaggtgcctggcgtaaccgatatcggccttaagcccagaaatgtgaaaaaagctgctgttattggaggaggtctaatgggttctggcattgctacagctcttatactaggcaacattcatgttatactcaaggaaatcaatcctgaatttcttctgaagggaataaaaacaatagaagcaaatgttaatggcttagtaagaagaggaaagttgacgaaacagaaggcagatgctgcactgtcactgcttagaggtgttctggattactcagaatttaaagatgtggacttggtcattgaggctgtaattgaaaatatcagtctcaaacaaactatatttagtgatcttgagaagatttgtcctccacactgcattttagcatcaaacacatcaactattgaccttgatgttgttggtaaaacgaccagctctcaaaatcgcattgcgggtgctcattttttcagtcctgcccacattatgcctcttttggagattatacgaaccgataaaacatctgcacaagtgattcttgatctgataacagttggtaaaatcataaagaagacacctgttgtggtggtcaatctttctgtgacttgtaggcttcaagacttggctggctatggagttgccgttgctacctcaaaagtatttgctgatgctttttctgatcgcatatttaaatctccactgcttgatcttctgatcaaatctgggcgaaatgggaacattttgtgtgaatataatcaattatttctgaccttggctatctctgccctaccaggcaaaaacaatgggaaagggtactacatttatgaaaaggctggcaagccaaaacctgatccttcaatactaccaatcattgaggagtctagaagactttgcaatattatgcccaatggaaagcctatatctgttactgaccaagagatcgtggagatgatactcttcccagtagttaatgaggcatgccgtgttctagaagatggagttgttattcgagcatcagaccttgacattgcatctgttcttggaatgagcttcccaaattaccggggtggcattgttttctgggcagacttggttggggccaatcatatatataccagcctaaaaaaatgggcacaattatatggtaacttctataaaccctcaaggtatttggaagaaagagcactcaaaggcattcccttg

SEQ ID NO: 52809 - DNA, 1707 bp, Glycine max
  Peptide Sequence Number=SeqID_169587
atggtgggaaatgatgcacgttgcacgagggcgttggctactgtttcttcagccagtgccgtttctgggtcgcgttcctttcttccttccttctttttcccccctacaaacaaaaacaaagcaacattcccttttctatctgtttccttcgcgaaccagcaacaacccccggcgcacgatagcgccatcgctttcgttacgcggttggataagctgatggtactgtggtttgtcaaatattggctaatgtgggtgggacattcatctatgtacaagcgcactccttcgagagataattcaaacatggaggacatggaagaaaactcagatcttttagacatcggcctggacaagggaacatcaaatccttcattgatgctttctttaccgcatgtacttgtggcgaccatttcttcattcctttttggataccatctgggggttgttaatgaaccacttgagagcatttctgtggatcttggcttccgtggaaatacattggcagaaggtctggtggtgagcatatgccttggtggtgccttgattggatgtctactaagtggttggattgctgatggggtggggcgtcgtagggctttccagttgtgtgctctgccaatgataattggtgcttctatgagtgcagcaacaaacaacttgtttggcatgcttgtaggaaggttgtttgttgggactggcttgggcctgggccctcctgttgcctctctgtatgtgacagaggtttctcctgcttttgtgcggggcacctttggagctttcatccagattgcaacatgccttggtctaatgggagctttatttattggaatccctgtcaaagaaatttctggatggtggcgggtttgtttttgggtatctaccattccagctgctatacttgccgcagctatggtcttctgcgcagagagtccgcattggttatacaagcaaggaagaactgctgaagcagaagctgagtttgagagacttctgggtgtatcagaagcaaaatttgcaatgtcggagttatccaaggtagatagaggtgatgatactgatactgtaaagctgtcggaattgcttcatggtcgtcattctaaagttgtttttattggatcaaccctatttgctttacaacagctatctggtataaatgctgtgttttatttctcttcaactgtttttaaaagtgctggagtcccatcagacattgcaaatgtctgcataggaatcgctaatttggcaggatctatcgtttcaatgggtttgatggataagcttggaaggaaggttctacttttctggagtttctttggcatggcaatagcaatgatccttcaagccacaggagcaacttcacttgtatcaaacgtgggagctcagtacttttctgttggtggcatgttactgtttgtcttaacatttgctctgggggctggtccagttccaggtctccttctaccagaaatctttcctagtcgaataagagccaaagccatggcagtctgtatgtcagtgcattgggtgataaatttctttgttggactactgttcttgcgtttgctggagaaacttggtccacagctgctttactccatgtttgctatcttttgcatcatggcagtaacttttgtaaaaagaaatgtggtggaaaccaaagggaagtcacttcatgaaattgagatcgcacttcttcctcaagactag

SEQ ID NO: 52810 - DNA, 945 bp, Glycine max
  Peptide Sequence Number=SeqID_169588
atggcgcacgccaagaccgattccgacgtcaccagcatggacacgtcatcgtcgccaaaacgcgccgtttactacgtgcagagtccctcgcgcgactctcacgacggcgacaagtcatcgacggcgacgcacgccacgccggcgtgcaacagccccgtggactcgccgtcgcaccactcctacgtccaccactctagggcttcctcttcgagcagggtctccgccggctcctacaacaatatcgcctcttactgggggaggaataataaagggacccgcaaaaacaaattagggtcatggactcatgatcagtgcaaggtcattcaggaagaggaagggtattatggggaaagagaaggcttttctaggaggaagactcagatcttcgttgggatcctagcctttgccttcattttcaccctcttttgtttcatcattgctggggttgccaggccacacaaagttcggatcagtgttaagagtttcacagtacacaacttcttattcggagaagggttggatttgacaggagttccaaccaagatgctgacagtaaattgttcagtaagaatgacagtgcataaccctgcaaccttcttcggaattcatgtcagctctaaagcagtgaatcttatgtattctgagatgacagttgcaactggtgagctgaataagcattatctaccaagaaagagtacccggatagtgtcgttgaatctgcaaggaagcaaggtttctctatatggtgctggtgctagcttaattggcttggtggacaatggaaaaataccaatgactcttgtctttgatgttagatcgcgagggaatattgttgggaagttggtgatgtccaaacatcggaggcgtgtctcttgctcagtggctattgattcccacaacatcaaacccatcaaacttaaggagaatgcatgcacatacaactga

SEQ ID NO: 52811 - DNA, 633 bp, Glycine max
  Peptide Sequence Number=SeqID_169589
atgccattgctacaacatctgcatttccagatctttaaggtatgcaaattctttaggtttatattgcagcatggaggatgtgttctcttgacagatgaagtgggacttgggaaaactttgcaggcaattcactgcctaaaattaaatcatttccatacgttatctgtgcaccatgatgcatggcagtgttttgcttctttacaagcaaacaattatttgtgcaagaagttaaatcttgtcaggatttctgcttttctatctaatatctattgttgggttgtaaattttgttaattatcttctcataattgcactatcttcgttatgcttgcaatgggcttctatgattcaacaatggctaaatattccttcatcagatatactgattgtcttgtctcaaaatggtggatcaaatagaggtggtttcaatatagtatcttcaagtgccaaaagcagcattcatctagatggagtattcaacattatctcatacgatttggtgccaaagctacagaatatgcttatgacatgtaactttaagatatatactgattctatagaagccaagattccatgtgttcttgattatgttggaactgtcattgaggtattcctttcctcctctttacagtag

SEQ ID NO: 52812 - DNA, 1092 bp, Glycine max
  Peptide Sequence Number=SeqID_169590
atggcttcgtcgagggacaaggaacccgcgccgccacatcatcacccacctcttctgagcagcctcgtcgtccgcccctcccacaccgaggccgtcgcagccggtggtggtcgcgtcgccgacttcgagcctggcgaactccaccgtgatccccctcctccttattcccgctccgatcgatatcccgatgaacctggttcttcatcgccagttcaccgaagagatgcagatcaccgttttggttctgattataataacatgccacgaagccgtggatatggtggtgggagagacccaggaagatatcgagacccttcaccctcgtatggtcgaggtagagtagggggcaggccaatgggtagagcttttgacgggcctggctttgtttctggacttgctagaggggaaggcaacaatcgaaataatcccaatgtgcgtcctagggagggagattggatttgtcctgatcccttgtgtaataatcttaactttgcaaggcgggaccattgtaacagctgtaataggtctcgtaatgcacctgctagaagtcctaggagggcttatcctgcacctccaccacttcatgctcctcctagacgctttcctggacctccaattgatcgctcccctgaaaggactttgaatggctatagatctcctcctcgtgggttggcaaggaatggccctagagagtatgggtctgctgctctgccgccactcaggcatgaaggcaagtttccagatccccatttgcgcagagagcgtatggatttcatagaagatgcttacagggggagaaacaagtttgataggccacccccaccggactgggataatagagatcgtggaagagatggcttctctgatgaagggaaaggatttgaaaggaggccactgtcaccccctccacctcttttgccatcacttcctcaccatcgtggtggtcgatgggctcgagatgttagacagagaagccgctctccaataagaggtggcccaccaccaaaagaatatcgccgggatacgttcatgcatcgtgcaacagatgataggcgcggaatgggacgagatagaattggaggaatgtattag

SEQ ID NO: 52813 - DNA, 522 bp, Glycine max
  Peptide Sequence Number=SeqID_169591
atgttgaaattatttgctaatacttggtcaggtcttggattcataacttccataactttcatcttcttggtcggggttttcatgtcatcatggttgggtgcatctgtcctgggccttggggagtggtttatcaagcgaatgccacttgttcgtcatatttataatgcctccaagcagattagtgctgctatctctccagatcaaaatacacaagccttcaaagaagtagccatcattcggcatccacgtattggagaatatgcatttggattcatcacctcatctgttacccttcagaactattctggagacgaggagttatgctgtgtctatgttcctacaaatcatctttatattggtgatatatttcttgtcaacaccaaggatgtcattaggccaaacttatcaattcgtgaaggaattgagattgttgtttcgggaggtatgtcaatgccacagatcctatcaacgatcgattcacgcatcagactaggggaaataagtagaatcaacagaagctga

SEQ ID NO: 52814 - DNA, 213 bp, Glycine max
  Peptide Sequence Number=SeqID_169592
atggattcaatgtggaagggtctccctcgtactagtctaagtgatatggaagagctaaaggtcaacactaaaaaaactaaaaacccaacacctcacagtggaagatgcacagtcaaccagaggcatctcacaactcatgagaagccttgcagttgtagagtgagcaacaacgacggaggacaaaggaccagcgacgatgaggatcacgactga

SEQ ID NO: 52815 - DNA, 2529 bp, Glycine max
  Peptide Sequence Number=SeqID_169593
atgtatagaccattcatgacatgtgatgatccaaagggggttgttgagtgtggggcaataaggaaatacaggaccagttctcagaaaatgaaggaaaagacaaaaaataggaggccggccgagacgtccttggcaaacaaacaagacaaagaagagaaggtttcaaaaggatccacagaaaggtcttttgatccatcatcgttgcagctcatggaggtatccagaggggctcaaaggttgaacaacatgattcattcatggtctaggggtcttaggtatgatgaaaggtctgaagatatagcaaaagatttgctaaaaggggctcttgacctgcaagagtctctactaatgcttcgcaaggtgcaagaggcttcacaacacatggctagtttgaaaagaagacaaaatgagaaatctgaaagaggcagatttgatgcaaaggtgattgatggaactgcacattgtgatcattttggtgaacagagttatccaatgaggttccaaagacgttggccttcagctgatggttcttcaagtagttgcaacgaggagcttaagaaagtgattaaagagagcctggttaggcaaaatttgttcacaaccactgaagggttggattcagcatccacattccgctctacaaactcaagccagtcttctgtggcttggaatgataggctttctgattcttctttctcaccaacaacttcaaggagagaaagaggatccaatctggttgccaagctgatgggtttggaagaagcctcttcaagatcatttccagctgttatacagaaacagttggagagtccaatgattctgaatcagaagaggcctgtatttgacatagatatgcctaaggtaagaaaaaatgttgagacggttaatctagaacataagatgaccttgaaggagattcttgagactactcatttcaatggagttttaaagagtcctgtcagagagcctaaggttcaggtccatcattccattgatccacattacaaacattttggcgatttacctcccattgtacttatgaaacctcggtgtactccatatcgagaatgtgcaaaaagttatgagcatgttgttcctccagaagagttatcccttagaaatctaaaagcaaaatttctcccttccaaagtattccaacacagagaaggctcaaccaccaacatgggaaagaaaatggaagaatatgtatccaaaaggcttgccaaagaggaaagagctaacctcctcagagagggtgtggagctgaaggaaaaagaaatcaagcctgttgaaaatgagaaggctccaggaggtaagttaaaaccgcaaagtcatgtcagtcagaaatcacaggtaaatgaaaccgttgataaaaaagctaaggtaaagaccattacaagtagaaagctatcagaaaaggaggtttcaaaacccaaacaacaacaacaacaacaaagccttatcccactaggtgaggttccaaaacccaaagttgtgaagaaatctcaagataaaggagaaattagctcaacaagtacaaagttgaggaaaccacaaagtgggtccagaattgacaaaaatgagattcccagcagaaagagcactgcttcaaattcaaacaccatctcaaaaccaaagagtaaaaaaaacagtaataccaattccaaggagcagaaaaagaatcagatgaagaagcaaaggcccgccgttgcggagcctgaagcagctaaaccagttgatgaacagttaagagcagaagaagcaaatagtcttgatgtttcttgtaaagatgattgccctgagattagaataatcactacaacaacatatgatctttcggtggagcatgaagaagtagatgcatatgcaaataagattagagaaatttgtgagctaagccagagttcttcaagtgatgatattttgatgcttaagtctgaacatgaaaatgatgctatccctgctgaggaagctcatagcatcaccaatatcagtttcagtgaaactgatcgtgagcccgacaaagacagttctgagctgaaatatttgcttctaactagtcaatcatttattgaacatgcagaggagctcctcaatcttgatgttgactgtcccaagatcctaccaagaagtgaaactaaggaaatagccaatctcaaactttatttagattgtgcaaatgaactcactgagcgaaaaagccttcaggggacacaagcagttcacccttttttgctaacttgtgcaggtcattcaagatatcacatctctttagggaggttggttgatgaagtctatagtgccattgagcatctaacatcttacagtgaaaaactagcttcagataatatctatgcaatgatggagagagatataaagagcaacaatggactgataaatggaatatggaactggggttggaggcatggattttctgcagatgaagctgagcaagttgtcaatgaagtagagaacctagttttaggtgaattgattgaggagatatcagcatcttcaccttgtatataa

SEQ ID NO: 52816 - DNA, 306 bp, Glycine max
  Peptide Sequence Number=SeqID_169594
atgccaaagcttggaggtattggtgttggtggtgatgatattgttggtagatgggcttttatcctttccaattatcaagtgaaaaaggccttccttcaagtcagccaaaccaatcgtcttcaacgtgctcatgtcctaaaaaacaaaatgactaccaaaatcagaattgtgaatttgatttgggttagaatgagtgaggttggctcgtacaaggaaggtggtgatggtggagtgcgaggtggagtaagatcgtcctcaccaaatgagccggaggtagccatagggagatggcgactggaagcttaa

SEQ ID NO: 52817 - DNA, 1218 bp, Glycine max
  Peptide Sequence Number=SeqID_169595
atgaaacatcaatgttggcgtgatgccatgaaatgtgagatcaaggctctacagttgaatcaaacctgggacattgttcaaaccccttcttatgtacgaccaattgggtgcaagtgggtatataaaatcaaacgactatcgaatgacaacattaagcgttacaagactcgtcttgttataaaaggatactttcaaattgagggcatagattattttgaaaccttctcccctgttgttaagatggccactgttagagttgttcttgctctagcatcgattaatcgatggcacctccatcaattagatgttagcaacgctttcttacacagggacctcagggaggacgtctacatggagatccctcctggcttgcttggttacacatcaagtcaaagttgcaaattgaagaaattactctatggattaaagcaatccaatagacaatggtatggaaaattatctaatctattgttgacttatggttattcacatgcccatgctgatcgtagtctattcatcaaggctcataattctgaatttatcgctctaattgtatatgttgatgacattgtgctaactggtaattcccttgctgagattgaacgcattaagcatattcttcacactaattttcacattaaggatttggggaaactaaaatattttttggggattgaagttgcacattctgataaaggaatttcattatgccaacataagtactgtttggatttactaaaagattcaggtatgcttgggtgtaagccatcctccactcctatggatagttctcttcaactccataatgattcctctggttttcttgacgatcccctatcttatagacgcctagttggaagactagtctatttgacaagtacacaccctgatattgcctttgctacacaacaactaagtcaatttatgtcaaaaccaacaaaagcccatcatgctgcagctgtccgtgttcttcgatatctcaaagggtgttcaggcaaatgcttattttttccaaggacttgctctcctcatatacttgggtttagtgatgctgattgggcaacgtgtattgactctaggcgctctattactggttattgcttctttataggcaattcgcttgtttcatggaaaaccaagaagcaaactacagtctcacgttcctcttctgaggttgaatatcgagcacttgcttccgcaacttgtgaattacaatga

SEQ ID NO: 52818 - DNA, 4395 bp, Glycine max
  Peptide Sequence Number=SeqID_169596
atggctgaccacaacacacgcaagacgaccacggataggctcgaggaggccatctctcgcttgtccctgcaccattccgagctcgccagcaaagtcgatgccattctggatcgtctcgaccgccaaagcagcgcgagtcccgtctcctcccccaagccgcctcctgcatcacgcacccatgtcaaaatcgatgttccacgttttgacggatccgaccccatggggtggattttcaaaattacccagctgtttgaataccagggaaccccggaagaggaacgagttaccttggcttcattctacctcgatggtccagcgctcagctggtaccaatggatgttccgcaacagcttcatcacatcctggtccagttttcttcaggctttggagtcccggttcgcccccacgtactatgatgacccgaaaggggctctgttcaaattgacccagaccggctccgtcaacgactacctgaccgagttcgaacgcctcgcgaacaggattttcgggcttcctcctccgtttttgttaagctgcttcgtgtccggcctcgccccggacatccgccgggaagtcttggccctccagcccatctccttgccgcaggccaccgctctggccaaacttcaggaggacaagctccgtgaccgccctcgacccccctgccaccctagcacaaacccatacacactcccttcccatccttccccctttccctctccttccccacccccacgacccaaggccccttttacccaacgcacaccttccgaaatcgcctaccgccgcgaacgcggcctctgctataactgtgacgataagtggagcgccacccatcgttgcaaggggcgcgtcctcttgcttatcgccgaccctgacaaccccgacaaccccgacaacccctccgactcacccccactttcccccgtggcctcttctttccgcccagaacccaacctctcccctgctcctgacttttcccctcctacccctcacatcagccttaacgccctctccggcctccctaccccagaaactttccgcctcttcggctatatcaaccatacgcgcgtcactgtcctcattgatagcggcagcacccataatttcttgcaaccccgccttgctaccttcctccgcctccccaccgtccccactgaccctttacgcgtccttgtcggcaacggcgccgtcctcacctgtactcacctttgcccagacaccaccatctcccttcaatctcacctctttaccctaaccttccaccttttacccattagtggcgccgacgtcgttttgggaattcagtggcttaaactccttgggcccattacgactgattacacctcccttgttatgaagtttacccacctgggccatccagtcgagctccatgccgacgcagacactgggccacaccccatctcagctacccaaatcaagcgcattatccagaccaaagccacttcagccttcttccacctctgcgtcctccctgctattgacaccaaccaccatccacccatgcccacttccatacccgccattgacgccctagtaaccaaattccactccctcttccacacacccaataccttacccccctcccgttccattgaccatcatatcactttacgacccaacacggagcccatcaatgttcgtccttatcgctatccgtatttccagaaggcggaaatcgagaagcaggtggccgaactcctctccgccggactcatccaagtcaaccggagtcccttttcctcccccgtcctcttagtcaagaagaaggacggcagctggcggatgtgcgtcgattatcgcgccctcaacgccgtgaccatccgcgatcgtttcccaatgcctactatcgatgaattgatggacgatctcggccatgcatcctggtattccaagctggacctacaacagggcttccaccagattcgcatggcccctgcggacattccgaaaacagcttttcgaactcaccagggccattacgagtaccgcgtcatgccattcggtctctgtaatgctccgtcgacattccaagctgccatgaacaccctgcttcagcctgttctccgtcgattcactgccggccaattctacctcaaatacaccaagtgttcttttgctcagagacgcctggagtacttgggccatatcatatcggagcgtggcgttgagccggacccttctaaaatacgggccatggtcgaatggcccactcccaagaatcctaaggacctccgcgccttcctcggcctaaccggcttttaccgcaagtttgttcggggctatgccacccttgcctccccattgacggcacttctctgcaaaaatgcatttgattggaccccagagtcacagatcgccttcgaaacgttgaaaactgcgatgacccaggctcccgtactggctttgcccaatttcgaatacccctttgtgatcgaaacagacgcctcgggcactgcaatgggcgccgtcctccttcaacagaatcatccccttgcatatttcagcaaacctttcggaccacgactcttacattcgtccacttatgtaagagagctccacgccattgtgtccgccgtgcgcaaatggcgccaatatttgttgggtcaccgtttcacgatcctcaccgaccataagagtttaaaagacctcttatctcagatcatccagacccctgagcaacagcattacttatcaaaactgctgggctacgattatgatatccagtacaagaccggcgcttcaaatgcagttgcggacgccctctcacgggtcacgataccaccggagagccaatacctcttcctctctattcccaattttacatttatggaccagcttcgccaatcactccatgacaacaccgaattccaaaccaccatgaccaatgttcaagctcagccctccgaccaccgggacttcaccatttctaatggtttattgttctttcaggggcgtatatggttaaatcacgataatcccttcattccctcgttgatcactgaatttcactcaacacctttaggaggtcacctgggtatcgcgaaaacgactcaccgcgtcaacgccaacttctactggacgaccctccgccacgatgttaaacaattcgtgcgcaattgtgtcacttgccagcaatccaaaaattccacatctcgtccggcgggccttctccaccccatacccatcccttccggcgtctgggaggatctctcactcgatttcatcacccacttaccctgctcccatggtttcacggtgatccttgtcgtggtcgaccggttctccaaaggggtccatttcggcgctctccctaccaattttacggcctataaagtcgctgtgttgttccttgacatggtctgcaaacaccatggccttcctcgaagcttgatttcagaccgcgacccggtgttcgttagctccttctggcgggagctattccgcctaagtggtacacgcctgagaatgagcaccgcctaccacccacaaacggatggtcagacggaggtcatgaatcgcgtattggagcaatacttacgctcctttgtcagtgctcatccttcagattggtttaagttcttggccatggcagagtggtcatacaacacgtctgtgcactccggcaccggcttcaccccgtatgagatcatttacggtaaggctccgccgtcaattccccactacatcacagggtcttctaacaacgaagctgtggactctctgttgacttcgcgccaggaacttcacgacaccatgaaacatcaagctgacggtcaccggcgtgacgtccactacgacgtaggccaatgggtttatgttaggctccgacccctccgtcaacgctccctttcggggcctgcccaccccaagctgtccaaaaggttttttggcccattccagattcttgagaagattgggcccgtcgcgtaccggctacagctgccctccaccgccaaaatccatcctgtctttcattgctcactcctgcgaccccaccatggtccccttccgccggcagccacagacccaattcccttaacgatgattgataaccacccggtgttgcgcccattgtccatcttaagttccaaatctgatgactcaactcatccccccacacgcttggtcctggttcaatgggagggacaagctcctgaagactccacgtgggaatcctgggacgaattgaaagaacaataccaccttgaggacaaggtggatttggaggaggggggtgttgttagcaatatacacacagatacgggtactacacacacagacaggggtgctgctagtaacacccactcaagcacaaacaggcccatcagaaacattcagccccctcactacctgaatgactacatcacgtga

SEQ ID NO: 52819 - DNA, 1026 bp, Glycine max
  Peptide Sequence Number=SeqID_169597
atgaatgtcatccaaatagaggatgatgggcttagcatagagtgtactttgtttggtccatttgtggatgaacttaatgcatttcttgaatctggagaagttgaaaatgttgtgataaaattgcatcttcaaaattgtatttgtggtacaagagttgtgttcaatgctaaatgtgaagaggtaaaagagttggcaacaagaatgtcagaggattttctgtataatacacccaggaagactattagtgctcttaaagattgttttgaggatacctgttttgtagtttttggtaccatgaaacacgttgtagatgatgaggaatggtggtatactgcttgcacatgcaacaagtgtcgtatcaaggttggtgttattgataaaacagattcagccacttttgtgatttttgattgggatgctactatccttttcagcaagtcatgtgctaatatgtttgaaacataccagaagagaggtcttgttggaacttttccaagggatattactaatttggtggataggtttttcctttttaaagttgaggttaagagtgtatgcaactcacagtttgagaaaacttttagagtcaaaaaaatttataccaatttatccattatcaagttgctcaaagaagaagcaattgatttatcaaaggattctaaagagttaacccctactaaacacaatttttgttgcaaatcagccgtgggagaattgactccaaatgaaagcgagtttgcaatccgaaatcaagaaaatgatattttgttcaataattctggagatttgactcctgttggaattgtatttggaactcaaatacattcactaaccaaaaacatggaaggggcagataaacaactggaaagtgggtgtttggaaaatgtcaaaactaaagaaaactctagagtgaaagggaagatagattgtgttattatggatgttgaactgatgcagagtcaatctttagaaatgcatttgccactaaattttttgaagaaaaggatcaaggttgagaaaatttga

SEQ ID NO: 52820 - DNA, 300 bp, Glycine max
  Peptide Sequence Number=SeqID_169598
atgtgtgtgcattttttcaactttgatcatttgagaattaaacttcaaagttcagacttctttaaaggcactaaatttcgtgctcttctcttcctctcccttcattcatcttcttctaccttcaagctcttatccatgccttcctatggtgtggcgtatccattcatctttctccttctccattccagtgcaatcatatctcaagaagcaaaggaatccattgatgaagaagatccaaggcctacaagctccaatggagctacatcagaaagggctaacactatcgatgtgagacactga

SEQ ID NO: 52821 - DNA, 396 bp, Glycine max
  Peptide Sequence Number=SeqID_169599
atgaaaaaccttcacggatttgctcatggaaacgtctcggaagcgttacggaagcacatcggcatgaattttcttcacggaaacaatttttttcacccaaaacagctgaaattcatagcgaggggggttagggatatttggaacaaccccttttcgcctatttacaggaaaaagggggaggaggttgccacccagctcgcccaggcgagctgggttgctttctccagaagcaaccctgcttcaaaaatattttggaagattgtgcaacaattcttcctttcgacttccggcatgtcgcggaacttcacggattgcctaacgatgagtgttaagtacctcgaagctgtcaagcaaaagttgcatgccaccaaacaaatgatccctggaagaaattag

SEQ ID NO: 52822 - DNA, 666 bp, Glycine max
  Peptide Sequence Number=SeqID_169600
atggttgggtcccaacgtttaacatggatgagattcaatcaaaagataactagatatgatgttctaaatggattgcaagaagtagtctcaataggagaaacaaatccttcttctattgtcaaacatgttatcttaccatcatcctttactggtggaatgagatacatgtttcataattttcaagatgcaatggaaatttgcatgtacactgttgagtttacaaaacaaaggacttctacatgcacatatattattatggttggatgtagttgtagcatgaaaaacaggacatcatgttcattttatggattcaaaggattgacatgtccacttttgagaggactcacgcacgcatgggtccacaaaggagcagtagtagaccacgagcattcagcaggggaccatggcaacacccaaaagttggtcatgcatcctttgaagcacattgatgacatactcagatgggcaccgaaagccacattttcgaccattgatttcgcaaatgaggtattttttctcatgaacccatatatgcttcatcattatacgattagtaattttagggttcattcatgtaatgcttcatcatcatacttctctgaagaaggattggagaatatagtgaggagttttcgacatttattgttcggattcactattaagtag

SEQ ID NO: 52823 - DNA, 263 bp, Glycine max
  Peptide Sequence Number=SeqID_169601
agatcaaagcattgaggtgtgaacttgaagatgagtgtcagaagctggaagaggagttgcatcttcaaaaatccaaagaagacaggcaaagggctttgttgcagttgcagttgaaagtgatgagtgacaagcccaaagaggaccaagaagtgaattcaaaacagactctcagtcatagcctctgccagggaataaataccttgaattcaaagcaaatcagacactgcattccaaggcggttattacataataactgtctttga

SEQ ID NO: 52824 - DNA, 177 bp, Glycine max
  Peptide Sequence Number=SeqID_169602
atggagaattggcggaaagcgctaggaattaaagtcgcggggcttcaaaaaaaatggagaatggagaattggcgaacagcgctaggaacgctaggtaatgaattcatggggctccgaaaaaaggggagaatggagaattggcgaacagcgctaggcagtagattcgcggggctctag

SEQ ID NO: 52825 - DNA, 177 bp, Glycine max
  Peptide Sequence Number=SeqID_169603
atggcattaggggtcatggcagctcgcccaagcgagctgttgcttcatcccgaggtaaggtggctcgcccaggcgagctggggaagtaaaaataaggatactaatttcgttcgagcgatcttgctattggaccaagcaactggagaaaaccaaggaagtgaaaccgagaaagcatga

SEQ ID NO: 52826 - DNA, 381 bp, Glycine max
  Peptide Sequence Number=SeqID_169604
atggttactaaggctttctacatcggtcaattaacatcggttattgcaaaaaccgatgttaacgaaagtgcggtgaaaccgctggctggaacccacagaacctcctatcgaagaaaagtcgaagaaaaccctgcattgctgttggaactgtgtgggtcgaaaaaaccctacactgctcttggaacagtcgtgggtgctcaaagctcaaagctttctacgctgccagttaacaagttgattgtgcttgacaagagttacacgccaagcaaagtttccatccgtgccggtgatggttttcacaacttgaagattaagaccgtggaactcgtgaagccaactgggtgggtttatctatccttgtctagagctgatcctaggtaa

SEQ ID NO: 52827 - DNA, 1341 bp, Glycine max
  Peptide Sequence Number=SeqID_169605
atggagaatgagattgagagaggaaaatggaagaacctggtcgcatcgatcgcaggtgaagggcaagaaatcgatgagcttgcaatcggacacagcacaggaaaggaaaaggaaaaggaaaaggaaaaggaaaagaatgagagtcgtcgccgcctcgtcggaactgagagggagtcttcctatgctgaccaccttgaccccctctcccttcgcactgcccgtagtttgggtaccatcagattcgagtcgagaaggaggatattcaaaagaccgcattcagaatttgttatagacactgagtatttagttatgtcatttggtgtgactaatgcacatgtcatatttatggactacatgaattgtatttttcatcaatacttagacaagtttgttgtggtgtccattgacaacatcctcatatactcaaggagttcagaaaagcacgcagagcacttaaggatcttcctaagacatgttgtgacgagcaaaggaatcattgtagatccaaccaaagttgaagctgtaatgcattggatgcaacctacaatgcctatagagaagattttccaagagttgaagaaaaggttgatgtctacaccaatcttgattttacttgatcctgaaaagaagttcaaagtgtgttgtgatgcatcaagacaaggactcaattgtgttttgatgcaagagaagaaagcgattgcatatacttcaaggcaactgagaccacacgaagtgaactatcctaaccatgacttagagctggcagcagtagtgtttgcggtaaagatatggaggtattatctttatggaactagattcgaagtattcaacaaccacaaaatcttgaagtacttgtttgatcaaaaagagttgaagatgaggcagagaaggtggatggagtttttgaaagactatgacttcgagttgtcataccatcccggaaaggctaatgtagtagctaacgctttgagcagaaagtcattgcatgtgtctgtcatgatggtgaaagaactacaattgatcgataagttcagagacttgaacttagtggtggagttcttacaagacattatgaggctgaaagaggaaggcaaggaattggaattccagcataatgttgagcacaagagagctattggagaattgcatcccttagacattcctgagtggaagaaggataacatctcaatggattttgtctatggtttacctaagaccaaacaaaattgtgatgatatttgggtaattgtggatagattgaaaaagtcttctcattttatcccctttaacatgaagcacatgaaaaagataatggaactcacaaatcaagaggaagggtga

SEQ ID NO: 52828 - DNA, 236 bp, Glycine max
  Peptide Sequence Number=SeqID_169606
tatgtgaaattgaacaagaggctccataccaagatgatgagcttgtagggcttcaagaaatgttggaacttgaccctgatgtcattaatgaatctcttgcggatgttgatggaggtggagaagagatagatgtagatttactcaaacaactaggcttgatcgaaccagacaaggatgaatgcatgttaagtgagaatgacatcgagagtgattttgatgattcaaatacttcttag

SEQ ID NO: 52829 - DNA, 873 bp, Glycine max
  Peptide Sequence Number=SeqID_169607
atgggaaacattataagcatcagtcttctgagtaatgcttggatagatgaggatgttaagctaggaagtcatgtttcccttgccttttcgggaagactgcaggaggaaaagggaaacaaccacgtgtggactatgtcatacaaagtaggcattacagattgtgaaatgcaactatggagacgtatggagaatggtgacatcaaggctttgctcttgttactccacagcgaatcaacctgctataaactcgatccaaataatcatgtttcggtccttgattttcgtttggacgtaaccactgtagatggaaaagatgatctgttgtttgtcgacagcaaagcaacttaccgtaacaacaaattatgcttccaactaactaagtccatttatggagacggcagcgtcacgcaaaccagtgttttcttgtatgggatgggacacaaagctggccttgttgttctccaaaggcactataatggtagcgctcaggatgaaaatccttgcgccgtaactctgacgcactatcatgctactagtcccggaatcaatgattactctaaatctaaagcagattttgggctctctgtgatagcaaggattgtaccatcgaaagggaatgtggttatagatgtggagggccccaagcaacacccttcttctgccttgttttacttgtttgatcaagtcagaagcactggggtttggaatcctagcatgtgccctcattgtgctgctcaagatcccagaccgcgtagtagagatagtgttgttcccgtggcacgccctcatgcaagattgttcgccaatgagggaaggttcgcggggaccggtaatggtggtaagattagatgtcgtaattttaatgtttattaa

SEQ ID NO: 52830 - DNA, 327 bp, Glycine max
  Peptide Sequence Number=SeqID_169608
atgtgggttcagcaatctaaggagaatcaaactcaggatgaatggaaaggcatggatgttactcttagggaaactaatgtggattggttgaggaggtgtatggttggaagactgtgtaaggaggaagtcatgatcaacacccaagaagcattttttgtctatggtcatagctcgatattgggatggagaggaagtataggatgggtggccagagaaggagataaaggcatatatgacattggtgaaagctttttggcacgactttcctttattccggggatggcgtgtggtgaggcagaagggttgacaacaaaaaactatggttga

SEQ ID NO: 52831 - DNA, 261 bp, Glycine max
  Peptide Sequence Number=SeqID_169609
atggcatttcgtcattgggattggcgaaacaggcatccatcaggtcacggcagcagtgagagtttcgccggtgatgttaacgaaataggaatgagagttttgtgtgaaacaagggaagatggtgaattaagggaaagagggagcacagtaaaaagcattcgagaagcgataactgttgggtactgttcaagctccaccagcatgatgccacaacccagaaacaaggaagaaatgattgtccaatgttatagtaacgattga

SEQ ID NO: 52832 - DNA, 3301 bp, Glycine max
  Peptide Sequence Number=SeqID_169610
cactgtaaaacctggatcatcatcttggagatttctattaccttcatttgttgccagtggagcatttccacaaaacaaaaggatactctcttttcataagaagtctagaacctccatatcagccacagaaacagatgtagcagtggaggaaccaggtcctgttgctgatgaagattctggtgaacttccttcaaatgaagttggagtaagtgaagattcatttactaagtctgatgccaaccctgatccagctaaagccagacgttcaagacctgcaaggaaaagtgagatgcctcctgtaaagaatgaggatttgttacctggggcaacttttactgggaaagtgaaatctgtccagccatttggtgccttcgttgatattggtgctttcacagatgggcttgttcatatttcaatgttgagtgatagctatgttaaggatgttgcaagtgttgtttctgtaggccaagaagtgaaggtgaagctgattgaagtgaatacggaaactcagcgtatttctctctctatgcgtgaaaatgttgacactggtaagcagcgtaaagatgcacccaccaagacagagaaagctggacctgggaagaggaacaattcaaaacccagtccaaagaaagataatgtgacgaaaagcacaaaatttgccattgggcagcaactggttggttcagtgaagaatttggctaggagtggtgcttttatatcacttcctgaaggggaggaaggatttctacctgtatctgaggaacctgatgatggatttgataatgttatggggaacactacgctggaggtcggtcaagaagttaatgtacgagttttgcgtatcacaagaggacaagtaacattgactatgaagaaggaggaagatactgcaggattggactcaacatttaaccaaggggttgtccatgttgcaacaaacccttttgtggtggcttttcgtaagaataaggatattgcttcttttttggatgatagggagaaaactcagactgaggttctaaaaccatccactgctagtactttggaagaaattaagggaactgtcaatcaaggggaaactgtattggatgttcctgacgtgcagggggaaccagaaagcagcaagttgacagatgatgttccttctgctgaagatgatatttctgaaaatgtgggaaccagtgcaactaatggctcgtcaacagctattgtggatgatgaaagtaacctagtcagcaatgtttctagcccaaagacaggtatagatagtgccattgagaaggaagaagaggtagcttttggaagtttaattcctgaagaggatctatctactgtaaatccaataattgaggaagctactcagacagatgtcacaacaatcgatttgaaaactgacgcacctgttgaaatagctaatgaaaatgtaatagaaactggagttgatcaaattgttgcagaagatgagaaacaatcacaaactcctaatgcaatggaagagtttgcagctgcagtactaacagacagtgatgtggtcgaacctagccctgataaaaatgatgcaattacagaatcagatattacatcgagtgcaccagctccccaagaaagtgcaggtgatgatgttggagctattactgagaacattgacagcgatactagtttgagtggacaaagtgacgagttgtctcctgagggaagcttgactacagatgcaacagaagaaactgatcaggttccttctcctgaaagttctgccactgaagtagtaaaaacctccattgatgatcctgaagaagaagcaaaaaaacaaactccggctacagagaatgaaaattcttttacctcacaagttgaagacaaagaggttgcaattgcatctgataaaaatagcagtttatctaattctgatggacaaactggtgctacttcaggagaaagcttgagtaaagcaactatatcaccagcacttgtgaagcaacttcgggaagaaacaggagctggaatgatggactgcaaaaatgcactatcagagaccggtggggacattattaaagcacaagagtaccttaggaagaaaggcttatcaagtgcagacaagaaagcaagcagggtaactgctgaaggaaggatcggttcttacatccatgacagcaggataggtgttttggtagaagtaaactgtgagacagattttgtctcacgaggtgaaatttttaaagagcttgtcgatgatatagccatgcaagtggctgcatgccctcaagtagagtttcttgttactgaagatgttcccgaggaaattgtgaacaaagaaaaagagatagaaatgcagaaagaagatcttttgtcaaaaccagagcagataagatcaaagattgttgaagggcggataagaaaaagacttgaggagctggcattgcttgagcagtcctacattaaggatgataaggtagcagtaaaggacttcgtcaagcaaactattgcaactattggagaaaatattaaagttaagaggtttgtgcggttcaaccttggagaaggtttagagaagaaaagccaggattttgctgctgaagtagcggcacaaactgcagcaaaaccagcacctatactggtgaaagaggagcctgctgttgcagatgcagaagccaaggagaccgagccaaagcaaataacagttgcagtctcagcctcattggttaagcaactgagggaagaaactggagcagggatgatggactgtaagaaagctctagctgaaactggaggggacctggaaaaggcccaagaatacctcagaaaaaagggtctctcatctgctgacaaaaaatccagcaggctagcagccgaaggcagaattggttcatacattcacgattcacgcattggcgttctaattgaagtgaactgtgaaactgactttgttggtagaggtgagaaattcaaggagttggttgatgatcttgcaatgcaagttgtagcctgcccacaggtgcagtttgtatccattgaagatattccagagactattgtgaacaaagaaaaggaacttgaaatgcagagagaggacctgctttcgaaaccagagaacatcagagaaaaaattgttgagggaaggatctcaaagaggcttggggagcttgctcttctagagcagccttttattaaggatgacagtgttttagtgaaagacttggtgaagcaaactgtagctgcactcggagagaacattaaagtgcgccgttttgttcggtttacgcttggggagacatctgaaaaagaaacaacagtaccagcataa

SEQ ID NO: 52833 - DNA, 345 bp, Glycine max
  Peptide Sequence Number=SeqID_169611
atggttatcttggtattgtctctaggtccaattgttgatacagttataatgaattctccatttggttctcggaaaaaaggtgcacatttggattttctctctgttgctttgaagcatgtgaaacgaatagcattaagggatttcaatgctagcagtgctgaagttatatgtgagctccagtttactcaaaatacttctgtagggtatctgcttcgatttgatgtaccgaaaatgtacaaatttcataagaaggaagcagaaatacttgatttgatgcagaaacggatagtgtgtattggaatagacgataagattgcaagtaaaaagaaaatttttggtacctaa

SEQ ID NO: 52834 - DNA, 783 bp, Glycine max
  Peptide Sequence Number=SeqID_169612
atgatgccagaaccttctaaagtcagatcgtgtggatggattctcaaaaagtcgccacttatagctatgatcgaagtgacaatgttgagcaccacgacattattcaggtgttacgtcctattaggaagtactactttgatgatgcttgcatctgcttcaccaatgacgctaatagttatcccttcattcaatgtcttctcaaacttcccactatttactcaaaagaagaagaaggttggagaagaagttgttgttgctgctaagaaagatgtcgttgcttccatccaggctgaagcatctactgaagttgtgggtgacaccattgtacatggggtcatcattgatcttacaaacactggtgtcatggacgaaactcctgaggcacccaatgcaactgtggctaatgaagttgaacaccatgttttagaaactgcgaccaagcagtctacaacttcacatgaggttacttccaaagataagggagaccatgatgttgtcatagtttactctaccaattccgccccacttctctcgactatgtacaacccaccattgtcaccagagatcaagctctctatgcataatgcaattataacccagttctccaaccttggtgtcgtactacttcaaaacatacaacaggctcaaatgtctatgctaggtgttgttactgcccctacaccagtacctcaaccaccacttgcacttgcatccctagaccctctaccaccacccttagcgcctattccacctcctcttccatcttcaccaccatcttcttaa

SEQ ID NO: 52835 - DNA, 270 bp, Glycine max
  Peptide Sequence Number=SeqID_169613
atggcagtgagacttgaagctttcctcgcacctcatgtcaccacgaaatgtgttgaagttgctgtctcgctaagcctagtccatgcgcttagcgagattcatccgctaagcgagacatcagcatgcttagtgagtaagaggaatcttggagagaatctgccttgtcagcacacgctcaatgcgtcaccagtttgcccagcgagatttttgtctctttttgcgctaagcgcgcctggctcgctgagccaaagtttactcactcgtgcttag

SEQ ID NO: 52836 - DNA, 176 bp, Glycine max
  Peptide Sequence Number=SeqID_169614
gagaaaaaggccccgatggactcttcagagtccaggcattgggagtaaatccacccggtttgagtgctcctttaagtcggtgccgatcccacatggttggagtattctcacaaaatagcgtgaccctaactagtctccctatgattttacctagtgagagtgacgtgacttactag

SEQ ID NO: 52837 - DNA, 405 bp, Glycine max
  Peptide Sequence Number=SeqID_169615
atggtgcctgatagagtctacccaagactgcctatctgtaatgaagggaaaaagacatgtacctgctttctactaaagggattccattcagaaaaagccgaagcagacgcagaaacgacaagagccaggaagatggtttccataccaattgctataattgttgaagcacccaaaatggcggagtctactccaatcatagttgctgagaaaccaaaagctaaggtggatgaggctcaaattgaatcaatctcacatgaagccacatctaaagacacaatggatatcatcgtctatattaccagctttggacccactccagttatctttgctcctccagaggtcgtaaccaaagctaaagtgaagaagatgatggaattggctatgaacaactttgctgagaagtag

SEQ ID NO: 52838 - DNA, 237 bp, Glycine max
  Peptide Sequence Number=SeqID_169616
atggcttggtctcttaggtacatttgttcattcgatttgccaaaggataagctatcttctttggaaagattaagattaactggatgcactagtaagagtttgggtcctctttgtgttttccaaatagatccttggagatgctgctttgagagattttcttgtcctttaacttctgaagacttgatggaagcttgctggtggagcttctatggaggctggatctttgagcttcaatga

SEQ ID NO: 52839 - DNA, 624 bp, Glycine max
  Peptide Sequence Number=SeqID_169617
atgatttgtggcagggtgttagcatgtactaccacaaaggagatgtgggatctaatgcaactggctcatgaagaaaaaaatttcaaaggaatatcctttcaacccaagaaaaagtttaagaatgactcaaactaccctaattttacttgttttaagtgtggcaaactgggcctcataaaatccaaatgctcatttttcttaaagaaacaacaaggaggagaaaagaaggaaaaatgtgaaagtaagaagaagaaggcttacatagcatgggatgagaatgcttctagtactttaagtgattcaagcaatgaagaaaaagaaaatctttgtcttatggcagatggtgaagttgatagcatgatgcatgaagaagctaaaaaattgttgttgggtatggatgaccactcgtctcatccatctaggattttgatgtatcataacaatgtgagacaacagtcttttcaaggaatcaatgctgatcccatgatggatccttcactaaagtctataaaaggtcatcttaatgaggaagcaactgacgaaaaagattacaagaaagcaagaaaatacttgaagaaaaactctgctaaaatcactagacgaattatacatagttttcattag

SEQ ID NO: 52840 - DNA, 519 bp, Glycine max
  Peptide Sequence Number=SeqID_169618
atggcctctgcaaacacccccactactaagactatcccaaccatggaaatcaccaccatccatacacacaatgagtcatccattcatgtagaacacttttttgacattcaagaactcgaaaaagtggttctaaagctcaatgagactttaccattatgtggtgaacgttggaagaagaattatgactcccatgccacaagaacactctatcgggagaatgctgacgaggttggcaaccagaaaatgaatgtctacaacctgaagttcaaaccaaccttgtctgacctccacaagttcgtattatttcacttgatggagaaccttccttttgaccatccacacaccatatacatcaacattttgaggaacctaaaggggttaggtggtatagacgacatctactatgtagctctcatcaacaagcttctatgggatcaaggagtataccatattttcaataacatggacaaggactctaagcacaccctaatagccaagggcccagttattgctaaataa

SEQ ID NO: 52841 - DNA, 213 bp, Glycine max
  Peptide Sequence Number=SeqID_169619
atggtgatggaggatgatatgatactattgaatcatcaagctccatttccaagggttgaatcttcaagttgggatgtagtaaatcccagtggggtgaattggaatgagctcaatcatataacaaattttgttacagctctcaatctcagacacgatgccaataacgtcttacgatatggtcaggtgcctgagacttggcctaaaaatatctga

SEQ ID NO: 52842 - DNA, 222 bp, Glycine max
  Peptide Sequence Number=SeqID_169620
atggaccgctattttgcagggattattcaggactgtgcttttctgttaagaagcaacttcttgaaagtctcgtcttatgtgaatagacatgctaatggaggagcagatactttagcaaagttaacttttttgaatcctgatactgtctggtttgaggtgatccctcaaattgttaatattgttgatgatgatgtaaggcctcagtgcccaccttatttttaa

SEQ ID NO: 52843 - DNA, 870 bp, Glycine max
  Peptide Sequence Number=SeqID_169621
atggcgctggccagcagctgcgcgcactcgtcgtgctcgcccagcgccgcatgcagggcctgcaggcgtggtgagtccagcggggccaacacgtcgcgcaccgccggcagcaggcccaggccgtcgcgcagggtggagaaatcgcgcgggcgcgccgagcgcagcgccacgcggggtttccaccgcatggtggcgctgtaccagcacctcgcgcaggcgcagcggacgatgcagccagcgccgcagcaggcggccgcccatcggcgtcaccgtgctgtcgagcacgcccagcagcgtattgcgggtgtcgccatcaacacgcgtatccagttccagatggcggcgggtggcggcgttcatcgcgatcgcctcgccggcagtctccatcgcgatggaggtcaggtgcggcaggcgctgcttctgggtttcctcgacataaccgagcagggcgccggcggcagcggtcgcgcgcggcttgtcatcgatgccgaagccgctcaggtcatgcagtttgaagaagttcagcagctggcggcggccactgtcggcatcgaacagccacggcgcgcggcgacgcacgccggtgcgctggcgcaggaactccggccagttttcttcgtcgggcaccagcagctcggccggctccagccgtgccagctcggcttccagggcgtcgtcggtttccacttcgttgaccaggaagcggccgccagccaggtcggcccacgccaggccgtagccctgcttgctgcgcgacagggccatcagcagggtgtcgcggcgttcatccagcagcgcctcgtcggtgaccgtgccgggggtgacgatgcgcactaccttgcgctcgaccaggcccttggccagcgccgg

SEQ ID NO: 52844 - DNA, 448 bp, Glycine max
  Peptide Sequence Number=SeqID_169622
atgactctcaatgggcctactgttaagagtaccaaacgggaaatgctaggtgcacccaaagcacttgctgttgcttcttttggttcttccggttcttgcttcctcttctccgtcagcgacaccgcgagccaagcttcttcttcttctccgcgaacgagccttcgagacgccggaaaaaatggagaaagggggcttacggtggcggcttccggaagatccgttaagggttcttccggaacttccagaagaagctgttccggaaaaattccgaaagaagtgttcttccggaagcaaccaaaggtcttccggaagaacccttcttccgaaagtcttccggaacacctcttccggaaactttctggaagaagtagttcttccggaagaattccagaagaagggttcttccggatgacctttgagttttccggaagaaccacttcttccggaa

SEQ ID NO: 52845 - DNA, 531 bp, Glycine max
  Peptide Sequence Number=SeqID_169623
atgtcagaagttacagagggtggtcatcattttgacttaaagaaactttcatttgtaggggttattgtgtccctcggaattgtttttggggatattgggacgtcaccattgtacgtaatgaaagcaattgtgaatgcccgaaaagatggtgcggcaatgccattcgatgaatatattgaaggtgcattatcatgtattatctggacattgacccttcaaactactatcaagtatgtaattattgctctaagagcagataataaaggagaggggggaattcttgcactttattcactagtaaagaaactcaagaagaaatggctctatgtggttgccattataggagcagcaacacttgttgcagatagtgtaatcactccttcactaacggttatgtctgctattgaaggtttaaaaatatataatcccgagacaccggtagttctcattaccctggtcatcctgtttgtagtttttgtggtacaacagtttggaacggcttctattgggaaattctttggacccgttatg

SEQ ID NO: 52846 - DNA, 348 bp, Glycine max
  Peptide Sequence Number=SeqID_169624
atgaaagtagcgattcaggctgctgaagatttggctaaagaaggaatttctgtagaggtgatcgaccttagaacaatccgtcctttggattatgatgctattttaaattctgttaagaaaacaaatagactggttattttggaagaagcatggccgtttgcgtctatctcttctgaaattgcatatatggttcagcaaaaagctttcgattatctggatgcaccaatcaagagaattacgactcctgatgctcctgctccatattcagcagctttatttgcagaatggttccctaaacttgaaaaagtgaaagaggagattaaaaatgcgttgtatattaaatcatag

SEQ ID NO: 52847 - DNA, 474 bp, Glycine max
  Peptide Sequence Number=SeqID_169625
atggatactatacaaaaagaaaaaaatatagctcttatcaaagatgttttgagaaactaccttttagaaaaaggtttccgaaacacacctgagagatacaccatattggaagagatctataatatggatcaccacttcaatgtggatgatctctatctgttgatgatgcagaagaaatatcatgtttctaaagcaacaatttacaatacaattgagatcttcctggatgcagggctaattcgtaaacaccaatttggagaaaaaacactgacgtcttcatcttatgagaagtcttattttgataagcaacacgatcacttggtgatctacaaaaaagattctgataaggagattgaggaaattatagagttttgtgatcctaggattcaagggatcaaagaagctatagaagatgcttttggcgtaaaaattgattctcattcgctgtatttttatggcattaagaatgactaa

SEQ ID NO: 52848 - DNA, 405 bp, Glycine max
  Peptide Sequence Number=SeqID_169626
atggtggtaaccaatcctagtgagttcaccattcataggaaggttgaaataatcattgaaaaaaagaaagtccctaaggctagtatgcaagaggaagacaataggaggacaccttctaagcccaaagatgataagaggaagacaataaaaaagcaagcccctaaggctagtatgcaagagaaaactagctctataaagtgctttaaatgtcttggaagaggacacattacttctcaatgccccaccacaaaaaccatgattatgaggggccaagaaatttgtagtagccaagataaggctactacttcaccttcctctagtgaaagtgaaaaggcaaaaggggcagaatctagtgaagaaatctacccccaagaagaaggacaaccattagtggttaaagagtag

SEQ ID NO: 52849 - DNA, 793 bp, Glycine max
  Peptide Sequence Number=SeqID_169627
atggatttggtggagtggccagcggtttgtccaggagacaaagagagtgtgtgcatcccaagtgagcgtgagacacttttgaagtttaagaataatctcatagatccttccaataggctttggtcttggaatcataatcataccaactgttgccactggtatggagtcctctgccacaacgtcacttcccatcttcttcagcttcacctccacacttcaccttctgctttcgagtatgactatgattacaactatgattacaattataataatctcttcgatgaggaagcttataggagatggagctttggtggagagataagtccttgtttggctgatttaaagcatttgaattacttggacttgagcggcaattatttccttggagaaggtatgtcaattccttctttccttgggacaatgacttccttaactcacctcaacctctcttatactggattccgtgggaagattcctcctcagattgggaatctctcaaatttggtgtatcttgacctgagatatgttgccaacagaacagtaccctctcagatcgggaatctctctaagcttcgatatcttgacttgagccgcaatagatttcttggagaaggtatggcaattccttctttcctttgtgcaatgacctccttgactcacctcgacctctctaatactggattcatgaggaagattccatctcagattgggaatctctccaatttggtctatcttgacctcggaagttatgcttccgagcctctgttagctgaaaatgtagaatgggtatcaa

SEQ ID NO: 52850 - DNA, 408 bp, Glycine max
  Peptide Sequence Number=SeqID_169628
atggtcatcatcatgcccatcatcatcgtcatcgaaggggcagagattaatataaagccatggcatattttgttgggagggttgaaagaaggcactacgaggataccatggctgaacagagagccttatgcttactggaaaggtaatccagctgttgctgaaaccagacaagatctcattaaatgcaatctttgtttgagtcaatggtttggagaagcagaaggatcagtaaagaaatttatgatggaatcattggtcaaggttcctgcaaataccgacccttgcaccatgcctgccccttttgaccctccaactttgtatgcaacattagagagaaaggaaagctcaattcaacaagttgaatcatgggagaaaagttattgggataatcaaaccataacatcttaa

SEQ ID NO: 52851 - DNA, 441 bp, Glycine max
  Peptide Sequence Number=SeqID_169629
atgaagaccaacaagaagtgtgtctgccttattctcaaagacagggatgatcctgaccttggcttgaagattaacatgacaattgctgttggtctcccttctctttgcaaaactcctgataatctctcacagtgctctgaccagcaaggaaccacaacagacccactcacctcagggattaggtttagccgcgacagcattagtgcactgcatttcttaactgggaatactcaggccctaaatcttccaattttagtaaaacttcgtaccccattgtccggaggctcttcgctatgcgaagctgaaggaagttcccagaatggtagaaaccaggggacagatgaaatggccacagctaagaagaatagtgcgtcttatatcgggaagagattgttagaaagtttggttgcagttgcagggcttctaatttggctttcatga

SEQ ID NO: 52852 - DNA, 225 bp, Glycine max
  Peptide Sequence Number=SeqID_169630
atggttcaagttgaagaagtggggggacattgtcatgaaattggtggagtggcctatgggatatggatcaagttgaagaagtcagagaccttagtatggctggactttgtggagtgtcctaagaagttgaagaagtcagagaccttaatatgggtggactttgtggagtgtcctaaggttcaagatgaaaaaatggaagaacttgacatggacttgatggagtag

SEQ ID NO: 52853 - DNA, 753 bp, Glycine max
  Peptide Sequence Number=SeqID_169631
atgggccggcaggcgacttggctgtaccgctttgatgctgccatcaggcagcgggaaaaacaccttgagcagcccttcctcatcgaacagcgtaatgccgatatcaccattgaacaggccgagcgcgctgtcgttacgcgtcaccatcaccggacgcccctgataccagcggctgccccctgccggacgacgaatcagctgcagctgcatcagcttgtgctcaatacgctgattgagcccctgcacgccaaatggcccttcgcgcagggcgcacagcagctgataacggccaaacgcagcaatcacctcggccggtgcggcacgctggttaatcaactggagaaatggccgatagccttcggcaatctgcgtcagcatcgcctgatacgcttcggcatcgttgagcggctggcgcacgatatcactgaagcccgcctgaaaggccgcctcgaccgcctgcgcttcgccggcgttgaccgccgcagccagctgaccgatgccggagtgcgccgcgaaacggtagcttttgcgcagcaggcagatggcatcgcgcaccgccggggccaccgcatcatcggtgccggcaacctcgcagccggtcagcgtggtgagctgcaacgcgcgcaccggactgtagcccgcctcggcacagcggcagatatccccgagtaccgcaccggcttcaaccgaggccagctggtcgcgatcgccgagaaaaatcacccgcgcatgagcgggcagcgcggcgatcag

SEQ ID NO: 52854 - DNA, 228 bp, Glycine max
  Peptide Sequence Number=SeqID_169632
atgacggtgcacaaatcacagggttcggagtttgaccacaccgcgctggtgatgccggctcagttcctgccggtactgacgcgcgagctgatttacaccgccattacccgggcgcgcagccagctgacgctgttcagtgatgaagcagtgttccggcgcgcggtgcagttgcgcacgcagcggcgcagcgggctgctggatcgcttagggggagaagagggcagatga

SEQ ID NO: 52855 - DNA, 573 bp, Glycine max
  Peptide Sequence Number=SeqID_169633
atggattcaaatgcttgtctaccacacttgctagtgttagcaataacattggtattggttagtcatgcaatgggagattcagctcaagacaaacagagatgtgcagaattcctgacaggtgttacaacgtgtctgccatatttgggtggtgacacgaaagcacccacagcagattgttgcagtggtctcacacaagccatgaagaccaacaagaagtgtgtctgcgttattctcaaagacagggatgatcctgatcttggcttaaagattaacatgacaattgctgctggtctcccttctctttgcaaaacacctgataatttctcagtgttctgtttcttaactgagaatactcagaccctaaatcttccagttttacacttctgcacttggatcctaaatcacctgaagctcaagcttttaatgaaattgatcagaaatccaatggtggttctctccgtccttcgcccactccttctgttgaaggaagttcccagaatggtagaaagcaggggacagatgaaacggcgacagctaagaatagtgaatcttatatcaggaagagattgttag

SEQ ID NO: 52856 - DNA, 462 bp, Glycine max
  Peptide Sequence Number=SeqID_169634
atggttttttacaatcttggcgtatgcacatctgccaattgttggctatttcaagcttggggcagtgcatcccacaccatccaccataatgtctcaccatatgcagcttctaatgcggtgtgggcggagtggcaacaacatgtcatttcgttgggtgatgttgtgtcatctatgggtccttgggcttgcacccctgactatctgctttggttttattgtatttcccacccctatgccattctgctagaggagggagagccaccacgtcctctcgtacatttattgcccatcccagtgcagttcttgcctgagcaaccattgatagagtatgtaccagatggagactactcttgccaatttctacatgagggcttcaaagatgggtgtagcttagagaggcaaaggaagagggctgccaaggatattggcaaaggtggcaagaagaggggtaagtgcggatga

SEQ ID NO: 52857 - DNA, 420 bp, Glycine max
  Peptide Sequence Number=SeqID_169635
atgaaaggaattgttggtacataccctgtggtggtgggacttaaatgctctcctggcaagttacatgctttagtcaaagttgaccttcaagcctacactttcttcatgttgaagcatgtgtttcccataactatttctctaacgccgtatatctatatgagggttctacatgagggaggcgcagatgatgagcctgatagagcaccccaacgtggtgagggcctactgctccttcatggtgaagcggagcctatgggtggtgatggcattcatggcgcagggctcctgcctgcatctcatgaaggccgcttatcccgagggattcaaagaggcctccattggatctatcctcaaagagactctcaaggtgttggagtatctccaccgacacgaccacattcaccgcgacgtcaaggctag

SEQ ID NO: 52858 - DNA, 330 bp, Glycine max
  Peptide Sequence Number=SeqID_169636
atgaaactccgaaggctatacttgattcaacaagtttccttagctgagtttgcctgtgaagtggaaataacagagtgtgaaccacttccagatggtcgtttttatatagagattgaaagtcgtaggagatttcgtatcatccgttctagggatcaagatgggtatcgtgttgcagaggttgaatggatacaagatattatgccaccagaaggaacaagtgaaagagagactttacaacaacaaacatataatgcagctgaagatgctcgatcgtggatagcaagagctaaagaagcagcaaaacatgtgaaaaccaagatatattggtaa

SEQ ID NO: 52859 - DNA, 181 bp, Glycine max
  Peptide Sequence Number=SeqID_169637
gtatcgtgctgcaaaggttgaatggatacaagatattatgccatcagaaggaacaagtgaaagagagactttacaacaacaaacatataatgcagctgaagatgctcattataaatttacatatcaacatcggttatttaaaaagctgatgttaattggcactaacaacatcggtttttaa

SEQ ID NO: 52860 - DNA, 321 bp, Glycine max
  Peptide Sequence Number=SeqID_169638
atgcggagatacccaagtggttatccgtccaaaacgatttctattaatcctgacccgagaagtcaagtggtaggcggaaataccccaagtggttatccgtacacatacagttctgctaccttgacctgtgagaagtcagttgggttgcttaagaaggaagcaactgggcggcaagctcctccacgttgttggaaaatggttttcggggcttccgtaaatttgcgaaaaccttgcataagcatatttcacttaacattggtgaaagggaagagaaacaaagatgaaaatcaaatccgaaacacttccgtaacttttccgtaa

SEQ ID NO: 52861 - DNA, 649 bp, Glycine max
  Peptide Sequence Number=SeqID_169639
atgtcggccgccggcgcatcaggcagccaggccaggtgcccgtgcgcggcggtgggactgtcgagattaaagggagggccggatcccactgagaccggcctcggggcagcgtcttcgccgctgacgtcaggaaagagcggcagcagcccgcctgcacgggcgggcctgacaggggagtcagaaggactcgcgggaacactcagtggtcaccgcgtggccgcctgtggtggcttcagccccctgactgtaggccttaccgtcaagccagcaggcaccggactgtgcgcctgtattcagtgcggtaaaaatatgctggagatggatgtcgatggcctgagcggcgatgttcagctgatcgagtttcttactgacgtcagcgtcgctcaccggctggcccgcaaacgcgccggcacaaaacccggcaagaggaggcggtggcaacggcccgtgtatgcagcgctgagtaaggtccatgcctgtgatctccatatgcagccacgccgaggccaggccgccggcaaacatcaggatgataaaaatcagcgcaaaccggcccgttgtcaccggataaggggtattgatgaatcgccaggcgtagaccgcaggcccggcattcaggaaaaaggcaaagaacgtggttccgattatc

SEQ ID NO: 52862 - DNA, 1246 bp, Glycine max
  Peptide Sequence Number=SeqID_169640
cggcaatgaattccttggaaaaggtatggcaattccttctttccttgggacaatgacttccttgactcacctcaacctctcttatactggattctgggggaagattcctcctcagattgggaatctctcaaatttggtgtatcttgccctgagagatgttgacaacggaacagtaccctctcagatcgggaatctctctaagcttcgatatcttgacttgagcgacaattatttccttggagaaggtatggcaattccttctttcctttgtgcaatgacctccttgactcacctcgacctctcttatactcgattcatggggaagattccatctcagattggtaatctctccaatttggtgtatcttggccttggaggttattctgttgtcgaacctctgctagctgaaaatgtagaatgggtatcaagtatgtggaagcttgaatatcttcatttgagtactgtagacctatccaaagcatttcattggctacacactctccaatctcttccttctttgacccacctatatttgtcaggatgcacactccctcactataatgaaccatccttgctcaacttctcatctctgcaaactctcattctttacaatactagttattcccctgccatttcttttgtccccaagtggatattcaaattgaagaaacttgtttctcttcaattatggggtaatgaaatccaaggtccgattcctggcggtattcgaaacctcacacttcttcaaaatctttacttgtctggaaattcattctcatcttcaatacctgattgcttatatgatcttcatcgtctcaagttcctcaacctaggggacaaccacttgcatgggactatttctgatgccctgggaaatttgacttctcttgttgaacttgatttatcaggtaatcaacttgaaggaaacattccaacttctttgggtaatctctgcaacttaagggacattgatttctcaaatctcaaactcaaccaacaggaagatgatcttgcaaatcttacaagcttgacggagtttggtgcatcagggaacaatttcactttaaaagtgggtcccaattggcgtcctaattttcggctttcctatttggatgtgacatcatggcagttaagtcccaactttccatcgtggattcagtcacaaaacaaacttgaatatgttggactatctaacacggggattttcgattctattcccacacagatgtgggaaacacttcctcag

SEQ ID NO: 52863 - DNA, 198 bp, Glycine max
  Peptide Sequence Number=SeqID_169641
atgtggtggctgtggtgccgttcttcgagcttgtcggatgagggtaaggttgaacttggaggagattctggtaaatcagaaagttctttggagaaaggcttagttgatcgcagtgacgcttcagatgttgatgctaaagtagataacatggcgaggtgtttcagaaccaaccagaggatactggtgagaaaggggtaa

SEQ ID NO: 52864 - DNA, 270 bp, Glycine max
  Peptide Sequence Number=SeqID_169642
atgaagaaacatttgtttgaagggaaaggagagggagtggtggaggcggaggcgaaggaggaagggagcttggggggagagggaggaagaaggagaggagtgacgaggggaagaaggggaaacgaaggtgaaggtgaggagaagaggcagattgttgatatgcgaggtggaagagagaagttgaggtgcggcatcaagctaggaaaaatcaaatctaaccttgtattcagactacgctactttggcaataactcttggttgatcctttga

SEQ ID NO: 52865 - DNA, 141 bp, Glycine max
  Peptide Sequence Number=SeqID_169643
atgccctcctttcgcgatttggagcagaaatgggcaccaaaggttgaagctttgtttgaagcttcaatggagagtgagggagaaagaaaggcaacttcctcgcgtttctctgcgtccgtctgggccagttttcaaaagtaa

SEQ ID NO: 52866 - DNA, 207 bp, Glycine max
  Peptide Sequence Number=SeqID_169644
atgcagactccaaacttcagagtagaaacttgcccactatgtccttcacttctgcaactcctatcccaagtcgaattgcttgaattagtagcaatcattggcttgattatgatgggaagtgcgatgatgcagcgtgttggtgcggtaatttggtggctaatttttccaagagaaattgtagatgaagggaatgccatagattactaa

SEQ ID NO: 52867 - DNA, 174 bp, Glycine max
  Peptide Sequence Number=SeqID_169645
atggtccaacccagcatctcgcttagcacacaactcgcgctaagcgagccaggagacacaggcgctaagcaagagcgatccaacaaaacaaagcgcactaagcgagaggagcccgctaagcgcgcgatccaacagaagcagcacacgctgattgagggaggtcgcattgagtga

SEQ ID NO: 52868 - DNA, 720 bp, Glycine max
  Peptide Sequence Number=SeqID_169646
atggcaatgagcaacaatgtgatcggatgcataaacttcgtggcggtgatcctctcaatcccaatcatcggcgccggaatctggcttttaaacggggaagccgattcctgcgtccagttcctgcaatggcccgtcatcatcctcggagtcctcatcctcgtcgtggccctcgcaggtttcatcggagccttcttcagagtctcgtggctcctcatcgtctacctcgttgccatgctcgtcctcgtcatactcttagtgtctttggtcgcttttgtttacatggttactcttcggggacacggcaacattgagcccaaccgcgcttacttggagtaccgcatggatgacttttctggctaccttcgtcgtagggttagaagctcgttcaagtgggaccgcatcagaagctgtcttagccaaaccaacatgtgtgctgagcttaaccagggttatcgaatggctcaggacttcttcaacgcgcgtctaacgcccatgcagtcagggtgctgcaagccaccaacgcaatgtgcgtacacgtttgtgaatccaacctattggattagtcccatcaacacagcagcggatatggattgcctgcaatggagcaacgaccaaacacaactttgctacaactgtgactcgtgcaaggcagggtgttgtgcctttaggaatgccaaaacggaggacctcttccgcaaatacaaacaaggctacacttga

SEQ ID NO: 52869 - DNA, 471 bp, Glycine max
  Peptide Sequence Number=SeqID_169647
atggctactttagaatcagctctcactctcttcgcacctcaacggttctctgcaaaagcaccaatctccatcaagctccatgcttccacctcccatatcttctcttccaagtccttcttcaaaaccggaagactctgcttccagttatgctccactctgcaagaggtagcaccaacagagcaaacacttgagcctatccaaccaacagacaacgtaaagaagctctacgtagttaacttgtcttggtctctgacggcggcagacatcactgacctctttgcccaatgcggaaccgtaactgacgtcgagataataaagagcaaagatgggaggagcaagggctatgccttcgttactatggcttccggggaagaggctcaagctgctgttgataaatttgactcttattgttggtctaagttaggtgttcactgcttccactgtcttaatttttggcttctgttgtggtga

SEQ ID NO: 52870 - DNA, 369 bp, Glycine max
  Peptide Sequence Number=SeqID_169648
atgcacacacaaggtttcacaattccacaattccatagaataggcctaactcacaaaaaggtccccagcggagtcgccaactgtcgcaacgtgcccttttgcgggcgagcgaaggcgaggctcacgggtgcgctttccaaaggaggaaagatgcgcggagtcgccaccaacgtttatttgtgggaaacgtcgaaaaaactgaaggaaaccgtcgacaaaagcggggctcttgctcctacgtaccctccatcgaagaggaaatcagacctacgtagttctttcttaagggtgaatcacacgatttctttttacttgaaaggtgatcatttaaaggtgttggaccttaaaaatgatccattaacttggtaa

SEQ ID NO: 52871 - DNA, 141 bp, Glycine max
  Peptide Sequence Number=SeqID_169649
atgtcggccttcatctactcttgcacctcctctactttacctattactcttgctctagcacaggttcggatatggggttgtgatatgaaccctcatggcacaagggctgatgacttaggatcgtctaggattaaaccttga

SEQ ID NO: 52872 - DNA, 375 bp, Glycine max
  Peptide Sequence Number=SeqID_169650
atgactgatggtatagaagaaacgaatcacacaggaggtattgaagaaagtggtgatatgacaatggatgatagatggggtgagctagatgcgggattcgatgaacaagttattactctacaaaatatggacacacaagatacattgcttccatctatatcaccaatagagccattattgggtagaggacatagaatcaaacaaccttttactcacttgcaagattacgtgacaaatactgccagaagattaaatccatctaattgttcaccctctccaaaggcagactcaggtgcactctatcccataactgattatgtgaattataaccatttttctcttgcacattgtgcttttcttgaatccatttcatag

SEQ ID NO: 52873 - DNA, 312 bp, Glycine max
  Peptide Sequence Number=SeqID_169651
atgaggacgtgtggaaggagtggtacctggagatatgtcgcgggggtcaggagaccttggggacatcaggtggggtgctatttcccaaaaccaagcttgaccaatccccgacccaacccgggcatagaagctaggggagcttctggtaatcgattaccaggggatgtaatcgattaccaggcttcaaaagggaactggaagactgtggaggcctctggtaatcgattaccagtctatgtaatcgattacacaaaggaatgggtcactggtaatcgattaccagattgtgatggcggcgcaactaatccatga

SEQ ID NO: 52874 - DNA, 328 bp, Glycine max
  Peptide Sequence Number=SeqID_169652
atggatatgattaagtccctttccagtaagcctgaaaaatttacaggtgaaaattttttctgttggcaacaacaaatgaaattctggcttactgaattggatttatactctgtgatttctaaaagagaaataaaaacttcaacttcctctactgatatagttcaaactgatgcaaccattaagcatgatgtttctgataaagatattttatgtcatggacgcattttaagtgctttggctgataacatatataagattttttgtcataccaaaacttctgttgagttatgggaagcacttgaattgaaatatggatctgctgaaaaag

SEQ ID NO: 52875 - DNA, 327 bp, Glycine max
  Peptide Sequence Number=SeqID_169653
atttttgtgtttcgtttattattggtgactgatcaagatcggttcgacaaacggggcaagtcttgtgtgaacttagccacaaatcgatgcactgttggtggaaaacatggtaacaaacggttaagagcctcagcatgctgtcggagtcaaactccaacaagcaaatggcgcattctaatgaatacttattccttggggagatccttcatgcacggtggcgtagaggaacgaggtggagcttatgttcacgaaacagcacctgcagaagaagagaatgctgaaacccacgaagcagaacacgaccaccgccacggtgaagaatattag

SEQ ID NO: 52876 - DNA, 555 bp, Glycine max
  Peptide Sequence Number=SeqID_169654
atggcagacgtggaagtaagagcagcgcacaacgtgttggaagcatgtgctcagacagaaactatggataaagtggttttcacatcctcagctaccgcagttgtttggagagaagatcgcaagaccatggaactagatctagacgagagacattggagtgatgttaatttctgtcgcaaattcaagttatggcatggggtgtcaaagacaatggcagagaagagcgcgtgggccttggcaatggacagaggagtgaacatggtgtccatcaacgcaggcttaatgatggcgcatgatctctccatcaaacacccttacctaagaggagccgctgagatgtacgaggatggggttttcgtgaccgtcgatttggctttcttggtggacgctcacatctgtgtctacgaggatgtctcatcctacggtcgttatttgtgcttcaatcacatcataaacacccatgaggacgctgttcagctcgcccgcaagttgacgcctggtgcatcttcctccttgccgcaaaggttggtcagagggcgtttttggtcattttga

SEQ ID NO: 52877 - DNA, 312 bp, Glycine max
  Peptide Sequence Number=SeqID_169655
atggccgcagaggagccattggatgcttccccctcgccgaatctgttttccgaaaccctaagtgccgccgaattggtcgccgatttggccggttattacgctcagtcaccgacaggcggcggttctactcttccggaggattccgatgaggacacggcggcagacgataccggcgtgccttcctcgttccggcagctcaaccacgatgactcgtcttcgctgtggtcgtcggcgttgggttccaattcgcgcgtctcttcggtggcgccggaatcgtggattgctgcacaagggaaattggctcttacctga

SEQ ID NO: 52878 - DNA, 1430 bp, Glycine max
  Peptide Sequence Number=SeqID_169656
caaaccgcactcagaaccctaacgacggcgaccaccccgtgaacaccgattccggcgaggaaaagaagcggaagaggaacaaggaaaaaacggacaaaaccccagccccagccatcgataccgttgtttccgtaatcgaagcttcggataaatcggagaagaagaggaaacgcgattccgacgaaggaaaagaccttattgtgggtgcagaagcgagtgggaagaggaaaaggaaaaggggcgaagttgagaaagattgggaggagaagaagtatgggattgtggaggaagggcttgagaataaaaccgttgggatcaagaggaagacgttggatgatccagctgatatgatggtttcaaaggagggttttgatgatgaggataaactcttaaggactgttttcgttgggaatttgcctctcaaggtgaaaaagaagactcttttgaaggagtttaagaagtttggtgaggttgagtctgtgaggattcgttctgtcccaatacaagataccaagaaacctagaaagggagctatccttgcgaagaaaataaacgatgctgctgatagtgttcatgcatacattgttttcaaaacagagcaatcggcacaggcttctttgtcacacaacatgtccctggttgaaggaaatcacattcgtgttgatagggcatgcccaccccgcaagaaacataaaggggagagtactccactttatgatgataagagaactgtttttgtgggcaacctcccatttgatgtgaaggatgaagagctttatcaattattttgtggtatatccaacctggaatcaagtatagaagctgtcagagttgttcgagatcctcatcttaatgttggaaagggtattgcttatgtgctatttaaaaccaaggaagctgctaaatttgttgttaagaaacggaacttgaagcttcgtgaccgagagttgagactctctcatgccaaagttgatgctaccccgtctaaaaggccaaacccatcatcagctcatgctcctagtacccctgcaaaaaggccatacccattagcacatgctcctagtacccctgcaaaggagttttctgtggcttcacggtctccatcaagcagtaataacatgtcaaagtcaaacagaaaaaccaatgcatcttatcagggtctacgtgcaaccaaatctgatgtgcacaagaaaatccaaggaggagaaaaaccaaaagaacgcatgacaaaaagaccttcagtagctgccagaaaggctaaagcaaaattgggcaaggagagtgatctaccaaaacaagcagggatgaaacgcaagcttgatagtcgtactccagacagcaccctacgtaataggaaagcaatgttctcagcagacttgaaggcacatttgacagcgaatggtgaagaattaagaaaaatcagtggatag

SEQ ID NO: 52879 - DNA, 561 bp, Glycine max
  Peptide Sequence Number=SeqID_169657
atgagcaagaggctccaagaagattgggctagagctgctgaagaaggccctagggttctcatgaaccttaggactttcatgattccagggactgtgttcatgtcattgcttgctggagcactctttggagtctttaaaggtgtggctctggttgtgttcactgccacagcaggagcttcttcatgctatttcctgtctaaacttattggacgacctattctctcctctctgtggcctgaaaagttgaaattcttccaaacccaggtggctaaaagaagaaagggtttgttgaactacatgctttttctaagactgactccgaccctacccaacacatttattaattttgcttcaccaattgtggatgtgccttatcatattttcttcttggcaactgttattggactaatacctgctgcttatgtcactgtcaaggctgggttggctcttggagagttacaatctgtgggtgatctttatgatttcaactcaattgctacattgttcctcattggtgtagtttcagtcacacccacactaataagcaagaacgaatcatag

SEQ ID NO: 52880 - DNA, 144 bp, Glycine max
  Peptide Sequence Number=SeqID_169658
gatggtcatgtagcaattgctaataagtgggagaggcaactgaacctgaggatcatgaccgaaggaacagaagcgtatactattgttgaagaatgtttgagcatcgcaagaagctacattagccaatcaattgtaggtcactga

SEQ ID NO: 52881 - DNA, 580 bp, Glycine max
  Peptide Sequence Number=SeqID_169659
cagtgccattagcactgcttggggcaataagcctctaggtttacagccagatatcactcagctagccaaaatacaacttgtgcaaaatcttttgcaacttatcaacaacaattcatttgttaacattggaaataataacccttacctcttatccaatcccaacctcaaccctttatttctgaatggcataaaccccctccaaactaataaggagcctcatgtggtgttgagtggtagtgaagaatatgctaaccctggtttatactctcaagcacaaagccagtgctctcagcatgatgtttcaaaatcattggcagatttagatggtggatctattccacaagattacaacaaaattaacagcactactacttcacgtgaaaatctagcagaaaatccacctcttcctgcattagttgcattccctccaaagatgggaaccttcaaccaaatggacagtggctgtaatatagctgctcaaacgtcaacagagtcaccttccaacacaatctttgatgattgggagaagttgcttgacgatgaaacaagcggttcctattggaaagagattctagagtaa

SEQ ID NO: 52882 - DNA, 669 bp, Glycine max
  Peptide Sequence Number=SeqID_169660
atgggtggacccttgggtactagtacccacacctttagagggctgcacgtcctcaccatcagagggctgcacaccctcaccttcagaggactgcacgtcctcgctttcagaggactacacgtcctcgccttcagaggactacacgtcctcgccatcagaggactacacgtccccaccttcaaaggtttgcacgtcctcaccatcagagggctgcatgtcctcaccttcagagggctgcacgacctcaccttcagagggctacacgccttcaccttcagagggctacacgtcctcaccattagagggctgcacgccctcacctttagaggattgcacgtcctcgccaccagaggactacacgtcctcgccttcagaggactacgcgtcctcaccttcagagggctacatgccctcgccttcagagggctacacgcccttacctttagagcattacacgtcctcacctttagaggactacacgtcctcgtcatcagagggctacacgtcctcacattcagagggctacacgccatcaccttcagaggactacacatcttcacctttagagggttgcacgtccttgccttcagagggctgcacaccctctcctttagtgggctgcacgccctcgcttttagagggctggacgcccttgtcttcaaagggtga

SEQ ID NO: 52883 - DNA, 237 bp, Glycine max
  Peptide Sequence Number=SeqID_169661
atggtggcaaagaaacttggaaacaatactggccacaatgaactaaaggggaatccgctagctatggagaccttgggagtgccaaacgacaacggagcttgcggcacactatcgacgtcacgatggagggaacaaggtgacaacggaggttatgacacggcggagggaacacgaggtgaaaatgcaacagaagttcagcaacaagctttactcatgcatgatgaacaagctagctag

SEQ ID NO: 52884 - DNA, 4098 bp, Glycine max
  Peptide Sequence Number=SeqID_169662
atggttgtctcgtggatagttcattcggtggccaactccatacgtcagagcatactttggatggacaaagccgaggaaatctggcgcgatctgaaatcaagatactctcagggagatcttctacgcatatccgaccttcaacaagaagcttcgacgatgaagcaaggcttgctcacagtgactgaatatttcacacgattacgcgttatttgggacgaaatcgagaattttagacccgatcccatctgttcatgcaatataagatgttcctgcaatgcattcaccattatcgcacagcggaaactcgaggatagggccatgcagtttctgcgaggtctgaatgaacagtatgcaaatatacgatctcacgttcttctcatggatcctatacccgctatctccaagattttctcctatgtggctcaacaggaaagacaattactgggcaacgccggaccaggtattcatttcgaacccaaagatatctctataaacgctgctaagaccatctgcgacttctgtggatgtattggtcacttagaaagtacatgttataagaagcatggaatgccctctaatcacgatactagaaacaagaataatggaagaaaagcttgcactcattgcggcaagatggggcacactgtggatgtgtgttatcgaaaacacgggtacccgccgggttataagccttacggtggaagaaccactgtaaacaatgtcgtggcagttgaaagcaaagctaacgaagatcaagctcagcatcacgaggctcatgattttgttcgcttctcccccgagcagtacaaggcacttctagccttaatccaggagccatccgcaaggaacacgacaatctctcaacccaaacaggtggcttcaatctcatcatgcatcaatactccgacaaacccaggtatgtctctttctttcagaacgcctcccatctcttggatattagattcaggagctacagatcatgtgacttactctctacacaacctccattcccataaaagaatcaatccaatcacggtgaaactcccgaatggccagtgtgttcatgcaactcactcaggaactgttcaactttcatcaaacatcatcttacaagatgttctttacattccttcttttacattcaacatcatttcgatatcaaagcttgtgtcttctgttgattgcgaattgatcttctcttctacatcgtgtgtattgcaggaaatgaacaaccatatgaggattggtatagttgaagcaaaacatggtctctaccatttaatacctgctcagttgaccaccaaaaccgtaaactccaccattactcaccctcgatgtaatgtgattcctatagatctttggcattttaggctaggtcacccatcagctgaaaggatacaatgtatgaaagcttattatccccttctcagaaataataagaactttgtttgcaacacatgtcatcacgcgaaacaaaagaaattgcctttttctcttagtaattcacatgcatctcacattttttatttacttcacatggatatatggggcccgtgttctaaaccatccatgcatgggcataaatacttcttaactatagttgacgactgttcacgcttcacatgggttcatctcatgaaatccaaagctgaaacccgacaaataatcatgaatttcattacattcattgaaacacaatacgattgcaaagttaagatcatcagaagtgataatgacattgaattctccatgcatcattactatgcatcaaagggcatcatacatcagaccacgtgcgttgaaactccagaacaaaacggaattgtagaacgaaagcaccagcaccttctcaatgtcacacgtgcacttttgtttcaggcaagtctaccacctagcttctggtgttacgccttgccacacgccacacacttgattaattgcattcccacaccatatttgcataatatttcaccctatgaaaagctacataaacacccttgtgacatttctaaccttcgtgttttcgggtgtctatgctacataaatacactcaaagcaaacaggcaaaagcttgatgctagggcacatccatgcatattcatcggctttaaaatgcatacgaagggatatcttgtgtatgatttacattctaatgatgttagtgtctctcgaaatatcacgttttatgaggaccattttccttattactctgaaacccagcatatacactcagaatattcagctccctcaccggaacccttctccgacaaaatcagtgacccacaaacagaaagtcacccatcacaacccgtgatctctgtaccaccatccaatgaacctgcaaatgatcaccctccttcaaaccttagacgatccacaagaaccaaaaatgccccaacgtatctccaagattaccacagagagcttgcttcatctacaccaaatacttcaatggttgttcgttatccacttagttctgtactttcttattcacgcttgtctcctgcacataggaactttgtcatgaacatttcctccatagcagagcctacctcatatgccgaagcctctcgccatgactgctggattaaggcaatggaggccgagttacgagctcctcagtcgaacaaaacatggcgactcacacctcttccttctcacaagacggctattgggtgcagatgggtatacaaaataaagtatcgggcagatggatccatcgaaaggtataaagcgcggctggttgcaaagggatacacccaaatggaagggttagattatcttgacactttttctccggtagcaaagctcaccacggtgcgtcttcttcttgcaattgcagcactcaaccagtggtgtttacggcagctagacgttaataatgcattcctccatggagaacttgacgaggaggtgtatatgcaaatacctccaggactttctgttgacaacccaaagcttgtatgtcgcctccaaaagtccctttatggccttaaacaagccagcagacaatggttcatgaagttgtcaagcttcttaacctctcatggcttccaccagtcaaatgcggatcactctctcttcttgcggtttaccggagacatcaccaccatacttctcgtttacgtggatgacatcattctcacaggaaatagcatggcagaaatacaaacgatgatcaccctcttagactctgagtttaagatcaaagatcttggggacttaaagttctttcttgggctcgaaatcgcacgtagcttgcagggaatacacttatgccaacgcaagtatacattagacattttgagtgtctcgggaatgctgggatgcaagcccaactcaacaccaatagattattctacaaagctacaggcagattcgggaagccctctctcagctgagtcttcttccttttatcggagattgataggtaaactaatataccttaccaacacgagacccgatataacgtatgctgttcaacaacttagccagtacatggccgcccccaccaatgctcatcttcaagccgcttttcggattctccgatacctcaagagttctccgggatctggtatcttcttcgctgccacaagcaccgcacaactccgagcatttagtgactcggattgggcaggatgcaaagactcaagaaagtccactaccggttacttagtttactttggttcttctctggtttcttggcaatccaagaagcagccaactgtgtcacgaagttcctccgaagccgaataccgtgctctcgcttcgactacttgcgaactacaatggctgactttcctgcttcaagactttcatgtcccattcgttcaaccagcaacattatactgtgacaatcagtcagcaatccaaatagccactaatcccgttttccacgaacgaactaaacatattgagatagattgccatattgttcgacaaaagcttaactcaggtctcataaagctccttccggtttcgtcatctttacaactagcagatatattcaccaaagccctttcacccgctgtttttcggcatctttgtaacaagctgggaatgatgaatatccattcccagcttgaggggggctcttag

SEQ ID NO: 52885 - DNA, 519 bp, Glycine max
  Peptide Sequence Number=SeqID_169663
atgagaattccacaaatttatagtttatctgctgtaggtggtcatactgctgagatgcttaatctattggtagtgctacagaaagataggtttaatccaagattctacattgctgctgctactgataatatgagtcttcaaaaagctcagttgttggagaattccctggctgctgagaatgcaacaagggtcactgatactgcacagttcatgaagatatatcggagtagggaagttggtcaatcatatataacctccgtttggactactttagttgcaatgatactttgcaatggacctggaacttgcattcccctctgtgctattgcattcatatttaaggtactgggaatcagatggtcattaattttctacgttgagagtattgcaagagtgagaagactctccttgagtggcctgctcctgtacaagttgcggatggctgatcaactttttgttcagtggccacagctgcaacgacagtatccccgggctacctatgttggtcgactcatgtaa

SEQ ID NO: 52886 - DNA, 3255 bp, Glycine max
  Peptide Sequence Number=SeqID_169664
atggcggtggggaacttcatgcactacataagccgatttgtagcgggctttgttattgggtttgttcgagtgtggcagatcagtctagtgacactttcaattgtaccgttgattgcccttgctggaggtctttatgcatacgtcacaattggccttattgcaaaagttcgaaaagcctacgtgagggctggtgaaatcgctgaagaggtgattggcaatgttagaacggttcaagcatttgcgggagaagaaagggcagtaagatcatataaagctgcactcatgaaaacttacgtaaacggtagaaaagctggtttggcaaagggcctgggcttgggctccatgcactgtgtcctttttctatcgtggtctttgcttgtttggttcactagcattgttgttcacaagaatattgccaatggaggcgagtctttcacaaccatgctcaatgttgtcattgctggcctgtcactggggcaagcagcaccagatatctctgcattcatccgagcaaaggcagcagcttatccaatttttgagatgatagagagggagacagtgagcaaaagtagctcaaaaaccggtcgcaagttaggcaaattggagggtcacatccagtttaagaatgtctgtttcagttacccatctcgtccagatgtagcaatattcaacaacctgtgtcttgacattccttcagggaaaattatagcccttgtgggaggaagtggttctggaaagagcactgtcatatcgttgatcgaacgcttttatgaaccaatttctggtcagatactactagacaggaatgatatcagggaacttgatctcaaatggcttaggcagcaaattgggctggttaatcaagaacctgccctttttgctacaagcatcaaggagaatatactttatggaaaagatgatgccactcttgaagaactaaaacgtgctgtaaagctttcagatgctcagcctttcattaacaatcttcctgatagattagaaactcaggttggtgagagagggatacaactctcaggagggcaaaagcaaaggattgcaatatctcgtgcaatcgtgaagaatccatcaatccttttgttggacgaagcgacgagtgcactggatgctgagtctgagaagagtgtacaagaggctcttgatcgtgtcatggttgggagaacaaccgttgtagtggcacacagactctctaccattaggaatgcagatatgattgctgttgtgcagggagggaagattgtggaaactggtaaccatgaagagctcatggccaacccaactagtgtttatgcatctcttgttcaactccaggaggctgcttctctgcatcgcctcccatcaattggtcctagcatgggatgccaaccaagcataacctactccagagaattatcccgtacaacaacaagccttggtggaagttttcgatcagataaagaatctattggccgggtttgtgctgaagaaacagaaaatgcaggcaagaaaaggcatgtttcagcagcaaggctgtactctatggttggtcctgactggttttatggagttgctgggaccttatgtgcatttattgctggagcacagatgccactttttgcacttggaatttctcacgcacttgtatcatactatatggactgggagacaacatgtcacgaagttaaaaaaattgcattcctcttctgtggagcagcagttattactgtcactgtccatgccattgaacatctttcttttggaatcatgggagagcgacttacccttcgtgtgagagaaatgatgttttctgctatcttgaagaatgaaattggctggtttgatgatacaaacaacacaagttctatgctttcatcgcaattggagactgatgcaacattattacgaactatagttgttgatcgttcaacaattctgttacagaatattggtttggttattgcttcatttattattgccttcatcttgaactggagaataacacttgttgtaattgccacatatcctttggtcattagtggtcatatcagtgagaaactttttatgaaaggctatggtggaaacttgagcaaagcatatctaaaagctaacatgctggctggggaggctgtgagcaatatacgcactgttgccgcattttgttccgaagaaaaggtccttgacctttatgccaatgagcttgttgatccctccaaacgttcacttcaacgaggccaaattgctggcatattctatggcatttcccagttctttattttctcatcttatggccttgccttgtggtatggatctgttttgatggaaaaggagcttgctagctttaaatcaattatgaaggcattttttgttttgatagtaacagcactggccatgggggagacattggccctggcccctgaccttttgaaagggaatcaaatggttgcatcagtttttgaagtgatggatagaaagtcaggaatatcatgtgatgttggagaagagttgaagacagtggacggaacaattgagcttaaaagaatcaatttcagctacccttcaaggccagatgtaattattttcaaggatttcaatctaagagttcctgcaggaaagagtgttgccttagtggggcaaagtggttctggtaaaagctcagtgatctccctcatactcagattttatgatccaacatccggaagggtgttaattgatggaaaagacatcacaagacttaatctgaaatctcttaggagacacattggtcttgtgcagcaagaaccagctctttttgcaacatcaatttatgaaaatatactttatggcaaggaaggtgcgtctgattcagaagtgattgaagcagctaagcttgccaatgctcataacttcatcagcggtcttcctgagggttactccactaaagtaggtgaaagaggagtgcaactatctggtggccaaagacaaagggtagccattgcaagagctgttctaaagaaccctgaaatcttgctacttgatgaagccactagtgcacttgatgtcgagtcagagcgtattgtgcagcaagcattggacagattaatgcagaacagaacaacaattatggtggcacataggctatccactataagaaatgcagaccaaatctcagttttgcaagatggaaagataattgatcaagggactcattcaagtcttatagagaataaaaatggagcatactataaattagtcaaccttcaacaacagcatcaattatag

SEQ ID NO: 52887 - DNA, 423 bp, Glycine max
  Peptide Sequence Number=SeqID_169665
atgtcgttaatatgctttcttggatgtgttttgctccgtcaccaagtgcacttccaacgccaatgcttgttcaggttctattcctctacttcttctgcattgatgttggaagacaacgtgtttgatgaaagttcaaaatctcattacaccaattttgtgattaataggcctgcaccccatgttcccgcaacaaggagggagttgtttcctttagtgtctagggtgttcaaatcactgagttggagtgttgcaagagaagctttgctggattcaccccagcatgtggaaagatccgatgttgtgtttgatgtgctcataagagtgtttgcatccaactctatgctggaaaatgctcttgatgcgtttgtgaatgctaagcatgttgggcttgagcctgataataggacttgcaattcttgctga

SEQ ID NO: 52888 - DNA, 471 bp, Glycine max
  Peptide Sequence Number=SeqID_169666
atggcaatttctcgaactgaaggttgtaacaaaatgaaatgtggtaactgtgaacaatacttctgttaccgctgcaacaaagcaattgatgcatcagatccatatggacatttcagggatggttcatgtgaattgttcccacgagaaatggttgattcctgggaagagcgcattaatcatcgccaggcggtaggacaactacaggctgagctctttcctcaacatggcttggcgtgtcctagttgtcgtcaatataatccaaaggacagtttctctgtcatcactaacaactttctctattgccattttgaattcttcaacagattggaaataataatcacttgttttgctgggcatgccaacgccattactgctacttatgcaaagcgattgtcaggcgtggcactaagcattatggaccaaagggctgcaaacagcactctgagggatagtataagcacaatcccttag

SEQ ID NO: 52889 - DNA, 1326 bp, Glycine max
  Peptide Sequence Number=SeqID_169667
gaaccgaggtccacaacagcaccaccaccaccagacttgcaataccgtgtcgtcagcatgcccgaaccggctccttcttcttccaattctcactccgtggaggacaatgtaaacgttgaagccactggcacgccgcaaaatcgccataacaaggacggtgccggtgcctccgagatcaacaccgttgacggctccgatcgcgtggctagttcaagcaaggccgaggaaggagacggtgatgataatgatgattatattcaagccagggttgataagttgctctgtaaaatcgaggaacctgaattgtccgaggaacagatcagaatcaatgatcaatcgcagcaagatgagatacttgtggtggagtcaatttatggagaaaacgttttcagccttgagaggtggaaaggcctgcgttgttttcagatacatataaatgttgatgttttgggtgaaattgccattactgctaacctaaactctatcaatcaacttgagactctaagcagcaattcagatgagttcttgtacactttcaaagttcaatatctaccaccaattgttttgacgtgtttattacctaagtcgtacccaagcgaccaaccacctatttttacactctctgttaagtggttggaacctgtgaagattctgaatctgtgctacaagttggattcaatatgggaagaacaacagggtcaggaagtgatttacccttgggtagaatggttacatagttcttctctttctcatctgggatttgatgaggaaatcatacttgggccttatggcatgaattatgtccaggatgagcgtgttatttcaggagctgaatgcattgatgttgatattccttttttacgaagttacaacgatgagagacacaatgagaacttcctcaaagaattgcatgattgtaacatttgctttagtgaatatgcaggctctcagttcatccggttaccatgtgagcattttttttgcctcaaatgcttgcagacctttgcccagatacatgtaaaggaaggcactgttagtaatcttaaatgtcctgaagcaaaatgtgcaattatgattcctcctggccttttaaaacaattgctggatgacacagattatgagcgctgggaatccatgatgttggaaaaaacacttgcatcaatgtctgatgttgtttattgtccaagggaacgacgccatgttggcatagcatgcatgagtctagatatgaagcttcagattttgcagcccaagagatcaaagagaattgagaaaactaatagagtgagattgattgaaaatgaggatgatgcaaaaaatgtgtga

SEQ ID NO: 52890 - DNA, 186 bp, Glycine max
  Peptide Sequence Number=SeqID_169668
atgacggcctcgagacgatccacacaggcgatggaaagttcggtgtccgccattgaagagtggcagttaatatccatatttaggtacgtaaaatctcaaatttcatggttgtcgttaaacatgctcatctacaaccctgcggtgtttgttatagtgaggatgaatctggtaatcatctacacctaa

SEQ ID NO: 52891 - DNA, 1599 bp, Glycine max
  Peptide Sequence Number=SeqID_169669
atggaaggcggcgggtccactccggcggcgccgattccgaacgcgaacgcgccgccgccgtttctgagcaagacctacgacatggtggaggacccttccaccgacgcgatcgtgtcgtggagcgcaacgaacaacagcttcatcgtgtgggacccacccgagttcgccagagaccttttgcccaaatacttcaaacacaacaacttctccagcttcgttagacagttaaacacttacgtgtttgattttgatgatgttgttatgtgttggcagcttgtgaattttgagtttcgatatattgtcatcatcctacgttgtgtctcagtaactaggaagactgataaagatgagataaggattaggggtttcaggaaggttgatccagatcgctgggaatttgcaaatgagggttttttgaggggtcaaaagcacttgcttaggagtataacaagacgaaaacctgcccatggccaaaaccatcaacagcctcagcaaccacatggacagagttcatcggtaggggcatgtgtagaagttgggaagtttgggcttgaggaagaggttgagaggcttaaaagagataagaatgtgctcatgcaagagcttgtgaggttgaggcagcagcaacagaccactgataaccagatgcaaacaatggttcagcgccttcagggaatggagcaacgacagcagcaaatgatgtcattccttgcaaaagctgtccagagccctggcttctttgctcagtttgtacaacagcaaaatgacagcaataggcgcataactgaagtcaacaaaaagcgtcggcttaaacaggaaggtatggctgaaacagagcatgctgctgctccagatggacaaattattaaatatcaacctatgatgaatgaagcagcaaaagaaatgcttaggcaggtcatgaaatgggatacttctcgtgtagaatctttaaataaaaattctgataactacatgattggtgatgcttcatcatcttccagtggaatggacagtagcagctcttcaggctggacttctggagtaactcttaaagaggtctctccagcttcggtgcagtcttcacatattcaagctgcaactgggactcaagggcatgtcccctcaatcgttaaacctgaaattttatcagtatcacaagcagtagcttctgaaaaagttatgaatgatggagcacatgatccaccttctatccctgtttctcgagcagatgtaatgatccctgatcttccttcaataacagagatggttgcaggaaatattcttgatattcctgaagaaaattatatggcaactgagacagatgagggatatatggatccttcattgggggctggggggtcatttcccattgattttgaaggtatttcacccgatgcagacattgatgatttgttagccaatcctatttgggatgaaattttgcaaacttcagttccagaggatattgataccaatgtggccgaagtatccaaagggaatgaggtccagccaacggaaaatggatggaacaatactcgacatatggatcaccttactgagcagatgggtcttctttcttccaatgcaaaaagaccatga

SEQ ID NO: 52892 - DNA, 335 bp, Glycine max
  Peptide Sequence Number=SeqID_169670
atgcagcaacagagtgtaattcttactgaactcagcaaacagatcagtcagaagggagtgtcgccagagggcgaaacttctgttggtgactcaactcagaacgagtctcgcctcgccggaaagaaggtcaaacttccggtgtttgaaggggaagatcctgtagcgtggattacgcgcgcagagatctatttcgacgtgcagaatactcctgatgaaatgcgggtgaagctgtctcgtctgagtatggagggctcaacaatccattggtttaacttgttacgggaaacagaggatgatctttcgtgggaaattctgaagagagctttgattgcgag

SEQ ID NO: 52893 - DNA, 294 bp, Glycine max
  Peptide Sequence Number=SeqID_169671
atgaatagttcatcgccggctcactcttcgctatcgacgacggcggttgtaggcggtggtggtggtggcggcggcagcagcaacgccactgtttccattgacgatttccatctcccttgtgatcccatctcatcgcaagaacggaaagacgaggccatgatagttttaaaatcagatctcatggctgcactcgacaaggaagttaaatccttggttgaagataactggaagtttgaagggcctcgttcgcggatccacctagtatcacatcgaggtgttgatccttgcatttag

SEQ ID NO: 52894 - DNA, 579 bp, Glycine max
  Peptide Sequence Number=SeqID_169672
atggtgctgtgggagataacgctcggaactgcgtatttcttgggtctgaagcgaacttacaggctcgctctcaggattcaacacaggaccgttagccctaagtaccctaagctccgccaatttcttcacagacggacccgtgctgtgtttgatgtagctatcaaagtgcatcggaacattcaagatagagacatagaagtgggacggaatttcgggaactttatattgcgatggctggatcgaatgaagccatcggctcagattcgcggtcctccgccttcgaatggtgttacatcaagagaaagtgttggaaagcgtttatcagcaggtagcagttccaaccagaagccttctggaacgttgaggagggactctgataggcatttgtctacctcatcaaggacaatgccttttcctacagttgcgaggatgatgcgatcgccctatcctgcagggactactgtccatggcaggcacttcagggcctctacgcctcaaattgttggatcaaattgcagagtaaattggtcagagggtgttattaggaaggatattatgcagtggatgatgcataactaa

SEQ ID NO: 52895 - DNA, 513 bp, Glycine max
  Peptide Sequence Number=SeqID_169673
atgcataggcaatccctgggttctccctctcccaagctccccatgctagagacgctcgtcaccgacgaagacgatgctcccaaacctcaccgtctcagcctctccccgccgcctccaccgccgcacaagttcgtccacctcattcctgtcctcactctcctctgcttcttcgtcctctacctcttctcccacactccctctccatcagacttgaatcatttcaccggattcaaccgctcgccatcacaccgtctagatttggcggagaagatcggcggcgacattggacaatacatggatgtaaaaagaagcgatgttttggcgatccgaaatggtgcgccgggtgggtgttgtaatgttggatacagctggagttggggaccgttactgcaccctcgggttgcgattaagtgccagctggaaatagcagtgttttttatgtcaggctttcttgctgcgtttggtgtgggaagattgatgaaacggcgtcgtggcaggaataatggtgaatga

SEQ ID NO: 52896 - DNA, 141 bp, Glycine max
  Peptide Sequence Number=SeqID_169674
atgggaaggtttaaaatgaggagtgcatcaggtaaaaaaagcctatacataagattgggatgtcgcggggattggccaaacatcaaaccccctggttgggatccatcaagtgaagataacacaactcttggtacacagtaa

SEQ ID NO: 52897 - DNA, 552 bp, Glycine max
  Peptide Sequence Number=SeqID_169675
atgaccaggcaacagttgtccttgaaaatgggccgagcacttggtcaatgtagggaagggtacactgcatcttctgaactgttgcctcttctagcagcgggaagattgcctttgttgaaggtggacaagattacgcaaacaattgatactagtagctccactattataaactccacaacattgtctagcccttttgcatctttgtctttcagtgcatcttcctcatttgaagttcaatcccctacaagaatacaggttgcatttaaagaaggttcaatccaagctccagatataaagtctaatgtcgaactaccagaaaatgtagacatttttggccaaaagcttaacctacagcctctgcaacaatcccttggtccactgcagggtctggtggaaaacatatcacgtgtcatttctggtcagccgcctcttaagattcccatccctggcgagaagacaagctcttggcttcttactacatatcttgataaggacttgcgaatatcaaggggggatggtggtctttttgttcttgccagagaaggaaagtaa

SEQ ID NO: 52898 - DNA, 210 bp, Glycine max
  Peptide Sequence Number=SeqID_169676
atggacgtcgtcgacagaccagccaatcaaaaaaccccaggcatgtcccacgtaccagacacacaccatcatcgtctgcacccgatcatgcccccatcgtattcattcaccattattcctgccacgacgccgtttcatcaatcttcccacaccaaacgcagcaagaaagcctccacggccacgcacacacacgctttcatttcaaattga

SEQ ID NO: 52899 - DNA, 504 bp, Glycine max
  Peptide Sequence Number=SeqID_169677
atgagaggagcttgggcttgtgtgaatagaaacgaagtgcaaatggaaacaagtctcaaaccccgcaactaccattggaagcaaagcgtaaaggaaatggctatgccaaggcagtcaagcaaatgtgtggcttgtacctttgtgattactcgtcagttcgggtcgttgggtagcgagaaattgcagcatctaagggtaacgcctccattatcagtcctttttcaggcgtggtttttacctaaccctacaattcgccgatccttccagttagggtttttcgctctcagcgaaaacggtgtatatagaaaccctatctattcctccgatgcaccaggggaattgaatatatataataagaaaaaggcaaaaaaaagaggtgaaaaaaatttgtctggtaaattgttaattctgttgttttgcgtgtttctggactcaggagctgcgctgttcccggggaaaagcatgtacagtatgaacactaaatgcagtgctgggtatgcataa

SEQ ID NO: 52900 - DNA, 681 bp, Glycine max
  Peptide Sequence Number=SeqID_169678
atgaagattttgatttttggaatcggaaatttcagaagatatcagcaggaggatgcccatgaattcatgcagtgtgccttagataaactggaaagatgtttcctagatttgaagaagagtaatttaaattttgaagatgataatcttgtagagaaagtttttggaggtcgtttcattagcaaacttcaatgttctacttgtggccacacttccaacacttttgagccactcattgatatgagtttagagatagataatgtagattctcttccaagtgctctggaatcttttactaaggtggaaaacattgatgaaaactttagatgtgataactgcaaggaagaagtgtccatggagaagcagcttatgttggatcagacaccatcagttgcagcattgcatttaaagagatttaagaccaatgggatccttgttgaaaagattgataagcatattgatttcccattggagttagacttgcagccttacaccattaaagttatggaagacctagtggctgaaaatgatgtaccgttgaaatatgatttatatgccattgttgtgcatactggactttcatctacctcagggcattacttctgctttgttcgctctgctccagacacatggcataagttggatgattcaatggtatcattgtttccccctgggtgtgcttaa

SEQ ID NO: 52901 - DNA, 310 bp, Glycine max
  Peptide Sequence Number=SeqID_169679
ttctatttctcgatggaggcaagggatataactcagcggtagagtgtcaccttgacgtggtggaagttatcagttcgagcctgattatccctaaacccaatcgaactccagtcgaatatgaagcgcctggatacaagttatgccttggaatggaagagaattccgaatcagctttgtctacgaacaaggaagctataagtaatgcaactaggaatctcatggagagttcgatcctggctcaggatgaacgctggcggcatgccttacacatgcaagtcggacgggaagtggtgtttccagtggcggacgg

SEQ ID NO: 52902 - DNA, 454 bp, Glycine max
  Peptide Sequence Number=SeqID_169680
atggagttcttctcaaatgagaattttgaatgctttcaagcatttgaaaactccaatcttattccattcatgtctctgaaattacctgtttattctgaactagtcaaagctttctattctaatttagaaatccatgaaggtaccctaatgtctgaggtttatgggattaagatggtcattgaccaatccctattttatgatttaacaaaattgcctagtgaaggtgtgccttttgcactgattgatgattggaaatttgatttttctgtgcatgatgcccaccggttggtttgcaccaaccaagaggatatgaccgaaaggcttcttgccggttcattggcttttgaaagccgcatcctccattatcttattgttcgcattttgcttcctagatcttcaaaccttgcccaggtttttgaagaagatctcattgtcatgtgggcctttcataaag

SEQ ID NO: 52903 - DNA, 682 bp, Glycine max
  Peptide Sequence Number=SeqID_169681
atgttagaaggtcccattccagatggatttgggaaagtaatgaactctcttgaagttctttacctctccggtaacaaactgcaaggcgagattccatctttctttggtaacatgtacgcattgcagagtttagacctctcaaagaacaagttgaatggggaaatttctagcttattccaaaattcttcatggtgcaacagagacatatttaagaggttggatttatcttataaccggttgactggcatgttacctaaaagcattggattgctatcagagttggaggatcttaacttggctgggaattctttggagggtgacgtcactgaatcccatctttctaatttttccaaattacaatccttgtacttatcagagaactcgttgtctctgaaattggtcccgagttgggttcctccattccaattaagttcattgggactcagatcttgcaagtcgggccccacctttcctagttggctcaagactcaaagttctttgtatgagcttgatatttctgataacgggattaatgactctgtaccagactggttttggaataacttgcaatatatgagatatttaaatatgtctttcaattacctcattggtgcaattcctgatatatcattgaagcttcctatgagaccatctataattctgaattcaaatcagtttgagg

SEQ ID NO: 52904 - DNA, 243 bp, Glycine max
  Peptide Sequence Number=SeqID_169682
atggctttcggtaatgggaaatattctttccatgtgtttggttgtaacagggaagcttggttgcatgggaagacaaagactgattctgttggaaacgtgcctttttctcttgagaaggaaatggatccaaagtgcctaagctatgagagaatatcagatggaagttcatcctcaaatctttcaggatcaagcccgaagaagcctaatttggatttggaattcagcttgggccagccactttaa

SEQ ID NO: 52905 - DNA, 324 bp, Glycine max
  Peptide Sequence Number=SeqID_169683
atgacagagcattgggaaatgaactttagcattgggaaatgtactgtttccttagaacttgatagagcagggctagataactgcattgctagggatagggtgcaaggaagatcttctgtaggtgttttgattcccatagacttggaaattaacgctacttccaggaaaagaaatgcagaaagaaacagaaactttttgcaggacattgaggcagcaggaactcaagaagaacctctatcttctgaggcatcttctagttttccaacacaagggcaatctcgcacagttttagctgaagcaaatatcatggctgaggagccatga

SEQ ID NO: 52906 - DNA, 728 bp, Glycine max
  Peptide Sequence Number=SeqID_169684
aatattctgagcctcgctttgattattattgtcaagaagatcacaattttcttgaaataaatgatactgaagatgctactcatggctttggacagttgctctctggatcaaatcaggtaatttttgattcgaatggctctaaagatgttgatgtccaaaagctgtttagtaacaggggacataatgataatactcttggctgtggacaatttccctctgggtcaaatcaggaaagtgttgatttgaatagctcaaaagatgttgatgctcaaaagctgtttaggaacagaaccaccttggatgatagtgccatgcttgacatgggaaattcatatattgagaatagtagtcttgataataacaaccgtcaggaaggtggtgattttagagagaatgctggtttccattctttaactccgcctaactcgcctcctgatgatgcttcagataagttccacaactcacgtggtaatttgaagagggagaatcttcggagctgtaaaagatcatcaaacaagttaactggggtttctgaagaaagacgagaagctgtgaaatatctttgcaagaatcgttcaaggagggggttacttttgaaatttgttacttcgaacaaagttctggacaagaagagaaaaaagatggattcttcgcagtgtaagaaaagcaccaaaaaatcaaaccatacatctgtcagcccccctgtggcagctgggagttcacagtga

SEQ ID NO: 52907 - DNA, 431 bp, Glycine max
  Peptide Sequence Number=SeqID_169685
atggacaggtcacctgccaatgatcttcctgatcttgacttttcaagcccaggaaacactaacaaacatgttgtggttgtgatggatgggatgacagagttcaccactgatactcttcagtgggcacttgataatgtcgttactgctggctgcatactcactcttcttggagtcatgccatggcttaacattccactgtttttgaagacaagaaatgatttttggacggaggaattggaagatgcaccaccagtgaaggagaaaaatgggtgtggaaatgatgccaagtatctgaagcgtcaagctgttatagatctttgcagaaaatacggggttgtaccacagaagaaaattgtaatgggttatcctcaacgactgttggttgtggagcaagttgccaccctttgtccaacatgggtggtctttgacgg

SEQ ID NO: 52908 - DNA, 639 bp, Glycine max
  Peptide Sequence Number=SeqID_169686
atggcaactaattctaaggtaattctcagtaacgttctctttgtgttgttgtgtttaggcatttgctctgctgctagaacactcttcactctggaggaccatgtttccggcggttatggcggtggtggagtagaacatggtggagctggatatggagaaggagctggcggtggtgaaggtgctggtgctggatatggggcagcgggtggaggaagcggtggtgctggtgctgagggtggtggatatggaggaggagcttgtaaagggggtggcgaagggtatggcgggggtggtgcaaaggggggtggttatggtggtggacgtggaagtggaggaggaggaggtggtggtgcagggggtgcaggtgctggttatggaggtggggaaggaagtggggctggtggtggatatggtggagggaatggaggaggaggtggcggtggaagtggtggtgggtcacatggaggtggatatgggggtggtgaaggtgctggacaaggagcgggtggaggatatggtggtggtggctctggtggcggcggtggaggcggatctggcgggggtgcacgtgggggtggatatggagctggtggtttgagtggtgaaggtggtggtcacggtggtggatactacccttga

SEQ ID NO: 52909 - DNA, 417 bp, Glycine max
  Peptide Sequence Number=SeqID_169687
atggagtcccagacctccacccaagagcaggagtttctcaatctcagggaagtcccatcagcagcagacataactttgggcttggacatggccaagggcagcgcgttttgcaagatgggtgaaggttggacatgtatcataactaaaactgaggggcctgatgctggcaaagttttcgttaaatgtggtgaaaattgcacatgtactattgagggcgaagcagtgtccccagaattaaatttgtcacctgatgttgtgagtagcagtggcagtggagcattgtgtaagtgtggtgaagggtggacttgtgtcattttcaggactgagggccctgatgcagggtctggcaagggctttgctgaatgctctggacagtgctcttgtactattgatgacaaatccaccaaagatatataa

SEQ ID NO: 52910 - DNA, 525 bp, Glycine max
  Peptide Sequence Number=SeqID_169688
atggaggattgggggattttctctaccgaatccttaaggaggattctgaggattctgcttcgattaaagtgttcctcttggtgtgggtcttcaatggcaagcaacggtggctcgtggcggccactggtggtcgtgggtgatgtcgccactcaaaaacgccaagatttccagcctgttatagttaaaaagcctacgcctttcccttacaagagcgataagacggtgccatggaagtacgccgcacaagggctcgatggaaagaaagatgcgttcatcgtacatgttaaagatgatttgtccttcgctaaggtcacaaacatatccgcacccgaactactagtgcggttcaaagacctaaaagggaaggtgtcgcaacctacccttcggcgggggtgcaaaaaggccaaaatagatgggcctaggagcatcttccgaaaaggaaaatgcatggagtcgccaccaacgtttattcgaggaaaacgtcagaaaaaccaaaaagaaaggtcgaaggtctacatattttga

SEQ ID NO: 52911 - DNA, 162 bp, Glycine max
  Peptide Sequence Number=SeqID_169689
atggaggagaaggtaaagctgaaaattaatggaggtttaaggagcacctacttgaagctcttgtgctctgattaccacttgatggaagcttgcttaagaagcttctatggagttgaagcagaagataaaggagaaaaggtgagaggaggccccatccactag

SEQ ID NO: 52912 - DNA, 1918 bp, Glycine max
  Peptide Sequence Number=SeqID_169690
atggcgatgacgccgacggtgacgccggcggcggacgccaacgtcttcggtcgcgcgcgcatccatgacaacgccttcatgcccggttcccccccaggatttccccattgctgcggcgccgggcgcgaagcccgatcgtgcccgcggtcaggcccgccagcacccgacgatgtgatcgtcgaccatgccggcggactgcatcagcgcgtacatggtggtcgggccgacgaagcggaatcctcgccgacgcaactccttgctcagggccgtcgactctgcggtgacggccgggacgtcggcgaaggatgccgggcgaggccgagccccctggggcgcgaacgaccacatcaacgcgtcgagctcaccgtcggccatcgcccgcacgaggcgcgcgttgccgatggtggcctcgatcttcgcgcggttgcggacgatgccggtgtcggccagcagacgctcgacgtcctcctcaccgaactcggcgacgcgctcgggctcgaaccccgcgaagacctcgcgaaagcgcggccgcttgcggaggatggtgatccacgacagcccggcctggaaaccctccagcgccatcttctcgaacagtgcacggtcgccgtgcagcgcggtgccccattcctcgtcgtggtagcgccggtactcgacgtcgtcgcccacccacgcgcagcggtcgcgggcgtcggggcccgtgagaacagaagtcatggcaccaccgtatccatcacctccgacgctgcggaccacgcgccggcgacgaggtcagtccacgaaggtcgccgcgtcgatgacgaagcggtaccgcacgtcggaggcgagcacacgctcgtaggcggcgttgatgtcggacgccgggatgacctcgatccgggcgctgatgccgtgctcggcgcagaagtcgagcatctcctgggtctccccgatgccgccgatgttcgagccggcgatcgaacgccgtccggcgatcagcgaaccagcgttcagggcgagggcctcggcgggagccccgacgcagacgatggtgccgtcgacgtcgagcagcccgaggtaggagcgcaggtcgatcacggcgctcacggtgttgaggatcacgtcgaacgacccccgcagctcacggaacgtcgctcgatcgctcgtcgcgaagtagcggtccgcccccaggcggagtccgtcgtcctgcttcgacagcgtctgcgagagcaccgtcacctcggcaccaagcgcgtgcgcgatctgcacacccatgtgtccgaggccaccgagcccgaccacggcgacgcgggtgccggggccgaccttccagtgccgcagcggcgagtacgtggtgatgcccgcgcacagcagcggagccgcggcgtcgagcgggagggcgtcggggatgcgcagcacgaagtcctcggtgacgacgacctgctcggagtacccgccctgcgtgatggtgccgtcccggtcgaccgcgccatacgtgccgatggcgccctgcgtgcagaactgctcgtcgccgcggcggcagtactcgcactcccggcaggagttcaccaggcacccgacgcccacccggtcgccgaccgcatgccgggtgaccccgacgccgacggccgcgaccgtaccggtgatctcgtgaccgggggcgagcgggtactgctgcggtccccagtcgccgcggacggtgtggatgtcggagtggcagatgccggcgaaggcgatgtcgatcagcacgtcgtgcggccccagctcgcggcgttcgatcacggtcttctcgagcggtgcggcctcggcgggcgccgcgtaggcggtgacggtggacatcgtgctccttctgctgggtacccgccgacactacccgcggtcagcgcttctgcttcttcagcgccttctcctggatcggggccgcgccggtcgctgcgag

SEQ ID NO: 52913 - DNA, 390 bp, Glycine max
  Peptide Sequence Number=SeqID_169691
atggccaaatttggaacgtcttcatttgtaggcatgttggctacaattgaggatgaggatggtgtggatgtaggtaccaaggatggtccatgtgtgtcaatcggggatgagaatggtgtggatataagtactgggaacggtccacatgcatcaagatgtgatggagatggtctaacttcagtcggaggtggagatggtgcgggtgcaacatcggaagatctgactcgcatagatacaatagacaaggatggggtagatgatgtaagactatctctaggtagtaatagtctaaccatatatcgttttttctttccacttgtccctttttcactggagtcatgtgacaagggtcggggaggatcagcaccacctgatgacatttatatatag

SEQ ID NO: 52914 - DNA, 240 bp, Glycine max
  Peptide Sequence Number=SeqID_169692
atgtcgtttaaagagtcgacaccgctttgcacaagaatcggttctttgtatggatggacagaagggctcagccagacccggttcaattcgttttttgcgggaataccaggtctctcgggtgtctacggcggatccgatcagtctcgtgaagaagtcttttccgatcttccactaagaaaggcgacgcgaatctatggtttctatgtttcaatcgggtaccaattgcttggatgcgtttga

SEQ ID NO: 52915 - DNA, 405 bp, Glycine max
  Peptide Sequence Number=SeqID_169693
atgcgacaagcagaccaaacgcctccctgggcctcccggctaagaccagatcgaggaaatctactctaccggacaatcaaaggcttaaaccctggtcgaagcgaagcgcatgcgatgagggaagagagagaccaccaatgcaagtggatcgacttaagcatcgatttcgaaggcgacaacatgaagcatgaaaatagagccagccactttttatcgttaataatgttacaagcaacaacgataaaatacgctcttggatgcatgcccctatctcccacccatcgtcctgatcttggcttgaagtatccaagtagcgctaaaacgaaaaagcgaactattggaattcttgtcttgggcttagccctcttttacaccaactcaataacaagcgccgaacaaggatga

SEQ ID NO: 52916 - DNA, 2448 bp, Glycine max
  Peptide Sequence Number=SeqID_169694
atggcacagaaggatgaaactgagggccgttgtccagcctgtcgttccccttatgacaaagaacgtattgtagcaatggcagcaaactgtcaaagattggttgctgaaatgaattcacagcataaaaagaaaatgcagaaactgaatttgaagcctaagtcagtggatggaaggaaacatcttagtgatgttagagtcattcaacgcaacctagtgtacataattgggctgcctctaaaccttgcagatgaagaaccttgcagcaataaagattgtttatatctacatgaccatggttctcacgaggatagctttaccaaagatgaactagttttagcatttgccaggagtagagtccaacaaatcattggtgctacaaataatttgcatcggcgttcagggaatgttttacctccaccagtagatgatcctaaacatatgtcatcagccaccaaattagtgtccaaaagtcctttagataaatgtgagaaccagattaaaggatttgcttcaggtattggggctgccaattcaactgtgcttcctgcgatgtcctcttgggttaggtgtgtatccggcaatcttccacaggatacaatttcatcgtgttctggtaatctggcaaatagaaaggttgaggcatctaatgatccgcaagcccttgtatcaggagttgcttgcactgaaaggtctattagtacaagatcaggggaagctgaaaatagctctgacgtttgttccaatggtgccttcgtaccttcagagacgaacaaccataatatcggtggaaattctaaaacatgtgagtcaaatgatttcaacgaagttactttggagaaatttcctggcattgtattgtctaactgtgaaacatttctagcagcttttatgggcaatgatcaagatactgcagcaccttctgtgaacacaggcttcctggagctctccagacaacatgatttcaatattgacactgcagttggcattaattcaaatggggatgtgcatggcttatgtttagggttatcatctattagcattaatgatcatctagaagattcatacttcactcctgattcagacagattaccttttactcttaactcaatcaattcctctctagggcagcatttgcagcaagataatgagtattcaacagaacagtcatccacaccagcattttgggaagatatcattgtggatgacatactaaacatagactctgaacaacaaaaattcagcaaagacatcaattgtttgtcatcatctgggctccattctacttgtctacctcagaatgtaaaccaatcaagccatcaaccatttaagcaagatcaaatttgtagccagaatcatttcagaaaaccttctactgagtcttttaatgaactcttggagacaggacatgttaagcatgtggagagtaaagataatggtacaggtgttgataatatggttgcttcagacatgggagagaacaatattatatctgatattttgtctttggaattagatgcatgggaaggttcattagttaatttgttgggtgagagggatgaactgtacagaccctttaaagcagctactttgcggaaagtccaagacaaaaatcagtcaaggttttcctttgcaagacaggatgatttcatgaatgaggcatctaatttgcagcaaccatttgcggttactgggcatggtcctgaagggaacttttcatcaggtggtttaataggaaacaaagatacagtcactggaaaatacccacatgtcttcccatctggcaattctgtatcatcagataaatttgttggaagtcagtcttttgtgccatctaatttttccatgtcaaaagctcactcatcagggccgccaggattttcattgtccagcagaatacctccagggttttcgtgtgggagagtagaacaggatagtaatacttctgtgaaacatttgcagcagcagtatgtttcttcaactggaaatattggcagcatgggagatgaatttaacaatcttgcagtattgaactttggtaagggcatgttggctgaaaggctgaataatgcttcttttgacatgaggcaaacttcgcttccacagtttattcctggtgaagatgatcctagacttaagctgttaatgcaacaatccacacctacccagaatttaagatttccagatcatgttggaaataggtttctcccccaaaatgattcttatagaatttcctcaaggtttcttgatcaatttccgcctaacagtccatcaatttacgaacaattacattctcaacagttcagtagtaatactcttccatcaaataaccagtggggtggttggaatgatgccaagaatttcagtgacctgtccatatcagaagtattgaataatgagagagtgggatttagtaatttcatgcctaattatgagaatatcaagttttaa

SEQ ID NO: 52917 - DNA, 675 bp, Glycine max
  Peptide Sequence Number=SeqID_169695
atgttggctagcggtaagatcgttcgggcgaatccccgtgctggaaagaaagcgagaatagaaatgactgtgccattctttcacatcactcttttcagtcttagatgcaccaaaaaggctctcgaaggccggcagcaaaagaagagttatagcgggcgaagtaggaacccaccccatatgggccatcttcaaaggggcgtagcgcttgcttactcgaaagaggggaggaataagtcagagacattagtagagttcgttctgtgtgggacggaatcctgcctttcctggcgtaacaactgctccgtactcctaaggatctctatgccacttgtgattcccagccctaagggctctcttggaaagctaccgcctaggaatgcactttctccagaacctgaaaggtgccccacaataaagactattagccacaagtgggagtcttctatcagtttagtacttaccgttctcgctttcttcaacagtaagagaaggacttacaccatccggggacgggaagcctctgaaccttccgtcccactatgttcaactaagccacttcgtccctttctaacagctgattcaatagctgcggattccttcgcctattattccacccaaaaagagaactgcggattctcgatggttgaacagaagagagacagggcaagcaattga

SEQ ID NO: 52918 - DNA, 864 bp, Glycine max
  Peptide Sequence Number=SeqID_169696
atggagaataagatgtcagctgggggattcaagctctataccttacctctcccaaagaaaagccggttaagtggtataatagtccgacactacgttcctcgatcttctacagcaaggggcgccgccctcccccttaccactcttttccaccctctttccactgcacaccaagccaatctcgaaaagaaaaattccgaattcccttcctctgctctggcgagtgactcttccggaaattccatggatgggattcatcaaagggatttaggacatcccactgccacccgcattctgggattgctgaaaggagtcaaaggggttggacaaagcaaagctggcaacgcaaagcatgaggggcgtactcacacgtcttttgtggcaatctgcaggcaggagggcaaagggttacaggggagagtcaagtcaaagcagcggttctctttctgcccctacgggatgcagcttctcttgttgaggcgagtccggttgcttcggacggtgccagtagggcaagccaagcaggcttttcagctagctcttttacttgcggttgtgttgaagtcaatgggtaacggacaagggttttcctttagaagcggtggatttcatcccccatctctaattcggtttcctcttgctggtgcggtggaaggcgagatgaggttatggctattcgaggcgattcttatggatcgctccttccttagctggtttcggttgtatgatggaagtggagatctcgagagcagcatattagtaatttcgaaattgccagcagagacactgctcacgatgagagacagagagcctaagggacataggcggaaagactacgggaaggcttgtttgccggccggcgattaa

SEQ ID NO: 52919 - DNA, 1425 bp, Glycine max
  Peptide Sequence Number=SeqID_169697
atggaagagattggtgggataccattgggtggaactcactcgaagcaggaaatcttagaaaataagcgagacctcatccgaggaaataaagggtataggatttcatcctgccctgggttcgctttgaagaccgcacaaaccctcgctgagggagacataggaaggaacttcgaggagatagagcacagcgctcagaaagaggctaagctagggttgctactggttttgaggtcatcgatgaacccagttcccgctctaccttttcggcttagtcactctctcgtcgttccgattaaaggattgaacaagaagaccctagttcttaaggcgaagtatcacatgaaagagaaaagtcaacatgagactcgaaagacgctcggcgataaagaaaagaaaatgactctttcttcggtggacatggcggaggctcatgcacttacacttaggaaagcaactccggatgtcccaccacagctggtcggtataaagggtgaacagattagccaatgcttcggccgattggcttatcgtgatctagcggactcctcccaggcatctcctgcctatctcactttcctaagactagctaacagctcactgaactgtcctcccgtgtggactggcaacctcttggatatctcgcttcttggccgctctttacactgtctcaccatttggtggtgtgcggagaagatatatccggggaagcgctttgataagtatgctatccttggtgtgactatatcacttcctaagtctttagtctcagatgtgggtggcgctgagtttgctaagaagtttaggcttctttgtaaacttaaccacactaagtcgtctacagtcttacggctgaaggcgatttggttaaaggctaagctacctttcgagttgtggcttggccagtgctgtcctgtcgacccttatttaaaaggtcgattgatctggaagcttcaacaagctttcagacctaaggatcttgtggtgcctccaacgagtacttataagtctgagacttttgagtacttagaggatatgacacttctaagatcttggactgaagcctggctcaagtacgtcaggtggtattacgctactgctttatccccagatgtttccatcgaggattttatccaagctcctgttgttactactcgctctttccagcgaggagtgagaacctctttgatgctgaggttgcggctcatcgagaactgttgcggggagaccatagctgaggctgggcttgatcctaaacctctaactatcctaggttctaggttaggtggaagtgaaaagactaagggagatgcagattacagcattgctgattcagaggagattactgatattgtggggacaaatttaattttcatgacaggccctgttattgatctccttctggtcatgcagcatagggttccatga

SEQ ID NO: 52920 - DNA, 477 bp, Glycine max
  Peptide Sequence Number=SeqID_169698
atgcctcccagctggggggcggatcgaatcggagtttccttaggtagccaccgacctacagttatccttaaacttccgtgcttggtggagaagaagcgaacaaaggtacgctcgcttgctgtcttgttctctgccgcgaactgggatcgctcgccagctagggggcaatacataccaaaaggtgctttagtgatctttgatggtctgaacaaggaactctgtgtggggatccatcttgttgttattcgcattgttcaccttggtcggaaatcagggtggttgttctgcgctttctattttaagcaagcagcttcatccttgatgatggcctatggtggtgatgaattcgttcatcctgacaatgcggtaccagtttctctcactcggtccggttaccctcggatcattccgtctcatcataggcgtatgattctgaagaaggatgagaaagcggacatgctggtgaagttttattaa

SEQ ID NO: 52921 - DNA, 267 bp, Glycine max
  Peptide Sequence Number=SeqID_169699
atggctctgtatctacctctgtctgctggtgcttattttgataagctgcaggatcaatggcttaaactactgcttcttcaacgcttctcctgcgacttgttctcctttcgtccttgctcctgcacgcacctaaaggaaggactgctagtcatcaccgagggtatgaccaaggaactgctgctgagagcgatagactttccaactgagatggagagaatgcgctcctactctctttcaatcgccgatgctaaaacaaagagggcgtag

SEQ ID NO: 52922 - DNA, 423 bp, Glycine max
  Peptide Sequence Number=SeqID_169700
atgaaaacatcgttaaacaaaataaatatacttttcctcaatgctctaacctttaattatggatcaagttttccagccaacaggagtgtgtttttcccagaacttgtagggcctaaaagcaatgtcattctggagaaaagcaaatggaagaacaagttatatccattggttccaaaggaattcctttcaccactcctacaaaaatgctcggcctccctccaccaacgccaacaagctccgccccttaatctcgttctcatcgtcaccaatgccgacaagttctgcggtgagatgctcagcctccatctaccactaccgactctgatctttatcattgtcgatgcccgcaagattgccagcgagtccccctcaacctcctccaagggaacctctccttttcaaaactatcgtaacctgagatga

SEQ ID NO: 52923 - DNA, 342 bp, Glycine max
  Peptide Sequence Number=SeqID_169701
atgtttaatggattggctgaagtttccatggtcgtttcaaggcttcctgttttctacaagcaaaagggactgtcgacgcttcttgggatattcctcacttatgttattggttttgagcatatgtttgaaggtaaaaacaactttctaacatttactactattttggttgtggttacaatggactacggttacatttacaggcttttcagtgggtgcaagatattccccatgccttaccgctggccgagcaaaacctcagtcttcaatccaaatttgccctacctaactgtagaagatgttagaatagaaacatacatggaaagaacaaagaaaactacgtaa

SEQ ID NO: 52924 - DNA, 810 bp, Glycine max
  Peptide Sequence Number=SeqID_169702
atgggaaaagcctatttcgacaaatcttaccggaattgctaccttaacagattcttggccatggtttcatgctttgcatctgtgtcgagatttgacagggactggaagaaaattgaagattttgtaggttcaaaaacagttattcagattcgaagccatgcccagaaatacttcttgaaagttcaaaagaatgggactgtggcacatgtgcctcctccccgtccaaagcgcaaagctgctcatccttacccgcaaaaggcatcaaaaaatggtttgtttctatttgagatggcgatattctctgtccctaaagttttggtgccactaccagcttccattggttatgcttcatcgagaaatacgcttgcacctgggtttgcctcatgggatgaaacttccctgctgatgaatgctggagccgataaacccatgacctctgatattggatcaaaggggatagcacagattaccaacagcagtctcagtggtgtaggaaattctactggagcactaccgacttctgagatacccaagcaagggaaacaagctccagtgcttcatggtttgccagattttgctgaagtttacagtttcattggaagtgtatttgatccagaaacaaacgaccatgtccagaagctgaaggaaatggatcctataaattttgaaactgttttgttgttaatgagaaacctcactgtcaacttgtctagccctgactttgaacccatcggtgtacaacccatctgctcgatgttttatgttttgagaaaattaaacaagagcatgctaatcttgttaaaaatataa

SEQ ID NO: 52925 - DNA, 351 bp, Glycine max
  Peptide Sequence Number=SeqID_169703
atggaggtcaaaccaggagaggaagtggagaaagaagtggtagcaaaggacgtcgatgagggtggttggggtgaggtggtcatcaatggcaaggtagacattagggatggcgagaatagagatggaggagtggttcgaggaatctgcacgaggggcgtagcagaggtgaggagggaggtgaattgggagagctttgacacgatggagaggagggtgatgaggttgttaatgtgtggagagagagacactggacaaaaagttgtatcggagtttagtcaaaagaaacttccgaaaagagtgtatgaagcaacttgtgaagtgcaagaagcaacaactttgaattggacgtga

SEQ ID NO: 52926 - DNA, 204 bp, Glycine max
  Peptide Sequence Number=SeqID_169704
atggcaatgggacggggcggggactggtattgtctccctagtcctcgatcccgactccccaacatatacccgtactcatcccgatactcaacggttgcagcgcattttcctacaaaaatcatcaagaaaagaatattaaattatggtgggtatgggaatgggtatgggacgggtagtgacatccccgtccccgaccccgattaa

SEQ ID NO: 52927 - DNA, 681 bp, Glycine max
  Peptide Sequence Number=SeqID_169705
atgggttcgtcgggctttgatcccattccgttccgaagcgttctgctcattgagttttgtaaaaggttccggtctttcttcggtgaatctcgaggtctttctgatggctgcgctcagcctaatgttatctacgttgacccttctcagactagtttacaacgggctttctggcgaaaaggaggaaagcattggtttatgcccacccggctgaaaggaggctttctggccggtgaaaaagaggagagaaggggagaaggagctcagagcactctcaactatcctttcttgcgtcatcagcttgatatcagaatcgctgaacgtacagcttgtggtacggacttcacgcgggatgtttccgagctagattgcaaaaccgaaagccggggggagggggtcttagcgagacctcgtcctctttctctttcgatagacttcctaaaggatgatctagctgtggatgatgtcccagctcgagagcctctggctactctcgatacctcttactccagaatagtcacgcttcccagtctctcagcgagttcgaaggcgattgaggagttttttaatcaatatccgctattctgcatctggtctttccgtaagcctgcccatcgagcggaaagaagagctggctttgttgttccttcccgcgattggaatgccaaccctagtagaaagtga

SEQ ID NO: 52928 - DNA, 795 bp, Glycine max
  Peptide Sequence Number=SeqID_169706
atggaagatgcccataatgaagatgttggtcttgataagacggtgggatttgtaggctcgaacaacttcatggagatggaattaggaatcaggaaaaagtgggcgttcctcggctgccccggcgtcggaaaaggaacgtacgctagtcgcctgtccaacctcctcggcgtccctcacatcgccaccggcgatctcgttcgcgacgaactcgcctcctctgaccccctttcttcccagctatcagaaattgtaaaacaaggtcaattggtgtcagatgaaattattatacgtttattgtcaaagagacttgttgctggggaagctaaaggcgatctgggatttattcttgatggttttcctcgaacaattaagcaagcagaaatattggaaggggtaactgacattgacttggtaatcaatctgaagctccgagaagatgttctgcttgagaaatgccttggtaggagaatttgcaatcagtgtgggggtaattttaatgttgcttctattaacatcaaggccgagaatgggagccctgaaattattatggctccacttcttcctcctgagaattgtatgtcaaagctcattactcgatcagatgatactgaatcagtggtcaaagaaaggcttcgaatatacaatgaaatgactcagcctgtggaggaattttaccgttcgagaggaaaattattggagtttaacctgcctggaggaatcccggaatcttggcctaagttgctacatgctcttaatcttgatgattacgaggacaaacgatctgctgcagcataa

SEQ ID NO: 52929 - DNA, 1311 bp, Glycine max
  Peptide Sequence Number=SeqID_169707
atggcagacaacaaaaagcgccggcgaaaggaccccgccggcgacgagctccccttcaaaaacaagctgaaaccggactccgcaatcatggaaaccctaaagcagttctccgcctcatcctcctcctcctccgcctccgtctcacaaaccctaaccctccaggacctctccctccccttccgctgccgcgaggtggcggacctctccctctcctccgtgcagtccaacatcgagtccctcattctccggatcgcccactccatcctctctggccacggcttctccttcgacgtcccctcccgctccgccgccaaccagctctacgtccccgagctcgaccgcatcgtcctcaaggacaaatcctctcttcgccccttcgcgaatatctccaccgtgcggaagtccgccatcaccgcccgcattctgcagctcatccaccagctttgcctcaagggcatccacgtcaccaagcgtgacctcttctacaccgacgtcaaactcttccaggaccagtgctgttgtttttacaaaaataagcaattcaccaaattttgcgtgaatcagatccaatctgatgctgttctggatgatgtgtcctgcatgctggggtgcactcggtccagcctcaatgttgtggctgcagagaaaggggtggtggttgggaggttgattttcagtgacaatggggatatgattgattgcaccaaaatggggatgggcgggaaggcaattccaccgaatattgatcgagttggggatatgcagagtgatgctttgttcattctgttggtggagaaggatgctgcttatatgaggttggctgaggataggttctataaccgctttccatgcataattgtgactgcaaaggggcagcccgatgtttccactaggctgttcttgaggaagatgaagatagagttaaagctgccggtgctggctctagttgacagtgatccttatgggttgaagattctgtcggtttatggctgtgggtcaaagaacatgtcttatgacagtgccaacttaaccacccctgatatcaagtggcttggggttaggcctagtgatttggacaagtacaagatacctgagcagtgtaggttgccgatgaccgagcaggatattaagactggcaaggacttgcttgaggaggattttgtcaaaaagaaccctggttgggtggaggaattgaccttgatggtcaaaactaagcaaaaagctgaaatacaggctttgagcacctttggttttcagtatctgtcagaagtttatttgcccttgaagttgcagcagaaggattggctgtga

SEQ ID NO: 52930 - DNA, 1458 bp, Glycine max
  Peptide Sequence Number=SeqID_169708
atggaaatcaatagaatcggagttgcctatacggagaaaaagggggctatgctgcaacttgacaacaaagaaggcaagctgacagaaagcagcaattcgcttttttcgatagatagtacctcacccgcgatagaaaagacgactcattctgacttgcaatggaagtctaatataggaagcgatctgtgggcgtctgccgcatctccatcttatgctccaatccgggatattcctccaggtcgagaagatgctccgcggtccatctctccagtgaaagatgatgatgacaaggccatcccagtggacgaatctgaacactcagatggggatgccaaagcagtggccctttcaaagtacgaattcggggcatatttctcaacgttgcgtcaccttgatccctcggcaacctcgcaagtcacttttcccgaaagagctatggcggggcagagcttggagcacttagtcgaagcatcttcaccacgcggcgctcaaccaagaggtgatgacgctgatgtgagagatgttgtggtagatagggaatttggtttggataaccaagatccattatatacgatgaatgagattccaatgagagagtcgagagccaaagaagaccttcgacttgacgggaaaggcaaaccccggaccgatacaaaagcctgcaaagaacccgccgagcttaaaggtcaatatatcggcccagcacttcccctgcaacacaaaataacaacggagagaaagggtctccttgtcgaactcctcgcgaacagggctggaaagattgactctatttttaggtatgacggaaagacatttgacaaccgtagcttctgtggttacgagtcggggggtgatcggtcgtctagcggagctacacagcaagccactatatgcgctactccgaattcttcttctgaaacttccgcctcttttcccagctatccctctttccctagtgtcgcagtctcgcggattctctttattgtgacttattgtgttggaaagaggctaaaacagccaaagcaatatgttcagaaaccgtctttagatcctaacattgttatgaaaaatgttccagatgggctaatctccgccgaaccagtgcaagaaagggaagaagaagtcaccaccataaagatccaaatagtggcactaatcaatgatataaagagcactcccttccaatcccaattctttcttctccccaaaccctatacccagacagaaggaatgcatgagcaggaaggaagcgcgagcaaaaaaagaatccaaaaccggcactccttctcgggcgaaattggacagattgaagcttcttttctttttgccggagggccacgcgagaaaagcgggcttcattcttcgtttgctgttgtgacctttcgagatggttcgatcgctaacaaagacaagcatgggaaacagcagactcccgcaactccaagagctcaagcctaa

SEQ ID NO: 52931 - DNA, 525 bp, Glycine max
  Peptide Sequence Number=SeqID_169709
atggaatctaagccaattgaatcagcaaccgctgtgaaccttctggctgattcaatatcaccggagtctgctcagggttccaaaccagaagcgaagtttcttttctacgatacactggaatcggactcttcccccggcccagtagtggagcttgaccctcgccctacgccgattgagatctttccttgtgcggtacaggtaaattttgctcttgagggaatacccggttcatcggaacttcaaccagaagaggtaggctcggggataaactttcttagtcagacttccttgataggtgagacttccacgaaagcacttattagaagaatcttagtatgcaaggccttcgatctaaagggagcttcggtcggtgaaactgtccctgtagctaaagtcaagccagttcattcattcatggcaatcggtctacaatcctgcttcggtagcagacttcggtcaaggaaatcgcttcaagcaatggctttggatcgacctgacttcttagagaggaaagccagtgaatga

SEQ ID NO: 52932 - DNA, 252 bp, Glycine max
  Peptide Sequence Number=SeqID_169710
atgtggaggcgtggaatgttcttgacgtgtcacgttggaggaagatatttccacgtcggcgtccacgtggatgaaatcaaaaggagggcgagtaacgtgaaggagaggatcttcaaagatttggggaaggacacgtggcgcgatctcgcttgggaagtttctggccttttgtggaaacgtcgatgtctcaaaatcatgaaggacagagaatcaatcgtcatagagttgttttcgtttaacaaaagtttctga

SEQ ID NO: 52933 - DNA, 537 bp, Glycine max
  Peptide Sequence Number=SeqID_169711
atggaggcgcagtcagcctggaaagcgaagccggtaatggtgactgatgagggacttggttgcatgggtgtgaagcatggtggcggagtcggtatggaaagcggaggcagcagtggtgactgcacggaggaagatggttttagaagaatggatcgagtttggattcaatggaagcttgggtctcggcgaaacgaagttgaactgcagcaagtttggccatggcagcatcaaggtgatccacgcaagtggcggaaagttctgcgtctgccattgaaggacggcagggaagggacaggtcggaggaagtgtctatgtgttggtgtcctagcgttgtcgttggcactgcagaatccatggaaggcggagtcggcatggtccacacagtttgtagagccgtggtcccgcacaagcctagcaagcagaaccgggtactctcaaaatcaatcccaagggattgagctggatgtacataaggagaaggtgtgtgctgaaatggaagggatgagtctgacagaggtggttgctgatgcagggtag

SEQ ID NO: 52934 - DNA, 393 bp, Glycine max
  Peptide Sequence Number=SeqID_169712
atgaatttcaaagagaagaaagaaaagaaaggatatatcacttgggaagataatgtcataaattattcaagtgattcagagaagaaaatcataagtctgaatatcatgatgaaagactatgaaaatggagaagagcaaagtcgatacattgatagcaatttctccaaacacatggcatgcataaaagtttattcatatttctccccaagaaaagtgaatatgcaatttatggagacaacaaacaaaggccacttgatcaacaaccccaacaattggaagtggaagttactggaagttggaagttggaagttggagatgaaagttattggaagttggaagttggaagttgagaatggaggttggaagttggaaggggaagttactaaaaattga

SEQ ID NO: 52935 - DNA, 261 bp, Glycine max
  Peptide Sequence Number=SeqID_169713
atggaaagtctctacatgacaaaatcattagcaaataggctaatcttgaagaaaggattacagactttccaaatgacattgggaaagtcgattgttgatcatattgacaacttcagcaagtttattcttgatcttgaaaacactgaggtgactatagatcaagaagatcaagcaatcattcttctcaatttcttgcctaactcctatgagcactttgtagaaacaatgattcttggaagggagtcattaacattgtatgag

SEQ ID NO: 52936 - DNA, 964 bp, Glycine max
  Peptide Sequence Number=SeqID_169714
gcacaggccattgtttttggttagtatatttgatagtgagagactgagagtgcaaccactaggtggacaccaaactttggattgtacaagcgccaggttgctcacttttggtggggatggtccttcagtcttcaaatcacaacctcctttctcctcaccaaatattaaggatattcatgcccctgcaactgcaccatcaccagcaactctgccagtaccctctccttcacctagaatttctcctctaggttcatcgttgaagaagaaaaagactccaccaccagcatatacattgattctgccacctccacctcctaataaggattgcttgtcgatgacttgcttggagcccttgacatatacagctcctgggtcaccttgtggttgtgtttcagagctagccaaggaaattgcaacaagtgttctgctgaaccatacccaggttcgcattgtgggagcagatgcagctaatcagcaactggagaagatcactgttctcctagacttagtacccaaaggagtaaaatttgatgataccagtgcaattttaatatataagaaattctggtacagggagattctgatagatgcttcggtctttggtgcttatgaagtactctatgttcattcaccaggtcttcctccatctccaccgtcaactccctcagatgcttctggtatagatgatgggccaaatccaggacatgacaacaatggaacgataatgaaacctttaggagtagatgtcccaaagaagaaaaaagaagggaataatggaagactgattgttatatttgtgctgtcatcatctgctatacttctgaagccagatacgagcagaggtggaggtatggatcctggtggctatgtaaaggttaaatgcatagcttgtggacatcgaaatgaaaggtttgtgctgctgacagccatgctgctagacctttttcctgttttgtatggatag

SEQ ID NO: 52937 - DNA, 479 bp, Glycine max
  Peptide Sequence Number=SeqID_169715
atgcctgagcggggcgaagccagaggaaactctgtttccctcaggatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtggtgtccg

SEQ ID NO: 52938 - DNA, 303 bp, Glycine max
  Peptide Sequence Number=SeqID_169716
atggcaaggaaaagtgtgattcagagggagaagaagagacaaaaattggaacagaaatatcatttgattcgccgatcctcaaaaaaagaaataagcaaagttccgtcgttaagtgataaatggaaaattcatggaaaattagaatcactaccgcgtaatagtgcacctatacgtcttcatcgacgttgtttttcgaccggaagaccgcgagctaattatcgagactttggattatccggacacatacttcgtgaaatggttcatgcatgtttattgcccggtgcaacaagatccagttggtaa

SEQ ID NO: 52939 - DNA, 342 bp, Glycine max
  Peptide Sequence Number=SeqID_169717
atgaagagtgcattcgacaagaaagtacgcttgcgcaagttccatgagggagaccttgtcctaaagaaaatgtcccctgctgtcaaggacaatcgagggaaatgggccccgaactacgaagggccttttgttgtgaagagggcttttttccggaggagccctggtgcttaccaacatggatggtacttaggaacggatgcaagtggggatggggtcacaaccgaccgatcgttgccccttctctgcgctaaacaagcagagaacgccgcgcaaggcagcccagtatcctttggattcgcagtattttactaccattgtttgtttttagtaattaacgcctaa

SEQ ID NO: 52940 - DNA, 499 bp, Glycine max
  Peptide Sequence Number=SeqID_169718
gcaaagacctcacagaagtgggcgctaatcttgctgaagatctacaatgtggggacatttttcatttgcttgctttagtctcatcgggtgaactttcaatttctccattcctaccagataatggtgttggagaggctgaggacttgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 52941 - DNA, 342 bp, Glycine max
  Peptide Sequence Number=SeqID_169719
atgaggaccaccacgggggaggagcttgccacccagctcgcccaggcgagctcagctcgcccaggtgagccaggttgcttcctccagaagcaaccgccttctggaggaagaatctggaaggcccaactttcggaatgttacggaaactcacggattgcgcaacaacacttccttttgatttccggcacgttacggaatttcacggattgcgtaacaatgcttccttttgatttccggcatgtctcggaacttcacgtattgtgcaacaaagggtgccaagtacctcgaagcgatcaatcaaaggttgcatgtcatcaaacaatagtcctcggacaaaattag

SEQ ID NO: 52942 - DNA, 339 bp, Glycine max
  Peptide Sequence Number=SeqID_169720
atggagcattctttcattctccaacctggccctacttctcacacttctgacataacactggacagggccaggttgatctacggcatcatccagaagatggacatgaacttggggtgtattatctcaagtcagatttctatgattgcacaacatgactcctcgaggctgggtttccttgccctcatcactactttatgcaaagcccggggagtcacttctgattcattatcttttgagagtctcagtccaaccattaatttggcttacgtgaagaaaaactgctggaacctcgatgacccctcagtcactttcagagggcctcgcaaggccaaggggtag

SEQ ID NO: 52943 - DNA, 189 bp, Glycine max
  Peptide Sequence Number=SeqID_169721
atgtgcacgtgtgcaatttttggtagccaagatgctttgagtatgcatgtatgtaaatttagccaaggaagtgcatgtgatgtaggtagcaaatacaccttggaagtacatataaataatctaggaaatggccccaaggaagcttgcctcaaagaggtccaggaaggattaggcgaccgaaggaactag

SEQ ID NO: 52944 - DNA, 342 bp, Glycine max
  Peptide Sequence Number=SeqID_169722
atggaatcagaatttattgctcttgatttagcaggtcaagaagctgaatggttgagaaacttgttggcagatgtgccattgtgggggaaacggtctataccagtttctcttcattgtgactctgaagcagctattggaattgctaagaacagtgtttataatggaaaaaggagacacatacgcattagacacagttcagtcagagaattgttaaaaaatggtgtgatctcattacagtttgttagatcagagaacaacttggcagatccgttcactaaaggtctaacaaagaaagttgtacttgaatcgtcgagggggatggggcttaagcctttgtgttga

SEQ ID NO: 52945 - DNA, 498 bp, Glycine max
  Peptide Sequence Number=SeqID_169723
atgtattgcatacctagagagagcaataccaggccagacttactttccaagttggccaacacccaaaagaccaaacacctcaaaactatcatccaagaaacgcttcaaactcccaccacagacacaaaagatgttatggggaccttaccaccagaccaaaatgaagctcgacgcttgaaactaaaggccaactattatgtcattattgatggcgaactattcaaacgaggtttcacaacacctttgctcaaatgtcgtgacaaccaacaggcaaactatattatgcgagaactccaagaggggatttgcggtcttcatatcgagggacgttccctggccacaaaagtagtgcgagcaggctactattggccaacgctcaaggtcgacaccctcgaattcaccaagaggtacaagcaatgtcaagagtttgccgatgtcccacgaaccccttctaacaatctccatattttgaactccccttggccattcgccatgtaa

SEQ ID NO: 52946 - DNA, 118 bp, Glycine max
  Peptide Sequence Number=SeqID_169724
atgacgaacaaggccaaaggaaaaggcaaggaggtcgccggaaaaggttctaccggcaagcgcaagggtgccttcgacgatgacaagaccggtggcggtcgcaagagaaacaagcgag

SEQ ID NO: 52947 - DNA, 900 bp, Glycine max
  Peptide Sequence Number=SeqID_169725
atgggtgaagaacaccgtaaggtagaaagagtggaagtagacaagctcctcaaagccaacttcatcagagaagtcatattttcaacttggcttgccaacgttgtcatggcatgccccaaagatccataccctctacctagcattgacaagctagtcaatggagcatctgactttcaagtgttgagttccatggatgtctactctgggtacaatcaaatccagaagcatgccctagacaaagagaaaatagcattcatcacaaaagatgtcaatttctgctacagggtcatgcagcagataggacgaaatgttcaggtctatgtcgacgacatgttgaatgacaaactagcatccttgtccaggttcctcccaaagcttgctgaaaaagcaagaccattctacaagctactcaagaaaactgagacgggagtacccctactcctatatctctcggtatttgatgacgccgccagtttggcccttgtccaagaagaatggaagcatcaacttcccatctacttcatcagccacttacttcatgatgccgagaagcgctaccaaatgggggaggagcctaaactatcaggaaggatggtagcatggtctgtagaactatcagagtttgacattcattatgagccccgtggccccatgaagacacaatttatggcagaatttgcgggaaacgatcagaccaccatagactggtggaccctctatgttgacggtgcatccaatgtaaaaaggagcaaagcaggcatcatccttgaaggccctgataatattgttctagagcaagcccttaagtttaacttcaaagcatcaaacaatcaggctgagtataaggcacttattgcaggcctaaaactagctagagaagtcggggccaagaagctatga

SEQ ID NO: 52948 - DNA, 375 bp, Glycine max
  Peptide Sequence Number=SeqID_169726
atggaacataaggcatattgggctttgaagtttctgaattttgatgaagttctattgggggagaagaggaagctgcagctcttggagctagaggagatgaggttaaatgcttataagtcatccaaattgtacaagcagaagatgaaggcctaccatgataaaaagctgttgaaaaaggactttaagctaggccaacaagttttgcttttccacgttcttggaattgttgtaccatctagttcctgtaatttgtatgctttgttgtctaagcttgtagtgaccctgaatgggccttcccagttagggccaagttttcccgctcgagggtcttttctagcttcacctcgtactcgccacacaagatcactcggttga

SEQ ID NO: 52949 - DNA, 1332 bp, Glycine max
  Peptide Sequence Number=SeqID_169727
atggagcaacgccatgaagaagaactgagaaagctaaaggctaacaatgaccagctggaggctcatctcaaatgccttcaaggcggcgagcactctgctcacacatcgcctgagggaactcaaggggaatcacacccccgacacaccttcaacactttggatattctgagtctttctcatgcccaccatcccgcaagacgaactactaggcgacatccctttgttcatcgaatcatggaggtaaacataccaataggttggaagccactcaaccaagaacaatatgatgggattgcagatccagatgaacatctggacaccttcctcacccaagaaaatctatgtatcaacaatgatgcaatcatgtgtcgcgtcttcctaacttccctcaaagtaaaagcattgacctggtacggtggactcttggactccctccaaactgctctcaccaacctgcgacaagcgaatgatgaatccttccaaaaattcatggacaggtttggacgtatcgttgttcagatccacaatctcaacctagaggtagcactacactccatgcttcttgctctgaggcttgcatggacgagctatgtgaatgagccaagggctacatccagatggaagaaatgtcctggtttaacgaggtccgacaagctagacaaaagtgagacaaaagagagggaggtaataagaccgaatcgcacaagttggacaagcgctagcctctcccgaaaggacccaggaagccttcaacatggaggtacccatcaagttacccctccacttcctcccaaactagggcagatagggccaaagactatcgataccaccgtagttgtggagcaagaaactgaggacaagaagaacaccgcagaggaaatgacacagatcagcggtgtaatcaacaccatagttggcggattttcctacggaggacagtctagccaatcctgcaagcgtcacctccatgccatccgtgacatcaacatctaccatgttgattcatcgtcattgcgaagccttcccccatcgatttcagtgaccaagatgtcaggggaaaacgctcaacgagcttggagtcattgtctccataccacatttaaagatgaagttccccacctcaactggggagatagtgactatcaagacaaaccaaaagcgggcacgatagtgttatgcggaaagcctaaaagtggaaacatatcctcccaccagggaacctaccaagcctattctcacagtggaagataccacacgagtcatgagcatagaggaagggtccctaatccaaatcctgacagtctaccaagcaagcccaaacgatgtatttga

SEQ ID NO: 52950 - DNA, 2160 bp, Glycine max
  Peptide Sequence Number=SeqID_169728
atggaactgcaaaaacccactcacgtggctcttctctcgagccctggtctgggtcatcttatcccaacgattgagcttgggaagcgcttcgttcttaaccacaacttcaaagtcactgttctcgcggttacttcgcaaacctcacgcgccgaaactcagattctgaactcagccctcacaccctccctttgcaacgtcatcaacatcccttcaccagacctcaccggcctcatccaccaaaacgaccgcatgctcacgcgcctctgcgtcatgatgcgccaagccctacccaccattaaatccattctttccgaaattacccctcgcccctcagcactcatagttgacatattcggcaccgaggctattccaatagggaggaaactcaacattccaaactacgtctacgtggcatcacaggcttggttcctgtcgttgctcgtgtattctcctattctcgatgagaaaatagaaggggaatacgttgaccaaaaggaagcgttgaaaatcccgggttgcaacccggttcgaccggaggacgtggtggaccagatgctagaccggaacgacagagagtataaagagtatcttggagtagggaaggggatcccgcaaagcgacggcattttggtgaacacgtgggaggagcttcaacgtaaagaccttgaagcgttgagggagggaggtttgttaagtgaggcactgaatatgaacattccagtatatgctgtgggacctttagtgagggaaccggagttagaaacaagttctgtgactaagtcgctgctgacgtggctcgatgaacaaccgagcgaatcggtggtttacgtgtcgtttgggagcggaggaacgatgtcgtatgagcagatgacggaattggcttgggggctggagttgagtgagtggagatttgtttgggtggtgcgcgcgcccatggaaggaactgcggacgctgcgtttttcactactgggagtgatggggttgatgaggtggccaagtatttgccagaagggtttgtatcgagaacccgcaaagtgggactgttggttccggagtgggcccaacaggtaacaatactgaagcatcgttctattgggggttttctttcgcattgtggatggggttcgacgcttgagagcgtaacgaatggtattcccttgatcgcgtggccgctgtacgcagagcagaggatgaacgcgacgttgctggcggaggagttgggccttgcggtgaggaccacggtgttgccgacgaagaaggttgtgcgtagggaagagatagcgcggatggtgagggaggttcttcagggtgatgaaaatgtgaagagcaatggcataagggagagagtgaaagaggtgcaacgaagtgcagtgaatgctttgtcggaaggtgggtacatcctttgtggtacaagtagagggtacatctacttgggtttgactgagaacaagagagggtacatctcttgtggatcagttctaatggagggtacattcactaggttgttcaaagagaacaagggaggcacacattaccaaaaatccctaatcccttggaacccaaaccgagcaacctccttgtcacattggcacctcctcgtcccgtttgtcacatcctcattgcattcacaacctcgtcgtcgtgttccaaacctcctcgtcgcatttgcaacctcctcattgcattttccacctcctcgtcagcaccgttcccatggaaaggagtgcatcatcatgcaactacgagtcccaaactcgcgtgatgtgtttgttaacgtagaggctccactggtgatatcacaaactgaggataatctagggaggcatttttatggttgtgatttatacaaggttacaggtaggaaagagtgtcaattttttgagtggcatgttctagttgtcaataatcgtgagaaaaggatcattgtagcattgatgaagaaggttgatgaattgaaggtcaaagaaaaaggtttgcaaaccaagatcagtgacatgaaaatgaagggaaaaattttagggattggattggttttatcttgggtcactgacgaaattaaggtgtatgaggtggtgaaggagcttaagaaaagtgatgttgggtttaggaaacatgtggaagaacttcaagaacatgtgtgctcgtaccttgtagaataa

SEQ ID NO: 52951 - DNA, 297 bp, Glycine max
  Peptide Sequence Number=SeqID_169729
gaaaccgcatgcacacttcagcagcctgtggagtggatactacctacacctactccatatcaacaagtggagccagttcaagtgatagaggtgtcatcctctgaagaagatcttgaagaggacctagaggagttacctcttgaacctgctgtggatgaccttgacttacctgaggatgatgaagacccactccctgatgttgattttccagaggatatcatgtcagcatctgaggcagactctacagaggagagtggccttggagggacagcgaatagtgacgactcttcatcatag

SEQ ID NO: 52952 - DNA, 906 bp, Glycine max
  Peptide Sequence Number=SeqID_169730
atgaagatgatgacaagcttctatgatgatgatgttaaaaagaacaggattgtgataatatcaacgattggggcggggttaatctgtctaggaatctttgtatggctggtctggagattcaagggaaaacttaaagttctgcctacagtttcctcagtttcttgttgcaagagtagtgatgcactaccagtttttgatgcaaacaagagcagagaaatgtcagcagaattttcaggatcagctgaccttagtttggaggggaaccaattaagtggaccagaatttccagttttcaattttagctgcatttcaatagccacaaacaatttctctgaagaaaataagcttgggcaagggggctttggccctgtctacaagggaaagcttccaggcggagaacaaatagctgttaagaggctctcaagacggtctggccaaggtttagaggagttcaagaatgaaatgatgctgatagccaaattacaacacagaaatttagttagattaatgggttgctctattcaaggggaggagaagttgctggcatatgaatacatgccaaacaaaagcttggattgctttttatttgatcctgtcaaacaaaaacaactagcttggagaagacgtgttgaaatcattgaaggcattgcaagaggattactttatttgcaccgggattcaagacttagaataatacatcgagatttaaaagcgagtaacattttgttggatgaaaacatgaacccaaaaatatcagactttggcttggccaggatatttggtgggaaccagaatgaagccaatacaaacagagtagttggtacatatggttatatggcccctgaatatgcaatggaagagattttgagtggccgcagaaacactaagctttcgtcactcagatga

SEQ ID NO: 52953 - DNA, 294 bp, Glycine max
  Peptide Sequence Number=SeqID_169731
atgactccttcacccttagatcgcaagactaaggcaaacgaggcggaacctcggtggcgtgataggctggttctcaccagggtcagtcctatcacaaaattggagtttctaacctcactctgcttgctattctatcactcagggatccagaatggagcaactgggggtgacgcggaagccacccgggtggggctggtaagagatgatatcaagcggtctagaatagaatcgaaagctcaaaagggaagtgaaggatcagttcctcccatgcaatgtggcatggctcgctcgtga

SEQ ID NO: 52954 - DNA, 785 bp, Glycine max
  Peptide Sequence Number=SeqID_169732
atgcaagaagcagttgtgaaatcttttggatggcaaaccatattcacactgttgacagagcaaaagcaacgatatcagagtaggagggtttcacttttcaaaattgggaaagccttattcaaaggaagaaaaagcttagaccaagatgcgaatgaatgccaatgccggggtcaatttcccttcttaaatttcctcactaccggtccacaataccaaaaaaactacgaaaccaaactcttatttctcttcctcaccaaacacttcatcaactctctctctctctctctgcaaacaatcatgccaggtttcttattcttcctcttttgcttcttctttgcatcatcacaacacatcgcaatttcattctccacagacaccttaagctcaacacaaattcttctaaccaaccaaaccctcgtatcaccaagccacatcttcgctctgggcttctttccggggaccaattccacatggtacttaggcgcatggtacaacaacatcaccgacgacaaaaccgtagtatgggtggccaatagagacaaccctctcgagaattccagtggttttctaaccatcggagaaaacggaaacatcgtcctcagaaatccatcaaagaagaaccccgtttggtcctccgacgcaaccaaagccaacaaccccgtgcttcagcttttggacacaggaaacctaattctcagagaagcaaacataaccgacccgacaaagtatctctggcaaagcttcgattacccaacagacacactcttacccggcatgaaaatggg

SEQ ID NO: 52955 - DNA, 252 bp, Glycine max
  Peptide Sequence Number=SeqID_169733
atgttatgcactggtgcacggaagctatggaatgaagatagggcctcggagctgatggatccattgcttgaaaatcagtttcctacagctgcagctctaaggtgtattcaagtggtgagagtgtcttggtcccccaacctggaaggccaggattatattccgagatttttctctgagacaaattcatcatcaggtggtggactgaactctggttccaatgacataactgttactttactagagggtcgttaa

SEQ ID NO: 52956 - DNA, 726 bp, Glycine max
  Peptide Sequence Number=SeqID_169734
atggacaacatcgttgtggttgcgcgcgaagaaccagccgaggagaggggaatagaggaggacgggggatgtgaggaagctagtgacagtggcgaggaaggtggcaaaggaggaggaggtgtcgtggtcgacaatattgtagttcacattttaccaagaaaatggctggctgtgataggttcaagccatgtgaaaattgtttcttctagtcgcaggatgggagaaggtggttttggctcagtatacaggggtaaattggcacatggacaagaaatagctgtgaaaagtggttatatgtcccctgagtatgcagcaaatgggcttctttccctaaagtctgatgtatttagctttggagttatagtgttagagatattaagtggcatcagaaataataatttctaccatccagatcatgaccgtaatctgttggggcaggcatggagattatggaaagaaggacgaactgtggaattcatggatgttaatttagaccttgcaactattccatcagaattactaaggtgtctgcaggttggtctcttgtgtgtgcaaaagttacctaaagacaggccaccgactatgtcgtctgtggttttcatgttgagcaatgaaagtattacacttgcccacccaaagaagcctgaattcactgaacaagggttagagtttccagggtacaacaacaattctatgactattactctattagaagctcgaaattag

SEQ ID NO: 52957 - DNA, 2166 bp, Glycine max
  Peptide Sequence Number=SeqID_169735
atgaagaaagttgttatcattatttttgctcttgcttgtctatcaatccttcagaaaacgtcatatgcagctgatgtcttgactccaacatcttccattaaaggtggccaagaactcatttctgctggacaaaatttttctcttggattcttcactccaggaacctccaaaagccgctatgtagggatatggtacaagaatattttgcctcaaaccatagtttgggtagcaaacagagatagtccacttaatgacacgagtggaaatttaaccgttgctgctgatgggaatattgtactttttgatggagcaggtaacagaatatggtttacaaattcatcaagaccaattcaagaaccaattgcaaagctgttggattcgggaaacttggtgctgatagatggaaagaacagtgattctgatagttatatatggcaaagctttgattatccaacagatacaatgttacctggcttgaagttgggttgggataagacctcaggtctcaatagatatttgacttcttggaagagtgctaatgacccctctcctggaaactttacctacagatttgaccagaaagaatttcctgagttggtaatccgccagggaatgaacatcacattcagaagtggaatttgggatggcatccgttttaattcagatgattggttatcatttaacgaaattacagccttcaagccgcagctttcagtaactagaaatgaggcagtgtattgggatgaaccaggagatagattgtcaaggtttgtgatgagggatgacgggttacttcaaagatatatttgggacaacaaaattcttaagtggactcagatgtatgaggcaaggaaagacttttgtgatacctatggagcatgtggggcgaatggtatttgcaatattaaggatttgcctgcttactgtgattgcttgaaaggcttcattccaaattcacaggaagaatgggattcatttaattggtctggtgggtgcatcaggagaacacccttaaactgcacagaagaatgccatgtggagtgcttgaagaactgttcctgcacggcgtatgcaaattctgccttgaatgaagggcctcatggctgcttgctttggtttgggaacttgattgacatcaggctgcttataactgaagaggatgcaggtggacaacttgatctttatgtaaggttagctgcttcagaaataggtcatagaaatcataatgaagatcaagcaccacctctttttgagatatatactattctggctgctacaaacaatttttcaattgagaacaagattggggaaggtggttttggcccagtatacaggggtaaattggctcacggacaagaaatagctgtgaaaaggctatcaaaaacctcaaaacaaggcatctcagagtttatgaatgaagttggattggtagccaaactccaacaccgtaatcttgtgagtgttttggatcctaagcaaggaaaaactttgaagtggaggaaacgatatgatataattgtggggattgctcgaggactactttatctccatcaagattcaaaactaaccatcattcatagggatctaaaaactagtaacattctactagacaacgaattgaaccccaaaatttctgattttggtgtatcccgcattgttgaaggagatcattttgcagtaacaacaaatgaaattgttgggacaattggttatatgtcccctgagtatgcagtaaatgggcttctttccgtgaagtctgatgtgtttagcttcggagttatagtgttagagatattaagtggaaccaaaagtaataacttcaaagtcaaacatccagatcatgaccataatctattggggcaggcatggagattatggaatgaagaacgagctgtggaattcatggatgttaatttagaccttacaactattccatcagaatttatgagctgcctgcaagttggtctcttatgtgttcaaaatttacctgaagacagaccaactatgtcgtctgtggttttcatgttgagcaatgaaagcattgcactaggccaaccaaagaagcctgacttctttgaagaaaagttagagtatcgtgggtacagcgagaaagagagttttagtaacaatgctatgactataacattgttagaagctcgaaattag

SEQ ID NO: 52958 - DNA, 357 bp, Glycine max
  Peptide Sequence Number=SeqID_169736
atgaagggtgacatggaggccatgaaagagcaaatgacgacaatgatggaagtcatgatgagtatgagaaaaatgatggaggtcaacacagctacagtcgttgccgtaagtactgcccctaaggtggacccaactcacctatctggcctcaatcaagtaaatcctctagtctcagatatggtagggcatggaggcgaagcgttaggaagtacgagcaacccccattttgtgcaagttcagaacaagcattccttccctccatatggcttgcctcccaactatataccaccctatgttgcacacgctaccgatgtgaatgtcaataactccactcccatactcattgagagccaataa

SEQ ID NO: 52959 - DNA, 207 bp, Glycine max
  Peptide Sequence Number=SeqID_169737
atggataaaaaattagcaagtgaggctaatccgcttagcgaggaagtcaactcacttagcgagagtagaaccctagagtatgtaaagtcagagagcaatgtgcaactagcccgcccagcgaagtctttgtcgcttcttgcgcttagcgtgtccatgtccgctaagcgcttagtcactaactctcactcagtgagacatgctcgttga

SEQ ID NO: 52960 - DNA, 249 bp, Glycine max
  Peptide Sequence Number=SeqID_169738
atgggtgcaagggataattcattcatgcacaagctgtgggctcgtcctgggctgatgcaggttcgccatgaggtgaagaaggagtatcctaggctggctgaggtgaagtacaaggtgaaacctgtggagttgtctctggagtggcctttcgtgcgacctacgactccggctaaggctcctgggctgggaaagcctcacctccccctaaaggagaaggctggactcctggccaggccacctgtgccatga

SEQ ID NO: 52961 - DNA, 639 bp, Glycine max
  Peptide Sequence Number=SeqID_169739
atgtatgagtgtgccagattatacaaggacaaagtgaaggcctaccatgataagaagcttctcaagaaggagctcaaaccaggacaacaagtattgatgtttaattccaaactgaagctattttcgagcaagctcaaatctaaatggtcaggaccatttactatcaaagaggtcaggctgtatagagttgtggaattgtttgaccctcattcatcaactctaaacagaacatgggtagtcaatggtcagaggctgaagttgtaccatggtggaaacattgacaggcgagtcacttctcgcgctaagcgcatcaacccctattcattggctgaaggggcttcactgagcgagccctgtgcactaagccctaaaaacttctctggaatttcatcttttggaattgggctaatttgtatgaactcgcttagccggcatgcctcgcttagcgagttagttgcttacgtcagactcttaaagtctttttgccttttgttggtggctgagcgggccctctcgatggcctccaagaagaggaaagccacaacatcccggccccaggagccttatgataccaccagattcacttctgaggcggaactggcacaaggccttgacctagttcatggacggacacattga

SEQ ID NO: 52962 - DNA, 1437 bp, Glycine max
  Peptide Sequence Number=SeqID_169740
atggaactgcacaaatccacacatgtggttcttctctcaagccctggtctgggccatctcatcccaacgattgagcttggaaagcgcttcgtccatcaccacaacttccaagtcactgttctcgccgttacttcccaaacctcaaaaaccgaaactgagatattaaactcatccctctgccacatcatcgacatcccttcaccagacctcactggtcttgttaacgaaaacaacggcgtcatgactcgcctgagcgtcatgatgagcgaagccgtacccgccattaaatccattctttccaaaattacccctcgcccctcagcactcattgttgatattttcggcacggaggctattcccatagcaagagaactcaacattctcagctacgtctacgtggcttcacacgcttgggtgctagcgttgatcgtgtatgccccggtgctggatgagaaaatagaaggagaatacgttgaccaaaaggaagcgttgaaaattccgggttgcaacccggttcgaccggaggacgtggttgactccatgctagaccggaacgacaggaagtataaagagtttcttaaaatagggaacagaatcccgcaaagcgatggccttttggttaacacgtgggaagagcttcaacgtaaagtccttgaagcgttgagggaaggaggcttgttaagtaaggcgctgaatatgaagattccggtatatgctgtgggacccatagagagggaatcggaattagaaacaagttcttcaaatgagtcgctagtgaagtggcttgatgaacaacggagtgagtcggttgtttacgtgtcgtttgggagtggaggaacgttgtcgtatgagcaaatgagggagctggctttagggttggagatgagtgaacagagatttgtttgggtggtgcgcgcacctatagaagaatctgtggacgcggcttttttcactactgggagaagtgaaagcgaggaggttgagatgtccaagtatttgccagaagggttcatatcgaggacccgcaaagtgggactgttggttccggagtgggcccaacaggtaacaatactgaagcatcgttctattggagggtttctttcgcactgtggatggggttcgacgcttgagagcgtgacgaacggtgttcccttgatcgcgtggccgttgtacgcggagcagaggatgaacgcgacgttgctggcggaggagttgggccttgcgctgaggacggcggtgttgccgacaaagaaggtggtgcgtagggaggagatagagcatatggtgagggagattatccagggtgatgaaaatgggaagagcaatggcataagggagagagtaaaagagactcaacgaagtgcagtgaaagctttgtccgaaggtggttcgtcctatgttgcactgtctcaagtggcaaaaatcatagaaggctga

SEQ ID NO: 52963 - DNA, 654 bp, Glycine max
  Peptide Sequence Number=SeqID_169741
atggcgaagttcaaaatgaaagaagacattgctaaaggaaatcataccttgacaacaaaaagaggaatgaagaagaaagagaagtcacaagcgaaaagcaaagaaagttcgggagaagaaataagaaccttattcacccacgaactatgttccataaacatggccactccacgagtgccacgcatgaagaggtactgcatgtgcctcgcacccgctagcctcgacaatcccacgcctgtcctagctaccagactagacactggactatccttgtccatactagggggttcgtcaaactctcaacccttctattcatcaaagacgactactctcgacaccggacaacctacctcgacatcaaataatctctttcgcccgcaagctagctcagagcttggggggattatgtactattcggggtccataaaatatacatgtccagccatgtggcacctaaataaccacgtcagcatcctatgtcagacctggaacaggagcacagacactcgtccctcaacagtcgggctgcccaacaatcttatctttatgtcttcccgttgtcctctcaacaaaggctactcaccgtccaacgtgcaaggtttggagcccacttcggccatgatcagcctgacatggaccatctctagattttga

SEQ ID NO: 52964 - DNA, 213 bp, Glycine max
  Peptide Sequence Number=SeqID_169742
atggagtgtctcaattttgtatcaccaaactcacttttctattcagaaaaaatacatcatctattcagaacgagtaaggatctggaaaaacaaaattgccttcagtgcctgcttaatttacacaaggatcatgaagaggctaggaggaaaaatgttggtggtaagggaattcttcaagctatttccattctttggagctctgtagttctatga

SEQ ID NO: 52965 - DNA, 1323 bp, Glycine max
  Peptide Sequence Number=SeqID_169743
atggctgatggtttgccactgatgttcagtcgggacggggagccccacttctcattttactggaaatctagccctaccatgtttaattcctttgataaggatttgttaacccttgtggagagggttgaaaaagtaatcttggatcatttgtcggcctcgttggatgcgcggaccattttgtcccttcttttggcgagtgatcccatcgccacattggacggtaattttgcttggagaaaactagtgaagcaggccggacctggtgatgggtatatgccttcatttgttgtcgttcctcctactgaagaaatgggtcaacttgctattgaggttgaccctgttgttggtgtcgaggtgtcgagtaaaaagaaatcaagggcttatctgagtcttcgagacttgagggatgttgtagggttgatgcccagtctgggtcactctttaagtttgcatagtccgcctctatctccatcaactattgaggctcctacccccgccgtcgctattgttgctctggctgctgatattaatgtaccagttgttatggctagtgcaactacgacttctttgtcccttgctgctacaccttcgctgagtgctagcgtggcagctgtgagttttcttcaaatgttgcctccttctgcaattcctttggctcccccttcaactgtatcgacatcgcctgccagcacttctcgcccccgcgtttacttggaccacatctacactaccaatgactctgattccttgtggagtgtgggttacaagccagagcagaaaacctcagttggctttgtgtcaaccttcaataaaaatctcattcgggggttggcgatcttagaggaaaatggacaccgccaccaagaggctctgaacaaggtggcatccttggaaactgaggttgccaagtggagggctactgctcgcacggtttggagagtggagtgtccaaagatggtgatgagttgtatgatagcacttgcatgtgaaaaggctgacttgggtggcaagatagagggtgttgcggtcaagaaggatgagcttttgaagatggtgtctgaactcgaggctaggctaaaggaatttgagttggaggcgtctaaagagaggaggccaacaaagggcttggaggagctattgttattcaagaaagagattgtcgagcagcatgagaaagattttcacaaagcagttatgcagggcaggtactttgtgaagagccttgacttgggtctttttgatcctttcaaggatgtgaaggatggtgtcctacttgacaaggatgatgtcgctgttggggaggaggacattggcagagaatag

SEQ ID NO: 52966 - DNA, 261 bp, Glycine max
  Peptide Sequence Number=SeqID_169744
atggctcctagaaagctcccaaccaagagatccaggaaggatgccactggagagggttctagtgcggccctgcaggcggatgtggactttgatggacacagagagagacgagtccaactaagggatgaagagtatgttgagttccaggaggagatagcccaaaggcaatgggctcagctcatatcacccatggctaagttcgatcctgaggtagtcatggagttttatgctaatgcctggcctatagaagaaggagtctga

SEQ ID NO: 52967 - DNA, 396 bp, Glycine max
  Peptide Sequence Number=SeqID_169745
atggtggtggtttccgttagagaaggagaagaagaggagaaaaggaagaagacaaaagcaaaaatcatcgtggctaggctgttactggtgaaaccaccgactacatctatgatctcccgaatgagtgtctggcttcagtgtttcaatttctcagcttcgctaatcggaattgctgctccctcgtttgttggtggtggctttggatcaaaggacaaattcgtgttgaagtgtgatcacaagtttgtgagcatacgcgatgacacactcatgatgatctcgcagtggtgccctaacctcacacagctcaagctctgggtgtgtcgtgagatcagtgacactggaatggaagcgtctaagaagaactgcaagggactggataagctttcctgcagatag

SEQ ID NO: 52968 - DNA, 192 bp, Glycine max
  Peptide Sequence Number=SeqID_169746
atggaggttgcgacagacttcggaggtcacggcagagtgaacggtagagtgaagatattatcgagtgaagggtgtagacaaaaggatcaagctgatgttttgatgatgccaaaggatcacatgcgtctcaaagctttattcaagacaaagaaattaaagatattcaagatggatgatcaagacagtctttag

SEQ ID NO: 52969 - DNA, 612 bp, Glycine max
  Peptide Sequence Number=SeqID_169747
atggctcatcctccctcacaatcgaactctacagcagccaataagccaaaacgttccaaccttctccattacattgccatgtttatagtagccttgatcatccttgtaggcatagctgtgataataatttggctagttttgaagccaaaaaggttggagtacagtgtggagaatgctgcaatccacaacttcaacttaacggatgcaaatcacctctatgccaactttgatttcaccataagatcctacaatcccaactctagaatctccatatactatgacactgtggaggtgtcagtgcgttatgaggaccaaactctagccaccaatgctgttcagccattcttccagtcacataagaatgtgaccaggctgcacgtggccctcacggcgcaatccgtggccctgtatgagtctgtgcctaaggaccttaggcttgagagatcctctggggatattgagttggatgtgtgggtgagggcaaggataaggttcaaggttggtgcgtggaagtcaaggcatcgtgttttgaggattttttgttctcctgtgttggtgcacttttctaaaggaaagagtttcgaaagggcaccttgtgaagtagaactctaa

SEQ ID NO: 52970 - DNA, 780 bp, Glycine max
  Peptide Sequence Number=SeqID_169748
atgggatttagtacgcacatgttacctgtttttctcattctgtcaaactattacataaattttgtcactgccttagacaccattatagtgtctctattaatgaaagaccctgaaactgtgacctctaatgatggtacattcaagccaggattcttcagccccggaaagatgtcaaatcgctatgtaggaatctggcaggtttacacatcctggatcaacagacaactagttgggaagcgggtaattcaacaaggtaactgcgatatttatggcttctgtggcgcttatggaagttgtgattcgaataagttgccaatttgcagctatctgagaggtttcgagcggagaaaccgtgaggaattgaataggcaaaaccggacaagtggatgtgtgagaagggaagcaacagcagttggttacatgtcccctgaatatgcaatggaagggctgttttcagagaaatcagatgtctttagctttggagttttgctgttggagataattagtggtagagaaaactcaagttttcgtaatcacgagctgttattgagcctcttaggatacgcatggcaactatggaatgaagaggagattgtatctctgattgatccagaaatattcaatccagataatgtcaatcacatattgagatgcatacacatcggacttctatgtgtgcaagaattagcaaaggagacgcctactatggctactgtggtttcaatgcttaatagtgaggttgtgaattttcctcctccacgacaaccctcgttcatctaa

SEQ ID NO: 52971 - DNA, 270 bp, Glycine max
  Peptide Sequence Number=SeqID_169749
atggaactacccaaaggaaagaaggaagtgggtgccaaatgggtatttagaaacaagctagacgaggtggataaagttgcaaggaacaaggcaagaagaagtttaacatgcatgatgaaaggagatgaaaacacctatgcatccaaccacatatcttggattggacaaggaatccaacaaggtggacaaccctcagaacaacatccagacctaacattatgttcagtgtttgcttatgtgcaaggtcaaggctatacaagaataacttga

SEQ ID NO: 52972 - DNA, 486 bp, Glycine max
  Peptide Sequence Number=SeqID_169750
atgcctttgaagatcttaaagaaaagtcttcagaagcaagaaaacccattggaagacttacaagttgagcagaaacaactcaatgaacttcatgatcacctatatgaacaaagacatgatctacgaagagagtgttcacaagctcatcatgattatgaaaacttggaggcaagtaaacatgatctatggattgaatgtgataatgacaagaaaattgtgaaattcttaaatgataagcttgaacaaaataaggctctcaaagggaaacctcaagatgttgttaaacttcatcaagagattatctctctaagagaaaatctacctaaatttgtcggaggcattgaaaaactagacaagttgttgggatttaatagatgtccatctgatagatttggacatggatgtgaaggagaaatttatgatcatgatgataaaactattgctttccatttctatggaaagattgaacacgacatccaattgtag

SEQ ID NO: 52973 - DNA, 567 bp, Glycine max
  Peptide Sequence Number=SeqID_169751
atgacaggagaaaggtgtatattccaatgtctgacccttatgcatggtagaacaatcactttcaacgaaaatcagaaaggaaagatagttggagtagggctcaaacacaatatgcttagcataagccaattatgtgacaatggacatgatttttcctttaagagagaaggtgtgtcgtctaaaacaaaaatgggactaagcttttttctactaagaggaaagcttggacgtgccaagttgaagttaatctcaaaggtacagaagcatgacctcgtaaaaggattaccaaggttgtcaatcaaggatgattttcttcgtgaaacatttcagaaagggaaacaagctaaaaaatctttttctagcaagaacattgtttccacctcaagacctcttaaattgttacatcttgatttgtttgtcccaactagaacaacctctgttagtggaaaaagatatggtctaatagtaatggatgactactcaagatggacatgggtaatgttccttgctcacaaagatgagtcctttgaagtcttatttaaattctgcaaaaaggattcaaaatga

SEQ ID NO: 52974 - DNA, 114 bp, Glycine max
  Peptide Sequence Number=SeqID_169752
atgaaggcatcaacttttatttcgtataaaataagagtgacagaaggagatgtagcaactgaggagaaagaggtacagtgtagagatagcaacaaccctgaataccatatttga

SEQ ID NO: 52975 - DNA, 174 bp, Glycine max
  Peptide Sequence Number=SeqID_169753
atgggggctgcgttaaggatctcaaaggaactggccatgggaggtacatctgcaacaactgtaattgtgctctgttgtgtcttgacttggttgctagaagtccttcacgttgttggagtcaaattcatcttcgaaacgccaactccttatgttaattacgtgaaccaaatttga

SEQ ID NO: 52976 - DNA, 402 bp, Glycine max
  Peptide Sequence Number=SeqID_169754
atgtccaaagccattggatgcctctgcgaaggaagcacatactatgaaggatgggagaaggcctacaactcttgcatccctagagccctctacgcaaagaatgatgacaaagtaggagatcagaaagccatcacatacaatcttttgtgtaacagggccaaaatctgggcgaatatgctaaacaagagtgtcctccacaaggtgtacgaggaagcagtcaaacaaagaaaacaaaataggcttggcaaagccatttcaaacaaagatagaggtctgaatagctttggaataaccaagaaaattcaaaagattatgagagagcaacagcaaagaaagaaaaccataatacaatcccatcggcaagaagaagaagaagaagaactccttgccaaagaagcatga

SEQ ID NO: 52977 - DNA, 540 bp, Glycine max
  Peptide Sequence Number=SeqID_169755
atgaatcctgaaggtggcccagctggactagctaatgcaaacaaccaaaatgaagtgatccttcatctatctcatgatcttgaatcactgagtctgcttccttcatttcccgttgatgaaagtatgcaaaggttcaatgaagggcttcctcatcagccacaactgaatctgcccaacggtccgaaaactgttgttcctcttcacgagttctctaatgtggcattgggatccaacatttctccttcaaattcccttgctggaactcctcaaaatccttccaccaatcttaatttgtcactagcctcaggcttaggtcatcagaatgcaataagatctcctggtatgaatcctagtaaccttcttgcaccaagacatgcagtccaagagcaaggcatgcgtagaggcacttcaacaaacattgtgcacttacgaaccaagagaagcttcagtgactatgtttttcatgaatttcacgtgggtgaaagttcgaagatgggtgaacaagctgcactggccaaaagacgtgatactcgattctaa

SEQ ID NO: 52978 - DNA, 809 bp, Glycine max
  Peptide Sequence Number=SeqID_169756
atgaaagacaaaggtggagacagccatggaagaagaaatcaagccattgagaagaacaacacttgggagttatcaagccttcccaaaggtcatgaagcaattggagtcaaatgggtgttcaaaataaagaagaatgcaaaaggagaggttgagagacacaaagcaaaacttgtagctaaaggttataagcaacaatatggagttgattatgatgaattgtttgcaccggttgcctgcatggagaccattcgtcttcttatttcctcggcagctcaaatgaagtggagaatttttcagcttgatgtaaaatcgacatttctaaatggctatcttgaagaagatgtctatgttgaacaaccaatgggttttgtcatcgaaggtcttcaagagtcttgtgggagtttaaggtatctaaccaatacaaggcccgatattctatatgcggtgggagttgtgtgtcactttacggaggctcctacctctcctcatctaaaagccgcaaaaagaattcttcgttacttgaaagatgttgatgatagaaaaagtactaccggatttgtattttttatgggtgattgtgtttttacatggagttctaagaagcaaggaattgtgacactttctacttgtgaagccgagtatgtagctgcaacttcttgcacatgtcataccatttggctaagaagattgttggaggaacttcagttgttgcaaaaggaaagcacaaagatctatgttgataatagatctgcacaagagcttgccaagaatccggtgttccatgaacgaagtaagcatatagataccag

SEQ ID NO: 52979 - DNA, 916 bp, Glycine max
  Peptide Sequence Number=SeqID_169757
atggcagcggcgacgataatctacttttatttttttctcttctccttcgtctctttccaccatttattgttttctttcgcagctagttctaagaccaggatcacgcagggcgtcacgatcagggacaaagagcatgaaacattggtgtcagaagagctcaactttgcgatgggtttcttcagttccgacaactcctcttcccgctacgttggaatttggtacgacaacattcccggaccagaagttatatgggtcgcaaaccgcgacaaaccgatcaacggcaccggaggagccatcactatttccaatgacggcaacctcgtagtcctcgacggagccatgaaccatgtttggtcctcaaacgtttccaatattaacagcaacaacaaaaactcctcagcatcgcttcatgacgatggcaacctcgttctcacatgcgaaaagaaagtggtttggcaaagcttcgagaatccaacggatacatacatgcccggtatgaaggtgccagtgggtggattgagcactagccatgtcttcacttcatggaaatcagccacggatccttcaaagggaaactacactatgggggtggatcctgaagggttacctcagatagtggtttgggaaggggaaaaaagaaggtggagaagtgggtattgggatggtagaatgtttcaagggttgtccatcgcagcaagttatctttacggtttcacgcttaatggggacggtaaaggtggtaggtatttcatatataacccgttaaacggcacggataaggtgaggtttcaaatagggtgggatggatacgagagagagttcaggtggaatgaggatgagaagagttggagtgagattcaaaaagggccttttcacgagtgtgatgtttataacaagtgtgggagtttcgcggcgt

SEQ ID NO: 52980 - DNA, 441 bp, Glycine max
  Peptide Sequence Number=SeqID_169758
atggaaaattcagcatcttcaagtggtagtgtgaatgtttcatcaaatgtctgccatgctccagtagtatgcaattgtggttctgaaagcaagttgattatctcgtggtctgatgataatccaggcaggaggtcgttctatggtaaatataatgcatccggaagaaaatgcaaatatttctcttgttatgaccctcctactaatgatttccatgcaaatctatttaataagattaaaaaggaaattaaagaattgaaggctacattggatgcacacaatcaatatgccatagacaatgttgctgctacaagtttgttgtccagtgttggttatgagagtattggtgaacttcaaaatgatattgaaaatttgaagatagaagtggcagtacaaaaggtagaactggacattaagcatttgcaactagagtcaaaagaatga

SEQ ID NO: 52981 - DNA, 357 bp, Glycine max
  Peptide Sequence Number=SeqID_169759
tgtgaagagaaccaaggggaggaacatcaacaagagttgccaagggtatctgtaatggaggtattcaaagacgtttcagatgtgaaattaatagtagagtatctgaaagtggttgtcggtgatttagcaagggttgttgttaataaccagatgtttagcccgtcacacacccctactggagtggcagtaacaaataccaatttaacctctcccatggactcgtccaccactaagaggagagaaacacaagcattggttgacaagttggcttcctctgccaaaaaactaataggaaagaagaatgttgctggtgctgctgagaagacaatccaatccaaggaagcttttctcatataa

SEQ ID NO: 52982 - DNA, 381 bp, Glycine max
  Peptide Sequence Number=SeqID_169760
atggcaagcaatggagcggcatccttccatgttccacttctaaagggaagcacctatgacaatttaagcatcaaagtgaaggcccttcttagagcacatgatgtttgggaaatggattcaagaaagagagacaagaaagctttcttcctcatctttcaagcattagatgatgatgcgttcgagaatatttctgatgcaacatccattaaggtggcatgggataagcttcaatcctctcacaaaggagaagacaaagtaaagaaggtgtgtctccaaactctaagagagtgtaaggaagaagaagacaaacacaagaattttatactggttcggcaacaacccgtgcctacatccagtccccaagcaacctacggtccttga

SEQ ID NO: 52983 - DNA, 186 bp, Glycine max
  Peptide Sequence Number=SeqID_169761
atgaatgaaaaagtgaaggttattctatggatgaatgctctcctaacacctaagcttttgaatcctagaaaaaccatgaattgctggcagcctaaccccattacaagtctagaaagagatgaaatgcaaaggttggaacttgtgttggttgtttatgatggaataagcctaaacactagagtttga

SEQ ID NO: 52984 - DNA, 759 bp, Glycine max
  Peptide Sequence Number=SeqID_169762
atgaagtcagcatacacaaccgcagatggtacaaataatccagcaactcctaagtgggttgaagtcaagagccatgtacaaagcggagggtatgagtgtggctactacgtgatgcattggatgtggaacatcgtcggtgggggtttaaagaatgattggagcatgtggtttcttgatggaacgacgttagacaacgaaacaattacaacgattcgccagaaatgggcagcatattttcttaaagttcaaagcattcaatgtacaaaatttagagtgaatgatggggaggacaactacacaactcttccaagaatagacccttctgttcatcatgctcggcgattctatgaaaatttggtaccaagttacacagtatgtgaggttgagtgcccagaccattcattttgtaaattcactgatgatggccaataccttataagtttcagcagaaatcatcacgagttgattgtttataggcctagatggctttctttttcatgcaaacatgaagattgtgataaacatgatttgccatcaagagcaaagagatttgacagttttttcacccaattatattgtgtagcacttgcttcttgcaatgaacttatatgtaaagatttctttctttactggtttctaggagacatttttggggcacactggtccaatcagtcggtgttgcttctctgcatctggaaacaatattgccagtgcttctctggatggaactatcatgtatctttttgggagttgatgtga

SEQ ID NO: 52985 - DNA, 543 bp, Glycine max
  Peptide Sequence Number=SeqID_169763
atggagcttacatcaggagggtatatcccttgtggatctttggcttgtaaaggtttttacaaggttgaaagaaatcttaagaaccgcaggttgcttggggactggataactctggcatggtggatggactctagtggcgatgaggggtctaatggtccaaacaacacgcagtttaaggctgccattgctaggtctttggggtggaaaacaaaggaagcgttgatgatgacgcaattgtctagggttgatccaaaatctatgtgccatttgaggagcacgccgtctttagtgtcggcagtgagggaggaggtggaggaatgggatgtggcagtgtgtaataaggataattacttgaactatcacaagaaggttattgatcttgtgaaaattggagggctgatcagctacgatagcaccctatggaatggatttgtggtagccttacctgatgcgcatatgaaggattacatcaagcattatcgtggtcatgtgattgagttcaacaagcatcttgctcaagattttgggattgagatttgctag

SEQ ID NO: 52986 - DNA, 315 bp, Glycine max
  Peptide Sequence Number=SeqID_169764
atgcagaactatcaacatgcaaagagatctgattctgcaaaagccgggatcaatagaaaacgtatcatgcagcagaagcgacatgctcatgctcagtcatcttcacaaccgacagttaactacacttcagaatatgatatgattgcgtctaattcatcagaaagtgaaaattctgaatccacacaagggtctaattttatgactttctatgaggattgtcaatctccaactaatcagcctgtaatcaacactgaaagtaatgactataattctgatttgcagtttcagatgctactgtacatgctcttaaattaa

SEQ ID NO: 52987 - DNA, 219 bp, Glycine max
  Peptide Sequence Number=SeqID_169765
atggagagaattgagagaattaagaaagaagaagaagaaagaagaggaaacaaagccaaggtgctatcaaatcgcaaccgcgatcattccgtacatcgttccttgttcggtgttcttcatgtgactgtcgacttaaagaactatgtaggtctgaattcgtcatcgtacctaaggatacgtaggagcaaggaagcccccatgtcgaccccaaaaaaataa

SEQ ID NO: 52988 - DNA, 645 bp, Glycine max
  Peptide Sequence Number=SeqID_169766
atggccgtcgcgcaggtaatcgaacagctcggcgtcgcccttcaggcccagtttgagcatggcgtcacccttctgccggctgatggtgctgacgctcttgtgcagctgcagcgagatttccttcacggtcatgccggtgcccagcagccgcagcacctccacttcgcgtggcgacagcggcttgccgtcgccctcgcgcatgcgccagctgccggcggcctcgacccgctcgcgcaggcttcggctgatgtagggctggccccggtagaccgactggatggcctgcggcagttcgtccatcgacgaactcttgtcgaccaggccgagcacgccgctgtcgagcaccatgcgcaggatcgccagattgttggagacactgagcatcagtacaggcaggtcgggatggcgccggcggatcatgccgatcatggcgaagccgtcggcctgtgggctgccgggcatggagtagtcggtcaccagcaggtcgcagggctggctgccaagcagggccatcagcgcctgtgcactgtcggcttcgccgaccacgcggccaaccccgctcgattcgatgacggcgcgggtaccgatacggaccaccgggtggtcgtctgcgatgatgatgcgcaagctcatgctctagtatga

SEQ ID NO: 52989 - DNA, 402 bp, Glycine max
  Peptide Sequence Number=SeqID_169767
atgcgtagctgggctgttcgcgggctggtcctgctgctggccgtgctggcgttgcctgcggcgctggcacaggcggtgcctggaccgttgccgctcaccccgctgcagcgcgagtacgttgccgcgcatccgagcatcgtcgtgggccagtatgacagtggctggccgccgttcgagtccctccgtgatggccagcaggtcggcctcggacccgattatctgtcgcttctcgcccgtcagctaggcatgaaggtcgaggcgaggcgctattccgactggacatccgtgctggacgcggcatgtcgtggtgagatcgacgtggtgatgaatgtcggtctcagtgccgacctcacccgctgcatggtctataccgccgcttatggcgaggcgccgctggccctg

SEQ ID NO: 52990 - DNA, 744 bp, Glycine max
  Peptide Sequence Number=SeqID_169768
atggtttctgatagcaatgacacaactcaaaatgttaacattcaaaatgatgaacttaaagaatatctagattgcagatacatttctccctgtgaagctgcttggagaatatttgcttttccaatccacggcagaaagcctggtgttgagagattgtattttcatcttccagatcaacacaatattctttatgaagatcatgatgatatagatgatgtactatcgaaaccaactatttcagattcaaaattcctagcttggatgaacactaataaaggttttgctaaggccaggaatcttacatattcacaatttgtgtcaaagtttgtatataataaaagaaacagatcatggcaacccagaaaaaaaggatataccattggaaggctcatatgggtaccactaaccacaggagaattgttttatttaagaatgatgcttggtagctgcaaaggacctacttcatttgaggatatcaggactattgcaaatatccaatatccaacatatagagaaacatgttttgcaatgggctttctacaagatgatagagaatatgttgaggcaatcaaagaggctaaggactggggcacaactaattatctaaggaaattgtttatattaattctattaacaggtgccatgaccaaacctgaagaagtttggaaccaatgttggcattggctagctgatgacattgcatatcaatatagcaaatcaacaatgaactcaggtaggccgtga

SEQ ID NO: 52991 - DNA, 396 bp, Glycine max
  Peptide Sequence Number=SeqID_169769
atggcgcctactaggcatcctctggacccgaagaattccaacagggccctggggtttctggctctaatcacatgcctctgtcagtcctacggagttcctgtcacccccaacaagtactgcacgcctaggcaggcgcagggtgatgcacatcaggccatgggcgcaccgccaccacctcggcagaccgatccgactgggccactgggtgtggatcgttatccacagcatttggttcgccagcaggcggccaaccaccgcggacaggtgcagatacatgagtgtctctatcggttcagcctcagtcagcaagggcagcgttccatcccttttgcatgccctaccctggagcagtttggggctgaggtcgcatggcctggagactggcccgatgcctag

SEQ ID NO: 52992 - DNA, 414 bp, Glycine max
  Peptide Sequence Number=SeqID_169770
atgaagagaatgatggaaagtaatgcggccacagctgccatcgccagtgccaccgctgaggcagatcctacccatccatgtgccataaatcaagcgtatcaacccatcccgacatggtgggacaaggagaagatgttgagcagcaccgacagtccacacatggggcataataggaatgcttacccctacagcttaccccccaattatatgccacccaccatgcatgtgcctaatgagaatgttaatcatgtcattctcgttaccgttgaaggtcagcaaccccagcctataggaggcacccacgaagaacctcgggagtgtgctcaaggggacctcgacccatatcccactttcaccaccgagggaccaacatataatgctatgccccagcctaacaccgcgggagctccttaa

SEQ ID NO: 52993 - DNA, 243 bp, Glycine max
  Peptide Sequence Number=SeqID_169771
atggatttgggtcctctcgcactaaaaataattggagataatcaccaagaattttttcaacgacccctatcttgcatcacccgtcaccatcgtgtatggcagtctttgtgctcatcaccacccatagccaccgcaagtgccaccccatatgtaagaaagaggaagaccaaggcagaagaaatgtggggagaaagaagaaaaggatacgaaaagggtacaacaagagaaagaaaaaaaggataa

SEQ ID NO: 52994 - DNA, 735 bp, Glycine max
  Peptide Sequence Number=SeqID_169772
atggctactcttgatgagaacgatcttttagctacaatgagtaactttattacgttgtcgggtggttatgggcaagcccgacagggtgctcccaccacaagtttcctcggcctatcaaagccttactggtcagcgtataataaggatcctcttttcaaatccatttggagatggtcagggctagagaggaagtgcattcatgcttgggaatgcgcaaggcaagacctttttacaaattttatgagaacgacaagagggataacaatttctaatctttgctctatatgtaatctttttcccaaaaatgtgattggatgcctaagggattgtcaatattcttacaaaatatgggagtgtcttgcagaaggagggagtgtaaaggaattatgttacgaggatttgaatccttcgttgctcaagaatctcatgcatgttagagcctatgtgaatagtgattggaatgtcacctttggcattcctttgtatagtttctggcgaaatagaaatgaggtgggtttttctggaaccgcttcatctgttggaagtatcgtgacccatgtaaaagccttgacattcaatgttttaaggtttaggaaagccacacaagttactcaaatgcctacccaaggacaattttatagggttccttcctactggcaatcaccagaagtaggggagttcaatctgaattgcaacgcagcggtaactagtggtggagaattggcatgtggatga

SEQ ID NO: 52995 - DNA, 282 bp, Glycine max
  Peptide Sequence Number=SeqID_169773
atgcatctagggatggacttaccttcaaaatttaaaggagaccgatgtcctagaacactaggtggtggtgatgctgtgcaccagtttccaaaggaaccttgccaagactctaactctggctatggcataacctttcgatccccaagagaccccaaacacaagttctgggaaatttccaacaatgcttctctgtgtttgtcctcaaagaggtccattgataatgtgctaagtactccctcacatgcacgttctgtgaacaatggggagaagccttactcctga

SEQ ID NO: 52996 - DNA, 432 bp, Glycine max
  Peptide Sequence Number=SeqID_169774
atgagtatcacatcctccaccgcttcaaccagaaccagatatccaattgtaagaccacctgcaatcatccaattcagagcagctttgcacaatgaccagacattcatagaaatacccccattctaccatgaacaatgggcaccaaattacccacaagaggtccggttcaaatacaatggagcaacctatccaatacgagtccaacaacaccgaggcagatgtttttttgcagatggactcacagacttcagagtagatttaaaaatctacgagtctatcatcatcaacttctttgcctgcgatgataacaccattttttatctacactttacacctcccctgaatcaacagacatgtggcagaccaatacttcattcccgtcaacatatctggacaacagaaataacccaatgtatactgggtgctccctaa

SEQ ID NO: 52997 - DNA, 219 bp, Glycine max
  Peptide Sequence Number=SeqID_169775
atggtcatcattttgcctaggggaaatcttgttgtctggttttgttccttgcataatagacctgacaactatctgaaagaaataattaacagtcaacaacatcaatgttttaatgttcctttcaatggtgctttgaaaggacttgacgatactccacaacctaaatccaaggttgtaggtgctaggtggattgttgttaaattaacgttgaatctctaa

SEQ ID NO: 52998 - DNA, 516 bp, Glycine max
  Peptide Sequence Number=SeqID_169776
atgttggacttggtgactcatggtgctagttttgatggtctagagaaaaagacagaaatcaaagaggatgagaaaaaagctcaagagggtggtaacaaaggtgaattgacagaggatgaacaaaaaaatgagatggatctagggacatttactccaagccaaattgctccactattcgtttcaagactcaactcttttgattctccaaaggagttaaatggcatagaaatgcctggttctgccccatctgctttgagaagaccatttgatattccatatgatccttttgaggagaaacttattctcattggggatagttttgatccagaattgaagggtttgttaatagaacctagcaagaagaccttgaagcaagagggcacaggttggcacacccaagagtctgaaggctttaagttaatggaaaaagcaacacaagaggaaattcaggtagaggaaatcatgacaagcttgaacaattattattatccaaagaagccagtgaaagagaaataa

SEQ ID NO: 52999 - DNA, 135 bp, Glycine max
  Peptide Sequence Number=SeqID_169777
atggcagtgacaatgatggccagagggtgcctttgcaagagtgagcatgagggatcagcgaaaagcaagagtttccgagagactgatgggcgcgcgaagatacaaagcttttcagtttgtaatataaaaaactga

SEQ ID NO: 53000 - DNA, 792 bp, Glycine max
  Peptide Sequence Number=SeqID_169778
atggcaagtcctggatctatccttgacattttactccaaagcttcaaatcaggtgatgggacacaaagattgctgaatcacatggtgatcataaccatggaccctcatgcttttgagtactgtaggtccttgcacccctattgcatccacccctccatatttccacatcattttgtcaccaaaagaggatccataataacaacccctgatcaaaatttattcacttggacaagaaatgatgttttgtttgaagtgattcaattgggttacagcataattttcacggaagcagatgtactgtggcttagaagtccacttataaagttaaatccaagtaatgaactcacaatttcatgtaatgtcttaagtgatggacaaagtggaagttacctacacggtgggggaatattcttcttgaaagcaaatgccatttcccttgagttcttcaagtattggaaattgactaagtttatgtttccaaacgatcccgcagaagagtccttgtgtaacacaataaaagcaaggcaagatgcagctgacttgtatggctttcgtgctcagcttgtaaatacaagctattttggtgggttttgtcagccaagtaagaacatgttaagggaggcttataccattcaagctaactgttgtgatgatctagaaagcaaagttcatgacctgaggattgttcttggtgattggatccgattcagaaatcatgcatcaggggtcaatgctttggacaaaatggatttgaggtggccactgaagtgctccacaagaaattatacttag

SEQ ID NO: 53001 - DNA, 435 bp, Glycine max
  Peptide Sequence Number=SeqID_169779
atggttaaggaggagtgtaaagaggtaagtgtctcctccaaaaggttagttaagaaggaaagtcattttgcaataaagacaaacattaaagaaacttcccttcttagacaacctccaaatcttctcctttgtaaaagaacacttgttagcactgccataatacctcttgagcttaaggttattcctcaagtaaaggagttgttggatgagggtttggttcgtaagagcttaaatccttgtgctttgttggtgcccaaaataggtattatgaggcaccaaatccctatgataggtggtatgatgaatgtgttgagtggtgcaaccttcttttctaaaatcactcatgcatccaacatcttaatggttcgcatgcatagggactcattaggtagtgttggatcaagtggcctcagaataattaagaacgggggttga

SEQ ID NO: 53002 - DNA, 624 bp, Glycine max
  Peptide Sequence Number=SeqID_169780
atgacaaggagcagaatgacaattcatgctgatgaaggtagagttgaagagaaggtggagggatataaacaacaatcggcagctgagccgacactagaaccagtttctgatcttattgaacttaaggaaagagagattacttcagctgaaggcaaggaagtaccatatccattggtaccttccaagaaggataaagagcgacacttagccagatttcttgacatattcaagaagctggagatcactttgccttttggagaagctctccaacagatgtcactctatgccaaatttttaaaagacatgctgatgaagaagaaccggtatatccacagtgacacgataattgtggaaggaaattgtagtgttgtcattcgacgcatccttccaccgaagcataaagatcctggaagtgtcaccatcccgtgttctattggtgaggtcgctgtgggtaaggctctcattgatttgggagcttgtatcaacttgatgcctttctccatgtgccggcgacttagagagttagagataatgcctactcgcatgaccttacaattggttgatcgctccatcacaagaccctatagagtgattgaagacttttggttagggtcaaacatttga

SEQ ID NO: 53003 - DNA, 999 bp, Glycine max
  Peptide Sequence Number=SeqID_169781
atgaccacagtcagacttgtgttatccctagctgcttctcagggttggcatcttcatcaacttgatgtcaacactgcttttttacatggtgatttacatgaagaggtctatatgaaggccagcaggcagtggaatgccaagcttacttccaccttacttgattcaggtttccaacaatccaaggatgattattctcttttcactaaaaagtctcctactggcctcactattgtgcttgtttatgttgatgatttggtgctaactgccattgatcttgctaaaatccagcaactcaagcagtccctgcatgccaaatttagtattaaggatcttggaatacttaagtacttccttggttttgaagtagctcgatccacctcaggtattttcttacatcaaagaaaatactgccttgatcttcttcaagacactggttttcttgctgccaaaccttgctctttacctatggaccctaccctaaaattacacaaagcttttggtgttcctctttctgattccactgtttataggaggcttatagggcgcctcttgtatcttacttacacaaggcctgatacctgctatgttgttggcaaattgagccagtatttgcaatctcccacaaacattcacatgcaagctgcccaccatgttctaagatatctcaaaggcactgctggtagaggcttctttactaagattggggagccagtattatgcataagaacttcaaatgcctacattcagaatctggacacaaccatatctgtcgtaaggatagttaagcgtgtttttgctaatgacttaaacccttatgcagttgagtatctagaaagaaattgtgttctaaacaaacttgagaggaagattaaggtctttaacatggatggaaggaggttcattaaagctatgtatgacagtgatatttctcagtccatcacacaagtggttatgaacttcccaagtgaagctgcagaatttctaggttgcctttcctga

SEQ ID NO: 53004 - DNA, 219 bp, Glycine max
  Peptide Sequence Number=SeqID_169782
atggcacggcgcttgctctcatcttcaatggacaaaatagtgcgactgtggcatttgtctaacaagtcttgtctgaaagttttttcccacggtgactatggtatttatcttagactaattggaaagaggatttctactccctcagatgcaatatctgttggccttgaaacgcattatgtgccatctggaaagttaagtttatttaaggatgccctctag

SEQ ID NO: 53005 - DNA, 885 bp, Glycine max
  Peptide Sequence Number=SeqID_169783
atggaccacggccacatgaagggcatggatcatggcagtatggccgggatggatcacggcggcgcgcagggtaaagccaaaccgttcgacttcagccacggcaacatgatcaacggcaaggccttcgacatgaccaagccgatgttcgccgccaaacggggccagtatgagaagtggaccatttccggcgagggcgacatgatgttgcacccgttccatattcacggcacccagttccgtatcctggtggcgcagcgaagtgctggtgcgcttcgaccatccggccagcagcgaacatgcgtacatggcccactgccacctgctggagcacgaagataccggcatgatgatgggcttcaccgtcggcgaatgatcgcggcccgtcgctcaggtggcggcgcgctcgcgtcgccaccggcgaaaggctatgctaaactctgcgcctttcttccggcaactgacctgaatactatgaaacacactgtagacgtaatgatttccgagcaggaagttaagacccgtatcgccgaacttggccgccagatcaccgaacattaccgcgacagcggcagcgacatggtgctggtcgggctgctgcgcggctccttcatgttcatggccgatctgtgccgcgccatcgacgtgccgcacgaagtcgactttatgaccgcctccagctacggcagcggcatgtccactactcgcgacgtgaagatcctcaaggatctggacgaagacattcgcggcaaagacgtgctgatcgtggaagacatcatcgattccggcaacacgctgaacaaagtgcgcgagattttggcgctgcgcgggccgaaatcgctggcgatttgcaccttgctggacaagcctgagcgccgtgaagtgcag

SEQ ID NO: 53006 - DNA, 408 bp, Glycine max
  Peptide Sequence Number=SeqID_169784
atgttcatgaattttgtggagattcttgtgaatcagaacaaagctgcacttagccctaaaaagagtatggaaaattgccatgctgaatatgattttttgtcagagttcggcatgcaacctacttattcaaagaaagctgctaccaaaaacataaagtctttggtttcttgttcgaatcagttgctttatgttttgtcagatttatttatcagtccacttcccgaaaagcacttttgtttaaagggtgcaattgggtgccttgcttctgtcactgattcttctgtaaccaaagaggttttagtgtctctggttaagaggtttctgtttgtagattgtgaaggtgaaatattgacaagtcctgtcggagtggtagatagtgatcaaagtgacttgaagggttattcttag

SEQ ID NO: 53007 - DNA, 321 bp, Glycine max
  Peptide Sequence Number=SeqID_169785
atgtcgtcgcggcaagtggtgaagcgtgctaaatacaaaaccatactgtcaaagaccttggcacccctgtgtcctcaaattgaatcagcaaatccactgaaattggaatcacttttcagcaggcttccaaatatgttcaacatagttatcctctctattcatggatactttggccaagcagatgtcctaggattgccagacactagaggccaggtggtatatattcttgatcaagtaagggctttagaggaagagctactccataagattgagctgcaaggccttgacgtgaagcctcagattcttgtggaaagctactaa

SEQ ID NO: 53008 - DNA, 306 bp, Glycine max
  Peptide Sequence Number=SeqID_169786
atggcgcaaagtgaagtttacgaaagaggaagaggctttcatggcaacaatagctcaaatttggaaggtgcatggggtgtagaaatcaaagaaggaggaaggaacctttacacctttaggttcctacatgaaaacgatcgagcacaagttgaagaaggagggtcatggtgcttcgatagaagattggtggttctcaatttatcaatgaatatagaagaaaatcctgggaaggtaatacctgaaactctatgtctaagtgtaatgactgatgtaagagactgcgttgataaggaaagaagggaatga

SEQ ID NO: 53009 - DNA, 525 bp, Glycine max
  Peptide Sequence Number=SeqID_169787
atggaggtttccttcgttccttcctctctactacagctatggcgaaacctaggcgaggtcgtggctccccctccggttccgtttctagctcctcctttggttcctctttcccctccgactcccgttcctccagtcgctcacgctccttttctcagtcttgttctccctcgtgctccaaatcctgtttcccctcctcctcctcttcctcccgaagctcccgcagcctcagccgtcccccgcaaaggagccactgtaagggggttttggagcgccgccagaaccatcgtgttttgcggatctcgacgaggctgtggacggcggggagtggcccaagagggatttgacggcggcgaaaggggagagaaagagagagatggaggctttgcagctgcactaattgatgatcctatgtgggtgatgaacactgtccttgttgaggctaaggtcaacacacttggtgccatatatgaacgtggattgattggaacctatatgaagtggtatgtcatttcttccattttctaa

SEQ ID NO: 53010 - DNA, 2664 bp, Glycine max
  Peptide Sequence Number=SeqID_169788
atggctgaccacggaactcacaaaacaaccaccgacctccttgaagaggctatagtccgcctaaccaacagtcacaccgccatcaatgaccgctgcaacgacctttccggtaaggttgattccatactcgagcatcttcgtttacataattcaacctctcacgctccttccacaccaacaaatccacccaaacattcacgaagcgcagtcaaaattgatatcccaagattcgatggacgggatccgttgggatggatctttaagatcacgcaactattccaataccagaatacaccagaagatgagcgcatcacggtggcatcgctgtacctcgacggcgccgccctaagctggtatcaatggatgttcagcaacgggctgatcacatcctggaatggattccttgaagcgcttgaatctcgattcgctccaaccttctatgaagatccaaaaggagctttattcaagttaactcaacgtggaatggtgaacgattatctcaccgaatttgagcgtctggctaaccgtgttataggccttccacccccatttttactgagttgctttatatctgggttgaatcctgagttaaaacatgaagtattggctctccaaccaatttcacttttgcaagccacagccttagccaagttacaggaggagaaattacgtgatagaaccactccagttccacgcaatcttccaccttacaaagcctcttccagccctagtcctcccactgtcgtcaaacccatacctcttttcgtccaacgtacgccgacagaaatggccttccgcagggagaagggtctctgttataactgcgaagagaagtggagtgcagagaacctcgaggtagaagacaatcgcgatgattctacggctgacaatgaccaattccagggtgacgctgattgttcacacattagcctccacgccctcgccggagttccttcgtcggaaaccttcaggatttatggtagcatcaggaacgcgaagctcacaatcctggtggatagtggaagtactcataacttcctccaacctaggatcgcacaattccttcgtctccctactgaagctaaccacccacttcaggtcatggtgggaaacggagccatgctaaccagtgatcaagtttgcccagacaccccactcgtgttacaaggccaccctttcaccatatcgttccatctccttcctataagcggtgcagacgccgttttgggcattgactggctgaagagattgggcccagtcaccaccgactttactgagtccatcatgcgcttccgatacacaggccgcgacatctcattacgtgccgacgtcgcgattgggcctgaacaggcttcaacaacccaactaaaacgtcttattcagacgggctcgacctctgaattttaccaactacacgttatcgaccccaacccacctgacccatccaatgtcccgcaccatattcactcggtggagcgcttacttctccgctatgctcacctcttccaacccccaacaaagcttccccctcctcgacagatagtccatcgtataaccctgcaaccatcaacagctccggtaagtgttagaccttaccgatacccacactttcagaaaaatgaaattgaacggcaggtttcagaccttctttccgccggactgataaggcccagcaccagtccttactcttcaccggtgttactcgtgaggaagaaggataacacatggcgactatgtgttgattatcgagctctaaactcggtcatggtgcgcgaccgcttccctattcccacgataaaagagctacttgatgaactgggctacgcttcctggttctccaagctggatctccggcaggggttccatcaaatattgatggggaagcacaacgtagagaagacagcgtttcgtacacataatgggcatttcgagtacctcgtaatgccgttcgggctctgcaatgccccatcgacattccaatccgccatgaaccagcttcttcaaccattcctcagacgtttcgcaaccgtgttcttcaacgacatattaatatatagcaactcgctaccttcccatcttcatcacctcgaaacaatctttcgaacccttcagcaaaacgagttcttcctcaaacgctccaagtgcctgtttgcacaagagagcattgaatacttgggccacattgtttcagggaaaggtgtaaaacctgaaccctcgaaaatccaggccatgctacgatggccaccaccttcaacgaccaaggagctgcgtgccttcctcggactgacaggtttttaccgcaagttcatcaagaactatgcttccattgcacttcccctcaccaggctcctatgtaaggatgctttccagtgggcacctgaatctcagattgccttcgatcaactcaaggcggccatgaccagcgcacccgtgctcgccctacctaacttctctgatccattcgtgatcaaaaccgatgcatccaatacggccattggtgctgtgctcatgcaacatggccaccccctggcgtatttcagtaagactctcggccctcatttgtctcatgcttctgcttatatccacgagttgcatgccattgtagcaacggttcggaagatggaggcaatacctcctaggtcgtcccttcacgatcatgactga

SEQ ID NO: 53011 - DNA, 483 bp, Glycine max
  Peptide Sequence Number=SeqID_169789
atggctgacagggaagattctaactcaaggatctttcaacaacaaggctttcatggcaacaatagtgcaaatttggaaggtgcatggggaagattggtggttctcacttcaatgaatatgaaagaaaatcctggggaggtcgatcttaatcattgtccagtttggattagggtttttatgatcttctggtgggtttcaaaacaaaggagatggcagagcgaattagcaaatgaatggggaattttatcaaatgggataagtgcaatgaaagtgttatggaaaaatctttcaagaataagggtaagagtggatatcactaggccactaaagaggggaattactctaaaacttggagaaaagatgataaagaagattttgttcaaatatgagagatttaggaagtctttgtttcttgtgcaaatgcttggatcatttgatgaagaagtgactgtagagaagaagatacaaaagaaactgatctag

SEQ ID NO: 53012 - DNA, 300 bp, Glycine max
  Peptide Sequence Number=SeqID_169790
atggagccagactcattggcaagacaacatgaattttctctatatggatctacctgcattgagggagggttagttaggagtcttaatcataagagacagggtacgatgtggaacaatgccacaaagtggagtttacgaaagaggaggtttagattgaagcttcaagaaagagtgggatctttcaacaacaaggctttcatggcaacaatagcgcaaatttggaaggtgcatgggggtgtagaaatcaaagaagcaggaaggaacctttacacctcccggttccttaataaaaaggattga

SEQ ID NO: 53013 - DNA, 179 bp, Glycine max
  Peptide Sequence Number=SeqID_169791
ggtatctgtggctcagtggtatttcgcgttcaatcgcttataattggtctcaacccaacatgaaaactagtgttaggataattcgtgcaagttcttgttacgggaaagttcctgtttctcgcaaaggaaagagattcgtgaagccatcgaaggttacaaaggatatgtatactgatcgt

SEQ ID NO: 53014 - DNA, 156 bp, Glycine max
  Peptide Sequence Number=SeqID_169792
atggttagactatgttctgttatgaccccgaagaaactccctgctaaaagagttaagaagaccgttacaggagaaggatcaagtacggctccacctatagaaatcgagtttgatgggcacttctttcaaagtgaagagctccagcactgctttgaa

SEQ ID NO: 53015 - DNA, 327 bp, Glycine max
  Peptide Sequence Number=SeqID_169793
atggttgatcaaaagattacaaaagctcaaaaagtattagcttgggcagctcaaggcaaaaatagcaaaattgaggacacaattattggagcctcaaaaagagagcaaggttttgaagtttttaggatttatgtgaaatcctctttcatcggtcatggaagctgcaacaatcatggccattgctttggccaatggaggaacatatacaagcgccaatggcctatattctcaatctactcaattcactcatacatcacgatcatattgaaagctattgtacactgggaaaatggtagccatccatctacagggcatgacaaacaataa

SEQ ID NO: 53016 - DNA, 174 bp, Glycine max
  Peptide Sequence Number=SeqID_169794
atgtcggaggcgcggcggggcggggaaatctcgataccgtcaggggtggagattggggataaatctacgccccatcgagtttcgagggctggaacaggggaaaataggggtgacggctactcactacaattaagcgcaaacagatccaatgaaaaaggacaatatggtaattag

SEQ ID NO: 53017 - DNA, 800 bp, Glycine max
  Peptide Sequence Number=SeqID_169795
atgctggtgatgcaattacattgtttcaatcacttgttggttcaacatttgatagcagccagcttgtctttactgcttgtatgggttatctagcagtgactgaggccagactaaaggaactgagagaaaaacacctgccatctgtgttagatgtcatagaagaaagatcaaaaaagggaagggcttggaaggattcgaaagggcttgcatctaaattgtacagtttcaaacatgacccagggtcattggaagaggaaagaatactcactgaaggaagtgatacggtagctgatggaaatgtgcagttggaatcccattcctctaatttagatgaaatgctcaatagtctcaatgttgattcagaagtgggttccctaccacatctccaggaacaggttgagcagttggagcaggaggtcgctgagctacaacaagtcattgctgataagaaagaacaagaagctgccatgctgcaggaccaaaaagttactgaagatgctcgcagaagatcagagcaagatcttgcagctcataaatttgaagttcacgtgcttcaggaaaagtatgacaaggccatgcaatcaattgctgagatgcaaaagcgagttgttatggcagaaagtatgttggaggctacccttcaatatgaatctggccaatccaaagcactttcttctccaaggttccttgatgaaatcatgaaactgaataacaatgaagcagctggggcttcaatgaaaggcttgaagtctctgggtaagagaaatgctagaaactcactctttgatatactcttttga

SEQ ID NO: 53018 - DNA, 804 bp, Glycine max
  Peptide Sequence Number=SeqID_169796
atggcatctcttggtgtgcaagcagttcatcctcctccattaacatccacctccgacccacctcctctttttgatggcaccaccaggttgtacatcagttattcttgcccctatgcacaacgtgtatggatcgctcggaacttcaagggactaaaagacaagatcaatttggtccctataaaccttcaagacaggccagcttggtataaggagaaagtctaccctgaaaataaggtgccatccttggagcacaatggcaaggtgttgggagaaagtcttgatttgatcaaatatgtagatgaaaactttgaagggacacctttgtttcccagagatcctgccaagaaagagttcggagagcaattgatatcccatgttgatacattcagcagagacctgttcgtttcattgaaaggggatgctgtacagcaagccagtcccgcttttgaatacttggagaatgctcttggtaaatttgatgatgggccattcttgcttggtcaattcagtttggtggatattgcctatattccatttgctgaaagattccaaattgtctttgctgaggtgttcaaacatgacatcacagaaggaaggcctaaacttgcaacatggtttgaggagttgaataagctaaatgcttataccgagacaagagtcgatcctcaggaaatcgttgatcttttcaagaaacgtttcctgattgtgattggtttcttactaataatctctttgctacttcctttgcatttctactctgcagtctcaacagtgaaacgttgtattgctgcaggcttcctctaa

SEQ ID NO: 53019 - DNA, 282 bp, Glycine max
  Peptide Sequence Number=SeqID_169797
atgcatggttataattataccatatacgcacgctacctggaatcaacctccaatgagcgcttactcagcgtacctcttgggttcgaggctgtggaggagattgaaactgaagtgcgccatgttcggatgcgttggcgcgaagatgaagagagagaaggattagggtttggtgagattgttacggaggaggatgaaaggctctctctgtatcgacgttataaatcaacttcggttgccgctggtttcttgcaacatgtgagtgtttgcagtagtagccgttga

SEQ ID NO: 53020 - DNA, 168 bp, Glycine max
  Peptide Sequence Number=SeqID_169798
atgtctagtatcaccagcgaagccatggatcattcccttgaagagcctaacccttcacagctttctgatgctgagaagaagattctctgggccaagtttggcactccatcgaagtcattgtcatcagatgcatcaaaatcagacgagctaaagagaaaggctagctag

SEQ ID NO: 53021 - DNA, 798 bp, Glycine max
  Peptide Sequence Number=SeqID_169799
atgggattggcctctgttgtccacaacggcgtccgaattccattcaacttggagcacattcacactcctcctttcagatgctctgcacttcaccaccccatctcttccttttgctcagtgtaccattatcgtcctcctcaccgcttcccacttctgtgctccagacgaattggccaccacaattatgcctcagaagtaaagaggattagtgctcaacaaaatgatgacataggcaaagttgagaaatctcccactcaggaatctctgggaaatgaagattacagttcctccgttagaactgtagcattatgggtgtgcactgcagtggcatttggtgttggtttgggttttaaggagggttttgacaaggcatccgaattctttgctgggtatatattggagcaaagtctttctgtagataatctctttgtctttgttctaatattcaattacttcaaagtgccagttgcatatcagaatcgtgtgctttcctatggtattgctggtgcagttgtatttcgcctgacattaatacttattggaacagccaccctgcagagatttgaggcagtcaaccttctcttggctgcaattttactcttctcatcatttaagatggaaacacctgaatggttttatctccctaacaacatattaggaggttcatacttcttgttgtggtattcacagttctatggactgctatttgccagtgaagaagatgagtctgacttatctgataactttgtggtgaagacatgtcagaaatttatccctgtaacaagtaatattctctaa

SEQ ID NO: 53022 - DNA, 447 bp, Glycine max
  Peptide Sequence Number=SeqID_169800
atggcaaaggtattgggagaaattcttgatttgatcaaatatgtagatgtcaactttgaagggacacctttggttcccagtgatcctaccaagaacgagtttggtccttcttttgaatacttggagaatgctcttggtaaatttgatgatggcccattcttgcttggtcaattcagtttggtggatattgcctatattccatttgttgaaagatatcaagttgtctttgccgagctgttcaaacgtgacatcacagaaggaaggcctaaacttgcaacatggattgagaagaattgtgattggtttcttactgatatctctttgcatttctacactgcagtctcaacagtgatccttggattgttgcaggcttcctctaagatctatatagactgtaccaataaagagtcatttgcattaatgggatccatctcttcagtcaaataa

SEQ ID NO: 53023 - DNA, 297 bp, Glycine max
  Peptide Sequence Number=SeqID_169801
atgtacaactatcctaccgcattttttttacattccaacaagggatacatatataatagttttaaatgcacgacgaatgggaatgcacctagcaccaccgtagaggagaataggaggcagaggagaaacgttcgacaaactggaacacgcttaacaccatcacgaaggcgaagaggaacatggaggagaaacaaccattgtggatgcaaacaagaagacaaggcgatgacagtgaacaaggaacacgtgactccacctttgactgcgcagagaagacgacctagcacaataacatga

SEQ ID NO: 53024 - DNA, 228 bp, Glycine max
  Peptide Sequence Number=SeqID_169802
atgctctcgggaacggaagcttcacgcacactccagacatcttctcaaagatcccaatgggtgttacattatgccttagctaaccttgaagggttgttcctagtacccaatgtcatcacccctcccaagttcaaggtgccagactttgacaagtacaaggggactacttgccccaagaaccatctaaaagatatattgtcggaagacgggggcatacgcaaaagatga

SEQ ID NO: 53025 - DNA, 396 bp, Glycine max
  Peptide Sequence Number=SeqID_169803
atggcaatatcatcacatgcaacagggagctcagaagtcagttcctctttgcgtcgctcagaggtctctctcgttcacgctcgccagtccaaacgcaagttgaacttagctcatcagtgggctaagcgtagcttcagcgcgacagaagaatctgacagggcatcaatatcaaggctgcgcgctaagcgggagatcagtgcactaagcgcagcagttgtcttcagccaggctcagcgcacgactggcgctaagctcaaatacacttactcgcgcggagtaattagggacaatttgaagaaggcccagggcacaaaattccacagcacaccacagtgcctatttcgggaaaagagctctggaggtagcaagaggagcagcttttgcagagatacctag

SEQ ID NO: 53026 - DNA, 414 bp, Glycine max
  Peptide Sequence Number=SeqID_169804
atgtcgtcacgcatgcgttgtatgttggtcttgtcatttgtcacgggaagccggaaggtccatatcaccttcttaactacacacatagggcaccgcgcccccaaatgcacaagccatgaaagagaaaatggccacaatgatggaggccattatgagcatgaaggagataatggaggtcaatacggctgcattgctgaggtggacctgactcacccatctggcctcaatcaaataagtcatccaacctcggatgtgagaggcaaagagttggcaagtacggacgacccccattgtgtgcaaattcaaaacaagcacgccttcgcgccatatggcttgccttccaactatacaccacccaatgtggcatacactcccggtgaggatgtcaataactccctctcccatactcattaa

SEQ ID NO: 53027 - DNA, 1188 bp, Glycine max
  Peptide Sequence Number=SeqID_169805
atggcaagggttgttgaaactctattcttggttatgtcatgcatcttatgcagtgttttgttaggcttttccgatgcagctccaacttctacatacaatgtggtcaagtttggggcaaaaccggatggaaaaactgactccactgaaccattcataaagtcttggcaatcagcatgtactagtctcaatcctgccactatttttgtgcctaaagggaggtacttgctgaaaaacactaattttcgaggtccatgcaagaggaaggtcacattcctcatagctgggactcttgtggcttctgaagattaccatgcactaggaaattctggattttggattttgttcaatcatgtggataatctcgttgtttctggtgggagattggatgctaaaggggctggtttctggaattgcaggagatctggaaagagttgccccgttggagcaaggtcaatgacattcaactgggtgaataacttggtggttagtggcataacttcaatcaacagccagctaagtcacattgtgatcaacgcttgcaacaatgttcttgttaaaaatgtgaggcttattgcaccagaccagagccctaacaccgatggcattcatgttgaacgctcaactggggttaccattaatgggtgtaccttgcaaactggtgatgactgcatatccattggtgatgccacctacaacatcttcatgtcccacataaaatgtggtcctggtcatggcgtaagcattggaagtttggggcaaaaactggacgaaaaaggagtagaaaatgtgactctgacgaatgccatcttctctggctcggataatggggtgaggataaagacatgggccagaccaagcaacgggttcgttaggaatgttctgttccaaaacattataatggacaatgttgagaatcccatcatcatagatcagaactactgccccaacaatcaaggttgtcctggccagacttcaggaattaagatcagccaaattacatatttgaacataaatggaagttcagcaacaccagaggcagtaacatttgattgcagcccaagtaatccatgtcaagggatcaaattgcatgatgtaaacctaacctacaagaacaaagctgcaacgtcatcatgtaagaacattgatgggacgagcaccggaacactggcgccagaaagttgtttttaa

SEQ ID NO: 53028 - DNA, 597 bp, Glycine max
  Peptide Sequence Number=SeqID_169806
ccgccacggcctccgcagtcactctcctcatcgcggaccacgaaaatcctcccgttctacaggcagcggagtctcgatcgcagccacaaaccaagccgcacaacggattccgacagagacgctaccgttggagtccttgacgaaaatgatggtgttgctagcgacgagcttcttgtggttgacaaacttgctccagccggtgctgaagaggtggcgacacggtgtgccgtgatagatgtggcggaagtgccactcgacgccgcggatgtcggcgacagagaggagctggacaggcggattggcacggaagtccagcgaagggaagcacgagtcggtgcagaagtgcagcacggagaagccgtcgtcgttgttggcatcggagggagtgaggatcttcgcgaacgaaacgacaccgttgttcacgcagtcctcatcgtcatcgtcatttcgaacctccttggtgtcgttttggaaatgaacttggcgaagacatcatcggagaaaggatcgacaggggacgaaggggagagagcagatgagaaggctgaggtaatgcgagggagaggtacgcttcatgtgaccctggggaaaaagtag

SEQ ID NO: 53029 - DNA, 345 bp, Glycine max
  Peptide Sequence Number=SeqID_169807
atgtccaacaaggaatgtcatgattacgatggaaacaagaaaatgaaaaatcgttatcaacagtgtgttagttgtgatcttgagagaggtgcggaggtctcacagtgcgacagcgacgaggaagtctggtgtcacatcgcatcgctagcgaggaatgttgcagtgtgttgtggcggcacgaacaaagtggagactaagaggagagaacgaataggtggagagaaagagagtggaagcacaagaggtaacaatggtgtggagatggagaggcatcgtgagaggttgcagtgccaacaactagggagtttcagtgtcgtgagagcgaaagcgagggattttgagtga

SEQ ID NO: 53030 - DNA, 312 bp, Glycine max
  Peptide Sequence Number=SeqID_169808
atggatacctcaaagccctacattggggcaatgaaaggcaccatgcataaacctcaagcaaacctaggggcaaatcagaaattctcgcccaataggttccttgctacaagatttcctacctctaatgtccaatcttttgaatttgggatgatcgaccctctcgatgagtcaatctcttgctttctcataaggagggctacacaccctcgccttcagagggctgcactccctcgacttcagaggactacatgtcctcgccttaagagggctgcacttcctcgccttcagaaggctacaagccatcgcctttag

SEQ ID NO: 53031 - DNA, 588 bp, Glycine max
  Peptide Sequence Number=SeqID_169809
atgtttcctagtcttcgagataccattgaagatttaaggcgttcattgcaacctaaaaagagtgctattgaggcattgcaacaattagttgcagaaaaggaacagatgttggaagatatgagagggttgcttcaggctgctgaagaaaaaaggcaagcggcactagctgagctctcagctaaacatcaaaagaatatacagagtttggaggctcaacttaatgatgcattgttcgacaaaattactgttagtgaagtagaggtcttgcatgaactctacacgaagttgagaaattcaattattgaagatggtcttattcacaaggaatctgtggagtctcccttgcaccatcgcggcaacatgagatttactattgcacccctgtttaccaatgctcctaattttctaagattcctaacgggcaacatgctaagtggtaataatttgagtgaacttgaggagggggggcttcttccatgttcaaagatctccaattgtcctgcatattctattccctgcaatgaaggacatgggctgcaggtttcttacaagcagcttggcgaacacggcacatcgttctttcactga

SEQ ID NO: 53032 - DNA, 726 bp, Glycine max
  Peptide Sequence Number=SeqID_169810
atggctgaaacaaagtgggtcatgaaggacaaaagatggtctctccatggaatgacagctctagtcacaggaggcacccgaggcatagggcatgccattgttgaagagttagctgagtttggagcaactgttcatatatgtgcacgtaatcaagatgatatagataaatgtttagaagagtggaaaagcaagggacttaatgtgactggttcagtgaacaatgctgctacaaatataacaaagaagataacagattacacagcagaggatatatcagccataatgggcaccaattttgagtccgtttaccatttgtgtcaagttgcacacccacttctaaaagattctgggaatgggagcatagtatttatttcttccgtagcaggtttaaaagctcttcctgtgttctctgtttatgcagcctctaaaggagccatgaatcaattcaccaaaaacttggcattggaatgggcaaaggataatattcgtgcaaatgctgttgcccctggacctgttaagactaaacttttggagtgtatcgtgaattcttcggaagggaatgagtctataaatggagtagtgtctcaaacatttgttggtcgcatgggagaaactaaagagatatcagcattagttgcttttctttgccttccggctgcatcatacatcactggacagtttcgtgtgtctttctctcagaattcaacaaggcagaacaattgttaa

SEQ ID NO: 53033 - DNA, 435 bp, Glycine max
  Peptide Sequence Number=SeqID_169811
atggtggtgcctccaagatctattccttcagttgagcagttcaggcggatggtagcctggcccgggacccaaccttctcttcacagggaagatgaaggtcccacagcccaggtagccgctaccactcctgagagatcccttgaggccacttcagagcctcatgcaccagtggtgaacctacccttacctcagcgtatagcagacccctccactcctattttagagataccagaggacccaaccacaccagtcttggctatggacacttctcctccagctactccagtacttcatctaacagatgaggaggatgttcagacaaaggacactcaggaccatgtcgcaacctacccttttgcgggtgagcgaggcgaggctcacgagtgcgtcttccataggaggaaaatgcgcggagtcgccaccaacgtttactga

SEQ ID NO: 53034 - DNA, 415 bp, Glycine max
  Peptide Sequence Number=SeqID_169812
atggttagatcgtgttggaagccaattgctgatggtgatgaaggagatgggagtgggagagttgatggtcttctatggtacaaggatttggggaaccacctttatggggaattctcaatggctgtggttcaggccaatagttcattagaggatcgaggtgaacttgagtctggacccttgagttctaatcacttgggtcctcaagggacttttataggtgtttatgatggccatggtggaagtgaggcttcgcagtttgtcagtgacaatctcttctgcaatctcaaaaggcttgcatctgaaaatcaaggcgtgtcagaacatgttatcaaaagggcttactcagcaacagaggagagttttctgtctcttgtgaagaaacagtggctaagtaagccacagattgcatccactg

SEQ ID NO: 53035 - DNA, 300 bp, Glycine max
  Peptide Sequence Number=SeqID_169813
atggttctatttcttctttctgcaacaccattatgcagaggtgtatatggagttgagatctcatggattatgccattatctctgcagaagttttcgaattctccagaagtgaactcccctccaccatctgttcttatgattttcaaacttttccctaactgtttctccactagtatcttgaacaccttaaagcatcgtctgcaagcggtgaataccctttctccacgatctcaaggacttcttgatacccaactatcaccttcatatgtgcataccaccgatgtcaattcttgtcgttga

SEQ ID NO: 53036 - DNA, 192 bp, Glycine max
  Peptide Sequence Number=SeqID_169814
atgaccttggaggttcagccagcgtttgtagacttaaaagttagagtttcgttgctactgcgaactagggagtttggagaggattcagaggagaagctctgttttagatttggggtcagagaggtgcatggtgaggagcatagggttgaggggctttgtggtggcggtggtggtgttgagctagggctttag

SEQ ID NO: 53037 - DNA, 126 bp, Glycine max
  Peptide Sequence Number=SeqID_169815
atgcatgcatgcttccaagttcgaagaagactgaaaggatcgaagccacctcgtgatctttacctgtcagacttttcacgccagaacactgaacaggcaaaggcattggcgcaagccggttgctag

SEQ ID NO: 53038 - DNA, 1500 bp, Glycine max
  Peptide Sequence Number=SeqID_169816
atggagttttatgaccaggatttcttggaggaattaataattagtaaagagcttgatgaaccaagcgtgaagtcgaacaccatcatcggattggagccacacgtcctcgtaggtgagtctgaggtaggaggggttgatggcgtaggacaaatgaatccattaagttgctcatacaaactctacaatcccaagaaaaagaaagtaatctacggtagagatgtacaatttgatgaattaaagtactggaaggataaagacaaccagaaggagcaagcaactgtcagcgtgcaggtgcctatggagaattcagttagacatcaagatgaagctataccacatggagaaggtaatgttgaacaaatcacagaacaaataagttcaggaagaatgaggagaatgcctgtaagactcagagattaccacatgttccctaacagtgcaatcacagatgaggatgccatgaatgaagaaataagagccatagaaaggaataaaacctgggagttagtcacttttccaattgggaagactcctatagtggtcaagtgggtttataaaaccaaaatgaagcctgatggcagcatagccaagcacaaagctaggctacaaccccctagatatgaagtcatagacagtgaagacaaggtgtacagacttagaaaggctctgtatggactgaaacaggctccaagggcaactaaggatggtggagtcctactaatatgcctctatgtggatgattttctaattacagggagtaatccaactgagatagaaaagttgaaggacaatctcaaatctgaatttgaggtgtcagatttaggtttgctatcatacttccttgatattgagtttgttgaaactaaggatggaataatgatgcaccagaagaagtacattaaagaagtattgaagaggttcaacatggatcaatgtaataaggtagatattccagtggacggaaatctgaaactggatacaggcgatcatgaagcttcaactgatgactttatggagctgcaagtggacaataagtctgctattgacttagcaaggaatcctgtgtcccatggccgtagcaagcacattgaaactaagtttcatttcttaagggatcaagttaacaaagggaagataaggttgaaacattgtggggtagatttgcaacttgctgatattatgacaaaggcgttgaaggctgatagattcaagttgctgagaaatatgctggaacttgttctaatggatgaactcacctctgggatttgggacatgttcctatatgaattggaaccaattttgttgaagtactcaacatcttgcattatgagtgatgcaaccgtgcctctggttcctatttctactgggggaaattcagccttgtcatttgagtcaagggtagtggatttatgcatgcttttgttggttggtgttggggagaaagcaaaatcttttgatttaagggtggtttgtgggtttgttctagaggggaagctatag

SEQ ID NO: 53039 - DNA, 399 bp, Glycine max
  Peptide Sequence Number=SeqID_169817
atggagaagacgtacgcgtccacatttgcgaaacagcttcttcatattcaccttggttatggagttcatacagagtcacgtggagccatggatgaaggaccagcgggcgcagctgccggggttgaaggagaagcacaagaagcggatccaagaagagtaccagtgcctctggaacctctgtcgcgccctcaaggtggaatccgtctccgatttacaggaccttctctgctttatggtgctctccaagtgcctgtcatgtgggaagatgatgctggctcaatagacataaatggaacacttttcttcctccaacaagcccattggcattggcctgccgaacataccatcaattgccgaaggttaatttcccctaagttaatccgtactttgagttcatag

SEQ ID NO: 53040 - DNA, 2148 bp, Glycine max
  Peptide Sequence Number=SeqID_169818
atgcatgcacctatcaatcatattgatgatacttatgccacttggcacttacacttacacatagagtttgtaccttccagtgacacacagaaggaggagacaccagagatggttgctgaagaggcaattagtgctgatgataaagacacagaaactttggcccaagagaaaactgaagtatctgctgcaccacctgcattgcaagagaaaaatggccacgggagttcgagttcgaggtccccaagtccaccttcatcaaaagggaattcccaagctacaactagtgaaacagtcaagactcctgtgagtggcacacgtgacaaggctcaaccaaatttgaatcatcagaatgctccaaacaccagtgcgaaagttaaaccaaaggagaacaccattctggtgtcagaatgcatgactaatgaaaacaagggtgttgactgtagggatggatgtcagagccagatgaaagtaaacatacccagtgaatgtctgaaaggggcaagggaaacatgtccagatgatgatgactataagactgaagataaaaaggcagagaaaggagcagaaaatatgatggaggaaactactgaatcaagggaagagaaggattcaagcacacaaactgatgcaggtcgaaaagaaggaagagttttgtcagatgcagatgctgctgttttcatacaagctgcatatcgcagttatctagttagaaaatgggaactgttgaagaagttgaagcagatagatgaagtcaggaaggaggtgactcatgttcaaggtcgtgttcaagcttttgagagatctctcgaacttcaaaatgatgacaaacaaaaaattgcaattggagagaccataatgagactcctgctgaagttggatactatactgggtttgcatccatgtttcagggagatcagaaaatccttggctagggagctcataatcttgcaagaaaggcttgattctataatagccaagaaacctcagcagcagatgccggatgccgatgttcaggaacacgttgaaatcactccaatgaacatgcaaagtgaagaacatgtgcaaaagcagcaagaagaaaaggttgttgtaccagaagattcagctgaaggcactagggatgatgtaaaaggtccttgtgctaatgatggtggaagtgaatctcagtcaccagttgatcctccatcaaatgagggagcagagtctgttgcacttccaaatggctcagataatgaagacaccagccaagtggttacatctgatgcattgaattcttcaagtgatctgtctgagagtgacaaaatggctgtggaatccgaagctaaatcagaagcgaaagacaatccgattgcggaagacattcccattgaggttgataaattggacaagactgtttgggaagaattgcttgtgggagttattgatgaagatatcaatgatgttagtattgagaaggaagaacatgatgatgttagatctggaagtctcccagccatggtgaatgattcggcacaagaaggatcagattcagagaactatgcaatgatggagctgccattgggattacatgaggagcatgaaagggacaatgaaatgaatatttctaatggagaaacatggtctgagaatgagatatttattgaggagcttcatgtgggactgcacgatgaggatacaacaatatctaaagataagagggatgatcaagctaagcctaaaacatataaaggggttctactagctcaagaaggggaatacaatgcagatgaggaaacaagttcttccatagatgacactgcaaacgaaactcaactagagcaacagcagaagctgaaagagcaagaggaggtgcattcttctagggtaaaaattgagtacctgaaagaaggtgaactcaatggtgatgcaccaatggatataagagttgagtgcaagtcaggtgaggaagctggaactgatactaagttgcttcctttgacaacacaagtcagtgataatgaaccagaaaatgaagatgtattctcagaagcaaattatgtaaataacaaattaaccgagccaatggagtttgtaccttccaatgacacacagacggaggagacaccaaagatggttgctgaagaggcaattagtgttgatgataaataa

SEQ ID NO: 53041 - DNA, 129 bp, Glycine max
  Peptide Sequence Number=SeqID_169819
atgaacgcgctaagcggaccatgtcgtgcgaagcgcgttcatccatgctgtcaggctaagcgcgccctatgcgctaagcttgagtgtgtttttgttgaggctgagctaagcgccagcatgctgcgctaa

SEQ ID NO: 53042 - DNA, 198 bp, Glycine max
  Peptide Sequence Number=SeqID_169820
atggatgactgtatcaaagccgagttgaagaatgctttcgacaagaaggtgtgcccatggcaaattcaagggaagtgggctctgaattatgaaggacctttcattgtgaagaaggtttttttgggaggagcgttgttgcttgcgagcatggatgatgaagaattgccttcctctgtgaactctgatatcgtcaaatga

SEQ ID NO: 53043 - DNA, 684 bp, Glycine max
  Peptide Sequence Number=SeqID_169821
atggctccacctaaagaaatttcgacccttatttaccacagtggtcacattgtagacgatccagttcaaggatcgacgtaccaatctcaactattcgacaatgatgatcttagaggcgcgatggaaacaattatccagaatccacaattgaattatgccaaattctatgctgttactgagcttattcctcaaccacaaccatcgtctccacaaccctcatgtccacaactacaactaccgcctccacaacagttaccgtacaacaacatagatctcaataatccagtatcttcatacaacaaccttgaatcacaagacccctttgacatttatacttcatacacacaaatattatccgagaatgattccttttttaatggccaagaaacctcctttgaccaacaaaaccatccttcatccccctttacgccaccttcacagctaccacaaacgcaaacattaaaccgagatgaacatcccattgctaacgaagatctcattatacgatttcatcatgaaaacatggatgatattagtgaggatgaggatcaacagttctttgatcacatcaatcagcaaagtgatgaccaaaccgatgacgagggtgttggcaggccaacgtcacccccgtcacctccgttgcaatatcagcaacctaggtgtccagtagacttgaacttttga

SEQ ID NO: 53044 - DNA, 180 bp, Glycine max
  Peptide Sequence Number=SeqID_169822
atggaggttgaagaatctttgatgggctcacgactaccattgcattatcaagcagatacaggagggtggtgtttggtcttggatgtgcatcaggtggattttgtggccgatttaagggtgacctttgtggataattgggcgttcttggttggtagggtggtgagtaatgggaaggactga

SEQ ID NO: 53045 - DNA, 300 bp, Glycine max
  Peptide Sequence Number=SeqID_169823
atgccaaccacaacgtttctggaaccctcctacaaagatgaagggagaggaaaaattcactctatcgctgccacatgtcaacaactctaccacgcgccagcaaattacgcaaagtccaaaatgaccaaaaaaccaacaaatgtgccacgtttcaaactgctaggttgcattaacaacggcgatgctaaaggagttaatgacatgggtatagatagagggaggggaatggtgatggtgaagggcacgatggacgtggcagctttggcaaagaagttgtcagagaagttaagagaaagatag

SEQ ID NO: 53046 - DNA, 1925 bp, Glycine max
  Peptide Sequence Number=SeqID_169824
ggattcccattaaggaggaaggggaaagggaaggggaaggcgaagggaaattccatatgagagttgaaccccgtactataaacttccaactaagagagaaaatagtaatattgccgttaattttcatacattttctttcacattctctgttatataggaatgatgctgagctgcttgaagatatcattgatcatgtgttgaagaggttgaataagaagccaattaataactcaaaaggacttattggaattgacaaaccgattgcagatttagaatcattgttacgtcaagagtcaaaagatgtccgcgttattggaatttgggaagatgtgaaaattaacacaacaaatgggttacccaatgatattttgagaaggattggtcgtatgaagatttttattgttcttgatgatgtaaatgattatgatcaagtagaaaaattagttggaactcttgattggcttggatcaggtagtagaataattataacagccagagacaggcaaattcttcacaacaaagttgatgatatatatgagattggtagtttgagtattgatgaagcaggtgaactcttttgtctgaatgcctttaaccaaagtcatcttggaaaggagtactgggactacttgctcctctcatattggatggtcgattatgccaaaggtgttcccttagttcttaaagttttaggtcaacttcttcgtggaaaggataaggaagtatggaaaagtcagctggacaaacttcaaaaaatgccaaacaaaaaagttcatgacataatgaaaccaagttattatgatctagatcgcaaagagaaaaatattttcttagatattgcatgtttcttcaatggattgaatttaaaagtggactacctaaaccttttattaagggatcatgaaaatgacaattcagtagctattgggttagaaaggctgaaagataaatctcttataactatttctgaggataatactgtatctatgcacaatattgtacaagaaatgggtcgagagattgctcatgaggagtctagtgaagatcttggaagtcgaagcagattgtcggatgctgatgagatttatgaagtactgaacaataacaaggtagcgaaaattctgcatttacggcctaaaggaacaagcgccattagaagtataagcatagacttgtcaaaaattaggaagctgaagttaggccctcgcatattttccaagatgagcaacctacaatttttggattttcatggcaaatataatcgagatgacatggattttcttccagaagggcttgaatatctgccaagtaatattagatatcttcgttggaagcaatgccctctacgatccctgccagaaaaattttcagcaaaggatcttgttatattggacctgtcagatagctgtgtgcaaaaactttgggatggaatgcagaatctggtgaatttaaaagaagtcagactctataggtgccaattcatggaggagctaccagactttacaaaggcaacaaatcttgaagtactgaatctcagtcattgtggtttgagtagtgttcattcctctattttctctctcaaaaagcttgagaaattggaaataacttactgtttcaaccttacaaggctcacaagtgatcatatccatttaagctcccttcgttatctgaaccttgaattgtgtcatggcctaaaggaactctcagttacatcagagaatatgatagaactaaatatgcgaggcagctttggactcaaagcgttgccctcatcttttggacgtcaaagcaagctagaaatcctagttatatatttcagtaccattcagagtttgccttcatccataaaagactgtactagagtgcgatgtctagaccttcgtcattgtgactttcttcaaactataccagagagttgtttttag

SEQ ID NO: 53047 - DNA, 750 bp, Glycine max
  Peptide Sequence Number=SeqID_169825
atggatgaaccttctggattcattctgaccagatatctaaggactgtattgtttccttcaacagcagttgaacaattgaaagaaaccaggaaaaagatagagttttggaactgcttgtgcttggataaacattctctcacggctattgagttgaatgtgcaaatcaacgtgatgaaatttgcatgtcagcatttcccagcaccagaacttgattttgatgattacaatgattatgtagtcattcatgatctccaaagtggttatgaagagtgtgattcttatcaagcaacgtacgcgtacccaggaagcacatttccaaagtggttagagtataagacaacaaatgactatgtggtcattgatctctcttctggtcaactttcccatcagttgggtttcattttctgcttcattgttcccaaggactcaaaacgtgatgataaattgatactttacattactatcagtgattgtgagggtgaaggcgaaaaaggcagcacgaaaatgtacatgaacaagtcagactcaacaaaatcagatcatgtgtgtgtgatgtacgaccagcgatgctctcactacctaaatagcatggccaaaaatatgaaaaggtttaaaatcaatgttacagcaaagacaggacccattagtttcagttgtgaagaagaggaggtgttaaaagggtttggagtcagcctaataaacacctcaacatatcacaatttcattcaacaaatgaaattcttcgattaa

SEQ ID NO: 53048 - DNA, 1683 bp, Glycine max
  Peptide Sequence Number=SeqID_169826
atgactaggtgcatgttgcatgaaaaaaatctacccaagaagttttgggcagaagcagctcatacgactgttttcttgcaaaacagactcctctcaaaagcagttaaggatcaaacaccatatgtggcttggtatggttataaaccatctctaaattttctcaaaatatttggatgtttgtgttttactcatgttccacagaacaagcgtgacaagcttgataaaagagcatcaccaggcatttttataggctatagtactgttagcaaagcctataaaatttttcagccacaaactggaagcattgttgttagcagagatgtccacttcgtagaagatgaagagtggaactgggatgaggtaaagaagaaggatcaaactgtggtagacctacaacttaagtctcttacttcaagaaccgaagaagaagaggattggcagagtgaattggcagacgatgccccttcaagaagaactagatcattctatgatatttatgagaggtgcaatatttgcgtttgtgaacctgcagattttggagcagcaaagaaagatcaaaattggatggctgtaatgaaggaggaattgtctatgattgagaaaaacagaacatgggaattggttgatcgaccccaagataggaaggtgattggagtcaaatgggtatacagaaccaagctaaatgttgatggttctatcaacaaacacaaggcaagacttgttgtgaaaggctatgctcaaatctttggcgtggattactcaggcaccttcgcaccagttgctcgtttggacaccataaggattttgcttgctgtagctgctcaaatgaattggaaagtgtatcaacttgatgtaaaatcagcatttttatatggtgttttacatgaagaaatttactttgaacagcctgaaggttttgtgaaaaatgaagaaaaggacaaggtgtatcttctcaaaaaggctctttatgggctgaaacaagctccacgagcttggtacagcaagatagatgaccatttgctgagcatcggttttaaaaaaagcttgtttgaagccactctttatgttaaacatcagagcaatgaagttctgatgatttcactttatgttgatgatcttttggtgacaggaaataatgcagggatgattcaggaattcaaacaagaaatgatgaaggtttttgagatgacagatcttgggttaatgaccttctttcttggattggaaattaagcaggctgagtatgaagtcttcatctgccagaagaagtatgtcaaggaaattttgaagaagtttaagtttcaggaatgcaaggaagtaagcactcctatgaatcaaaaggaaaagttgtgtaaggaagatggagctgataaagctgatgagggatatttcagaagtttgattggttgcttgatgtatcttactgcaacacgtcctgatattttaaatgccgtaagcttttgtccaggcacaagtgattttggtgttaagttcacatggagcaaagaatttaagctggtgggtttctctgacagtgactggggaggttccattgatgatatgagaagtacatcaggctactattttactcttggatctagtgttttctcatggagcttgaagaagcaagagatcgtggctcaatccactgctgaagcagaatttattgctgcaacagctgtt

SEQ ID NO: 53049 - DNA, 144 bp, Glycine max
  Peptide Sequence Number=SeqID_169827
cagaatcctgtatactggttaattggattctggaaatgtgttttagctggacttgtttccttgctaaaatggatgaatttgtctagccaagccatgtctttagaggaattactttacatatttgtttctcatagccaagccatg

SEQ ID NO: 53050 - DNA, 795 bp, Glycine max
  Peptide Sequence Number=SeqID_169828
atggaagaaacaacatcagccatcatcatgtcagcactctccactctcaccccttcccaattctcagatctaactcgctccattctctcagccaccaaccaccaccatcgccgcctctcttccctcctctcctaccccacgctcttctctctaacccttcaccatctccacactctctccctccctcaaaaaactcttcttatcgcccgccacctcctctcctccctccacctcctcaccgccacgtcgccgcatttttccaccgccacgcggcagcgagacctcgacgccgcgctgctcctcctcctcctctgcgagacgcataaccacaacccgcatgccctcgaggcaccggtctccgaatggagaaaaatcttgagcaaactcttctctgattcattgttaactgtttctcttgcaccccttgggacggttatgattcccttcgttgagacggtgtcgcggtgctggaggctcgtgggtgcgctggactgcggcggagggaaggaggcggcggaggtggccgcgtcggcggcgacggtggtggcgctgccgtcggtggaggtgaggcacgacggaagagagtgcgtgatatgcaaagaggagatgggaatagggagggacgtgtgcgagttgccatgtcagcacttgtttcattggatgtgtatcttgccatggttggggaagaggaacacgtgtccttgctgcaggtttcggttgccgtccgatgatgtcttcggagagatccaacggctgtgggaagtcttgcttaaaatggcagcaaaagattcatag

SEQ ID NO: 53051 - DNA, 807 bp, Glycine max
  Peptide Sequence Number=SeqID_169829
atggaatccttcttcatgataacaccatttcaaaaccacacattccaccagcatgtttccttcacgggaacggatttgtcatggatggtggagtttctgaagggcatggtgaagcccgtggctgccaccgccgtcgtgcttctggccgtgctcttagcatttcttcagctttctattattgggtttgtgttgcagttcatattcaaccaaggcaacgctggctggatcattctagcttaccttttcatggtgtgtgttgctggttacactgcaggtcaacgtgcgaaacatgtccctcgtgggaaatatgttgctggagcttccattctgacaggaactgcagtgaccatgttccttctagtgttactaaacgtgttccctttcacccccagatacatcattccagtagcaggcatgatggtcggaaatgccatgacagtaaccggtgtcaccatgaaaagactccgcgacgacatcaaagcacaaatgaacttagtagagacagcattggcacttggtgcgagtccacgacaagctacgtatgaacaagtgaaaagggctttggttatagccctttcacctgttgtggacaacgccaaaacagtgggtttgatatcgctgcctggggctatgactggtcttattatgggaggggcttcgccacttgaagccattcagctacagattgtggtgatgaatatgttgataggtgcgtccactatcagcagcataatgtccacgtatctatgctggccagcgttcttcaccaaagcctaccaattagagacccaagttttctcaaagtga

SEQ ID NO: 53052 - DNA, 4080 bp, Glycine max
  Peptide Sequence Number=SeqID_169830
atggcagacaacacacgcatgaaagagatctatgcagaattaaaaaaaaatgctgatgccattacgcatgtcagtgaggacttccatcgtcagatcgagcgtttggaaggtgctaaccacgctcatatggaaaggatggaagcgattcagatagcaaatgagtcacagattacacagctcaattctgctatgacgcaaatcctgcaacgactacaatccactccggtgtcttcccatggtgcatcgaactcaaacaaagaacaaacgaggactccttttcaggtgagatctgtcaaactggattttcctcgatttgatggaaataacgtaatggactggatatttaaggcagaacagtttttcgattactatgctactcctgatgctgatagattactcatagtgtctgtgcacttagatcatgatgtggtaccttggtatcaaatgatgcaaaaaactgatccattgctgtcatggcaagctcttactcgagctctagaacttgattttggcccatccgcttatgactgtcctcgagctaccttgttcaaactagctcagtctgcatctgtgaatgaattttatatacaatttactacgttagtgaatagagtcgatggtttaagcccagcagctattcttgattgctttattagtggcttgcaagatgaaattagaagggatgtgaaagccatggaacctaggaccctgagcaaagcagtggccttagccaaattatttgaagaaaaatatatagccaacaaaaaacctaaccaaatgaccaacgatgatgaagagctacagccagatcggaaccaggcaactatagaggaaggtgaagaaggaggtaatgaaactgaaactcaccacctgtcactcaatgctatgaaagggtctaatggagttggcaccattagatttacaggccaggtgggtagtataagggtcaagattttagtggatggaggcagctcggataacttcattcaaccaagagtagctcaagtgttgaagcttccaattgagccagctcctaacctcagagtattggttggcaatggtcagacgttacaggcagagggtatgattcagcaattacccttacatattcagggtcaagaagttaaagtacctgtgtatctattacaaatttctggtgcagatgtgatcttaggatcaacttggttagcaacattgggccctcatgttgctgattatgcagcattgactcttaaattctttcaaaatggtcatttcattaccctgcaaggggaagtgccttcttcactaccacccccaagagaacaggatcatgccattccactgaagcaaggatccgagcctgttaaggtgagaccttacagatatccacacacacagaaagaacaaatagaaaaaatggttcatgaaatgcttgatcaaggcatcatacaaccaagtaccagccctttctcttcaccaatcctgttagtcaaaaagaaagatgggagttggagattttgtactgactatagggctctcaatgccattactgtgaaagacagttttcccatgccaacagtggatgaattacttgatgagttatatggagcccaatatttttctaagttggatttgaggtcaggttaccatcagattatggtaaaacctgaggacagagctaaaactgccttcagaacccaccatggccattatgaatggttggtaatgccatttgggctcactaatgcaccagccactttccaatctctgatgaataaggtgtttcagtctgccttaaggaagtttgtgttagtattctttgatgatattttggtatttagctcttcttggcatgatcatctcaaacacttagaggcagtgttacaaatattacaacaacatcaattgtatgccagattgtcaaaatgttcttttggagcttcagaggttgattacttgggacaccgggtatcaagcaagggtgtgtccatggaaagcactaaagtccaggcagttttggagtggcctcctcttaccaatagcaaacaattgagagggtttcttggcttgacaggatactatagaagattcatcaaagcctatgcccacattgctgcacctttaacagatttgttaaagaaagataattttgtgtggaattctgaagcagaagcagctttccttaagctcaaaaatgccatgactatagcaccagtgctagccttacctgattttacacaaccattcattttggagactgatgcatcgggaattggagtaggagcagtgttgggtcaaaatggtcatcctatagcatatttttcaaaaaaattagcacctcgaatgcaaaagcaatctgcttacaccagggaattgctagccattacagaagcattggctaagttcagacactacttattaggcaataagtttatcattagaacggatcagagaagcttgaaaagtttgatggatcagtctcttcaaacccctgaacaacaagcatggttacacaaatttttggggtatgatttcaaaattgaatacaagcctggtagagataatcaagcagctgatgccttatccaaaatgttcctgttagcctggtctgagccccattcgctgttcctagaagagctaagaagtaaactaactgcaaatcctcacctcaagcagttaatggaggattacaggtcctctaatgaagccagtcattatgcagtaagacaagggttattgtattggaaagacagactagtcattccagtggaagaagagatggttcaaagaattttgcaagagtaccatagttcacccattggtggccatgcggggattacaagaacactagcaagattgaaggctcaattttactggccaaggatgcaggaacatgtcaaagagtatgtacagaattgtgtgatttgtcaacaagcaaaagtgagtaacacactgccctcaggactactgcagcctttgcccattccccagcaagtttgggaagatgtagctatggattttatcacaggtttgcctagtgttaatggtttttctgtcattatggtggtagtggatagactcactaaatatgctcacttcctacctctaaaagctgattacagtagtaagtcagttgctgaaactttcatgaacaatatagtgaagctgcacggcattccaaaatccatcgtgtctgatagagatagagttttcactagtgctttttggtgttttacttatgagaatcccaaaggatgggtcaaagctctaccatggtcagaattctggtataacactgcattccacactagcttgggattgactccattcaaagcattatatggaagagagcctcctacacttaccagacagccttgtactactttagatccggtggagttaagagaacaattgatcaacagagataacttgttagctaagctcaagaacaatctggccagagcacaacaagtcatgaagacgcaagctgacaagaagagacaagaagtatctatgaaggtgggtgatcacgtattggttaagctgcaaccatatagacagcattctgctgtgttgagaaagaatcagaagctagctatgaaatattttggtcctttcaaaatcatagccaaaataggcacagttgcttataaactggagttgccagacacagcaagaattcatccagtttttcatgtgtctcagctcaagttgttcaaaggaaattcttcagaaccttacctgccattgcccttgacagttactgaaatggggccagtaatgcagccagtgcggatacttgcaaatcgcaaattattaaggggcacaactcaaattgatcagatactggtgcagtgggagaacggggtgcaggaagaagcaacctgggaagacattgaggacattaaggcaagctatcctactttcaaccttgaggacaaggttgattctaaaggggaaggtaatgtaatggctagtggagcacgtgcggggcatgagagcaaggatgatgagtcacgcatagtggaaggcatgaataacaaacttccggatgatgcggaattgggacgtggaaagagagtgaggaggccaagctag

SEQ ID NO: 53053 - DNA, 822 bp, Glycine max
  Peptide Sequence Number=SeqID_169831
atgcgtcccttcttattttctatacttttcacctttctcgccactgtcttcgcccagccgttacaaccatcatcaactccaacgtcatttccgatcgacagcaacgcgccacaacgatcgtccccgcaaacaccaccagcaacgtcgtttccagccgacagcaacgcgccacaacaaccgtccccacaaacaccaccagcaacgtcgtttccagccgacagcaacgcgccgaacctaccgtcaccgtcaagcgaaaaccgaagcctccaaggcgtcgggcgccacaaaggaggccaccacagcggccgccgcaagcgcgtcaacacaagaaaatacttcggatacgtcccgcaaaccaacgacacgtcgttcacaaaccaaaccgcgttggcccaggagttcctccatgcgcacaactggatcaggaaacagtacaaccttcccgagtacacgtgggacgagaaactcgcgagctacgctcgtgggtacctcatgcagcgctacgaggattgcaagctggtgcattcaaactccaactatggcgaaaacgtcttctgggggaagaagttgcactggtccccttccgacgccacctactattggtaccaggagaagcagtggtacaatttccagaccctctcgtgcgcgccaccgcccaaagcgtgcggtcacttcacacaggtcgtgtggagggactcccagagaattgggtgcgcgcttcagcattgccacaaccctagtttgggcatgctcattgcttgcgagtatgaccccgctggtaactatgagaatgaggatcctttgaaacaacatgagcgatag

SEQ ID NO: 53054 - DNA, 141 bp, Glycine max
  Peptide Sequence Number=SeqID_169832
atgtgtggagcacgtgcggggcatgagaacaaggatgatgagtcacgcatagtggaaggcatgaataacaaacttccggatgatgcggaattgggacgtggaaagagagtgaggaggccaagctggaagctaacagaatga

SEQ ID NO: 53055 - DNA, 477 bp, Glycine max
  Peptide Sequence Number=SeqID_169833
atgacggtgcttctagatgtcaagagaccccacgctatttatgctttcaatggtcaagaatcttggcagcctttaagcaacttttcaagtaaaaaatgtaaacggtgtggactctatgaggaggacagcattactttggatgatgtatttgacgaatgggagttttgtccttctgactttgctgcacccgatggtgaatatattcggttcaaggaaaaggaattcaatgctactttcttgtgccccgagtgcttatctcttgctggtgttgatgagcatgatgatggcaaaggaatgcatatagctgtagtggttttgctgagtgttttagtttcaattatactgattcttggagtggtgggtgcaattaagttctggcgaaagaagttaagggaacaggaccgggctcggcttttgaagttatttgaagatgatgatgacattggggatgagctgggccttggtagtgcaatttga

SEQ ID NO: 53056 - DNA, 759 bp, Glycine max
  Peptide Sequence Number=SeqID_169834
atgaggatccgtaacctgccgtttccggcaacctccgacagaggctctcccgccccggcgtcgacttcgccgcctgtggctccgccctccagcgctactccaaccaccgcctcctccgccagggcaagcagctccacgctcgcctcatcctgcactccgttacacccgataacttcttcgtctccaaactcatcctcttctactccaaatctaaccacgcgcacttcgcgcgcaaggtgcgacgaggttggacttgcgcgaaacgtgttcgatggaatgtccgagagagatatcgtgacatggaacgcgatgattggtgggtattctcagaggaggttatacgatgagtgtaagaggttgtacttggagatgttgaatgtttccggggttgcacccaatgcggttaccgcggtgagcgtgatgcaggcgtgtggacagtccatggaccttgtgttcggaatggagcttcaccgcttcgtgaaggagagtggaatcgagattgatatttcgctttccaattctgtggttgctatgtatgccaagtgtggtaggttggattatacgcgggagctgtttgagggaatgcgtgagaaggacgaggttacttatggggcgatgatttcagggtatatggattacgggtttgtggatgagcccataataaagagtttgaagcttggaatatcttcaaagcttgtgctcattctgcttgtgctcattctggattcgttgatgaagcttggaatatcttcaatttga

SEQ ID NO: 53057 - DNA, 237 bp, Glycine max
  Peptide Sequence Number=SeqID_169835
atggatgttcatgcttcgttggaaaaagggaaatggctccgaagaagctctctacgaagaggtctagaagagatgccgcagcagaagggcccagtgccacccccgagtttgatagtcatcattttcggagcgctgagcaccaacagcgcttcgaggccatcaaaggatggtcgttccacagagagaggcgtgtccagctcagggaggatgagtatatggactttcaggaggagatag

SEQ ID NO: 53058 - DNA, 306 bp, Glycine max
  Peptide Sequence Number=SeqID_169836
atggatgaagacacagcaaaggtgtggaaaatctgtaggactgaggctagttatgggtgtagttataaaaaccttctaaaatattttccacctgaaagttgttcgaactcacgactcttctctcacatcaatgattctcttcttcaagaagcatcatatgagctcgcggagtgtcgattggatgcagacgtagggggacatgtaaaactgcacccgctagtcatgggagcagtcatcattgtccatcacgtagcagaagtgcttgctgacgcggagggcttgggtcatgccttgtgtcgtgactaa

SEQ ID NO: 53059 - DNA, 204 bp, Glycine max
  Peptide Sequence Number=SeqID_169837
atggtttcactggaaggatcaacaaccacatgttttggtgggactgaggagccagctgcctatggtgaactggtgtccatgggtgctcttaacccagaattgaacaaaaaactgagtgctggaattgcctgcgttcttgaaaccaagttgttgggctataattgtgcattgaacgggtctatcatggtagtcgagtccaaatga

SEQ ID NO: 53060 - DNA, 537 bp, Glycine max
  Peptide Sequence Number=SeqID_169838
atggagtcaaacaacatgccagacttgaacggtgtcgctaagaagactaaaggtcaacaaaagatcgaaatgaagaagatgagaaatgagagtaacctttgggtgacattctcgaagcgtcgcactggggttttcaagaaagccaatgagcttgcaaccctttgtggcgtggatgtcgctgtgattatgttttcacccggtaatcgagtattttcgtttggcagtcccagtgttgattctgttgtccaacgctataagacacaaggcccacctcccctccttaccttggacctcaataaggtgcactccactgtgtacgaagttgagctccacacacacctccactgcttgtccaaccaaattgctattgagaagaagcgcacaaaggatttaaatcatttagcgaaggctgcagaggatcagttctggtgggctaggcctattgaaagcatgaccgattcccaacttgacaagtataagaagatgttagaggagtttaagaggcaactcaaagaaaaatgtgggaacctcaactga

SEQ ID NO: 53061 - DNA, 183 bp, Glycine max
  Peptide Sequence Number=SeqID_169839
atggctcctgggatggttgtggtgaagacaaatccagaactgatgtggaaggttctgctgcttgctgtggggctcctgggatgcaaaggcctcaccccctccaataggagaaggttgggctcttggccaggccacctaccgagtgaactcctccaaggatatgaacggctgatgctgagctaa

SEQ ID NO: 53062 - DNA, 168 bp, Glycine max
  Peptide Sequence Number=SeqID_169840
atggtggggatgtcttctccacctctaaaatcctcacaatctctcaaaagctccttcaaagatcttcaagatgcctcctttggtctgctcagtcgcctctgggttttatatggaaatcctgtcggtggcctcttgttgagcaccaatcttgcgcttagcgcgcattag

SEQ ID NO: 53063 - DNA, 411 bp, Glycine max
  Peptide Sequence Number=SeqID_169841
atgggggatttcatcagcagactctccttccccgaaaacaccgagactttttcaagtctcacaagttatccagaactacgtaggtctgagttcctcattggaggatacgtaggagcaagagcctcgcttttgtcgaccacaccgccttttgttgccatgacccaagagctggtagcccgcggagacaccttacggttatccgcaccttgtcattcagtgaccccaagtgtgattgacgagcagaggccaatgtggtcatctgcgccctttccggagatgtcagcattttccgatggagacttttcaagtctcacaagttatccagaactacgtaggtctgagttcctcattggaggatacgtaggagcaagagcctcgcttttgtcgaccacaccgcttttgttaccatga

SEQ ID NO: 53064 - DNA, 811 bp, Glycine max
  Peptide Sequence Number=SeqID_169842
atgaccctacacattgccaatgcgccctgcagctggggcgtagacgatccagacaatcctttcctgccaccatggcaaacggtgctgcgcgaggcggcccaggccggttaccgcagcattgaactcgggccgtggcgctatctgccgaccgatgccgccgaactgcgccagcagctggaagcgcatcagctgtcactggtggccggcaccatttttgatgatttggtcagcgaggcgaatttcccggcgatggttgagctgacgcacaacatctgccgcaacctgtcgcaggtgccgtgcgcggcacgcacgcacggtgataaccgacccgcgccctatctggtgattatcgatttcggcaacccgcagcgggcgcaatttgccggccagacggagaaagcgccgcgcctggcacccgcagactggcagcgcatgatgcagcacatcactcagctcagtcacatcgcctggcatgactacggcgtgcgaccggtgattcatcctcatgccggtggctgtattgagtttgctgatgaactggaacagctggtgcaggacatcccgcacgaggtcgccggactgtgtctcgatactggccatcttttttattccggcatggatccgcagacctggctgcaacgctactggtcgcgcatcgactatctgcatttcaaagacattaatgcggccgtctggcgcgatgtgattgcgcgcggcgtctactttttcactgcctgtgccgagggtgtgatgtgcccgcttggccagggcgcgattgattacccggcgctgcgggcgtttctcgctgaac

SEQ ID NO: 53065 - DNA, 1020 bp, Glycine max
  Peptide Sequence Number=SeqID_169843
atgagcaaagttaccatgatcgcgattgccgccgctgccggggtggggatcgccaccgtggatcgggtgctcaatcgccgtgcgccggtgcgggcgcagaccgaacataaagtacaggcagcggcacaactgctgtgttaccggaacagccttcccccgatcagtgcatggagctacggcgtgactctgcgcatggggttttgcctgctgtcgacttcgtactctttttatcaaacgctaaccgatgcgctgcgccagcagacgcagccatttcatccggccggcagcgagccgctgtttgtctggcacgagattgatgaggtggcagcggtggtggattcgctctaccggctggctgagcaggtggaggctatcggcgtggtggcgctggatcatccgctgatccgccacgcgatagcgcacgtttcgcgtcagggcgtgcgcgtctacgcgctgttttctgacttttcgccctgtgggcatgctggctatttcggcctggataatcagaaagccgggcgcagcgcgggctggatcgccagccatctgctgcatcagccgggtccggcgggcgtgctgctgggggatcaccgctttatctgtcaggagagctgcgagagtggttttcgctcgtatctgcgcgagcaggacagtgcgcgccgcgtgctggaaccgctcaaaacccacgaatcgattgccggtggttatcaggcgactcgccagctgctggagcaacatgccgatctggcgctgatctacgcgccgtgtggcggtatagaaggggtcgttcaggcgctgcgtgagcagccgcagcgtaaggtggcgctgatttgtcacggcccggtcaatgacggcgacctggcgctgatagatggcaccatcacggtgatgctgcgccatcagatcgctgacatggcacgacagctggcacaaaccgtactgcaacgtcacgctgagcgcagcgaccatttttctcaggtcaccctgccgtttgagatcgtcatgcgggaaaatgtctga

SEQ ID NO: 53066 - DNA, 327 bp, Glycine max
  Peptide Sequence Number=SeqID_169844
atgtgtctcaacctaccctttcgacgggagggcgaggtgaagctcatgggtgcgtcttccaaggagggaaaatgcgtggagtcgccaccaacgtttattcgaggaaaacatcagaaaaaccaacatggaaaaggtcaagggtctgcgtattttgaaaatgagggttcgggagttgtttacgcatggggaagacaaaggatcaagctgaatgttttgatgatgccaaaggttcacatgcgtctcaaagctttattcaagacaaagaaattaaagatattcaagatggatgatcaagacaagtctctagtcttagaaagggtatattaa

SEQ ID NO: 53067 - DNA, 472 bp, Glycine max
  Peptide Sequence Number=SeqID_169845
tgatagagagaaagaggtgcacaggcgtgttgctcgtatgctagagtgtgtgaaatatgttgagggttcgatggaacctgggtcgagtgtccatgctcttgttccagggctgacatggagggttgacatgtgtttcggagttccattagagggtgatgagtttgtcgaaccccctagtgtggacaagtgtttgtccgatgtcgggtgtggtaatctcagcaggtattcattttctcttatcatgtcttcattcttgtctgattcttccgtcggcatgggtggcaatgattctggagacttgattgagcaaaccatgatggaccaggaggtcatttctattggtggttcctcatcagaggatacttgttgtggtgtttctgatagcaagtcgtcatctttggaaagggtgaaggctttgtgctgtactggtgggggcacttctcaccctcgccttgttaggaattcttcgtaa

SEQ ID NO: 53068 - DNA, 315 bp, Glycine max
  Peptide Sequence Number=SeqID_169846
atgtatttaagcctgatcaattcttcattttttcggacattagctagtgtgatccaattttcagaagactggcctgctggagttgctgcacatgatgtccaacgttatgtcaaggaatcagatcgggctgcacaatgcacaaggcaagatgaaatgtcaaatgaagaattgaagctacaggattcacgatgtcggatacaatgtccaggacatcctgcccgaaaatactggagttgctgcacaatgcacaatgcaggatccacgatgtcggatacaatgtccaggacatcctgcccgaaaatactggacacataa

SEQ ID NO: 53069 - DNA, 231 bp, Glycine max
  Peptide Sequence Number=SeqID_169847
atgggatttcatgagaaatgggtttcatggatgaatatttgtctccaatttgtccaatttcctattgctatcaatggtgatcctatagggcaaatatctccaaggagaggacttagacagggtgaccaactatcatcctacttgttcattttgtgcactggggaactattagatttactaaaaaaaataaaagaggcaaaaaagagacatccatgggtttatgacaaataa

SEQ ID NO: 53070 - DNA, 312 bp, Glycine max
  Peptide Sequence Number=SeqID_169848
atgtctcctccatctctaggaatctcacaatctctcaaaaactcactaatctccctaaaagatgaaaacttggccccttgctctgctttacactctttgaaattcacaatcttcaggcctctgatgactcctctggctctttctgttaattatgtgcaaatcaggcttaaaaagggcttcctgatctcgacgtcacgcttagcgccattctcgtgcttagcgcgaggcgtgcttgcggagcagatgcctttccagattcccctttactcgccaagcgcgctggtgctgagctttgccgttgatgcgcactaa

SEQ ID NO: 53071 - DNA, 225 bp, Glycine max
  Peptide Sequence Number=SeqID_169849
atggaaggactttatggtacatcaacaccgaaatatggaacaggaaaagaggctggaaatgagaaaggttatctcattggaatgtctgtttgttatccacaaccgggttcaatcaagattcatgatggtgaaattttgactctagaatctagatataaaaatgagtttcgtactggagctatgggacatttctacatctatttggcagaggaactaccacaatga

SEQ ID NO: 53072 - DNA, 570 bp, Glycine max
  Peptide Sequence Number=SeqID_169850
atggaaccagaatattgggacaaaaatcccttcgaggctacaaataaggctttccctccaggattccatttcaaacccactactatcaataaaacaaggactttttatgagttcatactgatagactcaaactcagtgtctatcaaacatttcaaagatccaaaagaccaatctttaaacactcattcaacaatccagatcctaaaggttatacctattgggattatatcgatgcttggaccaaagtattatggcaccaaaataccgaattcaaacattcatggcttatttactttaagacttcccaattggtttcttcaatggtgggacttcttcggcccaatacctgaaatttttccagaacaaaagtcccaactcgctgcattccttgcaagtgccagatcaaaagaaagtttggccaaaaatctcaaagaagtcttacaaatcctgcagcaagaagaagatgaaggttcctcctcaaagaaggaagaaactaactcttcagaagatgatgatcctttttaccaaaacgaagatgactgttttggtatttctttaaatgatgattaa

SEQ ID NO: 53073 - DNA, 543 bp, Glycine max
  Peptide Sequence Number=SeqID_169851
atgagcaaaacggccttcttcaccggcgtcttagccctcctcctcctccttctcgagaactccgtctccattgccggccagactcacctttccctctccgtgggttacttcgccttctgcctctatctatgccttgtcagtgttgtcaccaaacgcaaccttcatgagaatattcacctcttgtttaggcatgaggaagaagaagtaaccgagatcgttgtgaaaggaataacaacggagttgagctttgaaacaattccactgctgcagggacagtttgtttttgttcgccgcacacggtgtggcggttcaagtaagcgacattgtccttatggaggaggtagtgtacacatggtggaaggggaaaatagaaaggcggaagaggaagttaaaacaaaaaaggaccaccattggaaatcacctcggacaacggcgaatgccgacacttatgttgctttgaataaccaccacgccgaagcaacaccagacaagagcatagcaattcttggtagcttcaattgggtgagggacttatgggattaa

SEQ ID NO: 53074 - DNA, 615 bp, Glycine max
  Peptide Sequence Number=SeqID_169852
ggccttcataaggaggagcgccgccatgaggaggtggatccggtggagggagagcttgttggagtagcagatgtatatccagagggcgaggaaggcgaagtaggcgaaggagaagagagagtagagagtggggagttgggtctggccggcggagaggtaatcgcgggagtgttcggagtcggcgtcgaggttgtagagctcggtgtggacgagcatggagacggaggtttcgggggcgcagttggcgaagaagagggagtattcgttggggattgtgacgggggaggtgtgcgggagtcgaggacgcagaagctagggttttgctggatctcgatcaggacttgcaggagggactcttcgctcaggagaaagaaccctaatcgggagggatcgggttgggacccacctgaggccaccacgaagacggaggagacagagatcgacacgtggccggtgtgggtgaagccgaatttctccaagaggatcatggggcgggtgtcggaggttatggtgagggttttgatctctgcggctgaaggggaaatgaagaagaagaggaggaggagggtggcgacggcattggtggaggcggttatgcccatttcggagcggtga

SEQ ID NO: 53075 - DNA, 3522 bp, Glycine max
  Peptide Sequence Number=SeqID_169853
atggccactgagtctagttttgtgcaagcagccatcccacgctttgatggtcactatgaccattggagtatgctcatggaaaatttcttacgatcaaaagaatattggtcagttattgaatcagggattcaagaatcatcagtaggtgcagtcttgactgatgcccagaaaacagagtttgaagctcgaaagctgaaggacctaaaagcaaaaaattacctctttcaggcaattgatcgtgcaatctttgaaactattctttgcaaagaaacttctaaggatatttgggaatcaatgaagagaaaatatgaaggctctgtcagagtgaagcgtgcacaacttcaagccttgaggagagattttgagacactggctatgaaggatggagaatttgtgaccaactattttgcaagaacaatggagattagtaacaagatgcggttccatggcgaaaatatgacaaatgtcactattattgagaagattttgcgctccctaacaacaaatttcaattacgttgtttgctcaattgaagaatcaaaagacatagatgtgccgtctattgatgaattgcaaagctccttgttggttcataagcagaaaatgcacaaaagctctaccacagaggagcgagcactgaaggcctctaccgctaccaatactcattccttcgatttcagaggaaggggaagggggagaggtagaggtaggggtagaggaagaggagaacgtggaaacagagaagataacaagaatcccagagctaatactacaagcaaaggcagaggacaatactctgacagatccaagctagagtgctttagatgtcacaaatttggccactatgcttctgaatgctattctaggttgcctaatgatagacaaaagggggagagttcaaattttactgaaaataaggaagctgaaactctactgatggctattcaagaaggaggaaaaactgagtcagatatatggtatgtggatgcaggttgcaataaccacatgagtggatgtaagtcttctttttcttatttaaatgaagattttcattctactgtgagttttggtgattgttcttctataaaagtaatgggaaaaggtgatgtcaagataaaaaccaagaatggctttgtggaaacaatctcaaatatgttgtatgctcctaatttaaaaagcaatttattaagcgcgggtcaattacaagagaaaggttatgtcattactattcagaagggagcatgtgaaatttatgatcctgttagaggtgccattgcaattgttcaaatgagttcaaacagattgttgccattgaaaattgaaagtattcagacttgcttcaagactgacatggaagatccatcatggttgtggcactttcgttatggtcacttgaattttagtggactaaagaccctgcaacagaaaaacatggtgacatgccttcctcaaattactattccttcccaagtttgtgaagaatgtgttgttggcaaacaacatcgatctcaatttcccaaaggaaagtcatggagagcaaaagatgtcttggaactggtgcattctgatatttgtggtccaataaacccatcttctaatgaagaacatggcattcgaagagagcttacaaccgcatatacactacaacaaaatgatgtctcagagagaaaaaataggaccattttcaacatggtgagaagcttgctagcaagaggaaatgtcccaaaatcattttggccggaaacagtaaattggagcattcatgttttgaatagaagtccaaccttttctgttcaaaatatgacactagaagaagcttggaaagggaggaggccagcggtagatcatttcagaatctttggatgcatagcatatgctcaggtaccagaggtaaaaagaaagaaactggatgacaaggctgaaaaatgtgtcttccttggtgtaagtgaggtctcaaaagcatataaattgtttaacccattaacaaagaagattgtgaccaatagggatgttgtttttgatgaagaaaacacttgggaatgggaaaggcagcagcctagtcaagtcatttacgacaacgatactaaacacgagcaaatattagcaccttacatgcccgaaaactccacaaattcaactcctatagcagttgtaacttcaccaacaaccactagcatcaatgaagaagaagctcaatctcattcctgtgttagaagaaggccagtgtggatgaaagattacttacgagaagaaaaatggtgcaaagccatgaacgatgagattgatgctattgaaagaaatgacacatgggagctgtgtgatcttccaagaggacaaaaaacaattggtgtgaaatgggtcttcaaaacaaagttgaatgagaacggtgaagttgacaagtacaaggctcgtttggttgctaagggatacaagcaacaatatgggactgattacacagaagtgttttctccggttgcaagacatgacacaattagattggtggtcgcgttggcagcacaacaatcctggcaaattttccagctcgatgtcaaatccgcattcttgcatggatacttggaagaacaagtatatgttgatcaaccccctggttatgttaagattggaactgaggaaaaagtttacaaattgaagaaagccctttatggactaaaacaagcccctcgggcttggtatagtcgaattgaatcttatttcattcaatctggtttttcaaaatgcccttatgagcatacactttttattaaaactagcgatgaagggaaaattctcatcgtttgcttatatgttgataaccttatttttactggaaattgtgatgccatgtttaaagaatttaagaagtctatgatggatgagtttgaaatgtctgatattggaatgatgcattattttcttggcagagaagtggtacaatcaaatgctggtatttttatttcccaaaagaaatatgtgggagaaatcttggacagattccacatgcagaattgcaattttgcaacaactccagcagcatttggttgcaagttgcacaaagatcatgaagggaaaaaggttgacaacacatttttcaaacaaattgttggcagtttgatgtatctaactgcaacaagaccagacataatgtattctgtgagcttagttagcaggtacatggagtatcctacagaagaacatcatcatgaaaataccacaaaagaccaaggtgaagagcaaaaagacacgaatgaactcaaagaagaagaagccgatctcccagccatcagaagtgtcgttgatctggccgaaggagagatagttgcgggaaccgtcggggttgaggttgtagaactctgtgtggacggtcacggtgatggaggtttcaggggcacagttggcgaagaagaggctatattcattggagatggtgacggggtaggaatggctgaaggaagaaacccagctgtgggaggttcgcttggtgggacggcaccaccacggacaccgacaccgacggcggattag

SEQ ID NO: 53076 - DNA, 612 bp, Glycine max
  Peptide Sequence Number=SeqID_169854
atgcaccacgtaaagctcaccggcactcacggttgggatgtgttcttcttcaactttgacctcattcgcgtcgttttgctcttcagcgtggtcattttggtggggactcgttggaccttcctccacccgctcgtgcgggagagggggaagaaggtgctcttcctagttatcccgcttcaggttctggcgtgttgtgcttacagtgttgttcacgatactggaccctatatcataaattgggttacatggaaccaagttttcttgctcctcgacctcatctcttgctttgccgttgttttccttgttgtttggtccatgagatcactcaggaaaattacagaaggcgagcctgcagcagctatgaagtttagtcttatcaagcggttcaacctcgttgtcatcggctacttgtttttcacgcgctttgtcatgtttgcgtttaagacagttctttcgtatgagtatcagtgggtgagtaatctcgtcgaggagactgctactctggtgttttgcattgccatgttctacgtgtttggccttcttgagaaagatgaatactctgtgatcggtgacgaggaagaacaagtgtccgaaatcgttgttaaggaataa

SEQ ID NO: 53077 - DNA, 294 bp, Glycine max
  Peptide Sequence Number=SeqID_169855
atgggtctcggagtcaggtcaacgatcctttcttttccattccattttccaacaatcaccttcacctccggcgtctccgccctcctcttcaacagcggagatcaaaaccctcaccataacctccgacacccgccccacgatcctctttggagaaattcggcttcatccactccggctccgtggtggcatcaggtgggtcccaactcgatcctgagcgaaaagtccctcctccaagtcctgatcgagaccactgttgcctccaagaacgaaggtactgttggttcaccgtgttaa

SEQ ID NO: 53078 - DNA, 381 bp, Glycine max
  Peptide Sequence Number=SeqID_169856
atggcacaccaagagatgaagttgaggtaccaaggtgaagagcaaaaagacacgaatgaacttgaagaagaagaagccgatctcccaaccgttagaagtgtcgttggtctggccggaggagagatagttgcaggaaccgtcggggttgaggttgttgaactccatgtggacggtcacagtgatggaggtttcaggggcacagttggcgaagaagaggctatattcattggagatggtgacggggtaggaatggctgaaggttgggggaggaagaaacccagccgtgagaggttcgcttggtgggacggcaccaccacggacacggacaccgacaccgacggcggattagtggttgtgtgtggcaaagactatttgatctga

SEQ ID NO: 53079 - DNA, 276 bp, Glycine max
  Peptide Sequence Number=SeqID_169857
atgaatccaactcagtttcaagccaaagaagagaaagttaaagttgttgatgactcgcttagcgaggcaaatccgctcagcgagatgcatttgcttagcaaggcatccagcttgcttagcggatgggaaaccctacaagaggataatccaaagatctgcacgcccatcgcacagccagcccgcccagtgaggacgttgtctcttctcgcgcttagcgcgcccatggtcgctaagcgtaaattcactaactcgcactcagcaagacatgctcgctga

SEQ ID NO: 53080 - DNA, 321 bp, Glycine max
  Peptide Sequence Number=SeqID_169858
atgaatagccggctgtctatagttctcacaaatgataaagcaaaggaatttggaggctcttcgctatgcgaaggtatgggggagggatgttgtacgcagccttacccttgcatatgcaaagaggctgtttccggattcgaacccatgaccaacaagtcaccaaggcacaactttaccgctgcaccagggctcgccctctttttcgtaccccattgcccagaggctcttcgctatgcgaaggctgtttccggattcgaacccatgaccaacaagtcaccaaggcacaactttaccgctgcaccagggctcgccctcaagtaa

SEQ ID NO: 53081 - DNA, 324 bp, Glycine max
  Peptide Sequence Number=SeqID_169859
atgtcagcagtgccatctccctcatctgtgacctccataggcgtggtagcaggggtatcctacggtgtctcctctggctctggatgtggctcctgggctataggagcctcacctccccctacaggagaaggctggactcctgaacaggccacctgggccataaagcataagccatggtggaggctctgcagcatcggcacgatcgtgtttgtgctcaaagtggaggggccggagggtgcagtgagtgctaggggaaggactggtgttggcatacgtgctggtgtgggagctagagtagaggtagaagcatctgaaggtccttga

SEQ ID NO: 53082 - DNA, 297 bp, Glycine max
  Peptide Sequence Number=SeqID_169860
atggagggagtaaaaggccgagttgcattatggtctgatgttttggggcagttcatgcctttagttggcaaagattggacacaatctggagtggcaaggcttttctgtgctattaaggaaaatggataccaactactttttctgagtgcccgtgcaattgtccaggcatatctaaccagaaacttcttgcttaacctgaaacaggatggaaaaaccttaccaaatggacctgttgttatatcacctgatggattatttccctcgctttaccgagaaggtggggcacctctaacctga

SEQ ID NO: 53083 - DNA, 342 bp, Glycine max
  Peptide Sequence Number=SeqID_169861
atgaatggttttattgagcaggtggctcggaatatgcaaaattttaagcacactgtaaaacggttagaagaggtttctgtttcgtgtagagggatagagagagtacagttgctaagaaggtggttggttgcgcttagagaagttgagagacttactcttacccgcactgactccaatgctaaagatcaagacaacgaatttcttaatgatgaatccaaggatttacctacacaacaacccactttgatttactatgtagaccctgctgctccgggtgaactgaaaaattttggcgatgtctttctttccagtcaagctcttgagggcatatcattgtcaatg

SEQ ID NO: 53084 - DNA, 624 bp, Glycine max
  Peptide Sequence Number=SeqID_169862
atgactactctgactcagatatggatgacgctgctactcagcaacatcctgctcagcgaccataattttgacctccctctgcctaagtgtcagatggtgtacaccatcctgacatggatgactgttcacgtggaccagataattgctgacgccatttatttgtttgcaggggcggcgcccactaggcaccctttggacccgaagaggtccaacagggccctgggatttttggccttgatcatgggcctctgccagttctacggggtacttgtcatccccagcaaggtaatccggccgccgatcactcaagctttcatcgagaaatattgcacccctaggcaagcgaagggtgacgcacagcaggctgcggatgcaccaccacctcagcagcccgatccagttataccactgagtgtggagcagtatctacggcatatggttcgccagcagatggccaaccaccgcgggcaggggcagggctcccctccttttgtatgccctagagattggcccactgaggagggaaccggacccgcaggatcctcgagcgaagcggaggaagcccacatggatgaggatatgaccgacctactcggttacttgggaaagggcggagctacatga

SEQ ID NO: 53085 - DNA, 234 bp, Glycine max
  Peptide Sequence Number=SeqID_169863
aggttgagctttatatttgctgatttatggaacttaaccgcaggttacctcttttgtgtgactcagattcttgatgcaccaaatgaggaagaagtttcactactttcagagatatatgggctctgtattaaaggaggaaaggaagaacatactgccttgttatccagtgtacaggaattggcaaaagcattttctggatatgaagatgaagtgctggtaatgatgttagtataa

SEQ ID NO: 53086 - DNA, 626 bp, Glycine max
  Peptide Sequence Number=SeqID_169864
atggccacaaaacaagttactactactatggttcatgtagatgatgatgactacattgacatggaactatgtaattcctccccaaatttcttctcttattcccttagctctccaccatccaacagagagtttgaattccaaatgagtgagaaagagtcattaacttctccagctgatgatctcttctacaagggaaaactccttcctcttcaccttccccctcgtttgcaaatggttcaaaagctcgttgaaaactcctccaccaatgccaaatttgagtacatcaaatcagattcaccttcaacaaatgccaacaccccttttgaatccaacatctctccttcagaatcacgccgtgtgagcagtgatgtgagcccaaatgaataccaacttgggtggttttctgacattaacaagtacaaccttagtggtggtgatcttcctaagaagtctttgcccaagaaactgaaacagatgaagcagttctggcttggcctgagactcaaggcctcaagggcttacctgaaaaccttgttcaacaaatctggttgctcagacaagttttgtgccagtgctgcaagcaacaacaacatgggagcggagaagaaatcattaaagtgccaaga

SEQ ID NO: 53087 - DNA, 537 bp, Glycine max
  Peptide Sequence Number=SeqID_169865
atggagtcaaaaaacatgccagacttgaacggtgtcgctaagaagactaaaggtcgacaaaagatcgaaatgaagaagatgagaaacgagagtaaccttcgggtgacattctcgaagcgtcgcactggggttttcaagaaagccagtgagcttgcaaccctttgtgacgtggatgtcactgttattatgttctcacccggtaatcgagtattttcgtttggtagtcccagtgttgattctgttgtccaatgctataagacacatgtcccacctcccctccttaccttggacctcaacaaggtgcactccactgtggacgaagtcgagctccacacacacctccactgcttgtccaaccaaattgctattgagaagaagcgcacaaaggatttaaatcatttggcgaaggctgcagaggatcagttctggtgggctaggcctattgaaagcatgattgattcccaacttgacaagtataagaagatgttagaggagtttaagagacaactcaaagaaaaaggtgggaacctcaactga

SEQ ID NO: 53088 - DNA, 222 bp, Glycine max
  Peptide Sequence Number=SeqID_169866
atggctatcacttttctttctgaagttgaaggtaagcctattctcaattatgggtctgatagctgggattgggcagcagacccgtggggtatctactctacaaatagtgcttattcaatgttttgggaggaagcagcagtggacaatctcgaggaatgctttgaggagctatggaaaatcaagattcctagtaaaatagcggtttttactttgatagattaa

SEQ ID NO: 53089 - DNA, 210 bp, Glycine max
  Peptide Sequence Number=SeqID_169867
atggtagccataaccctagccaaggttcatcaacctccatttctccgagaatacgacccaaacgcaacgtgtgcttgtcacggagaagccccggggcgttccattgagcattgtagggctctgaagcgtaaggtgcaagagagaagtgagttatcaagaataggatgctggacaaatggcctcagttaccttaagaaaaaggggggttga

SEQ ID NO: 53090 - DNA, 969 bp, Glycine max
  Peptide Sequence Number=SeqID_169868
atgacgacaccccctccatctcccacacagttcgagattccttctgatgggatgtctaggaaaactagacaagccactcggctaagaaggttgacagcaagaacattggagcaagcaagggcaacagtcagtgtgaatccagcaactggtagaggatccggacctcacaaggatcagtttcacagttaccttggagttgtggcacgagacaagattccaattgttcacgctagctggaatgatgtacctgaaacactgaagaacatgatatgggatgacatattggcaaaattcgacatccccgagggtgatagtgccaaaaagaaggtgatgtcaattgtggcaacgcgttggaggcaatttaagtcggcgttgacaactaaatatgtgtatggtaacactgacggccaagcaaaagatgatcctttggttaaatatggcattaatgaaaaagattgggccgagtttgcaaaaatgaggcaaacccctacctggcaggactctttggaagagcaaagcaggcagggcagcattgtgccttccggacgtgacgatattttgaacatggctattggaagaccggagcatcctggtcgtgtacgtggggctgggacaggggttacaattacgcagtactttggtccatcatcgcgtcggtctaccagttcatcaaacatcactgtagaacagttggctaatataattggtaacctaaaagaagaatggcaaagacaggctgaacaagaaaacattaaaagagaggaggtgtggatgaggagggttgaagaggaaaaacagcgcactatggacacatttaaaggacaaatacaagaagctatcaagttggagttgtcacaaattgtatcacaacattcagccccacttcagccaaatgatatagaagtattagcagcaagggtaagcacggaagggaagctgtgtagcagcagagacaaatgcattagctaa

SEQ ID NO: 53091 - DNA, 1392 bp, Glycine max
  Peptide Sequence Number=SeqID_169869
atggcgaaccaagacttcgaagagcgccaacagcagcaacaaccgcaggagctagggtacgacccgaacttcgtccccgactcggtaaaatccttcgtggtccacctctaccgccacatccgcgagaagaacgtgtacgagatccaccagatgtacgagagctccttccagaccctctcggagcgtctcttcaaagacaccccctggccctccgtggacgccgtcgctcactacgtcgacaacgaccacgtcttctgcctcctctaccgcgagatgtggttccgccacctctacgcccgcctcactcccacgctccggcagcgcatcgactcgtgggacaactactgcagcctcttccaggtcgtcctccacggcgtcgtcaacatgcagctccccaaccagtggctatgggacatggtcgatgagttcgtctaccagttccagagcttctgccagtacagggccaagatgaagaacaagaccgaacaggaaattgcactcctgcgacagttcgaccaggcgtggaatgttttcggtgttctcaacttcctccaggcgctggtggagaagagtgctattattcagattctggagcaggagaaggaggggcttgagcagtttaccgcgactgatgggtatgattacaacggggggagtaatgtgctaaaggtgttagggtattttagtatggtggggttgcttagggttcattgtttgttgggggattatcatactgggctcaagtgcttgcttcctattgatattactcagcaaggggtttatactagtgttattgggagtcacatcaccactatttatcactatggtttcgccaatctcatgctccgcaggcttgttgatgaaactgtgaactctcagttacgtgagaagtatggtgaaaagatggttagaatgcagagatatgatgatgaggcatttgctatctatgatgagctcttctcgtatgcatgccccaagttcattaccccttcagcacctagttttgaggagcctcttgtaaattacaatcaggatgcctatagacttcagttgaaactgttcctttatgaagcaaagcaacaacagttgctatcaggtgtccggaccttcttgaaagtgtattcaacaatctccctcacaaaacttgcaagttacatggaagtggatgaacccaccttaaggactatcttgatgacatacaagcacaagacacatgctgttgatagtgatgggaaaattacatccaatgccgatttagatttctatattaatgatgacacaattcatgttatggagtctaagcctgccaaacgttatggggattactttttgcgtcagattgtcaagcttgaaggggtgatcaatgagatggacggtataaagctagagtga

SEQ ID NO: 53092 - DNA, 693 bp, Glycine max
  Peptide Sequence Number=SeqID_169870
atgccattcatatatgacacggtctgggacttgattaaattggcagattatctaacacacagagaggatatagacccttctaggataggaatcagtggagaatcatttggaggaatgcacgcatggtttgctgcagttgctgatactcgctatgctgtggttgttcctctgattggtgttcagggatttagatgggccatagacaacgataaatggcaggctcgagttaatagtataaagcctctttttgaggtggctcgtgatgatttgggtaaagatgttattgacaaagaagtggtggagaaggtgtgggacagaatagctcctggtttagcttcccaatttgattcaccctattcaattccaactatcgcaccacgtccattgcttattcttggtggaattgaagcatttgtttgggttttgagaactctaggtgcggaagatcgtcggtgtcctgttgcaggcttggaaattccaaggtcaatggcaagccaggcatatggagagtttcagtgtttagataatttaaaggtgcagcctcttaagttggatgtcattacgagaactcaaagaggtgtttggttgggcattctgtttaggtttattgcagaacctggaatttggcaccggttaacgagatttcaggtgaaagaatcatctgattggtttgataggttcttgaacccttaa

SEQ ID NO: 53093 - DNA, 2718 bp, Glycine max
  Peptide Sequence Number=SeqID_169871
atggtgaatcccttggtggaacgtgccacgagcagcatgctcgtgggccctgattgggccttgaacatggagatctgtgacatactcaatcgtgaccctggaatggggtatattcactctcagatcaattcagctcttgataggcttaaagaagattggacacagcagagcacaatgaaggtggtgcagtacctgtggtggatgcgtgatagttaccaaacccagtgggttggtggtgatagacagccatatttcggcgataaagatgggggactaatgttgtcctggttaagatcaatgttcaggggccatctagaggttcattctgtcttaactgaggcattgtgggggacatatgtgtggggcccaccgatttttgcttatatgggatggcatgcaaaggatgttgttaaaggtttaaagaagcggattggaagtaaagttcctagagttcaaattcttgcactgactacaatcataaagaattgtggggacattatccacatgcatgttgccgagagagatgttcttcatgagatggtgaaaatagtaaagaagaagcctgattaccatgtcagagagaagatattgattcttatagatacttggcaagaagcttttggagggccaagggcaagatatccacagtattatgcagcataccaggaacttttgcatgctggggcagcattccctcagaggtctaagcaatctgcacctgtattcacgccgctacaaacacaaccattgtcatcataccctcaaaatatacgagacactgttgctcagcaagacgcagctgagccctcagcggagtctgagtttccagcccttagtttgtctgaaattcagaatgcacgcggtattatggatgttcttgcagaaatgctcaatgcattagaccctggtaacaaagaagggcttcagcaggaagttattgttgatttagtggagcaatgtcgaacatacaagcagagagtggtaaaccttgttaattcaacttcggacgagtcactgctatgccaaggcctagctctgaatgatgatctgcagcgtgtcctggccaaacatgaatccattgcttcaggaacttctgctcaaaatcctgctgagaaaccgaaacctgcacctactggagcacttgtagatgttgatgatcctttggttgatattggagatactagtaaacaaacagatgtgagatcgtcttctagtgctggagctgggtctcaaacattgaatcagttaatgcttcctgcacccccaacatcaaatggatcagtcccccctgcaatggttgatccccaagtggacctactcagtggtgaagactataactcaccaaaagcagagacttcacttgctcttgttcctctaggagaacagcagccagccagccctatatctcaacagaatgcccttgttctttttgatatgttttctaatggaagcaatgcacctatttctgttaatacccagctaattaatgttgctggccaaaccagtccgttagctcctcaatttcaacaacagactttcatatctcaaggactgttttaccctaatgtaagtgtgccaaatgtggggtcacctcgatatgagcaatcaccttttgcccagagcacaggtccttcttggaatggccaggttgcgcaacagcaacagcctccttcaccagtttatggtacagcaagtggtggatcatttccgccacctccctgggaagcgcaacctacagataataatagtccagtagcaggcagtcaatacccacaaccactgcaagtgtctcaaatgattatgacgagtatacagagtggtacacatcctcagggacctcaagcaatggggcatgaccaggctgttggaatgtatatgcagccacatgctggccatatgtcaacgatcaataaccatgtccaaagcaatcaattaggcttgtaccgacagcatattcagggtgctgctggtccctatatgggcatggtttcacatcaaatgcataatagtcccgtggcttccatgtatcctcaacagatgcatggcaaccaattcggaggatatggctatggtcagcaaccaggagttcaatatcttgagcagcaaatgtatggtttatctgtgagagatgacggtgctccgaaaaattcttaccaggtttcttctccatcctatgtgccaccggggaagccttccaagccagaagataagttatttggggaccttgttaatatggcaaaagtgaaaccaaaacctactcctgaccaaactggtagcatggggtggtttgttcctgattttgatgccatctcttgcaattgtactgaggttgattttgactttggattgcgttttctcacgcaggcatcgcgggcaaggttgttcaaagagtacaaagaggtgcagcgggaaaaggccgttgatcctgatattcaactagtttgtgatgattcaaacatttttaaatggaccgctcttatcaagggaccctctgagactccttttgagggtggtgtgttccagcttgccttttctgttccggagcagtatcctctacagccacctcaagtccgggacgaacaagcagtttctaggcatagggactcaaatataaagattgtgcaggaaatcttctgcgttcaggcgatgttagagggtatcaatccatggcaagaatgtacacgagacttgcagcaatgccaaagaaaggctgaatga

SEQ ID NO: 53094 - DNA, 1164 bp, Glycine max
  Peptide Sequence Number=SeqID_169872
atgaaggcagtgacaaattgcaatcaatctggatgcttggcttattctagaactgaaatatctgatgttccacttttgtcttgttcagaggctatggaaaaactaaaatcattcagagaaaaggtaaagggcaagcagcaattccttgctatgtattctagcatttttggtgggataacaacagacccagctgctatggttattcccatggatgaccacatggacttgaatccacaagggttggtccactacgaaagagtatggccgaaaccccccagccagaatcaaacatctcgaggcaactatctatccctcggccaaagcctagtaccatcctcagatatagccagatactccatctgctgtcaaatgatgtattttatgcattattatagatacctctacgagctggatcaacaccttgaccgctttataaggtcagcatccacagccaaaataaaccccccatatgatcgtggaaccataagaggaatacttatccaaaccgtgagtgcttcaaaatgcagaaacggaacactacgttattggctctcagcgggaccaggagatttcgacctatctccctctggctgccacaaatcgtgtctttacgcaatcacaatacaggatttgtcaccaatcaacttcagaggagttaaagttgtgacctcaaatgttcccattaagcctcctcagtttgcaaccaccaagagtgtgaattatcttccgaacgtgctctccaagatggaggctgaggaacttggtgcgtttgtgggcatttggcttgatagtgatgggtttgttgctgaagggcctagcatgaacgtggcttttgtcaccaaagagaaggaacttgtgatgcctctatgtgacaaaattctaagtggctgcacggctaagagggttttaacccttgctgagtctttggttagggaaggtaagctttgtgggataagaatgaaaaatgtgagcgtggaggaagggaagaatgcagatgaaatgatgcttcttggcagtggaattatggttcgctctgtagtgcagtgggatgagcagataattggatgtggtaaagaaggccctataacccagactctactgaatctagttgttgaggacatgaaatccaccctgccagctgttggcacacctgttccttattga

SEQ ID NO: 53095 - DNA, 255 bp, Glycine max
  Peptide Sequence Number=SeqID_169873
atggagttcgtctttgtcgagttcgtctctgccacttatcaattgagctcgaagaaaactaggaaaggaaagagtcccggaaaaggtgggaatcgattttggaagtccattgtggttggctttaagactcccagggaagccatcaaaggtgatttcttcgtcttctttagtcgctgtcaagatgtggacaacagagcaagttccatgcatgctttgaatgtctttggtacatgtgacttgttggttactggttaa

SEQ ID NO: 53096 - DNA, 1200 bp, Glycine max
  Peptide Sequence Number=SeqID_169874
atggcggaaaataaagccattgaagaagctcagagcaagttccgttcagagttccttcaagttctgcgtagtaggcgacccgctcaagttccattaacagtcgaattcgcgaagccagtggtgaatcctttgcatcagaactctcctccatcgatcgaagagatcaagataatggagtcgtgtccgagaactgatatagagaaccttgaagacttgctcgaggaggagaatctctatttgaatatagaggaaggagagcaaggacggttgcctttgttgattttgaagttgaaggaaagcgataagcagagaaaaaggcctgcagttgtttttcttcacagtacgaacaaatacaaagaagtcctacgtccattgcttaaggcgtatgcttcgcgaggatatatagcaatttctgttgattctcgttaccatggagaacgtgctaccagcgcaaccacctatcgcgatgcacttatttctgcatggaaaactggtgagacgatgccattcatatttgacacggtctgggacttgattagattggcagattatctaacacagagagaggatatagacccttctaggataggaatcactggaatatcacttggaggaatgcatgcatggtttgctgcagttgctgatactcgctatgctgtggttgctcctctgattggcattcagggatttcaatgggccataggcaacgataaatggcaggctcgagttgatagtataaagcctctttttgaggttggagcggtgtttaagacctataagggaaaatatgatatgaatcttggtcctatctgttgggattcattcaagcatgctaaaagtggaaaactgaacatatattctgaagcggctcgtgatgatttgggtaaaggtgctattgacaaagaagtggtggagaaggtgtgggaccgaattgctcctggtttagcttcccaatttgactcaccttattcagttccaactatcgcaccacgtcctttgcttattgttaatggtgcggaagatcctcggtgtcccgttgcaggcttggaaattccaagggcacaagcaagccaggcatatggacagtttgactgtttagataatttcaagattattacagaacctggagttggacaccaattaacgagacttcaagtgaaagaatcatcttattggtttgacaggttcttgaacccttag

SEQ ID NO: 53097 - DNA, 747 bp, Glycine max
  Peptide Sequence Number=SeqID_169875
ggaacccttgaagagttgctcgaggaggagaacttgtacttgaacatagagaaaggagagcaaggacggttgccggtgatgatactgaagttgaagagaagtaataagcagagaaaaaagcccgtggttgtttttcttcacagttcatacactaacaaagaatccatgcgtccattccttaaggcgtatgcttctcgaggatatatagcaatttcggttgattctcgttaccacggagaacgtgccaccaacacaaccacctatattgatgtgtgggacttgattaaattggcagattatctaacacagagaagagatatagacctttctaggataggaatcactggaatatcacttggaggaatgcatgcatggtttgctgcagttgctgatactcgctatgctgtggttgttcctcttattggcgttcagggttttcgatgggccatagacaacgataaatggcagggtcgagtcgatagtataaagcctctttttgaggtggcacgtgctgatttaggtaaaggtgctattgacaaagaagtggtggagaaggtgtggagccgaattgctcctggtttagcttcccaatttgattcaccctattcagttccaactatcgcaccacgtgctttgcttattgttaatggtgcggaagatcctcggtgtcctcttggaggcttggaaattccaagagcaaaggcaaccgaggcatacagaaagtttcattgtttagataatttcaag

SEQ ID NO: 53098 - DNA, 198 bp, Glycine max
  Peptide Sequence Number=SeqID_169876
atgctggaccttgaatgtgatgcactgattttggagatgtttcagcatttcttgaaagctataagacctcgtcgggttcaatggaagaagaacaagctagggtgttgcttgaatgtcaaagaggctaaggttcaatggaagaacaagcataaggaagagactagggttcagaacaatgaacaggctaggggcgcttga

SEQ ID NO: 53099 - DNA, 283 bp, Glycine max
  Peptide Sequence Number=SeqID_169877
atgaattttaatcctaataaaataatagcattaaacagtgcatctttcgtcatttacctcttgttctcaagctgctatggcggtggttctcactctaactgtaaaatccaaaacaaattggcgggaaaagaagccattgtagaagctcagagtcagagcaagctccgatcagagttccttcaagtcctgcgtagtaggcgacccactcaagttccactaactgtcaaacctgcgaagccagtgaagaatcctttgtatcaaagcctcctccaacgaggaagag

SEQ ID NO: 53100 - DNA, 441 bp, Glycine max
  Peptide Sequence Number=SeqID_169878
atgggtttacccgaagagccgtcattgaaccatcgttgtatcctaaattctatcacgtttacggcacgtgcttcttactatctcttacgttggcgcgctgtatcacttcttttctccattttttcgactacttactattgctttggcgccctagctacacagagcatcttctccgacaaagaccatcgtctccgacaaccaccatctcgtgtccgttgcgtctcgttccgtttgaagccgccgccgacaaaggcccttggttgttgttggttgtcttcatcgtggtctacattgtactgtttaaggaagataagtggggtttatgtggggctcgttgatgaagctgacttgcgggcaatgagtgaacgaccttcgggaacagcctgctgccatccttcatcagtggtgtgtcatcctgtgccacattatcagtttcattga

SEQ ID NO: 53101 - DNA, 144 bp, Glycine max
  Peptide Sequence Number=SeqID_169879
atgacgggtagcggcaaacgtcgtcgttctgaagcccttaattacggatatgccaccgcaatgtgccttatggatgagtttgggaatttccttcaagcaagaacagctacttccttcctttggttcatgaaggagaggccttag

SEQ ID NO: 53102 - DNA, 552 bp, Glycine max
  Peptide Sequence Number=SeqID_169880
atgtataaaaaaacacatgaggttgcttgttgggtgtccaccggggagagacaagcagcaagaataagaggcttatacctcagagcaattttaaggcaagatatcagcttctttgacaaggaaaccaatactggtgaggttgttggaaggatgtcaggtgacacacttcttattcaagaagccctgggagagaaggtaggaaaattcatacagtgtgtggcatgttttttaggaggtttagtcatagcattcatcaagggttggcttctaacccttgtccttctatcttgtattccacctcttgtcatctctggttccatgatgagctttgcttttgcaaagttggcatctcgtggacaagcagcttattctgaagcagcaactgtagtagagcgcacaattgattcaattcgacaagttgcatcatttacaggcgagagtcaagctatagctcaatacaatcaatccttaaccaaagcttacaggattgcagtgcaagatggagtggttgctggtttaggcctggggtcaatccttaaccaaagcttatag

SEQ ID NO: 53103 - DNA, 132 bp, Glycine max
  Peptide Sequence Number=SeqID_169881
atggatgtgcacatagtaacaagggagacccctaaggctcgcccaggcgagctgaaacttagtgctaaagcaatgagctcgcccagacgagttggttgcttcaccatgaagtcatttggtggcccaggctag

SEQ ID NO: 53104 - DNA, 1122 bp, Glycine max
  Peptide Sequence Number=SeqID_169882
atggatgtcaataatgcctttttacatggagctatatctgaggatgtttacatgtctcaaccttctagctctattcatccatattttccaaatcatatatgcaagctccataaagcattatatggtttgaagcaggcacctcaggcatggtaccaggaattaaagtcctttgttgttgcctctggatttttcaatgttaaatatgtttcttcactctttatttataaacaagatcatgtcattgcttattttttagtctatgttgatgatcttcttcttacaggaaatgatgtcactttcctggccaaattcaaagcaactcttgctacaaaattttctctcaaagatcttgggacgccgagccatttccttggtgtagaacttcttcctaccgctaatggcatgttcttatctcgagaacactacattcgggatatcttgcaaaaaggtaacatgattgattcaaagccaattggaactctaatgtctactacctgctcgcttagctcacacaatgatacacctaattgtgattcatctttattctgcagcatcatcggatccttacactattcatccatcaccaggctagatgttgcatttgcggtaaacaagatgtcgcaatacatgcagtcacttacaactactcacatgcaggcactcaaacgtatcctacgctacctcaagcataccatctcacatggtctacaacttgtttcaaccaaaaaccttgatttcactgtcttttgtgatgcagattggggtggtgatacaaatgacaaaaagtttacaggtgtctatattgtctatcttgatccaaatgctatatcttggtcttgcaagatacaatccacaattgcaagatccttaactgaggctgaaaatcgcatcattggattaatggcttctgaacttctatggctacaacaactactattggaacttggcatcaaattgaccaagcaaccaactatcttttcagacaacattggtgccacatatctttgtacgaatccaatttttcactcaaggatgaagcacttagctattgattaccattttgttcgtgacatcgttgtcaagggtgaactcaaagcgtctcatgttccttccagtcattaa

SEQ ID NO: 53105 - DNA, 924 bp, Glycine max
  Peptide Sequence Number=SeqID_169883
atggcacccaccacttccactaccaccaatgagttaaaagaactcatggagttcaacaacaattttcagtttccaatcaagcttactgctaccaattaccctgcctggtacaaacaggctatgttaccggaaaaaaaaatttgtccacctgccaccgttggttctggcgatgctgcagcaccaaatcctgcatattccttatggattcggcaagataagctcatttatcttgcttttcttggctcttgcgattctgaagcacgatctgtcatggctgttgccgacacttcttgcgatgcttgggtagcccttgcacgtgcattttctaatcgatctcaatctagaatcatgtctctcagagaatgtctcagttctatcaccaaaggcacctcctcaattttcacttatctactgtcgattcacaatattgttgatgagttggctctcattggtaatccaattgacgaccttgaaatggtcatacatactctgtatggtctaggaccaacatttcgagagttcactgcctccattcgcactcgtgattcaccaattgccttcaataagttatatgataaattggtggatttcgagatgtatttacagtgtgaagaacgcctctcaactcccatccccgtcactgccaatgttgttcagtgtcatcaacatggtcaaggtcgtgggcactctttccatggccgccaacacaaccatcatgttcacagttctgtttcctcttgcaacaagaaaccaaccaatccgatcacttgtcagtattgtgaaaagcctggggcatctcgtcacatcgccaatgatttgacaaacttgactctcaaggatgactaccatggaaatgacaatcttcaagttacaaacggtaaaggacctatgaacgagggagcttcttctgcaaggattgaatga

SEQ ID NO: 53106 - DNA, 171 bp, Glycine max
  Peptide Sequence Number=SeqID_169884
atggattttgggtcttgtttctacgtcacgcaagaggagttcaatctgttccacagaatggacagagaactctacaagattcttgtggtgagccttttccgcgatccagaggagtccatgcaagtccatgcaatgtggctgtggctggagagggtggggtttcgcaacgtg

SEQ ID NO: 53107 - DNA, 957 bp, Glycine max
  Peptide Sequence Number=SeqID_169885
atgggtaacgctcatcattcacaatggcatcgcaaacacggtaactccgttcttccgccccataaatacaatcctcagccaccaccaaccacctccaattccaacatgctttctcttccttacacccacgtcgacaccactctccgctccctcgccgcccaagccgagggcttcggtcgcttcgccatcggcggcctccacggtccccttcaccacgtcacatctctcgcagatgatggaccggggtcgctgcgtaacgcgtgtcgccgaaaagaaccgctgtggattgtgtttgaggtttccggcaccattcaactctcctcctacttgaacgtgtcgtctcacaagaccatcgatggtcgtggccagaggatcaaactcagcggaaaaggcttgcggctgaaggaatgcgagcacgtgataatttgtaatctggagttcgaaggaggcagagggcatgatgttgacgccattcagatcaaacctaattccaagcacatatggattgatcgttgcacgcttagtgattttgatgatgggctcatagatatcacccgagaaagcacagacattactatttcaaggtgtcacttctcccagcatgacaaagccatgctcattggggctgatccctcgcatgttggagataggtgcatgagggtgaccatacaccattgttttttcaatgggactcgacagaggcaacctcgtgttaggttcgcaaaagtgcatctgtacaacaattatatcagaaactggggcatatatgctgtttgtgctagtgtggaatcccagatattctcgcaacataatatctatgaagcaggacagaaaaaggtggcatttaagtaccttactgagcaggcagcagacaaggaagtgggagcaactggtaccataatgtctgaaggagacatattcttaaatggtgctaaagcgggattaatggctgtggat

SEQ ID NO: 53108 - DNA, 609 bp, Glycine max
  Peptide Sequence Number=SeqID_169886
atgtcttgtttattctcttctgagagcagcgagattccccttctccagagcctggtggaaaaggaaatcagtcttcaattcgtgtatgaaaaccgaagcagcgcgcttcaaggggtggctaaagtgatgcaagacgtgtgtgtgagggcattcactgacatcatggagcaagcaatgataaggaactcagcggaagcagcagcacaaaaggtggtgacaacaacaagacaaagtagttcatcatcatcatcatcagagaattataattaccatcatgggcttgtgtggtttgggtcaattgggccagcggaagataggactttgttcgtgacgttctccaagggttatcgcgtggaagagtgggaagtgagagagttcttcgctttagcgtatggggattgcatagaggccttgttcatgcaggaagtgcagccaaatgaacaagcgctcttcgctcgcattgttttccgcgccgtttccaccattgacatgatactcagaggggctaacaaagccaaattcatcatcaatgggaagcatgtgtgggctcgaaagtttgtgcctaaacgaaacgccataaggactactttgcttgcaacaacgctctag

SEQ ID NO: 53109 - DNA, 1835 bp, Glycine max
  Peptide Sequence Number=SeqID_169887
atgagattcatttgcttcgagccgaaaacgcagtcgttttccttttcccgccacactccgccaacgagttcatcatcaccttctacaagcactaaggagagctttgaagaagcagaaactctgatactaaaatggaaccctgaaacctctgcgtacggaagagtaacctctctcttctacaacgacaaagctgaagccatgcactacatccactgcgttaacatgcttcagaaaaccatgcactctttgatctctcagaacgcttcctcgcagaaactcattctcgcccataacctaatgcaaatggccatgaagacactccagaaagagttctatcagatattatcaatgaaccgggcccaccttgaccctgaatccgtctccaccagatcctccaccacttcaacaagaacctctttctgttccgacagttacgacggcggcacagcggaagaagatgttcgcgaatcgggggattgtatctccgaagtcgaacgtgtttcttctgaagccatggcggatctgaaatccatcgcggattgcatgatttccaacggttatgcgaaggaatgcgtcagcgtttacacgaccatgagaaaatcgatcgtcgacgaaggcatttatcgcctcaacgtggaggagtttagttcctcgaaggtgaacaagatgcactgggatgtgctcgagttgaaaatcaagagctggttggaggcggttaagatcgccgtgaggacgctcttcgcaggagagaggatcctctgcgatcacgtattcggtgcgtcgcaatccatcagtgaagcttgcttcgccgagatttctagaagcggagcaaatctgctgttcggattccccgaactagtcgcaaaaacgaagaaatcgccgccggagaagatcttccggatgattgatatgtacgctgcaatagccgggatgtggtcggagattgaatcgatattctcgctcgattcaacaacagctgttaaatctcaagcctacggtcttcttctcggactctccgagtctgtacgaacgagtttatcggactttgcgaccgcaattcagaaagactcttccaaatcgacggcgaacttcgccggcgttcattccctgacagtgcaagtgatgaatcacttgactactctcgcggattacagcaacgtgctctcggaaattttcttcgacgtgccaccgccgccgaggtcgccgttgccggaatcttacttatacagtccagaatccgacaacaccaccacgacggagacggagttttcagtgcagatggcgcggcttattctgattcttctctgcaagatcgacgggaaatcaaggtattacaaggaagtttcgttgtcatacctgtttctcgcgaacaatctccggcacatactggccaaggtccgtgcgtcgaacttgcattacgttctcggcgacgattgggttttgaatcatgatgcgaaggtgaagaggttgacggcgaactatgagagagtggcgtggggcaaagtgctttcgtctttgccggaaaatccaacggcggaaatgtcggcggcggaggcgagggttatgttcgggaatttcaattttgaattcgagaaagcttatcggagagagaacacgttcaccgtgccggaacaggaatttcgagaagaaatcaaagcgtctcttgtgagaaaaataaccccaatttaccgcgaggcgtatgaaacgcaccgtattgtaatgggaacggtgagggaaataagagagtatgtcacatttgcccctgaagatgttgagaattacatgatgaatcttttctctgagggaagagcgagctccggtagcggaggaaacaa

SEQ ID NO: 53110 - DNA, 480 bp, Glycine max
  Peptide Sequence Number=SeqID_169888
atggataacctttttttccattcttactataataacactggtttggtcgtttgtggccttggcattgctggtaacacctcaaacattatcaaagctgcagtgacccctgcatttgatgctcagtttgctggtctcaacggcctcggcatttccgtggcatgtttggacttagcagcaggtggagttataccacttcacactcatcctggagcttcagaattacttgttgtaatagaagggaggatcctggctggattcatttcttctgcaacactgtctacatcaaaactcttgggggatgttatggcattccctcaagccttgacaattgtaagattcagtagctccaatcctggtctacaaattttggactttgcgttgttcaaaagtagtttccccacaccattgatagtacaaaccactttcattgatgttgctctggtgaagaagcttaagggtgttcttggaggctcaggctaa

SEQ ID NO: 53111 - DNA, 1278 bp, Glycine max
  Peptide Sequence Number=SeqID_169889
atgaagaagaaagtgtgtgacgcctgggttcccaagaggaatcaaaaagggggggagaagggctttttttttgtgccctctcttcaagaactctgccttgaaatgcttgcggataatgctgatgcaatggtttcgcttgagggtgtaccggatgagctgatacgcaagctttgcaacctgctctgtgactcaagaaagatgaacacccgatttcttgagcttcttctcagtggctctcccacggagattcggttaaaagactgttcttggttgacggaggagcagtttgccaaatattttcaaacgtgtgacactacaagattggaggtgctgcagcttgaccagtgtggaaggtgtatacctgattatgcattacttggtactttgagacagtcaccaaggtggttgccaaagttaattacactgtccctcagtggtgcgtgccgtctgtcagataaggggttgcatgtgctagcttcttctgccccagcactgagatccattaatctaagccagtgctcccttctctcatctgccagtattaatattttggctgattcattgggatcccttctgaaagagttatatcttgatgattgtcttatgattgatgctgcacaaattgtgccaggactgaagaaacttaaacatttagaggtgttgtcattggctggcattcaaactgtctctgatgaatttatcaaggactacatcattgaatgtggtcacaacatgaaggagcttattttaaaagactgtcgaaaattgactgatgcatcgattaaaggcgttgctgaacactgtcctggattgtgtgcacttgatcttatgaacttggacaaattgacagatttatccttaggatatcttacaaatagttgtcgagcacttcatacattgaagctctgccacaatccattcagtgatgaagcaattgctgccttcttggagattactggagtgtccttgaaagaactttcacttaataatattaagaagcttcttggccgtgataaaaaacttcgtaccctattgtccagaggctcttcgctatgcgaagacaatgagttgggtttcattgtagatagctgcttctcactgaggttgcttaaaatttttggatgctcactggtgacagatgtttttctgaatgggcactcaaacccagagattcagatccttggattgaagatgtctcctttattgcaaaatgtcaaagtgcccgaaccctgtcaaggtcctctgcgttattcaccagtttcagtagatttggtataa

SEQ ID NO: 53112 - DNA, 327 bp, Glycine max
  Peptide Sequence Number=SeqID_169890
atgccagagaccattaggagagccatgccaaatgatgttgggggcatctttaggagaatagttggtgcaaatgaggaagcagaaagtatgaagattgagaaattcaaacagctaaggaggaggttggtgaaggaacatgcccttctgacctttgatttagaagaagccatttctttatctgctttgcttttggaagagggtggaggatttgaatttataaggagggtgtgcaatattccctccgaaggcattcaaaccgtctcgaataaggagaaactgtgcactgcaaaacataagctcctgtctctgccacctgatgatgattag

SEQ ID NO: 53113 - DNA, 927 bp, Glycine max
  Peptide Sequence Number=SeqID_169891
atgtcccttctgaagtcaccaagggaccccaaagaagccaaagttttggtgaggctggagtgtggggcattgatggcaatgtgcatgctgcagtgtgtggtgctgatgctgagttgtgcagtgcatagttgctgggtgaaggattatgaggaactggaagcagagaaagcggcctccgcgaggaagaggagtagaagaattgcggaggtgcaagaggagtccatggctaatgcaaccaagatggcagaaatcaaagctaaggagttggatgagaaaatgaaaagcaagaccatcgatactgatttcttgaccaagaagaagaagcaagtttcggtgcaacttccgagtttgacatcacctgtctccactgtgaggttctgcgatctcaattttggccgcttgcaaccttcggatgacgaattggatcctcacaatagatttgagtttggcaatttcgttgcacgacaagccctgcttcacgaagagtattggacagcagcgtggctaagggcagaagagtgggcaagtcgaacacataaactgtatgacacggaatttgatgcgataaaaaagcggtgcaaggagcaacaagacggtcagagtagcacatgcatcatcacggtgaggaagcaggacaagaatgtaaaacgttcaataataagcagtgttgtaggaacccttgatttgaatatccgatatttgcggctaggggagacctttcctggggaaccggtggatgctcctcgtttttgtaaaatcgaacgaacaccatcaagcagatatggttatattgcaaacttgtgtgttgccaaatcagttcgtcgcaagggtattgccagcaacatgttgtattttgctgtggagtctgcaaaatctagtggtaatatgaacattaatgtgagagtaacatttacaactaatgtctga

SEQ ID NO: 53114 - DNA, 570 bp, Glycine max
  Peptide Sequence Number=SeqID_169892
atggaatcggtgccaaacccaaacggggaggaacccacttcgtgggatgagctatacaacatcaatttaatgccttcagagttatttctcaagttccgaaaagaacttcagggcattcgagttggtctcaacatggagttctataatgccccagtcaatgaatatcaagcaaagcttgtattgaagcctttaacacctgaatggaagtggaagataatctatgagccccttcatcaagatgttcgtgttctttcaaaaaagatccccatcactaaatttcttaatcttcaggttggtgtaggacacaattttcaaatgcatgctactggttggaaatggaagctcaccacttgtttgggtggagatggtatatcccggatccgaaataagacttccgttggcttgtttcccggttttgatttacggtttggatggagggcagactatgttcttcctgaaattactggggcattgggtactgatgagccaatgttcaacatgcactcaggacggctacaagcatcattagatagagttgaggccatcttaacccacactgatgctccttga

SEQ ID NO: 53115 - DNA, 1824 bp, Glycine max
  Peptide Sequence Number=SeqID_169893
atggcgatattctcggaatcaaatcaccatcacaacacttccgatggggtctcccagcgagtcaacagcccgcgtttctcgggtccaatgactcgccgcgcccactccttcaaacgtaacaacaacaacatcgccgccaacaccgccgccaccacctcccacggcggcgccggcggaagtggcgccggcgaagttgagcttcaaatcaactcgcccagatcggaggaagcgtcggagggagttccggtggggaagcacagccaccatcacgtgactcagagagtgcacgtgagggggttgctgaagaagcccctagcatccatcgttgaggatttggggttgagggaaaggaagaaaattgggcactggatgttcttagtgttctgtggggtgtgcttgttcatgggtgttctcaagatatgtgccaccggttggcttggatctgctattgaaagaactcaatccaacaaggaactatctgactccattgctagtctaaatctaatggacaaaagctcccttggttatgcatatagggggggagcaagtgatgttgaacgaacattaaaaacagtagcaacaggagatgggagccatactgccatgactgaagattcagggatctggtccaaacccaacagtgacaatttcaccaaatgcatagatcttccaaaactagatgcaaagaccaatggctacattctcgtaaatgcaaatggtggcctgaatcagatgagatttgggatatgtgatatggttgctgttgctaaaattatgaaggctacacttgttcttccttctcttgatcacacctcctactgggctgatgacagtggcttcaaggatttgtttgattggaagcattttattaatatgctgaagaatgatgtccacatagttgagaaattacctcctgcctatgctggaattgagcctttcccaaaaactccaatatcttggtcaaaggctgtttcatgggttcgaatccggaaacagcctctttgcatatgcaagggtaaggctgcgtacaatatccctcccccataccttcgcatagcgaagagcctctgggcaatggggatccaattggaagacacgggatttgagtctcacattggaagtgcgagatttttctgtgggatttataaggcccctgattctctaactgcaaaggatatgcttgcatttacaggctgcagtcacaatttgactgcagaagaagatgaagaactgagacagatgcgatatgaagtgggtcactggaaggaaaaggagattaatgggaccgagaggagattgcttggaggttgtccgttaactccaagggagacttccctattacttagagcactggattttccatcacacaccaggatttatctagtagctggagaagcatatggaagaggaagtatgaaatatcttgaggacgatttccccaacattttctctcattcctctctgtcctctgaagaagagttgaattcattcaagaatcatcagaacatgttggctggtatagactatgttgttgcccttaagagtgatgtatttctttacacttatgatggaaatatggcaaaggccgtacaaggtcataggcgctttgaaaacttcatgaagaccatcaatccagacaagatgaattttgttaaacttgttgatcagttggacgaaggaaaaatttcatggaaaaagttcagctccaaggatgtatttgtgaaacaagatagtagtagagactcccctgaagattgtctgtcttatgatggcactgcaaatgctatcaaaagacattgtggctgtgctgcgatatttttttaa

SEQ ID NO: 53116 - DNA, 396 bp, Glycine max
  Peptide Sequence Number=SeqID_169894
atggcagtcaccagggcttgtcaaaggtcgaagagaagtttgaccgaacaactgagtaggacggaaaagaatatgttgacaatcattgaccagtataaagagaagctaagcttagctattagccatgggcagagactagaggatgagcatgtgaaggtatcaactctgcaagtggaaagggaagcaagggagagggtgatagaatcatttcacgaggaagctgtgaaatggatggatagattcgctctcactctaaatgggagtcaagagattccaaggctgttagctagagccaatgcaatggcggacgtatactcagctcccgaggaagttcataagctctttgattattgtcaacacatggttgagttgatgtcccacataattagtgattga

SEQ ID NO: 53117 - DNA, 342 bp, Glycine max
  Peptide Sequence Number=SeqID_169895
atggaaagcaacagcaagaaaaggaaagcaacgaaggatgaaggtgaaaaatggaaaaaaaaattccggaagacccttcttccggaagaagaaggttgtcttccagaagaaccttcttccggaaacattccggatgatgtttttccggaaagtattcctgacttcttccgaaatcacaaaatctacttccggaagaaggttcttccggaaaatgaaacttccgaaatgattccggaagaaggttcttccggaaagaggcttcgcgggagggcattttcgcccattcactgtttgttgggtgccccaacaatattgctgggtgcacgtagcaactcccagtaa

SEQ ID NO: 53118 - DNA, 840 bp, Glycine max
  Peptide Sequence Number=SeqID_169896
atgaaacgcatagacatgttctgtgcttctcaagcctcaacagccatatgtctgagcatggaacaagcctcatgctcctcttccaacagcattctactaggaggccgaaccatggaccgccacaaccccattatcaatgactcaagaaggagcacttccaaatccctcactgctccatgttcctcttctcagtcccccatcaaccccaagccttaccatgagctccacaaggccaagaaaaactcttcttcaaaaaatgcagcaaagggtcatgataatcatcatcagaagaaaagtacagcagaaaaactcactgaacatgtcaccaacacttctaaaccagttgatggcattgttcgtaggggttggcttaaaccacctgctaatttaatcactcctcctggttcaactagatctttgctcagtgacactgccttattggatggttcgtcagattttgatccagttttggctttaactactacggttaataacaaaacttctcaagttggtcatcaagatgaagctaatcctgtttcgaaactttcaagctcttctcatccaaaatctggttcctcagaccaggttgtagtattgagggtatctttgcattgcaaaggctgtgaagggaaggtgaggaaacacctctctagaatgcaaggagttacttccttcaacatagattttgcggcgaagaaggtgacagtggttggggatgtgactccattgagtgtcttggctagcatatcaaaggtgaaaaatgcacagttatggccagcatctgcctcagcagtgggatctggtactgttgaaacaaagagaaaaactttatcttattaa

SEQ ID NO: 53119 - DNA, 1269 bp, Glycine max
  Peptide Sequence Number=SeqID_169897
atgaaacagctccacaagcaaacgagtctgaatcaccggagggaggaagagatgttggggagcagcgagagctcaccctactcccccaaatccatcaagcacaccagatctctccccagatccatcaactacctcctccgcgagcagcgcctcttgttcatcctcgtcggcatcctcatcggctccaccttcttcatcatccagcccactctctcccgcatgggcccacccgagccggcccacacattcctccctcgaaccgggcttgcccgcttcagcggcacaaggcctcgcacgggccgcgttccggtcgggatcggcggcaggaggcagcgaatcgtcgtcaccggcggcgcgggcttcgtcgggagccacctcgtcgacaaactcatcgctcgcggtgacgacgtcatcgtgatcgacaatttcttcacgggaagaaaagagaacctggtgcatctgttcgggaaccctaggttcgagctcattcgccacgacgtcgttgagccgattctgttggaggttgatcagatctaccacctcgcgtgtcccgcgtcgccgacgaatgtgatgggcacgcttaacatgcttggccttgcgaagagaattggggctaggtttctgcttactagtactagtgaggtttacggtgatccgttggagcatcctcagaaagagacttactggggaaatgtgaatccaatcggtgagaggagctgttacgatgaagggaaaaggactgcggagacgttggccatggattatcatcggggtgctggtgttgagtactttcccaagaatagctatgttcgtattgctcgaattttcaacacatatggaccccgcatgtgtttggatgatgggcgtgttgttagcaattttgttgcacaggctattcgtaaacaaccattgactgtatatggtgatgggaagcaaacaagaagtttccaatatgtctctgatttggttaatgggctggtggctttgatggaaagcgaacatgtgggacctttcaacctgggtaacccaggggagtttaccatgttagagcttgctcaggttgtcaaagaaacaattgattcaagtgctacaatagaatacaaaccaaatactgctgatgatccacacatgaggaagccagatattagcaaagccaaggaactgctgaactgggagccaaaaatccctctgagagaagggttgcctctcatggttaatgatttccgaaatcgaattctgaatgaaaacgaaggaaaagggatgaaataa

SEQ ID NO: 53120 - DNA, 369 bp, Glycine max
  Peptide Sequence Number=SeqID_169898
atgacattaggggtcatggtagcttgtccaagcgagttattgcttcaacttgaagtaaccttgctcgcccagctagcgttcaacactatagaggattttgagtcccatgaaagcataaagacacggactttgagtcctatgaaggataagggtgaggactttgagtcctatgaaagacaagcgaggactttgagtcctgtgaaagataaagggaggactttgagtcctgtgaaagataaagtgaggactttgagtcctatgaaagataaagtgaggaatttaagtcctgtgaaagataaagtgaggactttgagtcttgtgaaggataaagtgaggactttgagtcctgtgaaacaagccaataggtaa

SEQ ID NO: 53121 - DNA, 1649 bp, Glycine max
  Peptide Sequence Number=SeqID_169899
acttcgccgaagccttttccgcgcgtttcgggaacgccactccatacggcgagttgttgagagcagtaacattgcaattcaaatcgctgttttacgagatcggtttctcatcactgccgaaagatggaacagagcgaaacggcgtcggatttagctccgaggaaattggttcgccaattgaatttcgccgccgtttacggagatccgtcgcacctgaaactgcctccaccgtcaccgtcaccgtcaccgccaccgccgtcgcattctccgttgcgattgcaattggatttgctgccgccggggcaacggccgtggttatgttcagagccgcaggaacaacaggcgtggttatattcaccgcggctgaagctagtttcgccggttcgacgaattccgcaccccgtgaagaagcttccggtgaaggtgttgcaagtggcgtaagtactcttaaagctcaaacgaaattaaaaagaaaagaaaacggtagtgtttttggtttgccctgtctgaatgataaggaatactcggatcgcgctcaagtgtatcactctgggatctattgtgatggctgcaactgtgtaaattgccataataatgtggataatgaggctgccagacaggaggcagttggaataacattggaacgcaatccaaatgctttcagaccaaaaattgctagcagtccgctagaaagaagagattccaaggaatgtgaaattcaagtaataggaaagcacaataaaggatgtcactgcaagaaatcaggttgccttaagaagtattgtgagtgcttccaagccaatatcctctgctctgaaaattgtaaatgcatggactgcaagaattttgaaggaagtgatgaaagaagagcaatttttcacaaagattataatctagttcacatcaaacaggcagctaatgctaccattagtcgagttgctggatcatctggctatggaacccatttaacacccaagaagagaaaaattcatgaaatgtttcctggaaagtcagccatggatcaaactgataacattactgctcaataccaacaggaaattgatcctatggcttcatcgccttcatttctgtcagattcgtttgtttctgacccttccaacacaagaatttcagcgtcttcaagatctacataccggtccgtattggcagatttcttccagccacaaaatgtgaagaatctctgttcactttttgttgttctctcacaagtagctgctaagacaaatgcagaaatgataggcaaagtagaccagcaaacaaaaactgggaactttgaagcttctgttgcttcatcatctaaatcactgcaagaaactagagatgtccaccagcttgtttgtgatgatcacgtgaataaagatgaagcagatgcagttgatattgctaattataataggccattgtcaccagaaacactggcattgatgtgtgatgaacaggatgatatgatttttggaaatagttctgcaaatggagttgcatgcaacagcactttgcaaaacatgattcaaaagtcatctaattctgatggatgcactgatgtttgcagagagcaggaaaggcttatattgaccaagttcttggacgttcttcgcggactcgttactcacggtagcatcaaaggttag

SEQ ID NO: 53122 - DNA, 3090 bp, Glycine max
  Peptide Sequence Number=SeqID_169900
atggccatggcgattagggtttttctcatccttctactctctctctcatctactcatctcagttactcgctttacgaagatcaagttggcctcatggattggcatcaacagtacattgggaaagtaaaacacgctttgttccatactcaaaagtctgggcgaaagcgtgttttagtgtccaccgaagagaatgttgtagcttcactcgaccttcgtcatggagagattttttggaggcatgttcttggaaccaacgatattgttgatggacttgacattgccctgggaaaatatgtcataactctttcctcggatgggagcatattgagagcatggaaccttcctgatggacagatggtttgggagtctttccttcagggatcagtggcatcaaagtcaatattatacattccaaaaaacctgaaagctgataaggatgatttgatccttgtttttggtaaaggttgtctccatgctgtttccagcatagatggtgaagttctctggaagaaagattttgtgggagaaagcattgaggttaaccatattattcagtctactgacgagatatatgtagctggttttgttggttcttcaaagttttatgtgtatcaattgaatgctaagaatggagaattgctaaacaatgatcataaaacacttgcttgtgatacttttggggaattattatcagtctcaggtgataagtttgtcgtgttggataaaacgaggtctaagatattaacactaaacatcaagaatggagggattagttacaaacagaagcctatttcagacctcatcaaggattcatctggacaggcagtaatattaccattaaggcttccagagttgtttgcattacgtatcaattccctcgttcttttaattaaagtgacaaatgaaggtgagttggtgctggtggacaaaattgataatgcagcagctgttagtgatgctttgtccatttcagagggtcaacatgcttttgcatttgttcaacatgaagacagtaaaattcacctctttgtaaaggatgttaatgattggaatggtgatttgctcaaggaaagagtagtaatagaccatcaaagagggaacattgataagatttttataaacaattatgtgaggacagatagatcttatggttttagagcattgatggtaatggaggatcattcactcttattagtacaacaaggagaaattgtctggagtagagaggatggtcttgcatcagttgtagatgtaacaacgtcagaactacctgtggaaaaggaaggtgtatctgtggcgaaagtggaacagaacctctttgaatggcttaagaacagtcagcagtgggcccatgctttgcatgggaaaaagccctcaacccataaaatcaaaattcaaaattgcacttcactctcacagagattagggattgaggtttttatgtggatatcattaattacttttctaacgggacatgtgctgaagctcaaaggaactttaatgattgcaagcccagaggatgtagtagctattcaagcgctgaggttaaggagttctgagaaaagcaaaatgactcgtgatcataatggttttcgtaagttgcttatagtacttacaagggcaggaaaggtttttgctttgcacactggagatgggcgtgtagtttggtctattctacttcatactctgcgtaaaacagaagtttgtgaacatcccattgggcttaacatttatcagtggcaggttccgcatcatcatgcattggatgagaatccttctatccttgtagttggaagatgtggaccaagtttggctgcaccatctgttctttcttttattgatgcatacacagggaaggaactcaattctttgagtcttgctcatactgttgctcaagttattccactgccttatactgattcaactgaacagcgtctgcatctaattatagacacaaaccaacacgcatacctatacccaagaactcctgaagctattggcattctgcaacgtgaattttcaaatgtgtactggtactcagttgatgctgataatggtgttatcagaggtcatgccttgaagagcaattgcattcacaaagtagtggatgaatactgctttgacttcagggatttatggtctattgtattcccatctgaatcagaaaagattattgcaacagtaacaagaaaatcaaatgaggtagttcatactcaagcaaaagttatgactgatcacgatgtcatgtataagtatgtatcgaagaatgtactttttgtcgcaaatgcagcaccaaaagccagaggggaaattggaacagccaccccagaggaggcattgttggtcatctatatcattgatactgtgactggtcgcgtattgcatcgcatggcacatcatggttgccagggtcctgttcatgctgtatttagtgaaaactgggttgtctaccactattttaatctcagagcacacagatatgagatgtcagttgttgaggtctatgatcagtctcgagcggataacaaagatgtctggaagtttgttcttggaaagcataatcttacatcacccatctcttcttattatcgaccagaagttgtaacaaaatcacagtcatacttttttacccattctgtgaaagcaatagaagtgacttcgacggccaagggtataacctctaagcagcttcttattggaacaattggtgatcaggttttggcacttgataagcgctttttggatccccggcgcacacttaatccctcacaagctgagaaagaagaaggaattattcctcttacggattcattgcccattatttctcagtcctacattacgcattcccttaaagtggaaggtcttcgaggcattgtaactgtgcctgccaagctggagtctacatctctcgtctttgcctatggagttgatctattttttactcagattgctccttctaggacttacgattcactaactgaagatttcagctatgctttgcttcttctaacaattgttgcacttgtagctgcaatatttgtcacttgggtattatcccagaggaaagatctacaagagaaatggagatga

SEQ ID NO: 53123 - DNA, 1302 bp, Glycine max
  Peptide Sequence Number=SeqID_169901
atggcatctattagaagaaccttgtctcctgtgcctagagttggaactgtagcaaatggagaagtgtgttcagtagcttctccattgtcgaagtcctcgtcgagtccccagaacttctcaccgtcagttggattggactaccgtgcacttgtgtttggtgttttctccccgaggtctttttgggctcttgagagatcaaagccaagggggcagctttggaggaaggtgcttttccattttttcatttgtttcattgttggtgtttctatgggactcatcccacttgcatcaacacacatgtcctcaaatatcatgccaaaacaacaagccttctcctttgagatgatatctgctgtggggaatttccagccatttgagaatgtaaagataaatgtgacgccatcgatcgataaggctgtgaattttaatgctactttttattcaactgtgaaagaacaggaactaatagatggagtagcatataatgtctcagatagccaaatcagtgaaaatccatctttggagtctcagaagcttctcataattgtgaccccaacatacaatcatctatttcaagcatattacttgcatcgcttgtctcagacattaaaattggtcccacctcccttgttgtggattgttgttgagatgacttctcaatctgaagaaactgctgacatcttaaggagtagtgggattatgtacaggcatctcgtttgtaaaacaaatctaaccaacccaagccataggagcattcttcaaagaaatgttgcaatggctcacattgaaattcatcgtcttgatggaattgtttactttgcagatgatgataacatctactcattggacctctttcagcaaatgagagaaacaaggcgatttggaacatggactgtagcaagattatcaggggataaaagtagcattgtcttgcaagggcccatttgtaatggaagtcgagtaattggatggcatacaaatgaatcaaatgggaaatctaaaagatttcatgctgaaatgccaggtttttccttcaatagtacaatactatgggatccaaagaggtggcatcgccccactcttgaacctatcaggcaacttgactcggtcaaggaaagtttgtgggttagcacattgattgagcaggtggttgaagatgaaagtcaaatggagggcttaatgcacaactgctcgagagttatggtctggcagattgatcttgaatcatcttattcatcctatcctcagaaatggattgcaaagaacaacctagatgccattgttcatcttccacttgtgtga

SEQ ID NO: 53124 - DNA, 237 bp, Glycine max
  Peptide Sequence Number=SeqID_169902
atgtggcatgttttggattttgtagagttcgtggcaggggcaggaatgtctcaattggcccctggaatctcagtcctaaagaaattaagtgaaataaaaggtaatgaaaagaaacaacaaaagaaagaaaaaaaaaaaggactacaatctagggaaaagggtgcccatatcgccagcttgcagagccaatcaaccctagctcagcaggagggtggctatttacccttaaaaatttga

SEQ ID NO: 53125 - DNA, 228 bp, Glycine max
  Peptide Sequence Number=SeqID_169903
atgatttgtggtacatacaggagttattatcatgataagaattattatcagctcatgaagatagaacacaatagatttcctattgagaccaaggatggtgatcaagaagcacaattcaaatcctcttgtaagacactgggacaaggtgaagctgcactagttgacatgcttgccatggtggattctggtcgttcagggcagaaggacgcatatcaagcctatatataa

SEQ ID NO: 53126 - DNA, 2994 bp, Glycine max
  Peptide Sequence Number=SeqID_169904
atggacgtggtatccaatgtccgtcacacgtggttttgctttgtcgcctcctcgatccgcattccttcgtcgttgttcatgattcctgatggacaaatcgcgccacagcaagtccaaggcagcaccctgctccacccaccaaccccaactacctcttcctcaaggtcaagattgaaactagaggaatctctgctaaaaaacaacaactatgtccttttctctcaccggttgagtctgcggcatgggaacaaagaggttcatagacagcgacagcctctgaatctgttgtctcctgattctggttcatccagtggtggggttgcagacaaggattcattctcatctaaattcgggtggagatctacgaagcagctgtttggaactccgattaagaagttattagctgaagagatgtcaccgagagctgaatccaaaagaagatcacctggtgtgatcgccaaattaatggggcttgatgggctgccgttccagcagcctaccaataagcagcataataagggtttgtctgtaaaccaacagaagacagcacaattagaaaaaacacgcagcaaaggagtgctatatagtggtcaatcttctaggggatgctcaaaggatcagcaagaatttaaggatgtatttgaggtctcggagattccaaaggtagagagccctaggtatccatcacaggggtgtgcagacttgatgagcactgatgctgaaatttcattcattgaacagaagttcatggatgccaaacgacttgcaactcatcaagatttacagtcttcaaaggatttctgtgacacactcgaggttttggactctaacaaggatcttctgctaaaatactttaagcggccagattctttgtttaaaaagcatctaaatgatcttcaagctgctcctatccaatcacattatggtcatgtagaagctatggatattgagaagtatgatcatgacttcaatttgatgttagatggggagaaaacacggttgaactacaatagatcatctcatgagaagcatcatgatggttatccttgtgatcttgacaaaagacatgtgatgcatatttcaccaaaatcatcaaagcttctatttaagggtacatatgagcaaaaggcagtcacctcgcagattgtcctcttgaaacctaatcttggaaaagtgcagaatggtaccagaattgtgtcatcaccttgttcttcacacaattttctgtcagggcgtgaaaatgacactgaactgtgtcaaccgacaaatttgcctgaaagtgccatgtcttggaggcaggattcttttgaatctagagaaattgcaaaggaagtcactaggcaaatgaaaattagtcttcacagtggtggcatgaagctttccacctctagaattagaggatatgctggggatgatagttcatgtagtgtttctgggaatgaatctcctgaggagtctgaggaaacaactgcaactttgggaaattcgattgacttaaacaaccgtagcaggcgatcgtcccgatctagtgaatcttctgtcagtagagaggcaaagaagagattatcagagaggtggaaaatgacacataagtctcaagagctgcaaggcatcagcaggagcaacacgctggctgaaatgcttgccgtccctgacaaggtattgaaggctgctaattcatacagcatggctagtggggaaggtttccatgataaatttactcccaatagtcaaccttctaagtgggttgaaccattgggtatcagcagcagggatggttggaaggacggatgcattggtagtctgtcgaggtcaaaatcccttccttcttcatctgctgcttttggaagtcctagaagattcatgcgcactgaagcacttcttgatgagcgatttatggtgccaaaggaagctcacagatgtgagaggagaagatctggtcacaagaagtctaggtctttgcattcatcaattcccaataaattgaaaatcagtctcaaagattctcccaagcttgaggttctagctagtgaatctttatctgagattgtaagagatgcggttgatgatgatgtgacaagtgaaagtaaagttgggtctgaaccttctactaaggtgcttcctgaatcatcttctcaccttttgacaaaagacaacagtagtgcagacctagacaattcaatacaccaggatctatcagctgggtcatctggtggaagttcagtcctcaatgaacctcccgttcgtgttcctggacttgaagcttcttgctgtaaagatgctgatcagcccagtcctgtctcagtcctggagtcttcttttacagatgatgtgtcatcttgttctgattgttttgaaagtttgaacaatgacctacaagggcttcgaatgcaactccagttgctgaagttggaatctgatgaatatgtggaggggcccatggtagtaagtgatgaagatggtggggaagcatctactggaatgctagaagacaaaggattacgtaggactgaagatagctgggagtgttcctacattattgatgtcttgtctgaatctggcatcgatggagctcagccagatacaattttggaactttggcattccctagaatgccctgtgagtctttctgtttttgatgagcttgaaaagaggtatggtgattggactacttgctcaaggtctcaaaggagattgctttttgaccgtattaatttgggaattgtcaagatcaatgagcaatgcactcatgcactaccatgggtgggtccagtgaccgcaaatgttattggttctaatttgaacaagaacgggtttcgagatggccttctgaggatgttagtgagagaaggaaaagtgaagggtgatgctctggggaaggtgctggttatggaatcagagtggctggacttgagagatgacattgatgtcgtaggcagggaagttgagagaatgttgttagatgatttagtgtcagagataatcggtacttag

SEQ ID NO: 53127 - DNA, 252 bp, Glycine max
  Peptide Sequence Number=SeqID_169905
atggggaagaaaaaaaaccagcaagtaaataccctcccaaacaaagaagtgaaaaagggagaaaccaagaagaaggttacgaaaattcagtttttaaaaggtgtggatctcttgaataatttggtcgcgattgattgtgaaggaggtggaaagcacagaacgggaggcttagcaattttggggaaaaactctattgatgtggaggtgagatccttttcactaagccataaccatggggaaaagcctacatga

SEQ ID NO: 53128 - DNA, 408 bp, Glycine max
  Peptide Sequence Number=SeqID_169906
atggacaaagggaagaagaaggtggaggacgacgatgaggaccctatagtggttttatcaaatgatgaggtggaccatgtgcttagggaatgtgacaagaggaacgaggaatttgatgatgaagagctagagaattacccgtttggaccaaacctaaggggcctttctacgaggacaaaggcccagatctcaagacatcaatggatgataaggctaatgaagaaggaaaagaaagagggacccatcaaagaacaaaggatgaggccattggttccatgtggccctctctttagagagcatttccctagtgcaggaagaacaattaaaggaaacaaccaaaccttttggagtgagtataggggggatcaagagtgcattaaagaagcatatagggagaaatggacctaa

SEQ ID NO: 53129 - DNA, 1197 bp, Glycine max
  Peptide Sequence Number=SeqID_169907
atggagcgctacacgctaccggcaccacccaatattattcccgaggaagaagaaaacattgccattgccatgggtgcccctcttatcccttcctttaaatccatgcttcaacaacaccctcaacaacttgactcttactttaactcttcaattagttctactactatcccttttgttcctaacatggactcttttctctctcttgaccctttctcaccttctttcttcaacaacagcagcagcagcagcaacatggccctcgacccgggttttgatttgggcctggacactgggcttcactcttctgctcctgctccccatcttttttcccaggcccagatgatgggcttcgagttctcggagctcgaagccctggctggacctgggaatgtaaatgtcccgtttgcggacggggcaaaggcggctgctctgctgcggtctcctcatttcgagccgccgcagcagcagccgacgctgtaccggaagcggagggggacagccgcggagattccggggctggagatggtgagaaggaaggggaggaagtggcaggaaggaggaggggagggtgaggaagggagcagtgctgacgtgggcggttccgggttgaactatgagtctgatgagcagaatgagagcaatgggttgaagctgagtgagaatggtggagataacaaggggaagaagaaggggctgcccgccaagaatctcatggcggagaggcgccgccggaagaagctcaatgataggttgtacatgctcaggtctgttgtccccaagattagcaagatggatagggcttcaatacttggggatgcaattgactacttgaaggagttgctgcagcggattaatgatcttcatcacgagctggagtcaactccacctggctcgtcgctgacaccttcttcttctacaagctttcagcctttaacacccaccctgccaacccttccctgtcgggtcaaggaggaactgtatcctggcaccttgccaagccctaaaaaccaagctgcaaaggttgaggttagagtaagggaagggagaactgtcaacattcatatgttctgcacccgccgaccaggtcttttgctttctaccatgaaggctttggataacctcggattggatgtacagcaggctgttattagctgttttaatggctttgctttagatgtgttcaaagctgaggtataa

SEQ ID NO: 53130 - DNA, 402 bp, Glycine max
  Peptide Sequence Number=SeqID_169908
atgcttttaaacataaaggatgttagtcaccatggaagttatctcggagagggtgtggaaaaaactgaaagggtggaaagaaagcttcttgtcaaagttggaaaggagactctcataaaagcaatcattcaatctattcccacatacattatgaactactttaagctcccttatgcactgtgtgaagatattgagaggatgatagctaggttctactacggggtaacattgaaaccaagaaactgcattggattcactgggacaagctatttgaacctaaatctaatggtggattggattttcgtaggatacactttttcaacaaaagcctttctcgctatgcagctttggaggttgatcgaggaggaaaaaaacttggcttctagggtgatcaaggcctga

SEQ ID NO: 53131 - DNA, 633 bp, Glycine max
  Peptide Sequence Number=SeqID_169909
atggccaacaccttgcagagagcttcttgggtagattcagtggtttccactttgccaaggcataagtttgaaaagttgtggcttgaaagagaacatgagtgtgaaaaggtgatttcccacttttgggataaaggggatgactctgttcaaagtcttaagagaacaacctcgaacttaatggcttgggggaatgactctttaggaaatatccctaagcaaatcaaaatcctcaagaaaaaagtagagcaattccaaggaaaggaacaaaggtcgagggcgtcttggcttaagaatagagataaaaacaatgtcttcttccaccagaaagcatcccaaagacaaataacaaactcgattaggaagataaaaaattcaaatggggatatcataactaaagaaaaaggtatcgaacttgtcatttctaattattttgctggccttttcaaatcttctcaaccacaagatattgatgcagtgacctctctggttgttgggagggtgtctgagggccattgtgcgacccttaactgggagttctttagagaggaagtttgggatgcctttcaccaaatgcacttcacaaaagcccttggccctgatgaggcccttgtggtgttctcatattggggatga

SEQ ID NO: 53132 - DNA, 2247 bp, Glycine max
  Peptide Sequence Number=SeqID_169910
atgcctcacaagaacgtcatctccaccaacaccatgatcatgggttacctaaaatctggtaacctttccactgctaggagcctgtttgacagcatggttcaacgctcggttgttacctggacaatgctgattggtggctatgctcagcacaaccggtttctcgaagctttcaatctctttgccgatatgtgtagacacggaatggttccggatcatatcaccttggccactctcttatctgggttcactgaatttgaatctgtaaacgaagtagcacaagtgcatggccatgttgtcaaagtggggtatgattccaccctcatggtttgcaactcgttgcttgattcttactgtaagacgcgtagcctcggtttggcttgtcacctcttcaagcatatggcagagaaagataatgtcactttcaatgcattgttgactgggtactccaaagaggggttcaatcatgacgccataaacctatttttcaagatgcaggatttggggtttaggccctcggaatttacttttgctgcggttttaactgctgggatacagatggatgatatagagtttgggcaacaagttcacagttttgtggtgaagtgtaattttgtgtggaatgtgtttgtggctaatgctttgcttgatttctactcgaagcatgatcggattgttgaggcaaggaagcttttttatgagatgccagaggtggatggtatctcttacaatgtgctcatcacgtgttgtgcatggaatggaagagttgaagaatctcttgaacttttcagggagttacagtttactagatttgaccggaggcaattcccctttgctaccttgttgagcattgctgcaaattctttgaacctggaaatgggtaggcaaatccattcccaggctattgtaacagatgccatttcggaagttctagttgggaattctttggttgacatgtatgctaaatgtgacaaatttggggaagcaaataggatttttgctgatctggcacatcaaagttcagttccatggacagctttgatctcaggttatgttcagaagggactacatgaagatggcctaaagctattcgttgagatgcacagagccaaaataggtgctgactcggccacttatgccagcatcttaagagcctgtgcaaatctagcttcactgacactaggaaaacagttacactcacgtataatcagatcaggatgcctttcaaatgtattttctgggagtgcactggttgacatgtatgcaaaatgtggatccataaaagaagcacttcaaatgtttcaagagatgcctgtgaggaattctgtctcctggaatgcactgatttcagcctatgcacaaaacggagacggtggccatgctcttagatcatttgaacaaatgattcattcaggtctgcaaccaaattctgttagcttccttagcattctatgtgcttgcagccactgtggtcttgttgaagaaggactacagtactttaactccatgactcaagtgtataaacttgaacccagaagagaacattatgcatcaatggttgatatgttatgtcgtagtggaagatttgatgaggctgagaaattgatggctcggatgccatttgaaccggatgagataatgtggtcatcaattctcaactcatgtaggatccataagaatcaagagttggcaattaaagcagcagaccaactattcaatatgaagggccttagagatgctgctccatatgttagcatgtccaatatctatgcagcagctggtgaatgggacagtgtgggaaaggtgaagaaggccttgagagaacgagggatcagaaaggtcccggcatacagctgggttgaaatcaaacagaagacccatgttttctccgccaatgacacgtctcacccacagacgaaagagataacgaggaagcttgatgaactggaaaagcaaatggaggaacaagggtataaacctgactcaacttgtgcccttcacaatgtggacgaggaagtcaaggtagagtcactaaaatatcacagtgaacgcattgccattgcctttgcactaattagcaccccaaaggggtcacccatattggtgatgaagaatctacgagcttgtaatgattgtcatgctgctatcaaggtaatctccaagattgtaaatagggaaatcacagtcagggattcaagtagattccatcatttcacagatggatcttgctcctgtaaggactactggtag

SEQ ID NO: 53133 - DNA, 546 bp, Glycine max
  Peptide Sequence Number=SeqID_169911
atggccatgaagagacatagagagaatgaaggaacaacattagaaagctggggcatgcaaaattgttcaatttcaatcacacccgacacaacaagtgtttcaagttccaccacttcccctgaagaagtatttgagtgcaaaacgtgcaaccgcaagttcaactcttttcaagcactgggtggccacagggctagtcacaacaagagggtggagatggaaggtgaagaacaacaactcaaactcaaaaacaagggcaaaatctatgggttgggaaaacaaagtgagcccaaaattcataattgcttcatttgtggtcagggtttttctctgggccaggccttgggaggacacatgagaagacacagagatgcaaccaacgatgttttctcgtccataaaccaggttgttgctaaagtttcagttctcaagagatcgtgtaatggcaaggttttctgcttggacctcaacttaagtcctctcgagaatgacttgaagttattgctgttcgggaaagtgtcacccaaagttaatccttcttccttctga

SEQ ID NO: 53134 - DNA, 1242 bp, Glycine max
  Peptide Sequence Number=SeqID_169912
atggtagcaattctcaagagacagggagaaaacgaatccgaagaaaccatcataggcttggcaaaaagtctcatgcaactctcgcgtgtccaacaacaaagcaataagcctcttctcaaaaccttttctccaacggagttcgagtgcaaaacctgtaaccgcaagttttcatcttttcaagctcttggtggccacagggctagccacaagaagcccaagttcgaagctgaagaactcaaagaagaagccaagaagactaaacccaaaatgcacgagtgttcaatttgtggcatggaattctctctgggccaggcactggggggtcacatgagaaaacacagaggtgccattagtgagaacgacaataataatgaagcgttgtcttctataaagcaagcaattgcaaaagctccggttttgaaacgatcgaatagcaagagggtcatgtgcttggagatggacctgaatttgacgcctttggagaatgacttgaagttgttgttcggaaacaaggctcctagagtcgatctttctttgccatccattacgcgatttcacaatctctgctttgtcttcctgttcactcttgattccaccaacgcttctctcgtcaccatttccaagaggtccaacaagactcgcgattggatcgtcgccatcaaagccctcttgcttgttcacaggcttttgctcgacgcccaccctgccttccaggacgagatcatgcactccacgcacctcggcacctcgaggattctcaacatgtctaacttgagagacaacatgccttccaactcatcgaatcaagtgggtttcgttaaggtttactcgttgtatctcgatgtgaaggttgattttgtggcttataggagaaaattaagcgacggtgttgttgaatctgtggagtttagggataagtttggttctgctgagagagggaggaatgaggttactcttgtgagggaaatgggagctgagagagttttgaagaggttgaactgtttgctgcggatgcttgatcgtgtcttgggttgtaggcccagtggtgctaccaagaacaatagcttggtgctggttgcgctttaccaggttgtgagggatagttttaagctttatgcagaggtgtgtgatgttttaggtgtgttgttggatcggttttcaccgagatggagtatgagcattgtgttgttggatcggtgtgtgaaggcttttttcaattcagtccaaagacttgtcgcatga

SEQ ID NO: 53135 - DNA, 1923 bp, Glycine max
  Peptide Sequence Number=SeqID_169913
atgttctgcacaaaaaaattgaaattctttggagcaatattcaccacctcgatctgtgcgaagagttatagactttcctgcttcattttcaacacttgctttgaagcttttaaatgtagaaaacgcttggtaaaaagaaagaaactggatgacaaggctgaaaaatgtgtcttccttggtgtaagtgaggtctcaaaagcattaacaaagaagattgtgatcagcagggatgttgtttttgatgaagaaaacacttgggaatgggaaaggcagcagcctagtcaagtcatttacgacaacgatactgaacacgagcaaatatcagtaccttacatgcccgaaaactccacaaattcaactcctatagcagctcaatctcattcccatgttagaagaaattgcgatcctacaacttttgagagtgctgtcaaagaagaaaaatggcgcaaagccatgaacgatgagattgatgctattgaaagaaatgacacatgggagctgtgtgatcttccaagaggacaaaaaacaattggtgtgaaatgggtcttcaaaacaaagttgaatgagaacggtgaagttgacaagtacaaggctcgtttggttgctaagggatacaagcaacaatatgagactgattacaaagaagtgttttccccggttgcaagacatgacacaattagattggtggttgtgttggcggcacaacaatcatggcaaattttccagctcgatgtcaaatccgcattcttgcaaggatacttggaagaacaggtatatgttgatcaaccccctggttatgttaagattggaactgaggaaaaagtttacaaattgaagaaaaccctttatggactaaaacaagcccctcgggcttggtatagtcgaattgaatcttatttcattcaatctggtttttcaaaatgcccttatgagcatacactttttattaaaactagggatgaagggaaaattctcatcgtttgcttatatgttgatgaccttatttttactggaaattgtgatgccatgtttaaagaatttaagaagtctatgatgaatgagtttgaaatgtctgatcttggaatgatgcattattttcttggcatagaagtggtacaatcaaatgctggtatttttatttcccaaaagaaatatgtgggagaaatcttggacagattccacatgcacccaacagcatttggttgcaagttgcacaaagatcatgaagggaaaaaggttggcaacacatttttcaaacaaattgttggcagtttgatgtatctaactgcaacaagaccaaacataatgtattctgtgagcttagttagcaggtacatggagtatccaacagaagaacatttgttggctgccaaaagaatccttcgttacttgcaaggaacaagagatttcgggctgttttacaagaaggatacaaagtcaaatttgttgggatttactgatagtgattttgcaggagatcaagatgataggagaagcacttcgggttatgcattcatgtttggaacaagtgctattacatggtcctccaagaagcaaccgatagtcacttcgtctagcatagaagctgaatttgttgctgcaactgcttgcgcttgtcaggcaatatggctaagaagaattttggaggaattgcagttcaaacaattagaagctacacaagtcttttgtgacaacaactcatctatcaaactcttaaaaaatccaatgctacatggaaggagcaagcatattgacgtgagatactatttcttgcgtgaactaacaaaggagaaaattgttgagcttattcactgcagaagtgaagatcaagtagctgatttgttcaccaagcctctcaaattagcatcattccagaaacttagagccttgcttggagtatgcacaatggaagaagccgtgtaa

SEQ ID NO: 53136 - DNA, 495 bp, Glycine max
  Peptide Sequence Number=SeqID_169914
atgaagagacagagagatggagtagagagcatagatttagtaaattgtctaatgttgctctctcatcacagagaaatcaaaccccaaaaacttctgggccctgaagaatttgagtgtatgacatgcaaccggaagttcacttcgtttcaggccctcggaggccatagggcaagccacaaaaagcccaaattacacgtaaaagaacagggcaaaattctgatgttggggaataagcccaaaaaacacgaatgcaccatttgtggtagggaattcactttgggccaggcacttggaggacacatgaaaaaacacagaattgccgttgaccaagggttttctttgataaacgaggttgttgtaaaagtaccgtttcttaaaaggtctaatagtaagagggttttgttcttggacttgaacttgaacttgactcctctgcagaatgacttgaagttattatttggagaaaaggcacccaaagttgattccttcgtttga

SEQ ID NO: 53137 - DNA, 402 bp, Glycine max
  Peptide Sequence Number=SeqID_169915
atgcatcctgcgcagatcgttttgtatggatcaactttatgtgtcatgataacagtgcacttctccatgaagctactcgctgaacatgttttgaactggaagaaaccaaaggagcaaaaggccatagtaattataatccttatggccccattgtacgctgtggactcctatgttggtttgataaatttctttggaagtgaagcatttttcacattcttggactcaattaaagagtgctatgaagctctggtgattgctaagtttttgggcttgatgtacaattatctaaacatctccttaagtaagaacatagtgccggatgaaatcaagggaagagaaattcatcattcattcccaatgactctttttcaggtggttgatactcataaactgttttcgtaa

SEQ ID NO: 53138 - DNA, 282 bp, Glycine max
  Peptide Sequence Number=SeqID_169916
atgtcccaaacgacatccctcaccgacaaatctatgcatgcaacacctctgcgtcaccctgccattgacacactgccaccaacaccacttcattgtacgcacaccatcccagtgcgaccacaattgtaccagcaacatcaatgtccttcaccactagcaacctataacacccaaattctccctaatctcaccattaactacaacaaccaggccaaatttgcattcgacctcaagctttcaagccctctacacatgcgcacccccatttgggcagtttggtga

SEQ ID NO: 53139 - DNA, 627 bp, Glycine max
  Peptide Sequence Number=SeqID_169917
cctttctccccactttcgtatgagaatgttgtgaattctctaagtgttggaaaagattgcctcacacttgaggaagtcaagtcaagtccagtctctattcaagaaagcattggcacaaagcttttagaaatggtgatgaggagccaccgattcgaaatgttttacttgttggttgaaggtggagtgatgaaaatcaaagggaaaggaaagtttgctataattcttgcgtccaatgatgattctctatggcatatgcgtctgggccacatgagtgaaaaaagattggaaattttgagtaagggatacatggaaatcacaagagttccatccctaggaggagcaaggtgcttcttctctatcatcgatgattactcaaggatgacatgggtattcatgatgaagcagcaatctgaagatgaagacattgctagacaacatattgttcgacatactcttcaacaaaatggattacctgaaagaaacaacatgaccttattggaaagggcagtcaacacaacatgctactttgggaattgctccttgtccattgctttagatttcaagacccctattgagccaagaagggttcctttatgggccatggaaatggagttaaaggatccataa

SEQ ID NO: 53140 - DNA, 642 bp, Glycine max
  Peptide Sequence Number=SeqID_169918
atggagttgcaaaggtggctttatggcgaggcagacgaagttgtagaggggggtgcacgcggggaagaggaaggggaaggaggccgcacacagggaaagggaaggggaaggagggttgggggtgcaacgcaagggaagggggaggagggttggtggcacaagggaaaaagaaaggttaagcgagacaagttggacaaaagaaaggagcctaacatatttatcgggtatagcctaacatctaaagcttatagaaattttcaacctgacacaagaaaaattctaataagtaggaatgtaagcttcatggagaatgagaggtggaactggaacgatgaaacaaatcagcagactgatgatttgaatcaagaagagttagttgatcatcctcctgatattaagaagcagaaaaagatcctaaatggagagatgttatgcagaagacctcgctatgataaaaaaatcagacctgggaattggttgaaagacctcaacatcagaagccttcttaaatggcttcttgaaggaagaaattatgttgagcaacctaaaggctttgctacaaaaggagatgaagacaaggtgaatctattaaagaaggcgttgtacggcttgaagcaggctccaagagcttggtatagctga

SEQ ID NO: 53141 - DNA, 729 bp, Glycine max
  Peptide Sequence Number=SeqID_169919
atgatgcgagtctttgagacgactgatcttggagaaatgtctaatttccttggaatagaaatcaagcaaagacaaaatgaaatattcatctatcaacaaaagtatgcaaaggagattctaaagaagttctacatggataactgtaagagtatgagcactcctatgtgtcaaaaagagaagttgtgcaaggatgatgaaatagctaaagtgaataagtccgaatatagaagcttggttggctgcttgatgtatctaacagcaacaaggccagatattatgtatgctgtaagtgttctttcaagatttatgaattgtgctaatgagtctcatcctagagctgcaaaaagagttctcagatatgtcaagggagctgtaagctttggtgttaagttttgtttgacaccaagcttcgagttgcaagttcaaagaagcaagaaattgtggttcaatcaacagccgaaagagagttcatgctgcaacacggctatagttatctcaaacaatctagtttttcatggcaagaccaagcatttcaacatcaaactattttttgtcagagatgttcagaaaaatggtgcagttagactgaaatattgcaacgctgaagatcaattgacacacatattcacaaagcctcttgcaaaaagcaggttggtaaagattaagaccaacgtggatcctgaaaacgtctttagacatggccagagtatcccaccacttcccgtgtga

SEQ ID NO: 53142 - DNA, 1157 bp, Glycine max
  Peptide Sequence Number=SeqID_169920
atggactgtccggcagaagtggcgggcgttggctacaagccgctttttccaaaggattgcggacacccgcctccatcgtggctcttcatcaacctcagatggcggcttttccagtacagatcattgctacgccaggctgaggatttgaacctgcggccttcaggttatgagcctgacgagctaccgggctgctccaccccgcgctatggacctggcagcgacctactctcccgtgtcttaagacaaagtaccattggcgctggagcgtttcacggccgagttcggaatgggatcgggtgcagccgctccgccataaccaccaggccgcgcccgcgcagccgtttggcggagccaaactggcgtgagcgctataaattcatcgaagtttgttcgatggatattgtaaatgggagtgatcaagtcgatcgagctattagtaccggtaagctacatgcgttgccgcacttccacacccggcctatcaacgtgatgccttcagcggttatcccgtccatatatagctaccctgctatgcccttggcacgacaacaggtccaccagagatatgtccatcccggtcctctcgtactagggacagatcctgtcaatattcctacacccacggcagatagggaccgaactgtctcacgacgttctgaacccagctcacgtaccgctttaattggcgaacagccaaacccttgggacctgctccagccccaggatgcgatgagccgacatcgaggtgccaaacaaccccgtcgatatggactcttgggggtcatcagcctgttatccccggcgtaccttttatccgttgagcgatggcccttccacgcgggaccaccggatcactatgaccgactttcgtctctgctcgacttgtcagtctcgcagtcaggcgggcttatgccattgcactcgacgaccgatttccgaccgtcaaactacccaccatacactgtcccggatccggataacggaccgcggttagacatccatgaagataagggtggtatttcaaggatggctccacagaaactggcgtgcacggggtctttccgtctgaccgcaggaaccccgcatcttcacggggaattcaatttcactgagtctatgttggagacagcggggaagtcgttacgccattcgtgcag

SEQ ID NO: 53143 - DNA, 387 bp, Glycine max
  Peptide Sequence Number=SeqID_169921
atgcctgtcacgcgcatgaagcggctaccagctggtattgctgtgctcgcagtcttgctgatgctcactgcctgcgcctcgcaaatcatgaagagctatatcggtgcgccgatcagcagcgtgatgctcgactatggcccgccggacaacgtctatgatctgcgtccgggtgagcgcgcctatcaatggcggcagaagaagacccaggtggtcgccggccaatccagcggcgaagtcaggcaaacgcgccgcggcagacgctatgaagtcaccgaaacgcccggctatgtcgagcagatggagtgcttgtacaccttctatgcccgaagctccggatccgattggtatgtgaccagcttccgccagccctcgctcgaatgcgaataa

SEQ ID NO: 53144 - DNA, 738 bp, Glycine max
  Peptide Sequence Number=SeqID_169922
atgtggctttcaacgatgagaaattttccattagcaagccaggaagcttctggagcattagaagcctatcatgttaagctgaaagccaaactttttgatgattcacatcttggagcattgcaaagagtagattggttagtccacaagttaacaactgagttgcattcaagctactggcttgaccggtatgctgatgaaagtgattctttccagaatgtgaaggaaaaatatatagcttctacatcatggcatcgggcacttcaaattccggactatgctgtttccttggatgataaagaccacctctttgccaaggttgtgagccagaaagatagtagcttaacacatatagtgtggaatccaggatctgaatttgcattctgtgattgttcttggtcaatgcaaggttatcaaccatccatgtctttccggtcttttcaagaggttttgatggatctatggaaaaagccagtggatgattcttttgcgttggatctgtcattggcttggacccatcagatgctagatcaaattcaaaaacaagttgaactgaataattctactgatattggcactgtagttaacaatatgccactgaaatgggtttctaagaaaggcagaacctacattggcaaaccatcatcaagtttggctcttcctcatggtagcagtaacacaaaaagtgtggttgtgtataagaagaatcggaaacggaaaagattgtctcgattaagatga

SEQ ID NO: 53145 - DNA, 231 bp, Glycine max
  Peptide Sequence Number=SeqID_169923
atggaacatgcaatggtaaaaaccgcatctgggggggctccaaaagttgataaaattcggttaaacgatggtgctccgcacgatcgcatcgtcaagtcacatcttttccgtacacgtggcacatcgatgtctgtgcgtcagaggttcatcatacgccggctgcctcacctcacctcagtgattctctctgactgtgtctatgactattctattgtttcagttttattttga

SEQ ID NO: 53146 - DNA, 1452 bp, Glycine max
  Peptide Sequence Number=SeqID_169924
atggggaagagtcctgagggtttgaatgatggtgacatgacaaaggattcttctagaattgagtccaagcgtgctcatcagtggttcatggatgaccctgaagtggatatgtttcccaataagaaacaagccgtagaggctccgaacaatttgttatctggaatgctcaactccaatatttctttgtggggaaattcctcaggatttcactctttaaatggtcattttactgaacagttatttgccccagatgcagcaactatgagttttgaagacacaaacaccccctctgttagcatagatgataagttgagtgtggaaagaaaggataacgtggatcgctttgggagtgagtcctcttttggtttatccatctcaactgcattagaagatcctcatttagtttttaattatgatggaattagaaaagtcaaatttaacgaggtgaaggaatctgagaatgtcatgcctgttactacaaataatccctatgataggggtgttagtgacagtgtctcaaatccttgtctatacaaggaggaggataattccatatcaacgagtcatgcctacaatgaagaggttgccaatataataacaatggatggcacatatgacaggacagataacaatttcatgccaatgagtcaatcctttaacaagggaaatgacagcttatctatacatccaacgttcaatgagatttgtaatacgatatcaatggatcttggtttcagtaaggtagatagtaatgtaacatctattgctcaaggttacaacaaggtctatggcaattccgtgttaactaaccccttattcaagcagggaaatgatgtgccatttgtttcacattcctataataatggagagagcactatcatatcctttggtggctgtgacgatgatacaactccctctgacttattcatttctgactatgatctgttgatgtgtgaagcactttcacataagtcagaagctgtgaatgtgaaagagttggctagatctagttcaaatttacttccaagtacagctcagacatctgcacctgaaactgaaaatgttcccaagtcaaaaggggagataaaaatgtctagaaaagcaacttcaaacaacttcccttcaaatgtcagaagtttgctatccactggtatgctggatggtctctcagtaaagtataaggcatggtcacgggaggttattaatgcatttgaatttgagcgacatgctggttgcaagacaaaacaccccaataatcacatttactttgataatgggaaaactatatatggggttgtacaagagctcaggagcactccgcagagcatgttgtttgaagttattcagactataactggttcacctatcgatcagaaatccttctgcatttggaaagaatcttttttggctacagcagggaactccaacgcatatgtgcaaaacaagaagtaa

SEQ ID NO: 53147 - DNA, 1542 bp, Glycine max
  Peptide Sequence Number=SeqID_169925
atgagaacagagttgaagaagaagatatccaagtcttcgtggccaaaatttaatgtaagaaagtggctcaatattaggagcaacgatgataactttcactcagattactctttaccagttttgatttgcttttttggggtgaaaacgtgtctgcctcggggtccttgggtcccatctgagaggtttccaattgaatctccacgtggatggcttattttctggaaatcaaattggcctatgattaagcctgcaattgcaaaaccacaagaggggtggctgatggactccacaaatgaattgaaacattctgcatcagtgatggaggcgccacctgtcaatgacactgacacgctcaaccttaggatgttcgtggggacgtggaatgttggaggaaagtctccgaacgagggattgaacttgaggaattggttgatgttgccttcaccagctgatatctatgtcattgggtatattgttttatcgttccaagaaattatacctctaaacgcagggaacgtgcttggaccagaggatagtggaccagcatcgacgtggttgaaccttattcatcaagccttgaactctaacacaagctcctccagtggagaaaattctcctacatgcagtccaagtgaacatgaacaacagctctattattgcctagcagcaagtaaacaaatggtgggtatcttcttgtgcttgtgggtacgtgcggatctttacaagcatgtcagcaatttaaaggtgtcttgtgttggtagaggcatcatgggctatcttggaaataagggatcaatctcaattagcatgacattgtaccacacaacgttctgcttcgtttgtacccacttggcctccggagagaaagatggtgatgaggtgcgaagaaatttggacgtctcagaaatcttaaagaaaactaaattttcacaatcattcaaagctcttggtcaatcactccctcctgaaagcatattagagcatgataagattatttggctaggggatttgaattatcggcttactgctggttacgatgatacacttgagctactgaagaagaatgattggaaggcactattagagaaggaccagctaaggatagagcagagagctggtcgagtgttcaaagagtggaaggaagggaagatatattttgctccaacttacaaatacttattcggttctgaccagtatgttgcccaaactaacaagtccaaagaaaaacgacgaactccggcttggtgcgatcgaatactatggaaaggtgaaggcgtggagcagctatggtatgtgcgaggagaatccaaattctcagaccataggccagtgtattcacttttctcggttaacgtggacttcacatctaacaagctaagtccttctattgctacatcaaatagcagctctataatctcaaggtcgtgttcctctagacccttaacaaacgctgccttgtcctcatcttgctttgctaaagttcaggcagaggaacaactcttgttactaaccagggcacatagacacagggttctgacttag

SEQ ID NO: 53148 - DNA, 588 bp, Glycine max
  Peptide Sequence Number=SeqID_169926
atggagacacaaaattggttcgagagattgaagcctttcgcagctgtggtatcaatacagtttggatatgcagctatggatgttctatccaaggctgcaatgaacaaagggatgagcaattatgtgtttgttgtttatcgccatgctgttgcattcttggttatggcccctttggcatggaaagtaaggccaaagatgacattctcaattttcatgaagatagcggtgctcagctggatagagccagttattgaccagaatttgtattttttggggatgaagtacacaacagcaacctttgccgttaccataaccaatatgcttcctgccattacctttatcttcgcatgcattcttaggcttgagaagattaaaataagaagtatacggagccaagcaaaggtggtgggaaccctaacaactgtttcgggagccatggtcatgacactcctgaaagggccagtacttttcgggtcacacggaagcaatgatcacagccagcataatgggacaatctcatttatgtctaatcccataaatttggttcccaagttcaaatttggacccaagtccaaatttggacgttga

SEQ ID NO: 53149 - DNA, 424 bp, Glycine max
  Peptide Sequence Number=SeqID_169927
aggtgaatgcgacttttccgtcgtggagatcggtgatgttgacgaagccagcggatccgggggcggtgccggtggcttggtacattgtggcggcgagggtggtgccattggtgttctagtggtgcttcttggcaccaaagtagtcaaggaggacatggagggagaggacgttcttgacggtgtagatggaggggtgcttcgagagaaggtccgacatggcggctttgttgacggcacagacggtgatggtggttttgccgttgatttcggggacgaggtgggagagggtgaggtagtgcttaaaggtggagaactcagggtgctttgcgaggatgttggtgatgttgtgtgtgtcggagagggtggcgaggacgagcaatgctgccatgagcagttcccaaaggagctacattatagaaaatga

SEQ ID NO: 53150 - DNA, 714 bp, Glycine max
  Peptide Sequence Number=SeqID_169928
atggctccaccaattgagaccccaaccaaggtttccagctatcagcactccccaaaccctcgtcttaacgagaggattctttcatccatttccaggaaacatgttgctgctcacccgtggcatgatcttgagataggacctgaagctccaaagatcttcaactgtgtggttgaaattgggaaaggaagtaaggtgaaatatgaacttgacaaaagaactggtcttattatggttgatcgtatcctttactcatcggttgtgtatcctcacaactatgggtttatcccacgtactatttgtgaggacggtgatcccatggatgtcttggttatcatgcaggagccagttcttccaggttgctttctacgggccaaagctattggactcatgcctatgattgatcagggtgagaaagatgacaagataattgctgtctgtgctgatgatcctgagtataggcattacaatgatatcaaggaccttcctcctcaccgtttagctgaaattcgtcgtttctttgaagattgtaatcatttggcgtgccatataaaatcaaactattttatgttttccttaataaaggaattagacaagaagaatgagaacaaggaagttgcagtgaacgactttcttcctgcttcagctgcctatgaagctatcaagcattccatgaccttatatgcggaatacgttgtggagaacttgaggcggtag

SEQ ID NO: 53151 - DNA, 189 bp, Glycine max
  Peptide Sequence Number=SeqID_169929
atgacggtgacactgatggcagagccaataataacactagtgacaagagtgataatggtgaccaataatgataatggtagaatagtggttatgttaatgaattgcatctgtacggttgaaggtacacatctatttgcttgtgctcttatttcaaaacaagatgtcatgcttgcaagtgaaaagttgtag

SEQ ID NO: 53152 - DNA, 444 bp, Glycine max
  misc_feature (384)..(384): n is a, c, g, or t
  Peptide Sequence Number=SeqID_169930
atggagagaggagtgagtggatcaccccaaacgaaggaaccagtcgcatccaagtggtttttgctgacacaacctgctgtagccggtcatttgacaccatgttatcggctagggggtatttgtcggcttgattttcaaaccagaagagagtggcctcaacatgggttgaagggttcttctaatgcccacttacctagttattatcatgaatattttttggcattgggagataaacaaaacaaagaagaacaaaggaaacactacactctagggataggcagaagcatagcatcttctgacaacaatccctgcaactcactaggaggaaccactaactctgaaccaaggaccagaattaggacccaacttcgccagaaagtccgnacaacccgcacaacgagtgaacaaagctcaatctccaatctcccttcacaaaatctctaa

SEQ ID NO: 53153 - DNA, 312 bp, Glycine max
  Peptide Sequence Number=SeqID_169931
atgtgggacacattatctctgacgtatgaaggatcatcacagaaaggatccaagaagccatatagagaaacaaaggacaaggataaaagttccatcatatgctacaagtgtaagaaaccaggacatttcaagtccaaatgcctaaaccttgataagtcaaatcaaaagaaaaggtacttcaaaccaaaggacaaaaaagtactgatgggcacacgggaagaactagacgacacatcatccattgaggagacgaaaaaggaagaaaaagctaacctctttttgatggcagaccctacatcagaaggatcataa

SEQ ID NO: 53154 - DNA, 396 bp, Glycine max
  Peptide Sequence Number=SeqID_169932
atggcttcctctatgatgtcctccccagctgttaccaccgttaaccggggcagcatggtggctccatttactggcctcaagtctatggctggcttcccagttagaaaaactaactatgacattacctatcacaagcaacactggaagattacaatgcatcaacacacaatgcaaataaaagtatggcctcagattggcaagaagtttgagactctatcctatctgccaccacttacacgagagcaattgttaaaggaagatggatggattccttgcttggaattcgagttggagagtgtgccgaaaggttttgtgtaccgtgagaaccaccgatcacctggatactatgatggaagctaccaatgtttgggtgcacagactcagctcaggtgttga

SEQ ID NO: 53155 - DNA, 309 bp, Glycine max
  Peptide Sequence Number=SeqID_169933
atgaagtttcttgattggtacttgaagattggggttgtgtcggctctggttggggcttctatggagatgttcatgatcaaaactggattctgtgtgagaactttcctttcttattctctaatcaccctttccctgccttaccattttcttgattttccgtttgatgctcttattttcgcttcaaatgacaaagtaactgtcttagagtcagaaaagcgtgcctgggagaactccccggatgctcaggcaattagagaagctctcaacccctggagacagattgacacagaaaaaacaaagaagtcctga

SEQ ID NO: 53156 - DNA, 156 bp, Glycine max
  Peptide Sequence Number=SeqID_169934
atggacacacacaaaaacaatcaaaaaaagtgtctggcgaaaatgaatgcaagatgcaaggtcatcaagggagagggagacaaagcatgtagtggtgcccacacagaatcgggtgaagcatcctgtcccggaatgaaggaacgtgcttttacataa

SEQ ID NO: 53157 - DNA, 267 bp, Glycine max
  Peptide Sequence Number=SeqID_169935
atgagttattatggaaaaggaatcaacgtgaggtttcattcagatctgaaacggaagggggcgaaagggaaaggaaaggacatatttgttcatttaagtttccaatgggatgcaagaaataaaaatgaggtacaggaagcaattgccttttttcttgtagatgtagtagtgtacgggagtgcaaaaactaattttgtcaagtggctcaggaaggttcataacccaaacccaaacccaattggtgtgcccaacaatattactaactaa

SEQ ID NO: 53158 - DNA, 1773 bp, Glycine max
  Peptide Sequence Number=SeqID_169936
atggctatcaggtgcctgtcattcctagagcttcaaggtcagctagggggcacaatcaggaagaaacctgacagcagccagatacaggcttttgaaatcttggctagtgtagctggaaactttttgcaggagaatgagagttccaatcctgaaaatgttgtgcttgcaaaagatcctcgcactttgtctggtactaacataaaggacaaacatggggatgaaaggtcatttaagggggccctgtttgagcatggagcttgcagtgaaattgcctctgtctttgtccctagtatgcaagggaaacatgacaaccatagagtcatgggggattcatcttttcttgacaatcatcttgaaggccaaggacaaaatgtccctgagagggaagatgaaaggatcaaagggagaagtgtaaatgggaaaaccatccacattaaaggctgctctaatgggttaatagaaccaggtcacggagtatctaaacattgtagttctgctaataatgtggaaaagccatcgttggagggccgcaagcctcttgattcttttcccaaatgtttcacttctaggaaattagttaatagagatgatgatgaaacattagataggtgcacacaactgaactccaagaataatacatctggcgcaccaccagatacgccaaaattgaaggatgcaagtccttttataagtgatgagaacaatagtagggacatttctgagcttgaaagtttacaaaggatgtatccatttaagaagaggaaattcttcaatcagacctcatcttctgcatctgatagggggtctcaatgtcaaggcatgtttgattcttctgacaccatcagggttaatggcacaaaccatgcaattgaggaatcatcctctatagttggtcaacaagcacattttgggtccaggggttgtaatgtgaagctcagcataaaatcctttaaagtcccagagctttttattgatatacctgaaactgcaactattggttcactgaaaagaacagtaatggaggctgtgacagctatacttggagatgaattacatgtgggcatccttcttcagggaaagaaagtccgagatgatagcaaaactctgatccaaactgggatatctcaagatgacaaacgtcatagattgggatttatgttggagccaagacatactcaatctccatcttcatacaatgatgacccttgttatccaaccactagttcgcgacaaaaattatccaggcaatcaacatctgtaacgttacaacaaggaacatataatgtatccaaagaacgttctatgatcaaaattgaaagttatgctgagggtgatcttaatatggtcacctctctagcagatacttcagctaacaataacatgtcaaagtgtcgggctctggtggcagttcctgccattaacatggaaacattagctgtggttccattccggcgcaaatctgagaatcctgactttgcacagcgccgaatcagaaggccattctctgttctagaagtagaagcattggttcaggctgttgaaaaacttggaactggaaggtggcgtgatgtcaaacaacgtgcttttgaccatgcaaagcatcgaacttatgtggatttgaaggataagtggaaaacattagtgcacactgcaagaatctcccctcagcaaaggaggggagaacctgttcctcaggagcttctggatagggtcttagctgctcatgcctattggtctcaacaacagtgtaagcatcaacttaaaccactgtga

SEQ ID NO: 53159 - DNA, 195 bp, Glycine max
  Peptide Sequence Number=SeqID_169937
atgtataagccttatggatggcaattccacaaaggaccatggcctttttgcaaatcctatgttggtgattactcacatactattatacaagtgagctaccgtttctctaaggtgtttaattgtgatggtcgcgacttgatgctcaagagtatacttttccttcactacaccatgccttcaattggattcaagtag

SEQ ID NO: 53160 - DNA, 249 bp, Glycine max
  Peptide Sequence Number=SeqID_169938
atgagattcagacatcttcatggctttgatcttatcatgccagagaagcaagtgtggaaattttccacaaatttagatgctaaagttacaaaggctttcaaagctaaatactttcccaatggaggattcttggaggctcccttaggccacaatccaagctatatctggtgtagcatccaagcttcacagactttggtaaaagaagacatgagatggagagttggtgatggcctttcaatcaacatttga

SEQ ID NO: 53161 - DNA, 1858 bp, Glycine max
  Peptide Sequence Number=SeqID_169939
ctcctcgacctcctccgccgccagcccgacgaatcctccgccctccgcctcttccaatgggcctcggcccagcccaactactcggcccacccttccgtcttccacgagctcctccgccaactcgcccgcgccggctcagtcgactcaatgctctccctcctccgccagatgcactcctcccaattccccgtcgacgagtccaccttcctcatcttcctcgaaacctacgccaactccgaactgcactccgaaatcaaccccctcatccacctcatggaacgcgacttcgccgtcaaacccgacacgcgcttctacaacgtcgggctcagcctcctcgtccaaaccaacaagctcaagctcgtcgaaacgctccactcgaagatggtcgctgacgccattcaaccggacgtttccaccttcaacattctaatcagggctttgtgcaaggcccatcaattacggcccgcgattcttatgcttgaggacatgcccaactacgggctcaggcccgacgagaaaacgttcaccacgctgatgcaggggtttatagaagcggctgacgtggacggcgcgttgaggattaaggaactcatggtggagtcagggtgcgcgctcacgagtgtttcggttaatgtgttggtgaacgggctttgcaaagaggggagaattgaggaagctttgaggtttatttacgaggaggaagggttttgccctgaccaggttacgttcaatgctttggtgaatggattgtgtaggaccgggcatatcaagcagggtttggagatgatggattttatgctcgagaaagggtttgaattggatgtttatacttataactctttgatctccgggttgtgtaagctgggtgagatcgacgaggccgaggagattctccaccacatgatttcaagagattgcgagccgaataccgtgacttataacacgctgatcggtacattgtgtaaggagaatcacgtggaggccgccaccgagcttgcccgcgttcttactagcaagggggttttgcccgatgtttgtacattcaatagtttgatacgggggctgtgcttgacaagtaaccgggagattgccatggagttgtttggggagatgaaggagaaggggtgtgagccggaccagtttacgtatggtatattgatcgagagtctgtgtttggaaaggaggcttaaggaagcgttgacgctgctcaaggagatggagtcgagtggctgcgcgaggaatgtggtggtgtataatactttgattgatggtttgtgcaagaacaatagggttggggaagcagaggatatctttgatcagatggagatgttgggtgttgaggacaagagagtggaagaagctgctcagcttatggatcagatgataatggaagggttaaagcctgacaagttcacttatactacgatgctgaagtacttctgccaacaaggggatataaagaaggcagctgatattgtgcagaatatgactttgaatgggtgcgagccggatattgttacgtatgggacacttattggggggctgtgtaaggcagggagagttgatgttgcaagtaagctccttagatctgttcagatgaaaggtttggtcttgactccacaagcgtataaccctgtgattcaagcactctgcaaaaggaagagaacgaaagaagccatgaggcttttcagagaaatgatggaaaagggtgttcctccggatgttataacatacaagattgttttccgtggcctctgtaatggtggagggtcgatacaagaggctgttgattttacagttgagatgttggagaaaggaatattgccggagttcccatcatttggtttcttggctgaag

SEQ ID NO: 53162 - DNA, 363 bp, Glycine max
  Peptide Sequence Number=SeqID_169940
atgcaagccctagctcctggaacactacaagcctaccccctgcacccctgcactcctgcacctctgcaattgggcacaagctgtctcgccaatgggataggcgagacctgctcacggggtgtgccaagtcagcatggttctcgccattgctgttggcggttcctacatggactgtgtctcacccgtaacaatggcggtaccctccagctcagcaacgttctcgcccgtaacaatggcggcaccctttcagctcagcagccttctcgctattgcagatggcggcacagctatctcgctaacccagcttacgacatccatggaggaacagactctccttgtaaaaagtttgaaaacagactctga

SEQ ID NO: 53163 - DNA, 282 bp, Glycine max
  Peptide Sequence Number=SeqID_169941
atggcgacactgcttgtcaatggttctcgcaagatgcaatggcgggttccatgcatacgtggaagacttctcgccagtggtgctggcggcacacccacgtcaccatgcatttcgctagtggtgctggcggcacacccacatcaccatgcatctcgccagttgtgctggcggcacgctcaccatgcagccacgtcacgaagcttctcgctattgacaatgacggcacacccatctcgccaatcctgttggcggcatcaacgtaagaatagaccccctccgtaa

SEQ ID NO: 53164 - DNA, 231 bp, Glycine max
  Peptide Sequence Number=SeqID_169942
atggtgcttatgtttaaaccaaatgtgcttggagctttgacgatggatggaaactatgtcgtgctcatagttatcctttatgttcataaacacaggaggtatggagtgcgaatagttaagtcagatacatgtaaggtgtggtgggagcacaaagagtggaccaaagctgtgaagcgcaaaaagaaaggagggaagttccaccgacagcaatggtgtaaggttttctcctaa

SEQ ID NO: 53165 - DNA, 234 bp, Glycine max
  Peptide Sequence Number=SeqID_169943
atgggtggtggtggtggtgactgtgtggccttcttgtgggtgccacgcaaagtctttattttgaaaactaatggggatttgggaatcaacactgtgtttggtcggagggacagggagaaatattgtttattttatttaagtgggctggccaaatttgtcacgtcaggggttaattatttaccactcattatggagcatggatccagttatgattgggctaagacgctgggctaa

SEQ ID NO: 53166 - DNA, 222 bp, Glycine max
  Peptide Sequence Number=SeqID_169944
atggaaaagagcggaggcaaacagaataattttgggacaatgaaagaaagggaatggaaaatcttcagatcagataaattctcggcaagattgccattctcgactggcgatatcccaccccacatgaacaaagtggaaaagactgaaacacccagcttcctctcgaaaaacacttccctcgagaaaatcctattggtccgtgatcgtacgtttgatctttga

SEQ ID NO: 53167 - DNA, 534 bp, Glycine max
  Peptide Sequence Number=SeqID_169945
atgtcctcgcctcaagagggctgcatgtcctcaccttcagagggctgcatgccctcgccttcacaggactgcacgtcctcgccttcagagggctgcacgtcctcgcctttagagggctgcacgacctcacctcaagagggttgcacgtcctcctcttcagagggctacacgtcttcgccttcggagggcttcacgtcctcgcctttagtggaatgcacgtcctcaccttcaggggactgcatgttttcacctttagagggtttcacgtcctctccttcagagggctacacgtccttgccttcaaaggactgcacatccttgccttctgagaactgcatgccctcgccttcagtgggctacatgtcctcgccttcacagggctccacatccgtgccttcagggaactcaagggatcacgcccacaagacacctagtggacccgaagaagtccaacaaggtcctagggtttccagctctgattatgagcctttgttagttctacggagtgctcgtcgcccccaacaaggtcattag

SEQ ID NO: 53168 - DNA, 765 bp, Glycine max
  Peptide Sequence Number=SeqID_169946
atggctttccacgaccatctaccgcacgaaatcacgttccagccgtttaccgaggagcagcagttaggtcagagcagggacatgcagcggctgctcccgctctccggcggggcgccgacgtggctgaacaacagcaccgcggcgacgctccgccagcagaatttcctccacctgcagccggaatccgccgcaacgacgcagcaaaacgacgacgttcgcggcggcggcggcagcggcatggatcggaaccggaccgagagcaactctgaaccggatgatttggcagaatacaaagcggacattttaggtcaccctctctacgaccagctcctatcggcgcatgtctcatgcctgagaatcgccacccccgttgaccagcttccaaggatcgacgcgcagcttcagcagtcgcagcgcgtcgtcgacaagtactccggcatcggaaacggaaacggcgtcgtcgacgacaaagagcttgatcaattcatgaacagttacaggattgttggttctagtgcaaaatccacgaattggacaaaaaaacaagagacacagagaggagagaaagagaggggagaaaaaacgcattatgttatactgctctgtgctttcaaagaacaattgcaacaacatgtacgtgttcatgctatggaagctgttatggcttgttgggagctggaacaatctctacaaagcttgactgtaaaaaagttgaggagaggaataaaagtaaaattggaggctacacaacccccagagtggtaa

SEQ ID NO: 53169 - DNA, 192 bp, Glycine max
  Peptide Sequence Number=SeqID_169947
atggagcaatgtggcatcggaagcagtggcagaaagtactatgttgtggtccatgaaacctcgttgagacacgtgccgcccgtgggtgctcacgtccctatcgggttgggtagtggccagcccagcagcccactgccactactcctctcatacgtcgttttgggttttgggtccgctgggaataaaaactaa

SEQ ID NO: 53170 - DNA, 231 bp, Glycine max
  Peptide Sequence Number=SeqID_169948
atggtgcaatggtggccaattgttctctcctgtgactgtgatgctgagtatgagataaagctcccttaccttgcgacacagctatataccaatttgacgatgacaactagtctcatgcctctgaggatttggaccaagtttgttatgcttcaacttcaaggatctttcaaatcactgttgtcctgtgttagccgttcgatgcacggattaacttcttactctaagatgtag

SEQ ID NO: 53171 - DNA, 253 bp, Glycine max
  Peptide Sequence Number=SeqID_169949
gtacacgatgaattcggttataacagtgttgtatttcaatggaagggtatatgaagataatgatggtgtaatatttgaaggtagtaaaaaagtgattcagattaaacgtggaattagtttcaatgctttgaagaaaaaaattggagataaggaaaatatattgccttgcaaatttgtgacgacgaagacattgaaacaatgttggaaagttttaaacaacaagatcaaatgtcagttctggaattgtacatag

SEQ ID NO: 53172 - DNA, 1044 bp, Glycine max
  Peptide Sequence Number=SeqID_169950
atgaaagcaccaagtgtaacagtgataccacaagcaacaagaaaaggacaagaaaaagaaatggaaacaggagttgtattcattaaaattccattccaaagtacaatgccactagctcaagccttttttggtggaacttgtgttttgctaagaggaatgatggaggaaattcctgggaatgaagaagctgctgagcctccagcatcatctcaatcacctgctgatgtgccacataatatggaaacagaacgaatgactgctacaaagtattctattatcagtaggaatggggttgggaccacaggaaaacacttacctttacttgtgaatctcttcgaagttgttgtaaatgttccagacacagtatttttccagtatagtgatttccaggtttctattaactttgaagataaacgagctgttgaaagcaagggcattgggagaaaagtgattgataagctttatcaaacatactcttctgaacttggttgcaaaaggtttgtatacgatggagggaaaactttgtacacagtgggtcctctgccgctaaataagtatgagctcaaagtgttgctggagaaatcatttacaaaacggttaaaaatgatgacgacaatagtgaagggcagacagtggatattactgtttatgaatattttgccacacgctcgtggcatagagctgacctcatctgcttatcttccatgtcttgatgttgggaaaccaaaatggcccatctatcttcccttggagctatgttcacttgtttccctccaacggtatacaaaggttttatctccgatgcaaagagcgtctttagttgaaaaatcatgccaaaagcctcaagatagaatcaaaattctgaaaagtgctgtaggaaattgctacaacgatgatcctgttctttcttcatgtggcatttttattgagaaacaattgagtctgattgaaggttgtgttcttgagacaccaaagaacattgaacggccatatactttgatagaggaggaaccacagttgagaaaatctaaccctgttgcaagg

SEQ ID NO: 53173 - DNA, 588 bp, Glycine max
  Peptide Sequence Number=SeqID_169951
atgttgccagacaccgacgcacgagtacgttgttccgagatcgattccgatggctggaccctctcctttgccggccatgatgctgcgtttcttttcgtttgtggtgtcggcgagtcaacaacgaagagagatctgagagagacaagttggcaatggcggctgggtttcgagattgagtgcagagagagagtacgggaaaggaaaagttccacgatggtgtggatcacattattcatcatcaacaacagaagaagaaacaactcagagggtttcattgcccaaattttgaaatttaccgtttcaaccttctgggtcgccatgctcaagcaattcctcagcaaactccctcgcaaggcacctaaactcgactcggacaagtcatgtcgagccgactcgtcgctctcggacgattccccatgcgccgtcgacagaaacaaccaccttcccggtggcggaggcccctcctccgtgaagaaaacatcctcatcgacggtttttccaacaaaatgtaatggtagtgaaactatgcgtatgactcgatcactcattgttgctcgtcatgctggtgagaggctattgagatgctag

SEQ ID NO: 53174 - DNA, 392 bp, Glycine max
  Peptide Sequence Number=SeqID_169952
atggccggcaaaggagagggtccagccatcggaatcgatctcggaacaacgtactcgtgcgtcggtgtctggcaacatgatcgcgtcgatcttgtccttcttgatgtcaccccactctctcttgggttggaaactgccggtggggtgatgacagtcttgatccccaggaacactatacaatcccaacaaagaaagagcagggtttacaaaggtgagagaacaaggactggagataacaacttgctggccaaatatgaactctcaggcattcctcctgctcccaggggtgttcctcaaatcacagtgtgctccgacattgatggcaatgatatcttgaatgtctctgctgatgataaaactaccgaacaagatcaccattaccaacgacaagg

SEQ ID NO: 53175 - DNA, 633 bp, Glycine max
  Peptide Sequence Number=SeqID_169953
atggggcattggttaattgttgttgcatacatgtcagtcaaggaaggtggttacgatcataaggtgaatgaaactgtcaatgttgtcactcagaagacatcagagattggacagaggacttggggcataatgaaaggagtcatggctatggcttcccagaagattgaggagtacactaaggatgatccaaactggaagaatgataactggcaacgaaatgagaatgatacaaatggttattatcaggattttaatcgagagaaaaaaggatggaattcttctactggaagagaacaatcttcatcaggggaatataaaactgaaagctctagctcttgggatgattgggaccacaaagatagcaggaaggaagaaccagctaaaggatcaactcattcatcaggtgggcagtttagtacctacaactcaagctcttgggatgattgggaacacaaagattctaggaaggaagaacctgctaaaggatcagctccccataataatgatgattgggctggctgggataatgccaaagatgatggattcgataatatttatgaaggtgctaataagaaaggtgttggtcataaggggaaatctgatggcacttggacagaggaaggctttctctaa

SEQ ID NO: 53176 - DNA, 1260 bp, Glycine max
  Peptide Sequence Number=SeqID_169954
atggctgattccactccgactgcaactccttcaaacgacaccgtatcatcctatttccaacgaacggtcactttgtacgattggtggttgattaaagccaaaaacgacttccaaggaaagcgtttagccgtcgctggtgtctcgtcgagaaaggatgaggcaatgcgcgtgtttgtttctgctgctgttatcaaaagatatgacgtgttttctctcgagactgcagacgggatatgcgtcatgatcagtggattcatcaatgagcagcgcactctcgaaaatggttttgccgctgaggttttcaaccgttttttatttggctttcctccagactgggaaagctatgctctagattgcttcagagaagaatctaccactggcactgatttaggtagtgctgttcctgataatgtaccagctagttctctagaaattttatctgatggcgtggaaaattccattcctacttctttggcatcaccaaaggaggccccgggagatcacgagaagtcattccctggaaatgaatgcaatgtgtcaaaggagatgggtggggttaatgttgcttgtagtagtggtgggaaaagacgtagtgccaggttgcatgatattaaagtacaccagcagaagaagaagcctgcttctggagggtctctgaagaatccaaataatgagaactctacgttagtggccttagagaattgtgatgtagagggactgaaaagtccggtgacacccattcagtcacaatcatcaagacaactaagcacatcatctgggcagctagttaaaaaatctgcatccagaatttctagaacattgtcaccaaagactgaaggctgttataagaaaaagagagtgacagttgaaagaaaagtgggcaggcctaagggaaaactaaataaatctgcatctgctgtgaaaaatccgcaagaaaaggatctaagccacttgaccaagggaagccaacagaaaatatccacagttactccagagtcgccgagtttcagaaaatccagatccggtaggttgcttctacctcccttagagttttggcgcaatcaaataccaatttataatgcggaccacgagattacagaaattcaggatggtgcatctctgatatcaccttgtaaagcactgttactctgcctgcctcagaagtcagaatgtttgaatagggtatggatccccttggctttgcttatatctgaaggttgtcatgactctagtaaccctaccaaacaaggccctaagtga

SEQ ID NO: 53177 - DNA, 405 bp, Glycine max
  Peptide Sequence Number=SeqID_169955
atggttctggatgaaatcatcaaccatgtgcaatctctacagcgtcaagtggagatcttatcaatgaaactggcagcagttaacccaagaatggatttcagcctcgacagtttattggctactgatctaaaggtagagttaggcgagttaggcgagttaggcaagtgtgatcgtgatgaaggggcatctctagtggatagtaacttacctagcatggtgacacctctcatgtggccagaaatcccactcaatggcaaccggcagcattatcaacagcagtggcaattggatgcattccaccaaccgctatgggagagggaagaagtcaaccataatttcatgactccggaaaactcacttttgagttatgactcatcggcaaactcaggtagaatagaattttag

SEQ ID NO: 53178 - DNA, 309 bp, Glycine max
  Peptide Sequence Number=SeqID_169956
atggcaccaagatggaaaggaaaagatgcaaaagctaaaaaggatgcagaagctgaagcgctcaaggaacccatgtcaaagatggtatctcaacttcagtcttctctagttcaatttgatactcgtggatttctctctggtaacagtgtacacttagtagcagtagagcagaataacttgatctgctcgaaacagcatgctttggaccatgatacaggaccccaaaatgatcaagagctggggcattacatgaagtcaaagaaagaaacattcctttgtttctacaaggctcattccctcctgaaatga

SEQ ID NO: 53179 - DNA, 1533 bp, Glycine max
  Peptide Sequence Number=SeqID_169957
atggcggaagaggacattcacaatacagctttttgcacccacaccgaacactatgaatattgtgtcatgccttttgggctctgcaatgcctcggtgacgtttcaggcaaccatgaacaaattgtttaagcccttcctccgcaagttcgttgcaatgttttttaatgacacattggtttatagcgcttcctgggctgatcatttccaccatctggaagtcgtatttatggtgcttaccaaggatttgttctacttgtatgcttccaaatgcgtctttgacaaagccaaactacaatacttaggccacattgtctcggcagatggcgtagccctggacccttccaagatttctgctatgctggattggcctactccagccactaccattgaccttcgcggctttcttggcttgataggattctaccgccgtttcatacgcggttatgctctcttagcagtttcgttaactgctctgctccgcaaggataactttgcctggaacgatgatgctcagtgcgccttcaataatctaaagcaggtcatgacgatggcaccagtgcttaccccgctagatttcactatcctattatgtttggaaatagatgctttcagagtagcaatgggggcagtcctttcccagcgagctcacccaattgcgtttttcagcaaaaaaaattgtccaaagctacaacgctcctctacatatgttcgagaacttcatgctatcactgtggtagtccgtcaatggcggcactatcttctcggtcatcctttcaccatcatcacaaaccatcagagtctgaaggagttgataaaccagaagaagattcaccagaatcccgcggctaatcctaattattccctctctgcatactggatttgctatcgcgacaagctttggcttccgttcgacaacccctttatccccatgctcttggaggaattccactccacaccactgggtggtcacatgggcaaagccaagaccctgcgctggctttgggaaaatttcttctgggacaatatacgtcgtgatgtctaccgcctggtctctgagaaccgtgtgtgtcaacagatgaagcatgaatgccgcaagccagccggcctactccaaccccttccaattccttcaggactgtgggaggatttgtctctggattttaccatgttgtcgttgtcccatgggttcaccaccatcttggtattcatcgaccaatactctaagggcacccaccttggagctctaccacccagatactctgcacacaaggtcgccggacttttcatcgacataatctgcaagttgcataggtttccccacaatctagtctccgataaggacccgatttttctcagttcattttggcgcgagctgtttcgcctcagtggcaccaaactccagtatagcactacgtaccatcctaagtctgatgggcaaattgaggtccttaaccggactctcgagcaatatctctgctcgtttatccatgatcgccctgctctatggttcttattcctttctttggccgaatag

SEQ ID NO: 53180 - DNA, 1245 bp, Glycine max
  Peptide Sequence Number=SeqID_169958
atgcccaagcacacaacgcgccaaacttcccttgaacgtttggaagatgtcgtgaacaagctcacccaacaccaagccacattagctcaaaaccatcagacacttacccaaaccaatgccgacctcaacttcaaactagattcaattcttgaccacctcaccgccctcacagccacaccaccctcacccaaaccacccccatccctgccacccataaccaaccctcgaccacacatgaagctcgatttgccgcacttcaatggccaagatcccctcaggtggatcttcaaaattcagcagttcttcgattaccagggtgtctttgatgttgaacgcctcatcgtagcatctttctacatggaaggccccgctctttattggtatcaatggatgtcaaggaacgatttcctgacatcgtggcacgccatgcttctggctttggaatctcgctttgctttgtcgtactacgaagatccttatggcgcactctttaaactccaacaacgcaacatcgtcaatgaatacttgtcggagtttgagcgcctcacaaattgtgtcgtcagccttgctcctccactcttgttgagctgtttcatctcaagtttgtcacctgacctccaacgcgaggtgcaagcattgcagttaatgtgtttatcgcaagccatggccctggctaagctccaagaagacaaactctgcgatcgccgccgcagctatcgtaccacccaccacagcccagttcagaaccactctcaccacaccaccacccaaactcaccctccgcaaacatccttcataaaccacccacccaaactcctagtacgccgcctatccccagaggagattgctctcaaacacaacaaaggcctctgctattattgtgatgagaagtggtcattgggacatcgttgccatccccgtatccaccttctcatcacaaaggaggaagtcgagttgcctacgtcaccaggcccacctgaatccccacggctttcgagggattcttctccccctttacttgcggtggataacccccctcacttgagcctgaatgtgatgtctgggatgcccgcccctgaaactttccatgtctacggcactgttcaccatcaccgcctcaccatccttgtcgatggtggtagtacgcacaatttcatgcaactgagggtagccaaatttctcggccttccatccactccaattacccttcttccggtaatggttggcaatggtggtgtcatctag

SEQ ID NO: 53181 - DNA, 192 bp, Glycine max
  Peptide Sequence Number=SeqID_169959
atggattggacctgtttttcgagttcggtcttctggctatggggtatcggtaaggtgatggaatttgttaagaagggtggaaaggtctgggggaaggggtggttatcggaaaggagggtgggggaagtaaggagtgttgagggtgatgaggatggtgcagggcctaagtggaataaggccgaaacggcctga

SEQ ID NO: 53182 - DNA, 831 bp, Glycine max
  Peptide Sequence Number=SeqID_169960
atggaccaagctccgggaggattgcgcggatccgttcaccacggcgccacgctcgagtcaattcaattcaacgaagaaattcagggactcatggcgccggcgccggaaaacgcgagctcgttcaccgcgctgcttgaactcccgccgacgcaggcggtggagctccttcactcgccggaatctgacagcgctcggaaaccgcctaattgccatgtcagcgcgaaccagaaaccctacctgctcaattctttcggcagcaatttgaccttcccttccaacgccgccttaatcgaacgcgccgcgaagttctccgtgttcgccggcgagaactcgccgcctccgccgggggaggcgcgcctgattccagcaggaaccggttcgactttggacagagtgaagaacgagccgcaagagaccgattcgaacccgtgctcgagctcgaggctgggttgcatttcggatcccgcggttgaaaacaacattcagaggaccgccaagagaaaggagcgagagaagaaggctaaaggatcgtcgaagaagcgtaagagcgccgccgatgagacatccggtgacggcgagaagcttccctacgtccatgttcgagttcgtcgaggtcaagccactgatagccatagcttggcagaaagggctaggagagagaagatcaatgctcgcatgaagcttttgcaagagctggtcccaggctgcgacaagatcttctacggtattagcctgaatagagcgtcgaaggcacttaggcacccagttgtgtactctagcacatatttaagtcctgacccaaaaaaaagtctggaagctcatataagctga

SEQ ID NO: 53183 - DNA, 228 bp, Glycine max
  Peptide Sequence Number=SeqID_169961
atggcaacgggtgatttgaagattgcatattatttgggtgtcataagaatgctacaacttgttataaatgctgaaaacagtataattttaagtcaacatgagcccaacgctggtatttttggacatcacataaacttgctggcaattgctatgtgcaccaggaaattgctggtacacccagcacaagatgggcaattccaattttgcccttccgtaaagatgatatga

SEQ ID NO: 53184 - DNA, 360 bp, Glycine max
  Peptide Sequence Number=SeqID_169962
atgaaggagaccgcagaggtatatctaggatccaccacaaggaatgcggtctcccctatgcctgcttatttcaacgactcacaacgtcaagccaccaaggacactagtgtcatttctaggctcaacgtgatgcgaattatcaatgagcctaccgcggctgccattgcttatgggcttgacaaaaaggccattagctcgggtgagaagaacgttctcattttttatcccgatggtgggactcatgcggagggtgacgataacaacatagtagctcataccagtaacacaactacctcagcaacacgcaccaggcccaataggatatggaagaggcccaattatctcagcaattacgcataa

SEQ ID NO: 53185 - DNA, 144 bp, Glycine max
  Peptide Sequence Number=SeqID_169963
atggctgcatcggttccttatagtccactggctatgaactctgcagccatccaaagcatatataccctccaaccttacatgcatgattccttttgcactcaagatagcgagaaagagaaaaagagagagattgagagaggataa

SEQ ID NO: 53186 - DNA, 312 bp, Glycine max
  Peptide Sequence Number=SeqID_169964
atggcaactcgcatgttgcacccgatgataatgaggtggaagcaaatgacgttgctgtcaaccacgaaatctcataacaataactcggcaagtttcatttcgcttcttagggtggtagtcttcattgaggcacttgccgacaaatcacttattgttgtcattataaacaaggcacttgccatcgtcgtcgtcggaggttggcaccacacccacatgagtgatgctgcattcgcactcatgttcacaccaatgtcgacaatggcattggcatgtctgcttttgacaacgggtttcaacaatttggagatgtga

SEQ ID NO: 53187 - DNA, 1290 bp, Glycine max
  Peptide Sequence Number=SeqID_169965
atgaaaccgctttgttcttctgagtttttatgtgacaatgaaaaagctgagtcaattcattccgagtctgaatattttggggcactaaatgatactctctcacatgtatgtgatcaaattgattctaatggtagccagaaagaagcagagtccatggaaaaatgttgttctgaaactgttcatgattatggaaattctgggcttgaagaagaggaaacaacaaagttggttttcaaatttgaatatcaaaagtggaattgcaattatgatgaagaactcaaagaagggtacggtgaaagtagagattttgtgaaggggggtgatgctgtttctgctagcaccaataagtatgagttcatgtcaggcacgtctttcagccacttcttggatgaacctgaggctgaaaatttcactgtcaaagaattttttgttcattcaaatgatgttattcaattggaaaatcatgttagcaatgattttgggttcttatcaaacaaaaagccagaaaattgtgaaagaggagttatatcagcaaatcttaagaatttcacagaaaatgcacacaaagatgtgtcagagaagttcaaagctgaggagttaatagaacaacctgtggaaccagttgtttgcaattttctttccgatgatgattttatttgttcaagttctgactcagattctattagcagttctttggaggaggggtttttgtcagacacagactttggaaccactactgagtatgacacattgggaagaaatgcagcagaagaggatttggactttggggatgagaaaagctatgagaatttggatgttggatatgagcctgatgattttactgaagaggatgaagatataatggatgagtttggaaaattggaagaagaatgtaggctggagaagtcttcaagtaaaaactctgaagatagcaatagcatcaattccaaacatgaacaatctgtgaagcctaattcacaggctttagcaactattgatcttgaggattccaaccggtttgacacactgtgggaacatcaagatttgatagaacaattgaagatggagctgaagaaggtcagagccactggcctacctaccatccttgaggattctgagtctccaaggataatggaagacttgaagccatggaaaattgatgaaaaattacagcatggtagcaccacaaatgagcttccaaaattctacaggagttatcgagaacgaatgcgaaaattcgatatcttgaattaccaaaagatgtatgctatagaagatactcacctttaa

SEQ ID NO: 53188 - DNA, 207 bp, Glycine max
  Peptide Sequence Number=SeqID_169966
atgactcgtgctgaacatgtcaattgtattataataaacgacgagtccaaggatagtcagaatttgacccaaagtgtgactcgtaggtttcagcgtcgaaggtcctacaagagacctgcaactacatcagaagcttgcacagagaggtgtgctgagagcctggggagagtgcagtttttgaggctgtacctcccatatggcaggtag

SEQ ID NO: 53189 - DNA, 561 bp, Glycine max
  Peptide Sequence Number=SeqID_169967
atggaccagtccttcatgcacatgtggcctaaacatccaccatacttgccgtcaccacccacaaacagctccgtctccaccgacactggaccctctatattggcaccaacaccaacggaatccgtcatcgcagccaccacctctgccgttggcaaaaccatcctccacctcgaccccaactccttctacggcagccacttcacttctctcttcttccacgatctcacttcctacctcacttccctacactccctccccttcgccgcatcctttgactctgacgacatcgttgtcgtcgacctcgtccataacccctctgcaccgacgcggaaaccggcgctgttctgcgcggacaagacgatcgatctgttgatgaaatcgggcgcagcgcagtatttggagttcaaaggaatcgacgagagcttcgtctatgaagcaaacacggatttggcaaacgtgccgaattctcgaggagcgattttcagagacaagaagttttcgctaaaggagaagaatcagttgatgaggttcttcaagctggagtacaaaaagagggattga

SEQ ID NO: 53190 - DNA, 720 bp, Glycine max
  Peptide Sequence Number=SeqID_169968
atgggaaagaaatctttgaagctgccctctcttttcaaaaccaaagaagccccaagaaatcatcatcatccatggcaattcatgccctcttgtggccactcaaagaccctctctttccgtggtggagatgatgacatgttcaagacagttaactctatgttcttcgacccttcagcagagagcactatcgaaactcccaagtcatggttcacaacctcatctgaatctgcaagcatctcaactgagtcagaagactactactactgtgatggggagtctttggagatgttggtacgtggtgtgaggtcagagaggctttttttcgaacctggtgacacaagttccatcttggaaaaggccaaggctagtggatttcccttcaaagaaagtgtggtcctagccatggagtcagaggacccttatgaggacttcaagagatcaatggaggagatggttgagtctcatggagtgagggattgggaaggcttggaggagcttttaacttggtacttaagggtcaatggtaaaaacaatcatgggtttatagtgggtgcttttgttgatttactctttagtttagctgcttctaatggttctaacacttgttctgattcaacttcatattcttctgctgtttcttcttttgcttcttcccccttgagtggccagaatgagattgttgagcatgggattgggaatgatggtgctgtaacatcttag

SEQ ID NO: 53191 - DNA, 1146 bp, Glycine max
  Peptide Sequence Number=SeqID_169969
atggtgcgtcaggttcttcttaaaagaaaaccaagtttagaaagtgaagttgactctgaaggacgtttccctcttcatctggcttgtgctgaagggaacactgaggttgtgaaagctcttttgcatacaaactcagatgtttgcttggctttggacaaagatgacatgcttcctctccacttggctgtgatgagaggactcataggagttattaaggagttgaccagagccagaccagactcaatacaacagaaaattattgatgatggttctgttttgcacttatgtgttacgtatgatcatttggaaccaacagctcctgcttgccatagacgaagaggaacagcagttagtgctttaaacaaggcaggtttaacagctttggaggcgttggagcgctgtccaagagatttcataagcctaaaaattgaacacatgttaactgaagctggaattcaaactggcacttcacaacaagggtcatcatcaccaccaagcatagctactcaaccatcacaatccaagagaagcaaaatatgggaaacattatggttaaagtacttacaataccaaagtaattggatagaagagaaaagaggaacattgatggtggtagccactgtaattgccaccatgacttttctgtcagcaataagttcaccaggtggggtttggcaagaagacacaataactggtgggttcaactgcactacttatggcaatatttgtaaagcaggcactgcagttttagcatatgattggccacatgggtttctgaagttcatgaccttcaacaccacttctttcttctcctctctcagtgtggtgctgcttctcataagcgggtttcgcctcgagaacaagctcatgatgtggatcttgatcatggctatgacctcagcactcacattcatgggactcacatacttttgggcacagagcttggtcacccctgatcacattgttgataaagttaataggatgggaattcctttgtctatagtttgggtgatcttgcttctagtgactgttttggttcatgtggttaacttgttcttgtgcgtaaagaagttggtcaagaagtggaagaagcagaagctgctgctagctcaaagtcattcctccgagagttggtccagtgaatga

SEQ ID NO: 53192 - DNA, 1452 bp, Glycine max
  Peptide Sequence Number=SeqID_169970
atggacgacgacgacgaagaatacccaattcccgtctcaaagaaaccctccacgcaaaacgatgagatcatggaactgttatggcaaaacggccaggtcgtgatgcaaaaccaaaaccaacgaccgttcagaaaacaaccgccgacgacggacggcgacggccccattccggcgagggagattcgatcctccgaagcggaaaactacaatagccaacacttgttcatgcaagaagacgaaatggcgtcgtggctgcactatccaatccatgaagatcctcctcccttcgatcaccacgatttctgcgccgacatcctctacccgccgccaaacgccaccgcgagccagaatcaaagcagcgcctccgtgcagtcctccgttcgcacgacggagctccagcatccggctcctcggcctccgattccgccgccgaggcggcaggagcatacgctgagcaggatacacaatttcacgcacttcgcaaagcacggcaatgcgtcgtcgagttcgaaggcggccgcgccggcgcagccgacggtagccacggcggagcacgtggaaaccggccgcgcgagcgtcagcgccgccgccggtaaaacccccgcgtcggatggcgggagggagacggcgacgtgcgacgtgaccgtgacgtcatcgcctggcggttcgagcgggagcgctgaaccggttcagagagaaccagtggtgaaccggaagaggaagggaagggaacaagaggaatcggagtatcagagcgaggatgttgattttgaatctccggaagctaaaaagcaagttcgtggttctacatctacgaaaagatctcatgctgcagaagtccataatctctcagagaggaggcgtcgagatagaattaatgagaagatgaaagctttgcaagaacttatacctcggtgcaacaagtctgacaaagcttcaatgctggatgaagcaattgagtacttgaagtcactgcaattacaagtgcagatgatgtccatgggatgtggcatggtacctatgatatttcctggaatccagcagtatatgccaccaatgggaatggggattgggatgggtatgggtatgggcatggaaatgggaatgggaatgaacagatcagtaatgccatttcccaatatgttagctagttcgactttgccagcagcaactgcaactgctcatttgggaccaaggtttcctatgcctcctttccatatgccccatgttgctacacctgattcatccagaatgcaaggagcaaatcacccagataataatatgcttaactcacttggtacactagatccagatcaatcatgtatcccaaacttcactgatccttatcaacagtacctcagtctccaacaggcacagttacaattaatgcagtattatgttctccaagatttgtttgagcgctcatcatatttgaaagtgtttgtcccttga

SEQ ID NO: 53193 - DNA, 1497 bp, Glycine max
  Peptide Sequence Number=SeqID_169971
atgggtcagggaactccgggcggcatgaaccggcagggcgaccggaagccggacggcggcgacaagaaggagaagaagttcgagccggcggcgccgccagcacgcgtggggcggaaacagcggaagcagaagggcccggaggcggcggcgcggctgccgacggtgactccggtgacgaagtgcaagctgcggctgctgaagctggagcggatcaaggactacctactgatggaggaagagttcgtggcgaatcaggagcgactcaagccgcaggaggagaaggccgaggaagacagatccaaggtcgacgatctccgaggctctcccatgagcgtcggaaatctcgaagagctcatcgacgaaaatcacgctattgtttcctcctccgtcgggcctgagtattacgtcggaatcttgtctttcgtcgataaggatcagttggagcctggttgtgctattttgatgcataataagtttgggaatggagtcatgataaattgtctaataatctacacaatgcataagcgaagaagcattataatccttcttgaagaaggaaggaacttaatgtgtgatttgggaccatctgaacctgagaagagagtgggaaaagttgtggttgaaatgttctttagaaccgttctttctgttgttgggcttcttcaagatgaagttgatccaatggtctctgttatgaaggtcgagaaagctcctctggaatcttatgctgacattggtggtttagatgcccaaatacaggaaattaaagaagcagttgagctacccctgacacatcctgaactatatgaagacattggtatcaagcctcctaagggggtcattttatatggagaacctggtactgggaagaccttgcttgcgaaggccgtggcaaactcaacatcagcaacattcttgcgcgttgttggtagtgaattgatacaaaagtacttgggagatggcccaaaacttgtgagagaacttttcagagttgccgatgatctttctccttctattgtattcattgatgaaatcgatgcagttggtacaaaaaggtatgatgctcactcaggtggagaacgtgagattcaaaggaccatgttagagttgctgaaccagttagatggttttgattctagaggagatgtaaaagtgattctggcaaccaacagaattgaaagtcttgatccagctttgctacggcctggtcgaattgacaggaagatagaatttcctcttcctgatatcaaaacaaggagacgcatctttcagatacacacatcgaggatgacattagctgatgatgtcaacttggaagaatttgttatgactaaagatgaattctctggagctgatataaaggcaatatgtactgaagccggtttacttgctctacgagaacgccgaatgaaggtgactcatgccgactttaagaaggccaaggataaagtgatgtttaagaagaaagaaggggtgcctgaagggctgtatatgtga

SEQ ID NO: 53194 - DNA, 1239 bp, Glycine max
  Peptide Sequence Number=SeqID_169972
atggaatactatgatgagagtctacttctggcattagcaactttagtagggaaaccattgaaagtggacattcgctctgttgacgcgtcaagggagaggtttgcaagggtgtgcatcgagataaacctgaatatgtacctatggttggacgtgtttggtgtcgtgatcactagttcagggtggaatacaaagggttgcatccgggggaaacaagaaagtagttcattaggagtagaaggattgagtgtggatggcgctagcccttatacggtggggtctcaagctagagagggacataagggggaggggcaaactcataaaaaagtgcatgaaggtatgtctcaagtctcaaagaaggatggaccaggtacgacgatgcttggaaacatggtggaagcgcttagggaaggtatttcgtccaatttgaagaaaaatttggacccaccagaaccccctgatacaattatgggtacaatggagctgggaagttcgagtggaactgggtatggggtgactgatgcacaagatgctcttgtagtagatatggagaaagagtttggagatttttctatcctggcatggaatgttcgagggtttacgaacaagaggagtcatactcacatgagaaagttgttgactcgttaccagccagatttagtatttttgtttgagactcacgttaggattgaatcgtcagggcaattttggcaaagaatagggtatggagcaataggggtggaggaagtgcaaggacatgaggggggagtttggatactgtcgcataaaggtaagggaaaaggaggtcttgggtatttacactaccaagagcgcatacaactggctatgggggaggtttgtcctcgttgcctgcaacatcaagaagacattttgcattgtctagttacctgccatttttgcacggttaaagcttttggtggagctgggagtgtgactactgattctgctttaacagttgagttggttaagaaatcgttgaaggagcatcatgagtataataatgaaatgagcctggtcaagaaactcatggagagagattgggcttgcatgtcagaacacacgttgagagaggcaaaacaaagcattgatgctattaccaagatgggattaacaagtgcgaggcccttggtaatatttacgcaagcagctcctcaagagttgaaagctacgatggaagctaatgcccttgggattatatgctctaatgataacttttgttaa

SEQ ID NO: 53195 - DNA, 735 bp, Glycine max
  Peptide Sequence Number=SeqID_169973
atgggagttagatcaggagaaaataattggcagaatagaggaaatggaggaaagggacttgaaggaggcaaacaaattgggtgcaagatccaagaacccatgaatattatctcctacaatgaaactaagaaggaaagcattgacatgaggtcgtgccaagctctatggggggacaaggagatagggtgggaaatgcagccagcggctaacacagctggagggttactgtgtatatggagtgaaaaagcgttcaaattacaaagctcaatcataggcagtggtttcattgtgttggtagaccaatggctcaaggaggctcaacaagtccatattgtcaatatatattcatcatgtgacattcagggcaagagaagtctacgggaggccataaagcagttaaaaacttcacagaatgggggcctatggtgtattttgggggatttcaataatataagaaacaatgcagagaggcttggtagctgccacagaggacaggggggtaacagcatcgaggagtttaatgaatggatagatgaattggaggtacaggaagcaccgtggttgggaagaaaatttacttggtatagaccgaatggatcagccaaaagcaagcttgacagatttctattgtcacctgattggatgactaaatggcctaacactattcaaagcaccttggacaggaatttctcagatcattgtccagttattctcaagtcgaaagttactgattga

SEQ ID NO: 53196 - DNA, 4116 bp, Glycine max
  Peptide Sequence Number=SeqID_169974
atggaggaagcgctcgagctcgcacgcgcgaaggacgcgaaggagcgcatggcgggcgtggagcgcctccacgaggtgctggaagcttccagaaggagcctcagctccggtggggtcacttctctcgtcgattgctgcttggatctcttgaaggacagcagcttcaaggtctcgcagggcgcgctccaggctctcgactccgccgccgtgcgcgccggtgaccacttcaagctccacttcaacgcgctggtccctgccgtcgtcgaccgcctcggcgacgccaagcagcccgtccgcgacgccgccaggcggctccttctcactctcatggagtttagtgaattgttatttgtgagtgtgaaacttggaaagaaagagaggcaggtttcatctcctacaataattgttgaaagagcagggtcctttgcttggacaagcagaagctggagagtcagagaggaatttgcacgaacagtcacatctgcaattggtctattttcatctactgagcttccccttcaacgtgctattcttcctcctattttgcagttgctgaatgatctgaatcctgctgttagggaagcagctattttgtgtattgaggaaatgtatacacaagctgggtcccaatttcgtgatgaacttcagcgccacaatctcccttcatctttggtgaaagctattaatgctaggctagagggaattcaaccaaatgtttgctcttcagatggtatttctagcggttataatgctggggaaattaagcctgtgggtgttaatcccaagaaaagtagtccaaagcataaaagttcatcaagggagacctctctttttggaggagaaggtgatgccacagagaaactcatagaccccatcaaggtgtattcagagaaggagttaatcagagaaattgataagattgcttctacccttgtaccagaaaaggactggtcaattcgtattgctgccatgcaaagaattgaaggtcttgttttgggaggtgctgctgattatccatgtttctttggactcctgaagcagcttgttggacctttaagcacacaattgtcagatcgaaggtcaagcattgtgaagcaggcttgccatctattatgctttttgtcgaaggacttcttgggtgattttgaagcatgtgctgaattgttcataccagtccttttgaagctggttgtgattactgtgcttgtaattgcagaatctgcggacaactgcataaaaatgatgttgcacaactgcaaagtagctcgtgtgcttcctcggatagctgattgtgccaaaaatgatcgtaatgctgttctacgtgcaaggtgttgtgattatgctcttttgatattagaacattggcctgatgcagcagaagtacaacgatcggctgatctatatgaggatatgataaggtgctgtgtttcagatgcaatgagtgaggtgcggtcgactgcaaggatgtgttacagaatgtttgcaaagacttggccagaacgttcccgtcgcctgttttcatcatttgaccctgctattcaaaggttaatcaacgaagaggatggaggaatgcataggcgacatgcatcaccttctgttcgtgatagaggtgcactgatgtcaataactactcaagcttcagcaccctctaatctaactggttatggaacttctgctattgttgcaatggaccgaagttcaagtttatcatcggggacttctatcgcctctggtgttctttcacaagccaagtcacttggtaaaggtactgaacgtagtttggaaagtgtgttgcatgcaagcaaacagaaggtcactgctattgaaagcatgcttaggggtttggatttgtttgataagcatggttcatctgctctccggtcatcgagcttggatctaggagttgaccctccctcatctcgtgatccaccattccctgctgctgtcacagcatctaatcatctaactagctctttaacgacagaatcaactgcatctggtgccaataaagctagtaaccgaaatggtggtttgggtatgtctgacataatcacccaaattcaagcttccaaagattctggcaggttatcgcataatactaatgttggtattgagcctttatcaacgttctcatcatactcaagtaaaagggttactgaaaagttgcaagagagaggttctattgatgaaaacagtgacatgagggagactagatgctatatgaatcccaacatagataggcagtgtatggatacccattatagagatggcaactatagggattcgcagcatagttatgtgcctaatttccagaggccactattgagaaagaatgtagctggacgtgtgactactggcagcaggaggagttttgatgatagccaattatctcttggagagaagtcaaactatgtagatggcccagcatctcttcatgaagctctgagtgaaggacttagctcaggttctgactggtctgctagggttgctgcctttaattatcttcactctttattgcagcaaggccaaaagggaattcaagaagtagtccagaattttgagaaggtaatgaagttgttttttcagcacttggatgatccccatcataaagttgcacaggctgctctctccacacttgcagatattattctggcattccgaaagccctttgaaggttacatggaacgaatgttaccccatgtgttttctcggttaattgaccccaaagagctagttaggcaagcatgctcaatgaatttggaagttgttagcaaaacatacagcatagattctctcctacctgcattgctacgatcactagatgaacaaaggtcaccaaaggcaaaattggctgttattgagtttgcaataagttcgtttaataagcatgcaatgaatccagaaggtgctgctaatattggcatcctaaaattatggcttgccaagttagtcccattggttcatgataaaaatacaaaacttaaagaagcagctattacatgcattatatcagtatactctcactttgattcatctgcagttttgaattttattcttagtttgtcagttgatgaacaaaattctttgagacgagcccttaagcagcgcacccctcgcattgaagtagacttgatgaattatctgcaaaacaagaaagagcgacattctaagtcttcctatgatccatctgatgttgtgggagcatcctctgaagagggatatgttggtttgtcaaggaaagctcattatattggaagatatgctgctggttcactagatattgatggtagcaggaagtggagttcccaagattctgccctgattaaaggcagtattggccaagcagtttctgatgaaactgaagaacacactgattctaatagtggtgtttatggtttcaaaactaaagatcttgcttacacagccaattcaatgggtcaaaactttggcttacaaactagccacagacatgtgaacagtagcatgaattttgaaggtctatcatctgatctggatgttaatggtctgatgtcatcagaacatttaaatattactgaagactttggacccgacaaagaacatccttctgaattgaaccataatcatcagtcagctgaagatgtgaacgtaaactacatgacagacactggacccagtattccccagattcttcatatgccttacccttgcatatgcaaagaggctgtttccggattcgaacccatgaccaacaagtcaccaaggcacaactttaccgctgcaccagggctcgccctcacatcagaaattgggggtgatggaagccctatttcaagcaagcagactgcacttcaacagctagttgaagtgtctatagccaatgaacattctatttggactctgtacttcaatcagattttgacagttgtgcttgaggtgctggatgattcagattcctcaatcagagagcatgctctatctctgatagttgaaatgcttaaaaatcagaagagcaatgatgaaaaggaagagaaattcgaggcagtgctgagagaagacaaaaactggaggaatgcgccactaacggcgaagaacacgacaagagtgatggaggctgtgtggagtggttccaattga

SEQ ID NO: 53197 - DNA, 303 bp, Glycine max
  Peptide Sequence Number=SeqID_169975
atgccggtgtcgttaaggattcctatccctgcggaagcgaaattggccccaactaatagcttttgtccggtcagggaggttgtagccattggagaagcggccggtggggcgacgggtgggatagtcgatgccatagggaggagagtcggcgcgtgcggtggtcggcaagtaattgttgttgccactgtcaaccagagagtccccgaacacaaagaaagtgcgagcactttcaacactctttgtgttgatgagaagtgtcaccaccaccagggtgaggatcatgaggaccactctcattcttga

SEQ ID NO: 53198 - DNA, 135 bp, Glycine max
  Peptide Sequence Number=SeqID_169976
atgcgaatgcaaatgcaaatgcaaatgcgggatttaaaaggaagagatggtgaatttagcggaggcctcaaaatgaggggagaagttgccgtaggagagagaaacagaagggaggatgacgcggaaatgaaatga

SEQ ID NO: 53199 - DNA, 4917 bp, Glycine max
  Peptide Sequence Number=SeqID_169977
atggagaagcacgtcgtgcagatcttcgagcgaaagaagcgaatcatcgaccaatcacgacaacagtgccatctctgggagcaacaccttttccccaaactccgcctcaacggaattccccctccgccatggctctgcaactcttcccgtcacgcagatccacaagggttaagcaaagatgatctcgtttccgaagttctaatttcgcaaccacaatatagagttcctttccccagtgtgtgcagcaatctcgattctgtgtcctatggtgttcagtatccaattggtttgcataatgaaggtcgtgctttagaaaaggagtgtaacacgggagatggggtttcgaattttccagattgtcctgtcaactatgctgtatgtgcctcaagtggtcctcctgaattggattcaggtgctgtatcaccacctcagaatcagattgaaacaagggcctcagacagtcaccacgacccagctccgtctctcgcaaagttgcaaaggtcaaagtcgaggcagaaggctctggagctacgtaatagtgcaaaagcacccagacgattgtcaggagaagatgataatgcctgtgtctgtgctggcacagttacaggttctgcaccctcaactcaagaggcagaacatgcaatggagtcggatgtggtcaaagattttcattccaacatccaaagttgttccatggaagaaatggaagcatgtgtctatgtaactaactactctggccggatgacaagatctaaaagctcatcccagaaattcaactctttgaatgttgctagtccttctgtagcgaaggaagatggccctctgcctaataatttgaatgagtcattcgagatagtcaaccaaccttgttttgcaaatgcaagttgtggcatcaatgaagcaaataaacgagagtatcagagcaaggaagctggaaaaagtgtgtatgatgagagattaacagaatctagaagttctagccaggccagatgtaaccgtgaattgttgaagcttgatagcaccttgggcagtggcaaaggagttgacttctgtgatcatagacaaccaattacacatgctcaactaacagatttaagcaaagcctctgattgtaacaatggaagtggtaggaatacagttaaagatggcaattcctgcctcagcaaacaagaaagtaacattcatggtatgataaagttacttagaggttcctgcccgtcaccaggtcatgatcttatgatgactggtggttttgtaaggtctattgacaaatcagtgccattacctcaaccttcaatttcacagaattcacaggatcttgtgctgtctgttgttgggacattcaatagtcaaaaggatctggacttttctgcgctaaaaccaaacgatcgtttgagtagaagtggttctgaaaagattgaaaaagtactgaagtcttccagatacaatttctgtgagcagagtgctacctgctctgaatctgctggtaagaagtcttggaatgtaccgcctaccaaactggatgctagaaggttatcctcaagtccagagtattccaaattagatacagaaattggcaggaattctgcagacaaggagaacgttgcggcactagctgcttctggaaaaatgagggctgtggttacttctgcaaatgaaggatcattaaggccagtgagttcttccaatttatatggtgggccttcaaatttagaatcagtatatgttgaagcagcggtggatgagaaagtcttggatgttcaagaaaatataccgtatggtgcccttcccactgataatgttgagcacagatctgctgcaattgttggcaaagttgaagctgactttgatggattagttgaaaaagatccttattgtgttatccctaaggttgggcagaatgtatcagtcttgaagccgcccactgattttaccatgtctgtgatgcctaagcaacttgattttgatgatgtagaggagacaagtatgagtggaatttgtagtcctgatttgaaagagggtcaacagggagtgtcaccagaagaacctctgaactctttggaacctgtaaaattacttgaagaggaaacttcttctgtatgccaaagtaagtgcaactccttaggggagatgccttcgctgcaaatgcaggaagtaccgatcagagaagaggagcctcgtatggaatattgtgcaagtcacttagaggaggaagatatagctagggaaacactaagtgccgcgccaccaaacaaagagatgcctatggttcagaatggattctgtattcttacttcttcgttgatgaatcattcttgtccttcacaagttgccggtgaaaattcatcaagaagtttgtcaaaagaagttatgccaaccaaatttgtttcagtaaacagtacactagaaaatgatgaaagtagtgctaagttggcagattcttctgaagcagttacgggaaatgatctgcataaatccacagatgcaaatgttacaaatttcactgttgcgttcccattttctgctcccatggctgatgtgaatgttggtttggcacgacagggccctaatagcattaccttgtgtcaagatggtgacgtgttgcggaagacattgctcagcgaaggaaaaattaccagtttttcacctgatttccagattttcagaagttccactaaaagtttcacttatgatgtggaacattcttgtcctcagcataaaagaaggaagattgaaattgaaacggagagatttcgagccgcctcttcaaacctcttggaaaaaccatgtgattctattgaccaaaggcccgcaagtagaaacttgagtattgaagaagacagccgggagattgccctagaagttcaaaatttgccatctgatccagaggatgatataggacatcaatctattagtaacatcccaacagatgaaatgcaatacaacggggaatgccaaacaatggaagactcttcacttaaagtgcgaaaagaagagaaatgtactttggatggaagagacagaagtgaagacacccttctgttggcagtggcaaatccatcaggttttagtattgactcaacgatgggatgcaccatggatgagaaggtggagtcgtggcatcatcaggtcagttgtggacaggaatgtgcagaacatctgagttgtgttgaaaaaagcacctcaagtagaagagtgtatccaggaggaaatgctaaattctcagatggaatgtctgcttctccaggaatgcaatgcttggatttggttggtacagatgagactataccagagcttgaagggttcattatgcaagcagataatgcacagccatgcattactggagatcaaatggatttggaagagatggatttggaaaagatggatttggaagagatagatcttccaagtaactcaatagattatacatcccttggtaaatctaggttcatgcattcttcattgtgcaatactttaaccccatataagattcataacgtaccagagccctatcagtctttacctaatggacttctgaagggcttaggtataaggacttcccttcctctaagcgatggaagtccaaggtccctttctgattgccaaccaaattgcaagggtcagtacacttcttcagttcaaactctttgggatcgaattaattcgaacctgggcagttcaggaaagcgtaggagtttaaaactagaccttccctgcattactgaagaaaatgaaaatgtggacgagattcctggtacattccaaaggggcattggttccgaaggaatggctggttcaaatattagagaacccctagctgagattgtagataatgcaaacccctctacgtcagttttacaagatgatatattaacaggtggacgtaaagatattttaagcacagagtttaatctcagtgggacttgcgataaggtaaaaaataagcttgacaagcaggatggcaataggaaaagattcacaagaaaggggaaggagaaccataatatttctcttggagcgaatggtgtcaagaggactgctggatcagtttgcaaaaggccgaagttatctggaaaagatagtatgaaacaaggccccattaacaatattgtatccaacgtttcttcctttattccattagttcaacaaaaacaagcggctgctgttgttacaggcaagagagatgtcaaagtgaaggccctggaggcagctgaggctgccaagcgtatggctgaaaaaaaagagaacgagcgcaagatgaagaaggaggtgttgcgacttgagcgggaaaggttggagctggagctgcagaagaaaaagaaagaggaagaacgaaagaaaaaagaggaacaaatggcagcaaagaagcggcagatggaagatgaagaaaaaaaggagaaagaaaaaaaaaggaagcgagttaatgacaagaagaagcagcagcaagaccatatgaagatacaggccaagaaggaagagataaaaatacaacgccgagctacggatgaagtccaagaaaataagaaaattatagatgaaagagaaaatcataagaatttgtcggtgcaagacaaaagagagtgcaatatggagaaaatttctgaaaccgaaccgttgaccatggtggatttggcaaatgacaaaaaagaatcgcatcctgattattcggaatctgtgaatgattgtgctaataatggacaggtaatggacaatctgattaaagccactgaagatgatgacttgatcataaaagactcacttcaagagcagtcatacgatatctctccatatagaggttcagatgatgaagatgaagacgaggatgaccttccaaataataagttaatcccttcatgggcaaggtttgtgactgttcaagtttttggagcctatctgttttatagcgccattctttaa

SEQ ID NO: 53200 - DNA, 117 bp, Glycine max
  Peptide Sequence Number=SeqID_169978
atggagcggggaatagagcagaatggaaaggccaacgaagcattgaaggaaattcaggaatttcagaacgaaaccaagcgaaacgtggcacaaattcagccgcatcttatttcttaa

SEQ ID NO: 53201 - DNA, 414 bp, Glycine max
  Peptide Sequence Number=SeqID_169979
atgctagaggaatcattggtcaatgggctattaatattgcaagtatgggaagtagagcctggtataaaatatgctgctccttttactttattaaggttgaaacaagaaaacaggacaaaattctaccccagcactgtgcctagcatatttcatgtctgtgatttacatattgcattatctctactactggcattaattttgcgagccacagtttcttctaggagagcagattttgattatgaggatggatatgatgttaggggtagaagttgggagcccctactgaatcctcaacctggccaaccatctgggtctagcaaaggtgataatagtggaaatcactcagatttttggagtgtgcggatgagagagaagattaccgatgagcatgctggttacattagtgtcctttaa

SEQ ID NO: 53202 - DNA, 640 bp, Glycine max
  Peptide Sequence Number=SeqID_169980
tgcagaagtggcaagcccctatgcattaaaacccttaatggtttcttccttggactccaaggtagatgatcaagagtggcttctcttggtccacaaactactatcagcagctggacttgatgatcaacaccaatttgactcgtcttacactagatggcattcccttgagagcccattggacccatcactgagggacacattatatgccaatctaaatgagaaggagcctcagccaaatatgcatgagggcagaagaaggaggatgagatcaaaccataagcttgtgtttgactatgtcaatgatgcactattggaacttgttggttatgggtcagaaaagtgcttaaagagaagtgggagccgctgcagagtcctagtccaagagggtgcatcagcatcagcaacatcatctcccttatcggtggaccacattgtggcccaaatgaaggaattaagagcaagtgggatgaggtgtgagtgggaaaatggtggtgggaacagcaccagcctggtggtagaaaatattgtcagaaaagaggttgtgcaaatagggtgggttgagcttacggatttggagattgatattttagggaaggagattgaaggggacttgattcaagagcttgtggagaatgcagtg

SEQ ID NO: 53203 - DNA, 1786 bp, Glycine max
  Peptide Sequence Number=SeqID_169981
cctccgcgcgtacctcagcgcactctcccacacccccacgcgcctcgccctacgcgccctctccgtctctacatcctacgatgagatgagccaggtccgcgcccgctccggcaccagcatgcgcaagaccctccgatggttcgacctcgtctccctcggcatcggcggaatggtcggcgccggcgtcttcgtcaccaccggccacgccaccctctacgccggccccgccgtcctcctctcctacgccattgccggcttctgcgccctcctctccgccttctgctacaccgagttcgccgtcgacatgcccgtcgccggcggcgccttcagctacctccgcgtcacctttggtccgttcccttcccgagacacacaaaacacgtgttctcaaatcaatctctacacgacacatatacgtgaatttgcagcctttctgaccggcgcaaaccttgtggcggactacgtgctttccaatgccgccgttgccagaggcttgacggcgtacctaggcaccacaatcggaatctcctcagccaaatggcgcctcacggtgccgtctcttcccaaaggcttcaacgaaatagacttcgtcgctgtcgccgtcgttttgctcatcactctcgtcatctgctacagcacgagggagagttctgtggtgaacatgattctgacggcgctgcacatattgttcatagcgtttgtgataatgatggggttctggagagggaattggaagaacttcaccgaacccgccaacccacataatccctccggtttcttcccgcacggtgcagcgggcgtctttaaaggtgctgccttggtttacttgagttacattggttatgatgcggtttcaaccatggcagaagaagtgcgggacccagtcaaggatattccggtcggcgtgtcgggttctgtcgttgtcgtcacggttctctattgtcttatggcagcatccatgaccaaacttctcccttacgatgtgatcaatgcggaagcaccgttttcggcggcgttcagtggaagatcggacggttggggatgggtgtctcgagtgataggagtgggggccagtttcgggatattgacgtcactgttggtggcgatgctgggtcaggctcgttatatgtgcgtcatcggccgctccaatgtggtcccctcttggttcgctagggtccaccccaaaacctctacccctgtcaacgcctccgcctttcttggtatcttcacagctgcaatagctcttttcactgatcttgatgtcctcttaaatctggtgtgtattggcaccctctttgtcttttacatggtggcaaatgccgtgatctatagacgttatgtggctacagggacaacgaatccatggcctacattgtccttcctctgctcattttccataaccgcaatcatgttcacccttatttggaaatttgtacccacaggaggggcgaaggcagggatgctcagtgtcagtggtgttattgcgattgcaatattacaacttttccattgcatggtccctcaagttcgaaagccagaattctggggtgtcccattcatgccgtggataccctctatatcaatctttctgaatgtgtttctgttgggatcactggatgggccatcctatgttcgatttggattcttttcggctgttgcggtgcttttctatgtcttctacagtgttcatgccagctttgatgctgaaggagatgattctttgactgcaaataagaatggggaaatccacgtggaatcaaaagaaattgaagaccaaagtttcgaa

SEQ ID NO: 53204 - DNA, 1263 bp, Glycine max
  Peptide Sequence Number=SeqID_169982
atggtggcgaagatcctcgccgagctggagtatgaacgcaccctgcgcgccgagccgcttgcgtctgacgcctggcgcatcaccatgggcaacgactcctggcagttttgcgccacgcgcgggatctggggctggttgcatatcgacccggacagcctgaccaccgccagcggtaccgccgtggaggcggagcgcgcgctgctgcagctggcgaaggtgctggagatgagcgacgcgcagacggcggagcacatggaagatctctacgccacgctgcgcggcgacatgcagctgctgcaggcgcgtgaagcgctggacgcggacgcgctgatccacctcgatccggacgaattacagtgcctgatgcgcggtcacccgaagtttattttcaacaaaggccgccgcggctggggtctggacgcgctgcgtcagtacgcgcctgagtatcgcggacgttttcgtctgcactgggttgccgttcagcgggagcatctggtctggagtagcgacgtcgattgcgatatcagcgccctgctggccagcgccatggacaacgccgagcgcgcccgctttgacgcccgctggcaggcgctgggtctcgacgagagttggctgccggtgccgctgcacccgtggcacagtcccctgcgcacgctcaccaacgccagccgtcgcgcgccgtttgacatcaagctcccgctgacaatctacaacacctcctgctatcgcggtattccgggcaaatacattgccgccgggccgctggcctcgcgctggctgcagcagcagttcgccagcgacgccacgcttgcccgctctggcgcgcaggtgctgggtgagcccgctgctggatacctgtcgcacccgggctatgcggcgctgccgaaagcgccctatcgctatcaggagatgctgggcgtgatctggcgcgagaacccgtcctgctatctgcaggacggcgaacaggcggtgctcctggctgcgctaatggaaaccgacaacgccgggtgtgcgctgatcgacgcgtggatcagccgctccgggttaagcgccgacgcatggctggaaaagctgtttgaggcatcggtgatcccgttctatcacctgctctgccgctacggcgtggcgctgatcgcccacggccagaacgtgacgctggtgatgaaggactctatcccgcagcgcatcctgctgaaggattttcagggcgatatgcgcctggtggatgaagatttcccgcaggcccagagcctgccggaacag

SEQ ID NO: 53205 - DNA, 1676 bp, Glycine max
  Peptide Sequence Number=SeqID_169983
cagcttcttctgggtttgtgaattgctttgatgttgaaaagaaggaaaagattggaatatttgagctcaataaaggtgacctttctttgaaggtcaccaactggggtgcttcaattttgtccctggtgattcctgataagaatggaaagttgagtgatgttgttcttggatatgattctgttaaggattacactaatgatacaacatattttggagcaactgttggccgggttgctaacagaattggaggagctcagtttactctaaatggaatccattacaaattagttgctaatgaaggaaacaatacacttcatggtggagccagaggatttagtgatgttctttggaaagtgaaaaggtatcaaaaagaaggtccaagtcccagcattaccttcagttaccacagtattgatggtgaacaaggattccctggtgatctcctagtaactgtgagctacattctaactgggaaaaaccaattggttatacttatgaaaggaaaaactctaaacaagccaacaccagtgaatttggcaaaccatgcttactggaacctaggaggccacaacagtggcaacatcctaaatgaagtggtgcagatctttggttccaaaatcacacctgtggacagcaaactcattccaacaggcaaatttgcttcggtgaaaggaacagcttatgatttccttaagccacaaactgttggaagcaggatcaatcaattggctgaaaccaaaggctatgacatcaactatgttcttgatggtgagaagggccaaaagatcaagctagcagctatagtgcaggataagaaatcagggagagtgttggagttgttcacaaatgctcctggtttgcagttctacactggtaactatgttaaggatttgaagggaaaaggtggatatgtgtaccaatctcattcaggactatgtttggagtctcaagccttccctgattcagtgaatcagcctaatttcccttcaacaattgtgacaccagaaaagccttacaagcattatatgctttttaagttttccaccaaaaatccctacattagttcaaacattgcaactgcaaatggaatcacagggaacattccatatggactaggtatcctttctaaactcacttatcttgacttatcttctaatgacataaagggaactatctcacgtagaccaaataatatagatttggatttggtagtgataatgaagattttccttcctcccactcctttgcttgctcttctatgctctgcttatgttttccaccgctgttacataattgaagcaacagagaattttgacatcatatactgcataggagctggtggttatggcagtgtctacaaagcacagctacctagtgaaatccgcaggattttcaagaatgagtacatggagaggggaagcttgtattgcattctccgcgatgacattgaagctgtggagttggattggaccaagagggtcaacattgtgaaaggcatagcacatagcttatcataccttcaccatgattgcaaaccagcaattattcatagagatgtaacaacaaaaaatgttctcttgaatttagaaatggaggcttgtctctctgactttggaattgcaagacttctaaactctggttcctccaatcgaactgtacttgatggcactaattga

SEQ ID NO: 53206 - DNA, 192 bp, Glycine max
  Peptide Sequence Number=SeqID_169984
atggagcttgatgatacatctatatgtactaatttctgttacatggctactaattcgagtggcagcttcgacggcagtgctagagacatcttcgatgacaacactggagacaacttcaacggcgacactggaaagaaggcaaaccactgcgtttcagggtgcaagagagatagagtgagatttagtgcatag

SEQ ID NO: 53207 - DNA, 996 bp, Glycine max
  Peptide Sequence Number=SeqID_169985
atggtgcaccaacttgttcttgctggcttcgtagtcaagttgttagtgacggcttattatgttgggacatcttcacaagaagaaggcctcccacctgaagaacgttgcacctttcgtggaagcttctcaaagctaaacattcaagctggtggcattttgtggcaaacctacatgatccctgataatcatggacaaaaaggagaatattctggagcggctgtgtggagaattagccctcccattgatgcatcaaggaaccatatatacattgccactggaaacttgtatactgccccttttgacatacttgaatgtcaagaaagagagaataatgtgacacaaccaactcatcctgatgagtgtgttgagtcagacaatcactccaattcaattgtggcgcttgacttggacgatggaagtatcaaatggtaccacccattgggaggatttggcaccaatgatgctcacaattcatgtcaatggaacaagatgttgttgctgtgcagaagagtggttttgcttgggctttgcaccgtgacgacgacaagctcatttggcctacggtcactcttagaccatccaacgagactacaactagtggagggtgggtggcaatggaagcatgtagtggaaagatcttgtggtacacagctaaccctagctagtaatgccaaagctaatggtcctattactgtagctaatgacattgtctttgtaggatccacaaatcaaaaaggacctatttatgcaattaacggtaagactggtaaaattgaatggtcatatgagactggatcgactgtgtatggtgacatgcccgtcagtgatgggtgtatatatttaggaaatggatataagataggcaatggagtgtttcttggaaatgtttttgctggaacttcactttttgccttgtgtctaagcaaaattctatggatagttgatacaactgatactgatgatcgcacaacagacacaggggtacaactagcagac

SEQ ID NO: 53208 - DNA, 192 bp, Glycine max
  Peptide Sequence Number=SeqID_169986
atgttggtggcgacgtgtgcatccgacgctaagcgcaactttagcgcgcttagcgtgacaagggaatttggcagagcacaagaatcaaggccactcgctaagggcaagattagctcgctaagcgagatgttcatctcttgccaagctcagcgcgtggctggtgctaagcccatatccatttactcacgctaa

SEQ ID NO: 53209 - DNA, 270 bp, Glycine max
  Peptide Sequence Number=SeqID_169987
atgctaaagatatacacagggaaattttatatgtattgcattactttttacacactaaaagacgtccaggcttcaaacaaatcagggattattaaatatggagatgtttgccgtgaagtctcggcaagtgtctatggaggcatgtcaatcagcaaagggtgcatgtatgtgggtcatggatactgtgttgcgctggatcctgctttgagcttaaccagtggagccacgctctttgctttctgtgtggtgcctaagaacttacgtggttaa

SEQ ID NO: 53210 - DNA, 369 bp, Glycine max
  Peptide Sequence Number=SeqID_169988
atggtagacacttgtcttggacaacaatcacaagactggttaaaccagggtggagatttgtacagccgaagatatgcttacaaagagcgtaagatcaaccccgaaacagcaccaaacctacgtttgaagtggaaattcaatgcaggcaaagatatcactgcaacaccagccatatataatggcaccctttattttccaagctggaatggtaacatctatgcggttaaagaaggcaatggatcgcttgtttcgaagcaggacttgcagaatctgacaggactaaatgcaactggctttgttcgatctcaatgtaaattggactgtgtcaaggacaactcccactgttgctggggatttattgattgttag

SEQ ID NO: 53211 - DNA, 1626 bp, Glycine max
  Peptide Sequence Number=SeqID_169989
atgtcaaaaatttctggtcctagtggtccagatgagatagaagagaagagagtaacaaaggaagaaaaaatcaaatctgctaaaactgagatgggtgaggtgaaggaagaaaatgagagattgaagatgatgctggaaagagtagaaaaggactaccactcccttcaactccgtttctttgacatccatcacgaagatgtttcaaagaagggtttagctgattcttctacttgccatgatcatgaaactgaagagcttgtgtcactttgccttggaaggagtccaatggtgcctaagaaggaagcaagaattggaaactccaacaaactaaaagaagatgttggacccaaccttacacttggattagactccaaacaccttttgtcaatggaggttgtgtctgattttagtcccatgaacagctccgaacaaccaaaggaagcggaagaagaggtaacattgtcaacaaatcaatcagcaaaagtgataaatgtaaatgatgacatgtcagatcaaatgccagccaagagagccagggtatctgtgagagctagatgtgatactcccacgatgaatgatggatgccagtggaggaaatatggacagaagatagcaaagaggaatccttgtccaagggcatactatcgttgcacagttgcaccaacttgcccagtcaggaggcaggtgcaaaggtgtgctgaggacttgtccatcttaatcaccacatatgaaggaactcataaccaccctcttccagtttcagccacagccatggcttcaaccacttcagctgctgcttccatgctgttgtcaggttcttcaacatctcaccacccaacaaaccacaattctgcatcttttggaaatgctcctaccacactacaaagtggtctgagtttcagtcaccagtttgatgaatcaagaaccaaacaagttttctcacccccaaaccatgcttcactacacatgttcccaacaatcactctagacatgacttattcagcttctaattcctcctcattaactcaattccatcatcgcttaccttcaacaatggcatcaatttcaaacttaaaattttctccagctagtctcagctgttcacaagataataacttcataccctccatttggagtaaggggggtgacactacaacaccaccaataattgacaaaatccccactaggccagttatcaagggaaatccatatttccaagaaaatttctaccaacaaagcataacaaaccaaactcctttcaaagaagctttggcagaaacaataaccaaagcaatcagcacagacccgagtcttcgttcagtaatagctgctgcagtttcatcaatagtggggaatggatcaaacagtgggaaccaagaaggagcagagaatgttcttggttcagggttgaacttaaaacttggggatcatcttcaattggcttcatccaatcccttgaaccaaaatgggaaagggtgcttaacaggctacttcaaaagtttgtcctctaagaattccgaggcaggaaacttcatttttctccaaccaccattgccattttctttctccaagagtggcacaaatcagctcaaccattatgttccagaaatgaacacacatcattag

SEQ ID NO: 53212 - DNA, 1962 bp, Glycine max
  Peptide Sequence Number=SeqID_169990
atgcagatgctcatagacaaagaaatgtccaaacaaaaagactcaaagcacaacctaccaaatgtagtagcaaagctaatggggcttgaagcccttccaaagggagagcctaatttatcaatggaaagaagtcacaggagagactattctcaacaaatgtatggtcctataggcttaccattcaagcattggcagcaggaagataggtttatggatagggaaatgcttcatgaagttcatccaagcacagaacatgttgctgacaaagatatgtatgaaatatggcagcaaactcagagaggaaggtttagtgaagatgttgatgggaaaagaatggctctaattcgtcagaaattcatggaagcgaaacgtctgtcaacagatgagagaatgcgccaatccgagcaattcaaagatgcattggaagttctaagctccaatagtgatctcttgatcaagttattggattctcaaaatgtttgtgatttatactcaacttcacctaatgagacaaagcgcattactcttattaaacctttgaagatggttgacaatgacaaatgtgccagaaaggagaaaaagaacaatagactgattaagaaaccatcaagtgttgatcaagaaaatcctggaaactctccagataatcagaaagttgatgaatctccggtcctaaccactcgaatagtgttgctaaagcctagcccttggaggacacctgagcaaaaggctgtggtttctccaacaacatcatcatcgccattgaatctgaaaagtggaaatttccatcagggacctgaatatgatgatgtactagaatccattagagtggcaaatgaggtcacacagcaaatgcataaaggcctgaggagctatcagaaggataaaacttcatactcttcagtgttttccaatggctattctgatgatgagagttcattcaacaaatcatatcacgagtatgcatccgcgaatttcagcgatttagaagccacgtcaatgtcaccattgccaaggctttcatgggattacaattacatcaatggctgtggtggcagtccttattctacaatgtcgttgggccgtgtcccgtgctctcctgagtcatcggtgtgcagagaggctaagaaaagactttcagaaagatggactatgatgacattagataacaagggtcatcaagaacaaagacaagcaagaaagaaaagctctaccttgggtgagatgctttctcttacccacaaaaagaaatccttaacacctgaggttgaaattattgttaatgaggaacaagaacctggcaaatctgtttcttgcagccattctttcaatgcagaaacaagcattgaaggttctcctaaaaatctccccaggtcaaattctgtgcctgcatcttcttctgtctatgaaaatggcctctcagttgtagtaaatgatcataagaacactggcaaagcacaaggctccaaggtgcagaaaaagtctaagagtgtgagatcatcatttaaagggaaagttgcaagttttttgttttcaaggagtaagaaatcatcaaccaaggaaaaaacaagttcatctcaatctaaagatgaatccaaatctacttctactgtcactgaaacattagttcttccagcaaattcacttggagtccttaggagtgatgtgtctcaaagcatcaacgtggatggttttgaagagtgttctcttgcagctctatgtgaatcatcaggaaaaaattcaacagattcagtctcgaatgaacaagaagaagacatgattacactagagcctggattgactatgccaagaccgatggtgccagagattcattcaagcggaaacccggatcagccaagtccaatctcagtgttacaacctccatttgaagattttaataataatgcatcacatgagtccttggactgtatgaagagtggtgaccagggtaataatgcttag

SEQ ID NO: 53213 - DNA, 447 bp, Glycine max
  Peptide Sequence Number=SeqID_169991
atgtggaggataggtggtggttgggaagcagagagtagtggagaatatagtgtgagttcgacatattgcgctttactggatcagcaaggtgtaggggatgatcgacctgtttttgcaatgttgtggaagctcccggtgcctcctaaggtcaagttgttcttatggaggctgttcctcaatagattgccaaccagaagcaatttatttgatagaggcatccaaatccagtccacggtttgtcttctatgctcttctacagtggaaactgatgtgcatttaattttaaattgtcgacggatgagaccaatttggaatttaagtctgcagtggttaaacgaaatgtatgttatcccagggactaccattgagcattttatgtcacaaagtggggtggcaggctgcaaggcaagagtaatgaaacaatgtatatgggcatctatcagctag

SEQ ID NO: 53214 - DNA, 447 bp, Glycine max
  Peptide Sequence Number=SeqID_169992
atggcaagcagagaccaagtttggtcattctgcacacatgatacgcggagataccttacggttatccgcccccctttgccattcagacacagtcgtgttcgatggcaagcagagaccaagtttggtcattctgcacacatgatacgcggagataccttacggttatccgcccccccctttgccattcagacacagtcgtgttcgatggcaagcagagaccaagtttggtcattctgcacacatgatacgcggagataccttacggttatccgcccccctttgccattcagacacagtcgtgttcgatggcaagcagagaccaagtttggtcattctgcacacatgatacgcggagataccttacggttatccgcccccctttgccattcagacacagtcgtgttcgatggcaagcagagaccaagtttggtcattctgcacacatga

SEQ ID NO: 53215 - DNA, 450 bp, Glycine max
  Peptide Sequence Number=SeqID_169993
atgaagttgcctaacagatatataagttgcaccctaagaattaagacaggtgataccagttcagatggcacaaaaaaggaaattgcgggtgccaccgttgcatcgtatatgccctcgattgatgacattggctcctttatttctgtttcatgcgagcctgtccgaagcgattgggctcgtggacccatggttttgtctgaacaaattgggcctataatgcctggttccccaacttgtcattctcttgaatttcttggatcaatgatagaagggcagcgcttgaactttaatgctgtgtatactggaggggagcaaggagattgtacccatgagtggtttagggtaaaagacaatggtttacgagacaaattaagtagcaatggtgacctttttattgttgttttgtcagctaagtgttctctacttgtgatggcaaaagtaaatgcttaa

SEQ ID NO: 53216 - DNA, 108 bp, Glycine max
  Peptide Sequence Number=SeqID_169994
atgtatgtgaaaaatacgacattagcaaggagaaatgggcccaattttgtcaaagccgcagagaccccttgtggaggatgtgcggaaaaaggcacaagccatccataa

SEQ ID NO: 53217 - DNA, 387 bp, Glycine max
  Peptide Sequence Number=SeqID_169995
atgaagagagaaagagaagaggccatgaagagagaaagagaaaaggacgtcaagggttggagagaaagagaggggaggttctatgattttagggtttgggatttgggagaaaaaggaaagatgagtgttgttttaaatctttttgcacaaagatcacctgctgatagtgttgataaatacattagaattgatgaatgcactgcaatccagttcttagaagctttttttaagggtgtcaatgagatatttggggatgagtacttgagaaggccaaacaataatgacatcaatcgtctactacaaattggagaggcacatgtatttccaggtatgttgggttctattgattgcatgcattggaaatggaaaaattgtccacctgcatga

SEQ ID NO: 53218 - DNA, 150 bp, Glycine max
  Peptide Sequence Number=SeqID_169996
atgactagaatagtcaaactttcagtcatcgacaatggtgccctcaaaaggtgctttagatggtccgtggtggcgatggctagcaacagcggtggtggaggacgttccctttcgcttcttcgacgattctgtcatttgatgaagctttaa

SEQ ID NO: 53219 - DNA, 612 bp, Glycine max
  Peptide Sequence Number=SeqID_169997
atggtttgtaatgaccatgctgatatgaccgacagattgcttgctggctcattcacctttgaatgtcgcattatgcattatatcctttgtcgagttttgcttccacgttccataaatcttgctcaggcctctgacgaggatttaattttgctatgggctcttcaaaccggtggccaaattgactgggcccatcttgtcaggtatcgtatatataaggcattacgggctaatgcacctcttccatatcctcatcttgtcactctgtttcttcagcattttaatattcctttagaggatgaaccttttgttaaggttaaaagatcatttgctattggtgctggtgttgttgcctccttcggataccggaaggatgtggatggccaatgggtgcataaacaagacctgccccctcccattcctgatgaacgcacaccctccccacccccgcaacgagatacctcctcttccttatcgaatgacgttctcactaagctacgggatctttgggctttcattggcgatcgcttcgatgcaatggactcacgtatcacgcgtcttgaagacgacatgagcttcattcgacgttgctttgatccttctgcggattcttag

SEQ ID NO: 53220 - DNA, 525 bp, Glycine max
  Peptide Sequence Number=SeqID_169998
atggtgggagcaggtttgaaaaaggatcttagagtgtctagggttgtgccaggagggtctcttaatgccttcctttttcttctcatcggagttatttcacaaagacttgccatggaatctattgattctctcccaattggttggactgtaggtgcgatgatttacttcacgggcgaggtctctgctcagttggtagagctccgctcttgcaattgggtcgttgcgattacgggaccgaacatgccactgaaagactctactgagacaaagacgggctgtcaagaacgtagaggaggtaggatgggcagttggtcagatctaggtttcctcatttgggatcctggggaagaggatcaagctggcccttgcgaacagcttgatgcactatctcccttcaaccctttgagcgaaatgtggcaaaaggaaaaagaatccatggaccgaccccatcgtctccaccccgtaggaactacgagatcaccccaaggacgccttcggcatccaggggtcgcggaccgaccatag

SEQ ID NO: 53221 - DNA, 1151 bp, Glycine max
  Peptide Sequence Number=SeqID_169999
gtagcggtcgtgataagccaggtgggagttcaaatcgacaatgggatcaaatccgttctctttgccctcttcatatacgcggtcggttttgaaagcgggccacagtttttccgctccttgggaaaacaatctatacgagagatcgtcttggctgcggttcttgcgatcagcggtcttgccaccgtggtcgtgctcgcaaaattgacaggtcttgataagggcatcgccgcggggattgccgccgggggactgacacaatccgccattatcggaacggcgagctccgctattgaaaaacttggccttgccgccgatgagacgcagaggctccaggcgaacgtcgcgatcggttacgcggtcacctacatatttggttcttttggagcgatcatcgtctgcgtgaatattcttccctggttcatgaaacgggggatacgggatgacgccgtgaaagcggaagcagagatgctcaagggcgcccgagtatatggcgtcggtgaagcacctgcccttccggacctggtcggacggatattcagggtcgagggtgcggctgggaaaagcattgccgaattggaagcactgtcgacaaaagggcccatcacgatcgaacgcgtgaaacgcggcagcgctctggttggcgttgaacccgagcttcgtctgcagaacggtgatctcgtactgatagtcggacgtcgtgcgggcgtcgtcggtcttgaaaacctgatcggcagggaggtggccgcggcggaaggcctggaactcgtggtcacaacgcgcgacatcgtcgtaaaagacagggacttcgccggccaaaccgttgcccggatattggatcgaagcaaagacctgcgccatgggatctacgtgatccaggtaactcgggccggtgtgaaactggaattgaccaacgataccgttatacgtgccggcgacatagtgaccgtgcacggagtacaggaggatttacagcgcctctcgaacagagttggcagcgtcataactcccagtgacaagacagacttcgtataccacgggtttggtgtggccatcggcctgctggttggtcttctcgtattgaggatcggttcagtcccgctgacgcttggcgcgggcggcggggctttgctcgccggtctcgtatttggctg

SEQ ID NO: 53222 - DNA, 222 bp, Glycine max
  Peptide Sequence Number=SeqID_170000
atggaaaagagcggaggcaaacataataattttgggtcaatgaaagaaagggaatggaaaatcttcagaccagataaattctcggcaagactgccattctcgactggcgatatcccaccccacatgaacaaagaggaaaagaccgaaacaccccgcttcctctccaaaaacactaccctcgagaaaatcctattggtctgtgatcgtacgtttgatctttga

SEQ ID NO: 53223 - DNA, 267 bp, Glycine max
  Peptide Sequence Number=SeqID_170001
atgtggggcgggatatcgccaatcgagagcgactttgaatggcaatcccaaaggaagaaccacttcaaaaatgggttttccctttgccggcagtcacttgccctgtcgaaaaatttatctggttttagcattcgttatttgctctcccttgaggagattccgctgtccttttctttgggggaaaggatgaggattcttttcatgggtcaaggttcaaagcagcttaaggttgtgtctcaacatggtcttttcatcatgcgagcctga

SEQ ID NO: 53224 - DNA, 762 bp, Glycine max
  Peptide Sequence Number=SeqID_170002
atgacgcagatcgattacgaccgggagatggcgattgtcgcagtacgccagcataacggtgccgatgagatcatcggcgtgacgcgcgcgatctccgatgctgacaatatcgacgcagaattttcggtattggtgcgttccgacctcaagggtctgggcatgggccggcggctgctggaaaagatgatccgctatacgcgcgatcacggcctgcaacaattgaacggtatcaccatgccgcacaataccggcatgattaccctggcgcgaaaactcaattttcgtgtgaatattcaactggatgatggcattgtcagcctgaatttaccgctggctgacaccggtgacctggctgtagagaaagagaagaagtgcactgtgatgttgtctaaattcaaacgcaataaacaccaacaacacctcgcacagctgcctaaactgtcacagtccgtgtcggatgtgaccacgctttactcgcccgccgagtttcgtgaaaccctgctgaagaaaatcgccacggcagaaaaacgcatctgcatcgccgcgctgtatctggaaaatgatgacggcggacgcagcatcatgcaggcgctgtatgcagcgcgtcaggcgcgcccggaactggatgtcagcattctggtggactggcatcgtgcgcagcgcggccgtatcggtgccgcgcgcggcctgacgaatgccgactggtattgcgaaatggcggcgcagcatcccgatatcgcgattccggtgtacggcattccg

SEQ ID NO: 53225 - DNA, 231 bp, Glycine max
  Peptide Sequence Number=SeqID_170003
atgaggcatgtaaagcatgaaggacatgcacaaagtgtggcaatggggtgtaataattggacccaacgttggcccatgggcttagaaatctaccctgaggttcatgagaaccctagggccttctttagcagctctagcccaatcctcttggagcctcttgctcatggctctagtgactggtcccttcctagggaggattgcatcactcttagtccaccatctaagttctag

SEQ ID NO: 53226 - DNA, 321 bp, Glycine max
  Peptide Sequence Number=SeqID_170004
atgtgtcatgtctggtctactattgacacatgtaaatccaaatgcactagagctgccctcaaaaaactcaatttggtagaagatagatctattccaagggacaagctcatttctttcctaagaatatctgtagatcttcagtacaaggatttaaggcaatttcagtggcattgggaaaagggggagcctgtcattgtcagcaatgtgcttgaatgtacatctggtttaagctgggaatcgcttgtcatgtggcgtgcattacgtcatgtaactaataccaagcatggccaacatttggcggagaaaacattgattgcttag

SEQ ID NO: 53227 - DNA, 279 bp, Glycine max
  Peptide Sequence Number=SeqID_170005
atgggttttgaattcatagtccaggcttgcttggtagatggtcaggggtcggattggagacccttcatccatgctccctggtgggaggatatggtgcttccttcaggctctctacatagcatagtcgtgcttgctttcgggaattgcattttcaaaagcagtgtggagactatggctccaagcttattaagtgtttttttgccgatcaaagcaaaatatgatgcgtctgcatcaacaagtagatattgtatgttgaagctcctagagatcttgccttga

SEQ ID NO: 53228 - DNA, 675 bp, Glycine max
  Peptide Sequence Number=SeqID_170006
atggaagcagccagaacttccgtggaccatctgccaactatttatcttatgaaagccaatttggatgcctttgtgaagaagaatatggggacttgggttttggttattggtggaggagatggtggagtcctgcgggaagtagctcgtcattcctcagtagagaagatagacatttttgaaatagacaagatggttgtcgaagtctctaaacaatttttccctgatatagcagtaggttttgaggacccacatgtaacacttactgttggtgatggtatggacaatttttcacatgatagattgtctctcaatgatctaggagttgcattcttgaagaatgttccaaaaggaacttacgatgcagttatagtggattcatccgaccctattggtagggccttgctcaagagctgtttgaaaaacactaaatgttgtcgcaacgtgcccttcgcgggcgagcgagggcgaggctcacgggtgcgctttccaaaggaggaaagatgcgcggagttgccaccaacgtttatttgtggaaaacgttggcaaaaccgaaggaaacaggtcaaaatgaaaattctaagttcgggagttgtatttacgtttgaggaaggtcgacaaaagcggggctcttgctcctacgtaccctccatcgaagaggaaatcagacctacgtag

SEQ ID NO: 53229 - DNA, 219 bp, Glycine max
  Peptide Sequence Number=SeqID_170007
atggtcggtgtagttgtaacttataactgttatccgttatcgaatacaattttatttcaaaaagcaaaaccccttatcctggctgcaattctgcaaaccgccactcctagtggcgagtttgttgggaaaacaccacgtgacacgaaaaacgtcactcgtagtggcgagttgcccagttgcaggcctaaaggggagttgcaattgcaacttgcgatttga

SEQ ID NO: 53230 - DNA, 234 bp, Glycine max
  Peptide Sequence Number=SeqID_170008
atgaaagtcaaacacaagcgttatgcggaaaatacactatactcaagcctacatgtaatgtggtaccatttttcagtgaaaaacctcgtcggacgtctaggagtacatgataggacatgcctcacaatgggcttaaaggagcactcaaaccggatgacccccaaggcttgcactccgaagagtccgttagggcctctccctcctgattcaggtccaactaaaaaaaacatttga

SEQ ID NO: 53231 - DNA, 267 bp, Glycine max
  Peptide Sequence Number=SeqID_170009
atggagaactcaccctggccacaacaacaagggcctagcttatatgagagaacaacaaagctggaagaaactcttgctcagtttatgcaactgtcattgactaaccataagagcacagagtcagccatcaagaatctagaggtccaggtagggcagctagccaaacagcttgcagaaaaatcatctagtacttttggagctaacactgagcagaatcccaaagaagaatgcaaggctgtgatgttggatcaagtggcctcagaataa

SEQ ID NO: 53232 - DNA, 2016 bp, Glycine max
  Peptide Sequence Number=SeqID_170010
atggtttcaaccagaggaattgatgcacgagttgaatttcttgagcacagctacgaggggttcatcaccacgcatgaggtattgcaagaattaaggagaatgttcgaggaagagaggcttcagcgaacagaaattaggaggcaaataggagaattaattgagacagtgagaggaatgtcgaatagcggaggccatgccggtggcagaaataacagcatacccacactaattcccaaaaccgcaacgagcggtggcagaaacttgaaattccaacctttgacagtgagtatgtatatggttggccgaggtccaagcagcaatggtcgcaatggagggaaatgctctaacatggaccaatggtgggaatttctcaaacaagaagggacagtggaggagtaccacgagcgatttgagttatatgcgggacctctccgaggtgcagagccagagtatcttaagagggatttttctgaatggcttaaaggatgtagtgaaggcagaactcaaacttcatcaagttctctaccagaattgatggattttgcacaaagtattgatgaaaaaaatacactgttaacaaagggtaatacaccggggagtaaaggaggagggtcttctaggaattacacatcctcaaggatagtagttactttggacctaggaaataaagggagtcaatttaagtcacctgagggaagttcaagtatggacaccaatagtgtgagatctacaggttcctatagagggagaccctttaaaaggttatcagatgctgagttacaagataaggccaacaggggatggtgttatcaatgtgatgggagagaaagagaaattacagtgactacaaccccaccttacactgtagaagtgggtgatgggaggatgattagatgtgaaggggtatgcaagcaagtgatctttcaagttcaaggattggaaattcagcaagatttctttatctttggattaggagaagcgatatcatgttgggaatggagtggttggcaggattgggagattaaggcgaactttaaggatctcacattgaaggttcccacacctaatggtaaacaaatcttgaaaggagaactagctatgtctagatcagctgcatctttcaaaactgatggagggtggaggttttgtgtggactatagagccttaaataaaattaccatccctgacaagtttccaattcccatgattgatgagttgttggatgaaaaaactgcattcagaactcatgagggacattatgagtttgtggggatgccatttgggctcacaaatgcaccttccacatttcaagctttgatgaatgagggaggaggcacaactatctatggaaacactaagaaaaaactatggctgaaatccccatcttcagtgcctgatttcagtcaaaacttctgcatagagactattgtttctaataaaggactaggatcagtcctcatgcaacaaggtaggccagtggcttttctaagccaaacattttcagaaagagcccagaaaaagtcagtgtatgaaagggagcttatggccaatgtcatggcttccaagtggacttccaaactcatgggtttcgattttgagatcctctacaaacccggaaatgacaacagggctgcagatgcactgtcaaggcaaatgacttatgaagctatttccctagtccacaacccgtcttcacacctcagttacacttttcagaataggaagttatggtacaaagggaaattggttttaccaatagggtcttccaaaattcacacactgcttactgaatatcgaagttcagcaataggaggtactcaggtatgcgacaagacatccagaggtttttcgcttcttgtgagatcttccaacaaaataaatatcagtccctcacaatcgcgggtctcctacaacgattacctattcctacactggttaggttctgacatatcaatggactttgtggagggacttcctaaagcacaaggcaaaaatgctattctggtggtggtttag

SEQ ID NO: 53233 - DNA, 402 bp, Glycine max
  Peptide Sequence Number=SeqID_170011
atggcttggttgttgctgttgctgtttttcgttcacttttcacataaaatgattttcttggacactgaccggagggtggctgataccttgcgtccgtactggtctgatgcaacaaatggtcgtgcctctgttgttcaagctgtgccagacatgctggaaattgtacccgtgggaacatcgaaagggaatggagtaaaagtgctgctagatcattttgaggttactgctaaggagataatggctattggtgatggggaaaatgatgtggagatgcttgaattggcttctctaggcatcgcacttagtaatggatcagagaagaccaaatctgttgctaacgtaattggtttgagcaatgatgaagatggtgcagcagatgccatctaccggtatgcattctga

SEQ ID NO: 53234 - DNA, 1365 bp, Glycine max
  Peptide Sequence Number=SeqID_170012
atggcgcgtgccgtcacgtgcgccactcagccctctcatttccacgcctcgctcggcatcgccacctctcgccaccccgtctctctgccctccaaatcctcgcttttctgccgcacctttcacgccctcgcgcggtgccagagcgaagagatgacgcggcggcgcgtggctggagtccgcgccgggcagagggagtacaggaaggcgaggagaagagcgccgcccaagagcaaaggcaaggagctgcaactctgtgtcgacatttgcatcgaagaagatttgcctgacgatcctgaaattttgagcatctcaaacggaagttcttgtgagcagggtttttacatgtctgcggccgaaactgcaattaaaaaccttgcttgtgagagcattgcagagttgcttcgactaaatgttccaatggcgatgaaactagtgtttgatggtttgaaaggttcgaggtataaaacacgagacactgctataagtgatgttggtgggtttgatagtgttgagttatcggtacttctttgtaatgatgagtttatacgaaaacttaataaggagtggagaaatgaagatcgtgccactgatgttctctcaatgtcacaacatgtacctgggctgaagattcctattcttatgttgggtgatgttgtaatttctgttgagacagcggcaagacaagcagaggaaagagggcatactcttcttgatgagatccgaatcctcatggttcatggcttgttacatcttttgggatttgatcatgaaataagtgaagaggctgaagtagaaatggaaagagaggaggaaatccttttaaagagtcttgattggaaaggaaaagggctaataaggagtgcatttgatgctgaaacaaattcaaattttcaccaagacagtgcagatgatgaattgtcaaaagacaggaagaaagaaggcagtcttagattttacaaaccaaagttcagatatatcttctgtgatatggatggaacattgctgaacagcaaaagtcaaatttcttctacaactgccaatgctttgagagaggcgtcatccaggggtgtgaaaattgtgatagctactggaaaagctcgtccagctgtgatagacatttttaagatggtagatttagctggaaaagatggcattgtttcagaattttctcctggggttttcttacagcgtaccccattgcccagaggctcttcgctatgcgaaggtatgagggagggatattgtacgcaaccttacccttgcatatgcaaagaggctgtttccggattcgaacccatgaccaacaagttaccaaggcacaactttaccgctgcaccagggctcgccctcagtattctctattaa

SEQ ID NO: 53235 - DNA, 345 bp, Glycine max
  Peptide Sequence Number=SeqID_170013
atgcttaagttcatgtcttcattgttttcctgcaacaagccatccactaacaaacgaatatttgcctcaggaaaagctttattgagctttgctaaggcaaattgtccagatgaggcctcacctgccccctacgctgcctcacctgccacccctagtctgcgccctctgatgcctgctacgccctacgctgctctgcacggtgtcgccagtttgactggcaacatacacgctgtcatttcgcagcttccactggcgacatccattccacgtgtcgcttgcttgcatgtgtcgccagcatgcatggcgaatgactatacacatcaatacatgcataattttacgtga

SEQ ID NO: 53236 - DNA, 1425 bp, Glycine max
  Peptide Sequence Number=SeqID_170014
atgaaggtggcatgttgcaccccagacattaatgttccctacttggaaaccccaagaacaaggtttgggtctgaggaagcccttgtcttgcttaaaaaatgtagcaatttcaagcagctcaagcaagtccatggcaaaataatccgttatggtctcacctatgatcaattgcttgtgaggaagctaattcagctctctccctcttatggcaaaatgaaatatgccactttggtatttgatcaactcaatgccccagatgtcttcacgtggaatgtcatgattagagcttataccattggcggttctcctaaaatggcctttcttttgttcaaggccatgctataccagggctttgcccctgacaagtttacatacccttgtgtgatcaatgcttgcatggcctataatgcccttgatgttggaagagtggcccatgctttggccatcaagatgggattttggggtgacctctatgtgcagaacaccatgatgaatctctacttcaagtgtgagaatgtggatgatggatggaacgtgttcgataaaatgtgtgtgcgcaatgtattcgcgtggaccaccgtcattgctggatttgttgcctgtgggaaattggacactgccagggaactatttgagcagatgccttccaagaatgttgtttcatggactgcaattattgatgggtatgtgaaacacaagcagcccattgaagcctttgatttgtttgaaagaatgcaggctgataatgtgagaccaaatgagtacactttggtgagcttggtcagagcatgtaccgagatgggtagcctcaagttgggtagaagggttcatgattttgctctcaagaatggttttgagcttgagccattcttgggtaccgcgcttatagacatgtacagcaagtgtggcaatttagatgatgcaaggacagtgtttgatatgatgcagatgagaaccctggctacttggaataccatgatcactagcttgggtgtgcatgggtatagagatgaagccttatccatttttgaagaaatggagaaagcaaatgaggttccagatgctatcacttttgttggtgtgctgagtgcttgcgtttatatgaatgacctggaactagctcagaagtatttcaatcttatgacggatcattatggtataacacctatcttggagcactatacatgcatggttgaaatccatactcgtgctattaagttggatgagatttacatgtcagggaacacaatggaagctaatcatgatgttgcagaattactccacaagaacaaactcactagtttcgacgacattaaaaaacttatacacaagaaatacggggatttggatttctcagaactagttttagaccattcctccacgagctcaagtgggatgcagattgatatcagcaaaataagatga

SEQ ID NO: 53237 - DNA, 738 bp, Glycine max
  Peptide Sequence Number=SeqID_170015
atggctggagaagaggaggaatcagactatatgaccccaaacaggaatttcctaatccgaggggtgttgccatcagatgagaatgaagcccgatgcctgaaatggaaggccaactactatgtcatccttgatggcgaactattaaaaagagggttgacaacacccccactcaaatgcctaaacagccaacaagtagattatgtcatgggagaactccatgatggaatttgcggcctccacacaggagaacgctcccttacaacaaagtttgcaaacgtgccacgcaccccttctgacaatctccacagtctgtattccccttggccctttgccatgtgggtaatggacatattgggaccactgccaaaggccccaggagtagtcaaatacttactagtcgtcattaactacttcaccaagtggatagaagaccactatgggaacatatgcaggcttcctagcaaggctaggcatcaagcaccttgtcaccttatcgaacatcctcagaccaacggtcaagcagaggcagctaatagagtcatccttagggctctacgtactagactcgacaagtctaaggacgtcatgatccccattgaagtcggggacgtggagccatcgacaaggagactattgttctggcaacaacaaaatgatgaaaatataagggtagaaatcgaaacaacagatgaagtccaagacatggtaaggattagggaagaagccaccaaactctga

SEQ ID NO: 53238 - DNA, 2007 bp, Glycine max
  Peptide Sequence Number=SeqID_170016
atgaaggccatgaaagagaaaatggccacaatgatggaagtcgggatgagtatgaaaagagtgatggaggtcaacacgactacagtcattgttgcaagtatcgccactgaggtggacctgattcacccatctagcatcaatcaagcaagtcgtccagcctcggatatggtaggtcaaggaggagaagcgttaggaagtacgggcggcccccattttgtgcaagttcagaacaagcactctttcccaccgtacgatttgcctcccaactatgcatcacctgatgttgcacacgctcccgatgagaatacacttgaagcacctagagaccataatctaattgactttgaacctcacctcggatatgccactgaggggcaagcagttggtgtccctcctgctatggtggaaagggaaaaattcaatcatatagaggaaatgctgagggccattgaaagaggcagagatcatgtttttgttgacatggcagagttgtgcctagtgcctgacgttgtcatccctccgaagttcaaggtgccggacttcgataagtacaaggggactacttgccccaagaatcacctgaagatgtactacaggaaaatggaagcatatgcaaaagatgaaaaattattgatgcatttcttccaggaaagtcttactggggcagccgtcacctggcaataccagtataattctgatatggctccggataggatgcagctacagaacatgtgtaaaaaggagtatgaatctttcaaagaatacgcccaaagcaatgtttcttcgagccttcatgccctgaggcaggttgtagggttgacgctcggttcaggtcgcccttcaagtgtggaagatgtgccttcggctccaccgattgtcgaggctcctgttgttgatgttgttattgctattacttcttctcctccacctcctgttgtgcttgttcaggaggttgctcctattgctgctgaagagagtgagccagctactttggctggttctattgtggggccctcgtccaccgtcgttgcgcctttactaagtgtttgtgtggcgaccaccagtgcctctatggcatttcctcattcctctttgcctcctatggtccctctttccactgcattagcttcgacttccacctcctatcacccccatgtttccctggatcatatctacacttccaacgatgttgattccttgtggagcatggaggtggttgctcgcactgcttggagagtggaatgccctaaggtagctaatgccatcgtttctcttgttgaggctgtgaggtcaaaccaccaactgtcttctaaagttggcaatgtattggccaaactgttgcgcatcgggttggacggtgatgagttgtttagacgttgcaaggacttgcaagaagagaaaaaagagcttggctggcaaggtagaggatgtggcggtggaaaaggacaagctgctagggagatggaggccagcaagaagcttaaggaggagctgctcgtttacaagaaggaagctgtggagcagcatgaaaagggctttaacaaggttgtcaggcaggttgggttcttcaccaagggccttgacttgggtctctttgaccccttcaaggacgtgaaggaatatattttgcttgatgaggatgatattgttatggaggaagaggctgctggtcttgtgacccatttggtaatgattctttctactttgcccctagttgaaggtcttgccaaccagtctaaagttcgttttgttgaacttggacctttgacgatggtcgtcgagttgcaacgagtgagcggaccaaggagatgctttgggttttgtaggagtgcgtaccaaggggcagaccttgcgtaccttgagttcttgtggagatggaacttagcaacagaaagggctcaccaagggcttggattttttgaacttgtgaggatcaccaagcatgtactggagatgtcgtgtcgtgaatcagtaggaatcaccaaggacggaccttggattttgtga

SEQ ID NO: 53239 - DNA, 231 bp, Glycine max
  Peptide Sequence Number=SeqID_170017
atggcattaggggtcatggcagctcgcccagggccaattatgtgtcatgatccaaaaatagaaaggaaaaaaaagggtcgtccaagattgacccttatacacattgaaatgaacgaaagacaaagggggcagctgaagcattgttcattatgcaaaaccattggtcattccaagaacaaatgtccaaaaaatcaggaaagcacaagtcaaagttgccaacatacccattaa

SEQ ID NO: 53240 - DNA, 752 bp, Glycine max
  Peptide Sequence Number=SeqID_170018
atggtgaaaaaatggatgaagagcatcattgcaagccttgagtgggtggtggtggaagggtcaaggatgagtgttttgtttggattaagggttggaaggatggttggaatacttactggtgtggaggttgggttggtggaagcggttcaagatgagatattcaacaaggctacaaaattaggaggcaatggcttgttgcatggagcaaagttgattggagtgggtccagagctggtagtgtggatgatgactacaattgcatctttagaggtggctttatgtgaggttgattcaattgaagcttcattcggcttagcttttggttccatagcaactatgattgaaattatttcagccactttgggtgcttcagcagttacgatagttgatgatgaaggcgttggacatgggcttccagcatttccattgtcttcttatggatgtcaaagacgcaatggcataatattgtcagtagcaacaataagcattttaaaaagcacatgtgtagagttggaagagatgactcccttggtgtcataccacgcagcctggttccacgaggtcctagcatcatacgcgccaagctttctgatgagctttaggcctcgaagcatggtagactttgtctggcaccatgttgatgtcaatgcatctggtgatgtgaagtccaaggggatgtgttgttgcttggtctggtacatacatttgctcatccctcctatcatgtctagttcttgcaaggagggtcttag

SEQ ID NO: 53241 - DNA, 258 bp, Glycine max
  Peptide Sequence Number=SeqID_170019
atggatgataagaggtttggacttgaaatatttgtctttgatgctcaacaagatattaaggggataatggatttgaatttgctgagggcgagccctggtgcagcgaaacagcctctttgcatatgcaagggtaaggctgcgtacaacatccctcccccataccttcgcatagcgaagagcctctgggcaatggggtacgaagttaagttaatggatttgaatttgcttattgattctgttgattctgcaagaaactaa

SEQ ID NO: 53242 - DNA, 546 bp, Glycine max
  Peptide Sequence Number=SeqID_170020
atggaactgctaaaccgcatatcagagattggatcaactatagttatggggaagaatgaatgtctgcacacgtcaggtcatgggtatcatggagaattagaaaatcctgcagttgttcttactaatgagataaacacaaagttgtctggaaaattaaatgtggatgggatgtcgacattgagaaaagtggtggatggacatgagaaacaaaatcagagaaccaaaatgcaaataagaggtaagatcaatttacatttgaagaatacatatagaattgtagaggatgctaaaacaaagattgagaaacaggatagaacaataggaatgcagaatctcctcctggtattcaagagaccagggctatccctcctactacaagcattcatgagacctggcctctctttaatcacaatgttgatcactattgattccctcctattacttagaacttgtcatctatcatattccctccttttgggattgagaggcagaatagagacatcatggggccaagcctgctttgataccaacttgagaaagttttag

SEQ ID NO: 53243 - DNA, 267 bp, Glycine max
  Peptide Sequence Number=SeqID_170021
atggaggttatgactcttatgaggaacaaaatagccttgttgccattgctgtgggcacataaatgctatactgaggtaagaaggcaaacagggaagacaaacacagaatggcttctaacctttcccaaaattggatcactccttttttttcagagtaatctctccctctctcctctttgcatatgcaagggtaagactgcgtacaatatctctcccccataccttcgcatagcgaagagcctctgggcaatagggttgtattattaa

SEQ ID NO: 53244 - DNA, 621 bp, Glycine max
  Peptide Sequence Number=SeqID_170022
ggactaaagctccatgttgttgagattggaagtggtcaaaaggcactggttttcttacatggattcccagaaatatggtatacatggaggcataagatgattgttgcagcaaatgctggctatcggactattgcctttgatttcagaggctatggactttctcaacatcatgcgaagccacaaaaagcaaacttacttgaccttgttgatgatgtcgtgggtctgttggattcattaggcattaccaaggactttggtgcctttccagcatatattgttgtcgctctccatctagaaaaagtagattcagtcataatgttaggttttccattcatgcttccaggtccctctgttattcagaacctcccaaaaggctcctacgttattaagtggcaggaggctgggagggtagaagcagattttgtttgctttgatgttaagtcagttataaggaacatctacacactcttctctggaagtgagataccaatagcaggtgataatcaggaaatcatggatttgtatgacccaactactcccctaccaccatggttctctgaggaagacctggcaacctatgaatcactatacaaaaaatctggcttcagatttgcattgcag

SEQ ID NO: 53245 - DNA, 225 bp, Glycine max
  Peptide Sequence Number=SeqID_170023
atgacaaaccaaagccaccctcaaatgaagagaagacctggacaacctaagaaggctaggagaaaggacataactgagggagaaagcagcaacaataggattatgatgaaaaggaatttccccactgttacttgtatgagatatggccttgaaggtcacaacagtaggggctgcaataatggtggtgtgccacctaaacccaaaaaatggaacattaggcattag

SEQ ID NO: 53246 - DNA, 1977 bp, Glycine max
  Peptide Sequence Number=SeqID_170024
atgaagcttcttccatcaggtgcgggtcacatttcacacttgaatgctgtgatacttggtgaatctctcgccactgaagaggatgatttcgttcttccaagtgaggactttgctagccaagccaatgttcagtccccagaacagtatctgaagatgtataatagatccattgaggatcctgctggattctggtctgagattgcctcagagttctattggaaacagagatggggtgataaagtgtgtgatgaaaattttgatgtgaggaaagggaatataaagattgagtggttcaagggtggcatcaccaacatctgttataattgcttggatagaaatgttgaagctggacttggtgacaaggttgccatttactgggaaggcaatgagcctggtttggatggtactttgacatacactgaacttctacaacaagtttgccagcttgcaaactaccttaaagatattggtgtgaagaagggagatgccgtaattatttatttgcccatgcttatggagcttcccatcgcaatgcttgcttgcgcccggattggtgctgttcattcggttgtatttgctggtttttctgcagaagctctttcccagagaatcattgattgtaaaccaaaagttgttattacttgcaatgctgttaaaaggggccctaagcctatctatctaaaagatattgttgatgctgcaatcaatgattcagcccaaaatggggatgtcattcctcaatatccaactacttgtccgttggagtgggttgatgcagaggatccactttttctactctatacaagtgggagcacaggaaaacctaagggtgtcctccatacaactggtggttacatggtgtacactgcaacaacatttaagtatgcatttgactacaagccgtctgacatctactggtgtacagctgattgtggttggattactgggcacagctatgtcacttatggacccatgctcaatggtgcatctgttattgtgtatgaaggggctcctaattatcctgatgctgggagatgttgggacattgttgacaaatataaggtgacaatattctacactgctccgacattggtgcggtctctcatgcgtgatggtgatgcgtttgttactcgctactcaaggaaatctttacgagtcctaggaagtgtaggtgagcccataaatccaagtgcatggaggtggttttacaatgtagttggagattcaaggtgccctatctctgacacttggtggcaaacagaaacaggtggcttcatgataactccactaccaggtgcttggccccagaaacctggttctgcaactttccctttctttggagttcagcctgtcatactggatgagaaaggtgttgaaatagaaggggagtgcaatggatatttgtgtgtgaagaaatcatggcctggggcattcagaactctgtatggtgatcatgaaagatatgaaacaacatatttcaagccatttgccggatactatttcagtggtgatggttgcagcagggataaagatggataccattggctcattggaagagttgacgatgtcatcaattctgatgtagttgctatcatatgcagtgggcatcgaattggcacggcagaagtggaatcagctttagtttcacatccgcaatgtgcagaggctgctgtggttggtgtggagcatgaggtcaaaggacagggcatctatgcatttgttacagttgtggatggtgttccttacagtgaagaactgcggaaggaccttgtactcatagttcgaaagcagataggagcctttgcagcacctgataaaattcattgggcacctggccttccaaaaacaaggagtggaaagataatgcgaagaattctgagaaaaattgcgtctcggcagctggatgaacttggagatacaagtacccttgcagatccaaatgtggtcaatcaacttatagaacttgcagattcttga

SEQ ID NO: 53247 - DNA, 813 bp, Glycine max
  Peptide Sequence Number=SeqID_170025
atggctgatggtgaatctgacaagaacattgagatatggaagatcaagaaattgatcagagcattggaatctgcaagaggtaatggcaccagcatgatttctctgattatgcccccacgtgatcaaatatctcatgtcactaagatgctgggagatgagtttggaactgcttcaaatatcaaaagcaggatggcaaggaaaaaaaaggtgacaattgattttgaacctttcaagcctatcaatgcatcactttacctctgtgataacaagtttcacatagaagctctaaatgaacttttagaatcagatgacaagtttggttttattattatggatgggaacgacaccctttttgggacattaactggaaacactcgtgaggtgcttcataaatttactgttgatctaccaaagaagcatggtcgaggagggcagtcagcattgtgttttgcttgtcttcgcatggaaaagcggcacaactatgtcaggaacactgcagaacttgctactcagtttttcatcaatcctgctactagtcaacctaatgtttctggacttatacttgctggttcagttggcttcaagactgagctgagccagtcagatatgttcaatcctcgtttgcaagcaaaaatattgaatgtggttgatgtttcctatggtggggaaaatggttttaatcaagctattgagttatccgcggagatgttatctaatgtgaagtttgttcgagagaaacgcttgatcagaaaatactttgaagagatcagccaggacactgggaaatacgtcttcggagttgaagcacgctga

SEQ ID NO: 53248 - DNA, 987 bp, Glycine max
  Peptide Sequence Number=SeqID_170026
gttgatccagatatcagcctttctcttaaacagaaccctgcttcttatatgcaagttttgaatgcttcctctagagggttgcacagaatgggaactgtattcagttatcttcccatatccatggcaactgaacctgctgcagatgactcaatactttcactgctaagggttttctggcccatcttggagaaaatttttggctctgagcatatggagaatggcaatttatccgtagcagcttgccgagctctttcactagctgttcgatcctcagcttccattgtcattgaagaatttggtcatctagaggagtacggacctttatttgtcacttcgtttgaaagatttactcatgcagcttctgtaatggccctaacttcatcctacatatgtgaccaagaacctgacttagtggaggcctacaccaattttgcttctacctttatccgatcctgtaacaagtctgcatatctttacctcatcgatgatgtatcacaggatgctctatcagcttgtggttctcttcttgaagtttctatccaaaaggcagctatatgttgcacagccatgcaccgtggtgcagcgcttgctgcaatgtcatatttatcttgtttcttagatgtgggtcttgtctctttgttagaatgtatgaattgtattactgagggatcattcaacatcacagctattcatgtcatatctcacagtggtgagggtcttgtatctaatgtggtgtatgctttactcggtgtgtctgcaatgtcacgggctcttcctgctgaataccttagccatggagaagtagaggccatagtgccactttggtccaaggccctagctgatgcagccactgattatcttgagagcaagaactctgatggattaaagagcgattttgggcatatgcaagggaagggtggccgagttttaaaacggctggttcgggaatttgctgatgctcaccgcaatattccaaatgtaacttga

SEQ ID NO: 53249 - DNA, 261 bp, Glycine max
  Peptide Sequence Number=SeqID_170027
gacactcacaaaggtttgctaccactttcaacattccgccatttgcatacaacctaccaccatcgagctcttgttaccgtctgtcattacctactcagatgcatgacatgggtcatgaagatgaggagaaagatgatgataacaataataacaacaataatgatgattgtgatgatgatgatgaccatggtggtgatgatgttgctcaacaacaacaaatagttacacatgatcatcctagaacaagaagaggaagatgtc

SEQ ID NO: 53250 - DNA, 540 bp, Glycine max
  Peptide Sequence Number=SeqID_170028
atgttgtccattaaaccttctgatggcttaaagggtttcatttgcattgtatacagatctctagcagatgctgttggttccttttccaagtggatatctgcttttaaggaaaattttagagccttgctattatttcttgctattgggatttcacaacctctatcttcgaatgcctgtgcatctgccttgcgtaaagtctgtgaagatgcttctgtagtaatttatgaaccttcaaatttggaaattttaatgtggataggagagggttgggacaagtggcatttatctttggaagatgaggaagaagttatgcatgctataagtctggtccttggttctgttcccaatctagaactaaagaacaagttattggctaaattgctttcacctagctatgaagctattgggaaacttgtgagccttcgttttcctttcttgttcactactgattttgactgtgcaatgcctattttgaccagctctattgagctggttgtttcaactgcattctttcagcattatgcactgattcatctgtag

SEQ ID NO: 53251 - DNA, 2134 bp, Glycine max
  Peptide Sequence Number=SeqID_170029
gccgaggcagcatcactcactcagacactcactccaccccaatgctttctctcttctcagacctttaccctcttccaaacaaacaaacatgcctcttcaacttcaacccttcttcaggcacatcaagcccccaaaccaaaccccctccaccaacctcattcccccaaaacccttaaaccctctccaaacacccccttcttctccttcttcaccccccatcgaccatctatacatttcacagctcctctcaagacccgattgggccgtgcttctaaaccacgacctctcctcaaagactctactcctcaaccctagttacgccgtaagcatcttccagaaccaacaaaacccctcccacgccatcaagttccactcctggctctcccacgtcaaccctacattggcagcacacaactccgtgcaccgcgccttgcggaacacgctgcaccgaaaaggccccgcgcttctctccgtcgacttgctccgggagcttcgcaatttagggtttcgcgtcacggaggacctgctctgcgctttgttagcaagttggggaaggctaggtttagcaaattactctgctcacgtcttctgtcagatctcgttcctcggtctttcccccaccactaggttatacaatgctctcattgatgctttagtgaaatcaaattcaattgaccttgcttatttgaagttccaacagatggcggcggataattgtgttgccgataggtttacgtacaacacactcattcacggggtttgcaaggttggggtggtcgatgaggcgctccggttagttagacaaatgaaggataagggacattttcctaatgtgttcacttatacaatgctgattgaagggttctgtatcgcgagcagggttgatgaggcctttggagtttttgagacaatgaaggatagtggggtttatccaaatgaagccactgtaagagcattggttcacggggtttttcgctgcgtggatcctagtaaggcacttgagttgttatctgagtttttagatagggagcaggagcaggagcgcgttcattttatgttagcttgcgatactgtgttgtattgccttgcaaataattctatggcgaaggagatggttgtgtttctgaggagggttctgggaagaggaggttatttccctggtaactctgttttcaatgtcgtaatggcttgtttggttaagggagctgagctgagagagacgtgtgatgtatttgaaattttaagaaagcaaggtgtgaaggcaggcattggtgcttatcttgcgcttattgaagtattatacaagaatgaatggagagaggagggggatcgagtttatggtcaattgattagtgatgggctaatttcaaatgtcttctcatataacatgataattaattgcttctgcagagccaaattgatggataatgcgtctgaggctttcagagacatgcaggttagaggcgttgttcccaatcttgttactttcaatacacttattaatggccattgcaaggatggagcaatagataaggcacggaagcttctggagagccttttagaaaatggacttaaacctgatatcttcacttttagctctatagttgatggactctgtcaaataaaaaggaccgaggaagctcttgaatgctttactgagatgattgagtggggcatcaatccaaatgccgtcatttacaatatcttgattcgatctttatgcaccatcggggatgttgcaaggatgaataaagttgagaaagctaaaaagctttttgattcaatgtcaagatctggcttaaatccagacaattacacttacagtgcttttatagaggcactgtctgaatctgggagattagaggaagccaagaagatgttttactcaatggaggcaaatggatgctgctacattattgagcttttgaaattgaagagggtacaggtaagagggtacagcactgtggtcgaattggggaggctgggtcagcccatgacagccagggctccatctttcatagctacccaacccatcctgtgtgtggaagaacacgaatttggtgtcagtctcatgacaggacaacccaagatatcaagttttttggccataggcccttttggcagtctcttatga

SEQ ID NO: 53252 - DNA, 1335 bp, Glycine max
  Peptide Sequence Number=SeqID_170030
atgggaaccacttgtccagaatctccaccacttctccaagacctaagggttaccatccacgaaacttcaatggtttttccatccaaagaaaccgagaagaggtcattgttcctatcaaacatagacaaggtcctcaacttcgaagtggaaacggttcacttctttggagcaaacaaagattttccaccccaaaaagtggccaagatgttcaagaatgctctagaggatgccctagtggtctatgacttcttgggaggaagattgaatctgaaccccgaaaccaaaagattagagatagattgcaatgcaaagggtgctgggtttgtggtggcttcaagtgagtacaagttaagtgagattggccacttggtttatcccaatccatcttttgcacaatttgttcacaagagtaaggatttccttcaacaaaatgatcaaccactatgcgttgcacagttgacatccttcaaatgtggaggcttcgcaatagggttcacaaccagccacaccaccttcgacggtctaagcttcaaaacattcttggacaaccttgccgcattggctgctaacaagcccctggctgtgataccctgccacgataggcacctcctggccgcaagatctccgccacgtgtcagcttcccgcaccacgagctgatcaagctcgataacttacccacaggcagcaccgagtccagtgtcttcgaggcctctaaggaagagctcgacttcaaagttttccaactaacctcacacaacattctcagcctcaaggagaaagccaagggtagcaccaatgctcgtgccactgggtttaatgttatcactgcccatatatggagatgcaaggccttatctgcaccctacaacccctctaggtcatccaccatactatatgccgtggacatacgtccacggctgaaccctcccctccccaaatcctttgcgggtaatgctgtgttaaccgcgtatgccacagcaaaatgggaggaattggagaagggagagttctcaagcttggtggggatggtgacagagggtgcaaagagaatgagtgatgagtatacaaggtctatgatagactggggagaggtgcatagtgggtttccacatggggaggttttggtgtcttcgtggtggagattaggctttgaggaggtggagtatccgtgggggaagcctaagtattgttgtcccgtggtgtatcaccggaaggacattattttagtgtttcctccttttggtagtggggatgatgggataaatattatagtggctcttcctcccaaggaaatggacaaattcgagaccctcttttacatgttcttgaattga

SEQ ID NO: 53253 - DNA, 162 bp, Glycine max
  Peptide Sequence Number=SeqID_170031
atggtggccgctttggaggtcgtggtggtcgctatggtgactgtggtgttacaacaacaatcttatctcatcaatccctctgaagttcccaagactgcaaattatcaagtgccacagccacaatcagctcctgcatcatccattgtttccaaacatccttaa

SEQ ID NO: 53254 - DNA, 180 bp, Glycine max
  Peptide Sequence Number=SeqID_170032
atgggtgacctagcctatgtgaggaaagaatgggcctgtggtattttgatcatgaatgacctagcttatacgggggaaaacatgagtaagttgaagtttgactttgtccttgggggtgttacccagtttggaatcttcatgtggctcatgctgatcccatgggttgaagtgtccttgtaa

SEQ ID NO: 53255 - DNA, 642 bp, Glycine max
  Peptide Sequence Number=SeqID_170033
atggcttccgcaaacaacaattcttctccgtcaccacctccgcctcctcctctgccgccggcaccacactcccacgtctcgttcttgcacactgtaacagcgaaactcacagattccaattaccttctatggcgttctcaagttcaacttattccgcaaaaatttctcaccgttgaagatcttgacaacaacatcgttagcactgcctatcgtttttgggagcaacaagatcaattgatcctctcttggctccaatcgactatttcagaaacagttcttcctcgcatcatcaattgcgcaacctcgtggcatctatgggatcgattgtatgaacactttcaatccactacgcgcgcaaagaagaagcatttgcatagtgagcttcgttcttcttctcttgagaatcgtttgattactgcttatctgttgcacattcaatccttaattgattcacttgcatcaattggagactcgatttcgacgagcgctcacatcaacctgattctcgatggttttcctaatgattatcgcacaatttgtactattctaaacaatttgcgtgatcctctaaatctggacaatgtcacttctatgttactgctgaggaatctagcattgaaaagtctcgcaagaagaatttga

SEQ ID NO: 53256 - DNA, 1098 bp, Glycine max
  Peptide Sequence Number=SeqID_170034
atgaggagttggtgtatggtgggatgtagaggagcagagccaaaccctcacccgtccctcagtcactcactgctctgtcactccctcatagcccgtagccgtccgatgcaacgaaaaagccaaccaaaggcgcacatcatggaattggcaatgaaggtggccgaggccgtccatgtgctgaaccacgatacgcaatcctgcaaccgcgtcgcagcgaatcagtggctcgtccagttccagcaaacccacgcagcctgggacgtcgccaccgccatcctcaccgctgatcgccgcctccccctccccgccaacttcgaggtcgagttcttcgccgcgcagattctcaaacgcaagatacaaaatgaaggttatctactgcaattaggagttaaggatgctttgttaaatgccctccttcttgcagtcaaaagatttagtactggtccacctcagcttttgacacagatctgtcttgcactctctgctcttgtacttcaagttgctgcacatggaaaccctatcaagcagcttttttacagtctccggaatctgcagagccaggatgatgacaatattgctgtcctggaaatgctcactgttctgccagaggaagttgttgacaatcaacatatcgattctaaaattagtacattacacaaaagccactatacccaagagcttctctcccatacacctatggttcttgagttcttgctgcagcagtctgaaactaattttgatggttctgtgcaacaacacgaaaggaataggaaaattctacgctgcttattgagttgggttaaagcaggttgcttctctgagatttctcctggaacattgccagctcacccacttctaaattttttgttcaactcattgcaggttcctttatcatttgatctagccatcgaagttcttgttgaacttgtgactaaacatgagggaatctaccacgccctctcccatgagctccaccatgacctcctcgaccatacgaacagccaccatcacccctcccttgattaccatacacagaatcataatttgaggaggagtgtgtgttaccctgagttagatgaacctgagcttcagaagtag

SEQ ID NO: 53257 - DNA, 285 bp, Glycine max
  Peptide Sequence Number=SeqID_170035
atgagattttggatgttaacatttgtttctaaacgaccatttaaaggaaacactgggtccaacaaaatagaagaaaatcactcaaagtgtatcgatctcacacagggcaaggatgggcattctcaccctgggtcaaggtttatggtgagttgggattttggctcaaggcttgtagaacgactggacatgatatatgtcagagtgttggacatgaaaggtttgggagttgtatttacgcacggggaaggtattagcaccccacacgtccgtcgcaagagacggtag

SEQ ID NO: 53258 - DNA, 510 bp, Glycine max
  Peptide Sequence Number=SeqID_170036
atgaaacttcctttttatcctgaattacttaaagccttttattctaacttggaaattcaagaagattccttgatttccgaagtatatgggattaagatggtcatagaccagtcccttttctttgaactcactcaattgttcagtgtcggtgtaccgtttaagggtacacttgatgatgagtggaagttcgatttctctgtttctgatgcttgccggatggtttgcaccaaccaagcggatatgaccggaaggattcttgccggatcattggcattcgaatgccacatcatgcagtacttgattgtgcgcacatcctacttcctagatcatccaaccttgcacaggttgggtggactccacaccttcgttggtgagcgctttgactcattggacagccgtattgatgccatggatgcacggtttacaggaatggatactcgcatcactcagcttgaggagaatatgagttatattcgtcaatgcttcgaccttccaccaccatcctcatag

SEQ ID NO: 53259 - DNA, 501 bp, Glycine max
  Peptide Sequence Number=SeqID_170037
atggaagatactaagcctatgaaaacttcaatgcatgattccaatcctttgagaaaaaacgaatcagataaaccagtagatcaaacgatttacagagctcaagctttccctaaaaacttgtttatccctgggaaatggataaactttcaaagccagaagaaagaaggctttgagatgtgctctggatggtttgaccatgagcaaagactagataaggagataacccaggaaactatggacaagtttctctatggaaagtctcacccaaacggaggtgacaagaaggctctgcacaccttcttgaggacaaccaacttgacctacatgtgtaggatgatccacagtgtgtcattcaacatattcatgcccagggttggctcaagagactatgttagtgacaaagaatttttttgcatctacaagatcatgatgcaagccttcaaagacagattcaaccccaaggtgaagaagaaccaccttccctcttcacctagactctaa

SEQ ID NO: 53260 - DNA, 456 bp, Glycine max
  Peptide Sequence Number=SeqID_170038
atggcgaggattcctgacaagattaggtctattgatggatcaaaagaaacgcttaagcttgctgttaggatcaccgatctttggttcgttgggactcctaacaagtctgagcaagcgaaaatggtttttgttgattctgagggtgatcaaattcatgctatttgtaaatcggaccacctcaagtcttggaaagctgatttgaaagagaattgcacttatgttatgcataatttcaaagttgttaagaatgatggtcaatttagagtgtgcgaacatgagtacaagttattttttattggagtgacggttgttagagaagctgatttgcatgaactgccttttaaggaatttagatttgttgaatttacaaatgttgttgctagcaattttgtgtctggcttgttggttggtggtctttcggcatgtttcatcgaaaaataccagggttgtttttag

SEQ ID NO: 53261 - DNA, 459 bp, Glycine max
  Peptide Sequence Number=SeqID_170039
atggatgaaaccattaacgccgacgcgaagcttacctcgacagtggaagagcaaaacggagttgcaggtcctcaatgccgacaacaaaccacccaatgcgtggcaaatgaacctccaaggaaagcaaactgcaccgggaggagaagaagctctaacatcgttgtgaaaacaagcaaatggtgtagggaagaggaatgtacggaacgggtgaatactggagtgttgggtgtacagaagtatctcgtgtgcttcatatgcaactccaacgaaatgaaattccacgacgttgtttcagccatcgacgaggaccaagtgctacaacccggtcaactctatttcgtagttccattgagtctcttgaagcaccctttgcaggcgcacgagatggctgcattagttgtcaaggtcagctctacgctcatgaaaaccgccgacaaatgcggctctcgccaaaaatag

SEQ ID NO: 53262 - DNA, 708 bp, Glycine max
  Peptide Sequence Number=SeqID_170040
atgtctgaaacaagttccgttcattctcttcccatgcgctatgcggacttccccactttagtggacgcgttggattacgcggcactgggcaatacgggaatgaatttttacgaccgtcgcaatcaactcgtgaccgttctcgaatatcgcacgctgcagcaaaaagcgatctcgggcgcgcggcgtttattgtccctgaaactcaagaaaggcgatcgcgtggcgcttatcgccgaaaccagcgcgggattcggcgaagcctttttcgcttgccaggacgccggcctggtggcggtgccgctggcgatcccgatgggcgtgggccagcgcgactcctacaccgccaagctgaaggggctgatcgccagctgcaaccccgcggcgatcgtcagcagcgaagagtggacgccgctgatcgcctcagccacggaaaacacctcggcgctgcacatcctcagcgatgcggattttaacgccttgccggagccggagatcgccttgccggcgccttcgcccgacgatatcgcctatctccaatacacctcgggcagcacccgctttccgcgcggcgtgatcattacccagcgggcggcgatggcgaacctgaacgcgatcagtcgcgacgagatcaagctgcgcgcgggacgaccgctgcgtttcgtggctgcccttctatcacgatatgggtctgggtcggttgcctgttga

SEQ ID NO: 53263 - DNA, 239 bp, Glycine max
  Peptide Sequence Number=SeqID_170041
tcccgaacccgtcgggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaaggtagccaaatgcctcgtcatctaa

SEQ ID NO: 53264 - DNA, 540 bp, Glycine max
  Peptide Sequence Number=SeqID_170042
atggatgagggcgaagagtgtgacaacgagtctagccttggaggcgacgagttgcttgtagatttcagcgacaatgtaaagagggttggtggtggtggccacaatgccaagatggaggccgccatgtggaaggggttgaccttgtcggctctattgatggcaagatctaaccctaatagatcaatcggaggaggaactctagagagtatcaaaaataccaccattactaacaaagaaagcttgaatgactacatcgaggtgagccaacctatgatgatgatcatgctggaggtggagaggtttagcttttctcatggaaatattctgatagatgtgacatcggggcatatgacttttatctcacatgtgtcacaagatccaaagtggggttggcgtcgagatcggagagggggatcccgagggagagtggttgttattcgtgagttttccttattgaagatgtcgccgatgcgattgacaatgtgcttggtggtggagagtgccgaggttgacagaggaggaggggaaagggaagacaat

SEQ ID NO: 53265 - DNA, 945 bp, Glycine max
  Peptide Sequence Number=SeqID_170043
gtcctcgcctttagaggactacagatcctcgccttcagagggctacacgttctcaccttcataggactacacgtcctcacctttagagggctacacgccctcgccttcagagggctacatttccacgccttcagaggattacatgtcttcaccatcagaggactacacgtcctcgccatcagaaggctgcatgccctcgccgttagagggctacatatcctcaccatcagagggctacacgtcctcgccttcagaggactacacgtcctcgccttcaaaggactgcatgtcctcgtcttcatagaactacacgtcctcgccttcagaggaacacacatcctcgtcatcagaggactacacgtcctctccttcagaacgctacacatcccaaccttcataggactacacaggactacacgtccacgccatcacaaaactacacgtcctcgccatcagagggctgcatggcgtcgccttcagagggaaacatgtcctcaccatcataggactacacgtcctcgcattcacaggactacacgtcctcgccttcagaggactacacatcctcgtcatcagaagactacacgtcctcgccatcagagggctacacgactacacgtcctcgccttcagaggacttcacgtcctcgcctttagaggacttcacgtcctcaccttcagaggactgcacctcctcatcttaagaggactgcacctccctaccttcagagggctgcacgccctcgccattagagggctacacgccctcgccatcagagggcagcacgccctaaccttcagaggactacacgtcctcaccttcagaggactgcacgtccttgccttcagaggactacctgtccacaccttcagagggctgcacgtcatccccttcagaggactacacgtcctcgccttcagaggactacacgtcctcaccttctga

SEQ ID NO: 53266 - DNA, 168 bp, Glycine max
  Peptide Sequence Number=SeqID_170044
atgaatagggagtctactttgatttggcaggatgcgaagaggatgaatacgaagtgcagcatagaatgtgaagaagatgaagagatgtgtactatacgtagatatatttgtatagaagtgttagtaagtggatgttcaaaagtttatggtataggactgaaagcatga

SEQ ID NO: 53267 - DNA, 189 bp, Glycine max
  Peptide Sequence Number=SeqID_170045
atggcaggggacggccttaggcctatgtttcatcctgaagcaatggggcatgctacattgcccccactctcttgctattcatgcctaaacatgtgcccaccaaatgctccgtggaatgcctcaatgacatatgagcatggtttgggacagcgtgaaggatttaaaatgagtgcccgaatgcaattctag

SEQ ID NO: 53268 - DNA, 378 bp, Glycine max
  Peptide Sequence Number=SeqID_170046
atgtcattcgccaatgcccaattttgcaacggcatccttgtctcctatgcctacaccgtcgatgtgcgactgccgtcgaatgtcttcgatccagcaaaggaaccttaccaatttgagtcaacggtgacggtgctcaacaacgacctcgacaagctcaagtcgtgggaggtctttggtgggtacgaccaagacgagttattggtctccgcctccaatgttttgctcgccgacgacaccaccctccctgtcgccgtcgaaaaagaccgccgtcgaaaccaccgacaacttgacccagatgtagatcaaacttgtcggcaccatgttcgaggtggcatcaaccaatgtttcaatgccgaaatccatcaacctcgccaatga

SEQ ID NO: 53269 - DNA, 258 bp, Glycine max
  Peptide Sequence Number=SeqID_170047
atgatgtcatccctagctcttgcctcagttgtctctctgaccttagagggctcacccccccatcagcagagggttggactcctggcccaagcaacctgctggataaaggcctctggggttgtcaatggtgggtccatccctaggattgaggtggatggcggctggcgacgtgcagtaggtggtggaggaggttgtgctggagatggggcgtctggtgctgcgtctctggctcaggcacaacgtgcccttggaaggtga

SEQ ID NO: 53270 - DNA, 183 bp, Glycine max
  Peptide Sequence Number=SeqID_170048
atggggctccagataagatttgatggtggaggacgcacgaacaacgctaggcaatcaattcgtggggctccggacttgatggcaatcaattcgtggggctccggactcgatggtggaggacgcacgaacaacgctaggcaatcaattcgtggggctccggacttgatggtggaggatgcatga

SEQ ID NO: 53271 - DNA, 348 bp, Glycine max
  Peptide Sequence Number=SeqID_170049
atggggattcatcggttggtgtttgtgttattccgtcaacagtttagacagagggtgtatgctcctggatggcgacaaaatttcaataccagagaatttgctgaactttacaaccttggattgccggttgctgctgtcttcttcaactgtcagagggaaagtggctctggtgtgaggaagggagaaaggaacaagcatgagcaaccatgcaacccaaggaacaccatttgcgtttcaaaagagagaaaggaacaactgaacaagcatattgagaatgaatgggaaaaggaagagtcattcacgttacgagaaggaaggaccctcgtgtctcatgtgactaggaattag

SEQ ID NO: 53272 - DNA, 279 bp, Glycine max
  Peptide Sequence Number=SeqID_170050
atggatgggtatcatggtaaagaggtggagtctttgcataagaatcatacatgggagttaattgagctacctttaggcaagagaaccataggttgcaaatgggtgtataagaggaaacctctgttgagacacatttctatcagggcgacgctagccttggtagccaatgaagacatgcacttggagcagatggatgtgaatacaacttttcttcacgatgacctagaggagcatatttacatgaagcagaatttaaggttgcacaatggaaactgttga

SEQ ID NO: 53273 - DNA, 2565 bp, Glycine max
  Peptide Sequence Number=SeqID_170051
atggttaccgattatttcagagattcccctgcaccttatgattatttggtgtctttgaatggaacaatatctgcacaaaacattttaggattgctggatgttcgcaagatgattgttttatctttgcctccttctagtgcaacctctcaagttatcattgattgtaccttggatgtgagtgaatctgtacgcaaagcagcatactgtgttctagctaataaatttcctcttcaaagcttaagcattaaactcaggacagtaattcttcggagaggacttgctgaccggtctgttgctgtctcaaaagaatgttttaaactattgaaagatgaatggctcatgaagtgttgtaatggtgatactatagaacttttgaagtatcttgatgttgaaacctatgaatcagttagtgaatctgtaatggaggtgcttcttaaagctggtttggtaaaactacagaatggtgcaagtatccagcagtacatatcatcaaatggtgacagaacagaaggggatgcggttcattgcccaccaagcattcatccgatggaagcagaggctgctctttattggagaactgtttgcaagcatttacagtcagaagcacatgccaaaggctctgatgctgcagcaacaatgggtactgaagcagaagtatatgcagcagaagcatcagataaaaatgaccttctagaaaaaattcttcctgcaacagttggtgaatatatagaattggtcagagctcatactaatgctggatcaaaccatcgctttgcatgccggcagctgcttttgcttggttgcatgtttgatttttctgatgttacaaatagaaagactgctggtgcatttctgcatgagcttatgtgcaagcctcctgagcatgaggatgatgatgaagggaatatagttgttcttggagatggattaagttttggtggggacaatgattgggctgaagctgtagccagtttagcaaggaaagtccatgctgctcctggtgaatttgaagaagttattctggcaataatagaagagctcgcccaaccttgcagggagagaacagcagattatgtgcagtggatgcacagcctctctcttactggccttttgcttaaaaatgcaaaatcacttcgctttcttcagggcaaggctattgaacctgatgagctactccaatctttactactaccgggggcaaaacaatctcatttggatgtgcaaaggattgcaatcagatgccttggcctttttggccttttggaaaggaaaccaagtgcagaacttttgaaacagttgaggatttcatatattaaggggccgcattcaatcagtatagaggcttgtaaggcattaattgatctcgtgatgtggtatggtcctcaagaagttgacaagatgttaaacctcagtattccatgccaattaaacagtgagaagacgactttttctcctctgaacttttctgattcagaagaggaattagatgttgggacgcttgatatcttatatggcggctttgaaaatgatgactgggcgagtcctttacctagcaacgaagatgagtgcgttcatgctattcttggagaggggtttgccaaaattcttctcttaagtgacaactatccaagcataccagcttctttgcatcctgttattttatcaaagctcatttacttgtatttcactgacgtgtcggaacacttgcacaggtgcataacgaaaagtttcattccagcaatgcgttcaatgtggccaggaatttttggcaattctgcgggttctacttttatggtgtcgcagatgcgtaagcgtgctgttcaagcttcccgttttatgctgcagatggtgcagattcccttatacgttaaagagactcaaccagattgtgaaaatactagcacggaacatccacaagtcatagatagttgtgtggaagttccatttgagtgtggtgaggaggggctcgcactacgcttagccgtagaggtggcaagctttcaatcgaagaagacagcagctgagaaggcatatgtgtcggctttatgtagaatacttgttttgcttcagtttcggatatcagaacaaggaccaataaaatttatgaggaggcttttatgtcgcgtgctagaatgtgcatcttcagagaaagatattgttaaggaattgaaacgcatgtctgaacgtctcatgacagtagataatcaaccagatcaggaattgatgcaagatgaagttaatcttattttggggaaattggaacttgattgcgacctggatttgaatggttctgtttcaatgccacaaacaccagctgcacccccaactaggccaacacgttccaggagaagggtaaggattgaggaagaaagttctgatgaagattcaccttctgcagttcctaccacccatcattctgtaataagtcgctcacagagagcaagcaaaacggcagcaatgaacaagatgtcttctgccactagatcgctcaaaattgatgaaatggaagaactcgaggaagaagagtctgatgtaacatcagaagcttctgatgcattcgattag

SEQ ID NO: 53274 - DNA, 426 bp, Glycine max
  Peptide Sequence Number=SeqID_170052
atgacgggtcatagcacccgtcttaggtttggcgaagcattgcttctcaggttttgcttagaggctaagaacactttttctcctcacgattcttctccaccacgcattcatgcacgcgtgccgtcacacgactcttttcctttcaaggaaaacagaacgcgactcatcgcagcagcactgcctcaacccaccaccacgccaccacgcaaagcccgcggaccggtccgtttgaaccgcgggtccgcgggacagggacgaaccaatttatttggtccgtgtaaaaatgcggaacaggctgacccggtccactgtcaatacaagcttatgcgggtgagtcttacgcaggacaaactgaccggcttactcacccctagttttgctaaagaagggcataaggtggtgtattgggtcaggttcgaacattaa

SEQ ID NO: 53275 - DNA, 126 bp, Glycine max
  Peptide Sequence Number=SeqID_170053
atgggtttaatgggccgaacagttcaaggattcaaatcgacgagaccagcgagcaccaccaccgcgaccggcgagcccagccaccgtgttcgacttcgaattgagtccgagaaggctgttagatag

SEQ ID NO: 53276 - DNA, 570 bp, Glycine max
  Peptide Sequence Number=SeqID_170054
atggaggagaacgatgcagaagaagcgaagcgattgatgctgaaaatcgccgcaattctcgacgaggctcgaacctcatacgccactcacaaccgaaagctcaaggaattgtcgcttctccgatccaaatcctcttctcattcgcacttcttctccgccttctctaaaaccctaactcctctcttcgactttcagaggcgccttgcttccgccgaccgcgttgttttcttcgtctccgccttcgccgtcgccaccaccgctgctgcttccgatgagttcctcgaccacttcctcaagttcctcctcgctgccgccacggcatcaaacaaaaccgccaggttccgagcctgccagatcgtctctgagataatattgcggctaccggatgatgctgaagttagcaatgagatatgggatgaggtgatagagtggatgaaggtgagggtgcgagacaagatccctgtggtgcgtacttttgcggttagagcgctttcgcgcttcgtgaatgactctgtgaatagtgacatccttgatttgttcctcgaggtgcttcctttggagcagaatgcg

SEQ ID NO: 53277 - DNA, 732 bp, Glycine max
  Peptide Sequence Number=SeqID_170055
atggttggtgctataaaagcagcgattggagacgcagtgttgactttcatgtgggtgttctgttcctctgtgttgggaattgcttctgggtacataaccaatgcccttaaccttcaacacatcacctacaatgggttcccttacgcttcttttcttgtcaccaccaccctcgtttttgttcttgtttttcttttcaccatcatcggcaatgttcttggtggggccagcttcaacccaaccggcaccgcttccttctacgctgttggtcttggttcggatacgctcttctcaatggcgcttcggttccctgcgcaggcagctggtgctgcgggtggtgcaatggcaattatggaagtgattcctgcgaagtacaggcacatgattggggggccttctttgaaagtggatttgcacaccggggctgtcgctgaaggggtgttgacctttgtgattacctttgctgttctcctcatcttcctcaggggccctcgtagtgacttgttgaagacttggttactggccacggcaactgtagttttggtcatggttggatctgcctacactgggcctgccatgaatcctgctaatctgctaaaacgcttgacttgtacaatttcaaggactaatctgagctattcttctcgcctctttgccccatacttattatgttatttaatgatgtcaaatcctgttgaacgtctgcatagtccctacagttttggtgttctataa

SEQ ID NO: 53278 - DNA, 696 bp, Glycine max
  Peptide Sequence Number=SeqID_170056
atggtcttgaaagaaggcagtaggtggcgaattggtgatggttcaaatatcaacatttggcacggtccttggttgaggaaagagagcagttactatcctacatcacctattagtggtgcagaatcagtaatgaatactcctcttattcctcaaattctcgaagataaactgatctgggcacacactatggatggatcatggcctgctagaattgtctccctagctacaagagcaaacctgagaactcgtggtgttgaatgccccataacatgtctttactgtgagacagatgtggagacaacatgcatagtctgtctacgtgccctttcggtatttcaagctggaacaacattgaactgggtcaaaaaattctccagcttggtcatcagcttgtggaggagaaggaatgaaaaggtgtgggatgataaactgcttccagatttcatgaatcaatgtactgctattagcgcttgtataagagacaacactggtacatttttggtagccaaatcagaatggaagaattcgtgtcttaaagtgcttgagggagaatcttgggctttgtggtcagctctcactcttgtgaatgacttgtacctcagcaacatctactttgaatcagattgcaagatctttgtggataaaatcaatggcaaaggtaaagatgtatcaaaagcgggtgtcctcatttcctag

SEQ ID NO: 53279 - DNA, 224 bp, Glycine max
  Peptide Sequence Number=SeqID_170057
atgagggcttctggtaatcgattaccaagggggtgtaatcgattaccaggcttagaaatgaaggcagcaggttgtggaggcctctgtgcctttttcaggttttcatgccctgaagctgtgattcaagtttggcctctgatcgtgagggcagcgcagctaatccatgatcgagtagagatggagtgcctagagggagcttgggagaccctcgaaggcaacacgag

SEQ ID NO: 53280 - DNA, 810 bp, Glycine max
  Peptide Sequence Number=SeqID_170058
atgattagcaatgttacaattgccttgaggaaggaaggtttagaatcatcaaatcttgtccttggaattgatttcacaaaaagcaatgaatggactggaagtgtctcattcaacaatagaagcctgcatgctattggaagtacacctaacccctatgagaaagccatctctattattggcaagactctggctccttttgatgatgacaacttgattccttgttttggctttggtgatgccaccactcatgatcaagaagtgtttagctttcacagtgataattcaccttgccatggttttgaggaagttttagcttgctatcaaaaaattgttccaaacttgagactgtcaggaccaacatcttatgctccagtgattgaggccgcaatagatatagttgagaaaagccatggccaattccatgtgttagttattgttgcagatggccaggtaacaacaagtgctgcgtctgaggatggagaactcagtccacaagaagcaaggacaatcaaagcaatagctgatgcaagttcatatcccctttctattattctggttggagttggtgatggaccttgggaagacatgaagaagtttgatgacaagataccagctcgcgactttgacaattttcagtttgttaacttcactgacataatggctaagaaatcaagcccctcagaaaaagaagctgcttttgctctggctgctctaatggagatacccttccaatataaagcagccactgaacttggactacttgggttggttccttatacacaggcttatgtttcattagatgaaaagtga

SEQ ID NO: 53281 - DNA, 222 bp, Glycine max
  Peptide Sequence Number=SeqID_170059
atgactgggagtagcatatcattcaaggatttcgctaaaccttttaaagtgaagcaattggagtccattgccaccaaaatgaactcacccaagttgaatcatgaaaaacagaaatggtcaggaatgcctgatttagatgagaaattgatcacaacgaagttattaacccacactcctgcaagcgacaagctaggtctgggcaatcaacaagatgagaagtaa

SEQ ID NO: 53282 - DNA, 216 bp, Glycine max
  Peptide Sequence Number=SeqID_170060
atgtcgaaatgggcacttgcaactgacaaggacagtgtcgatgacactgtttgcgaaacgtacgacattagcaaggagaagtggacccaattttgtcagagccgcagagacccttcgtgggagttaatggaggagaagaaaaagaaacaactggaggaagctgctaaatctggaagcattgacaccgtcattgatcctccatctcccatcagatga

SEQ ID NO: 53283 - DNA, 1821 bp, Glycine max
  Peptide Sequence Number=SeqID_170061
atgatcagaatcagatttaacttaactcttttctctgttgagctatcacgcatcagccatagctcactcactgttactcatagtcataaagttgagcacccccttatgagtgctactttcaatttctttaagccttttagctctgaaacttttttagcaccaccaaaatttggtttctcagtcaagcatttttctacttcttcaaccagaaaccttggggcttcaactgatgcccctgcacatgaggccttgagtcatgatgatgatgatgataatgatgatggggatgatgatgatcatgacaagaacaaagatacccattgtagtcagttacgttttagggatgatagactttcccaagatgttaaaaccattttggatataatgcatgaaatgggttctggaccatctcaaactaagcagaagcttgagcattgcagtgttgacctatcagcaaagctggttgtggaggtccttttgagaactcgcaatgattgggaggcggctttcacttttttcttgtgggctggcaagcaaccggggtatgctcattcgattcgcgagtaccattctatgatctccatccttggcaaaatgaggaagtttgatactgcttggaacttaattgaggaaatgagaagaggtagaactggtccatctcttgtcactccccaaacactgttgattatgatcaggaaatactgtgctgtacatgatgttgcaagggctatcaatactttctatgcttataaacagtttaactttcaagttgggctagaggaatttcatagccttctttctgccctttgtcggtataagaatgtgcaagatgctgagcacttactgttctgcaacaaaaatttattcccattagataccaaaagctttaacatcattctgaatggatggtgtaatttgattgtaagcactagtcatgcagaaagaatatggcatgagatgagcaagcgaagaatccaacacgatgttgtctcctatggaagtatcatatcttgctattcaaaatcttctaaactttacaaggtgctcaggatgtttgatgaaatgaagaaaaggaagatcactccagataggaaggtttataatgcagtcatttatgccctagcaaagggcaggcttgtgaaagaagctgtcaatctcattggaacattggaagacaatgatgttactccaaatgttgtaacttacaactccctgatcaaacctctctgcaaagccggcaaagttgatgaagctaaacaacttttttatgagattttgaaacggcatctgtccccaacaattcaaacttttcatgctttcttccgtatattacggaccaaggaagaagtatttgagctcttggacaaaatgaaagagctgggatgctacccaaccattgagacttatataatgttgatgagaaagttttgccgctggcgccagcttgatgatgtatttaagatgtgggatgcaatgagggaagatgggataggccatgatcgtagttcatatatagtgctgattcatgggctgtttctaaatggaaagctggaggaagcgcacacatattatgcagagatgcaagagaaaggcttcctacctgaaccgaagacagaagaaatgcttcaagcatgggtttccgggaaacaggcaacagagggtcaggagacaaatttagaacctaatcaactggaaaatgatactcttaaaaagaaagtaaaggccataccgagtaaatttgacagggaaaaagcctttcttcgtgaacctgagaccagaagagtaacaagagaacggggtttttctttctgggagcagtaa

SEQ ID NO: 53284 - DNA, 260 bp, Glycine max
  Peptide Sequence Number=SeqID_170062
atggacgatcatgatgaccttctagcttcagagatggctgagcattcgacccctccacctactgcctcaaacattgctaatgacttacaaccttgcacccaaagatgtagaaaaaatcggtctagagtttgggatcactttactccagaccctgagttagaatataagagagctacatgtaaccattgtcaaagctcaatcaagtgcgataatgggacaagttctttgctagcccattcaaagaggtgctatgatagggg

SEQ ID NO: 53285 - DNA, 321 bp, Glycine max
  Peptide Sequence Number=SeqID_170063
atgggcaacttaaaacttccttatgctcttatcaatcaagtagttaatagagcaattttccaacatcaaaagagaaagcataaccccattaccatttactcgtcgaggcaaagtatcgagggtgagagagatgaaaggccgcaagggaggagagatgcaaggccgcaaggggagagagaaagatcagtcatgagtcacaacgcaaaggagagagagaccaatcgtgatgcaatagagattagagagaaatgtgatggagagagatacaagctccaagccccaaggcctcaactgctgactgctaaagggagtagggattga

SEQ ID NO: 53286 - DNA, 472 bp, Glycine max
  Peptide Sequence Number=SeqID_170064
tgatcataggcttcccatggaccctaagagaatgaaggtcattcctgagtggcctactccaccatcaccactcattgagttggtgaggaactatgttctctcatgggaagatggaatgatgcaatcctaccctccaagggcattggatagaagactccaagaagattgggtcagagatgcaagaaaaagccctaagtatgagcttgtcgcaacctacccttttacgggcgagcaaggtgaggctcacaggagcgtcttccaaaggaggaaaatgcacggagtcgccaccaacgtttatttgtggaaaacgtcagaaaaactgaaggaaccggtcatgaagaatattccagatttgggagttgtatttacgtttgaggaaggtattagcacctctcacgtcgacaaaagcggggctcttgctcctacgtaccctccatccaagacgaaatcagacctacatagttctttctga

SEQ ID NO: 53287 - DNA, 471 bp, Glycine max
  Peptide Sequence Number=SeqID_170065
atgccactgaaagaacatcttcataagttaaactttgttctgatggagcttcatgacattgatgactccattacacttaaagaagttaagtgtagtctctattctagagagcttcggctgaaagtgtctgggaatggtgatgaagcctctatgcccagaatctataattactgcaaagaacctggtcattggaagaaagattgtccgaggatagcaaagaatgattatgttgctgtcatggagaagtctggtggtaattttctaatgggtaacaatgctccttgcaagttagttggtataggttctatacaaatcataaagcatgatgggatttttagaaccttaaccgagactcatcatgttccacagctaaagaaaaatctagtctttgtaggtgcaatgtattcaaaaggtttttcttgttgggttgaaggtggagttatgcaaatcaaagggaaatggaagtctatg

SEQ ID NO: 53288 - DNA, 286 bp, Glycine max
  Peptide Sequence Number=SeqID_170066
atgtccagctccttctattctatagttccttccccctttccttcaccaccagctggagcgcagtcttcgccggtctccaggttatcaacaagacaagacctatcacgtggctacgagctctttccttactcagacagaccccaagcgggcacggagttgggcgagatgcaagactttttcctcaaggagttagagcagaagttgtttactcacgctcagctcaagccaacttctatcagttcaggcggaaggtcagggggagtggtacaattaggccttcccttcg

SEQ ID NO: 53289 - DNA, 274 bp, Glycine max
  Peptide Sequence Number=SeqID_170067
atggttgttcatgtgcctttatctttagaagctcaagcagaagctcgtgtacttaggtttgctctttattttcgagggtggattgttagtgtggacaatttggaagatataattgggggccatgtatggttgggtaccatttgtatacttggtggaatattgcgggttttttctaccaattggggccctcccttcaccacccccatgcggatggtctatagggttcataactactcctcttactacaggacagtttcgtcttataatacctcag

SEQ ID NO: 53290 - DNA, 111 bp, Glycine max
  Peptide Sequence Number=SeqID_170068
catatatctcttggggaacatcaagcacaagataatggggcacttgcaccaatacacgaatgcatacaagacacagacacatcgcaacatagggcacggacacataagtag

SEQ ID NO: 53291 - DNA, 615 bp, Glycine max
  Peptide Sequence Number=SeqID_170069
atgggcactgcaactgcaaccttatccctgtgccaatggcctacttcttcttcttcttcttctgtgcgcatgcatgtgaggttttcatgcagaacccctcacctttcaccatatacagttgacagaaccctctgccaaatcaacaattctggtgtcatagcttgcctaagagctaacagtgcagaagtggccatggaagctgcaaaagctgcaatagcaggtggcatttcagttgttctacaacagctggtgaaggagcatcctacaatggccctaggggttggaactgttctcaggattgaggatgcaaaaagtgcaattaatgccggagccaaatttctaatgagtcctgcaactgttaaggatataatggaaatggattatgttcagagtggtgaaattttatatattcctggcacaatgactccaactgaaatattgtcagcatgtgatgaaggtgctaaaattgtcaagatttatccagtttctgcactcggaggatttcagtacatatcagcactgaagaaggcctttcctcatatctctatggttgcttctcagggaataacaataggtagttttacagtttttcctattgcgttatatagtgagtga

SEQ ID NO: 53292 - DNA, 816 bp, Glycine max
  Peptide Sequence Number=SeqID_170070
atggggttgggtttagcagaagggctaatccccacaacatgggaaaccgaggttcgaattcctgtttggagagagccttctccattgcataccacaacgattgtggagaagtgtactcttaagctggttgatgattacaagaacatgttatgccaagccacggaacccttgtcaacctttttagagtatatcacatatggtcacatgatagacaatgttgttttgattgttactggcaccttgcatgagagagatgttcaagaattactagaaaaatgccatccactcggcatgtttgacagtattgctactctggctgttgctcagaatatgcgggagctttacaggctggttcttgttgacactcctctggctccatacttctctgagtgcattacatcagaggacttggatgatatgaacattgaaataatgaggaacactctttacaaggcataccttgaagacttctatagattttgtcagaaacttggtggtgccacagctgagataatgtctgaccttctagcttttgaggctgatagaagggctgtgaatattaccataaatagcattggtactgagcttaccagagatgaccgtagaaaattgtactctaattttggtttgctatacccatatggtcatgaggaacttgctgtctgcgaggacattgatcaggttcgtgctgttatggaaaaatatcccccctatcaatctatttttgctaagctatcatatggagagagccagatgcttgacaaggcattctacgaggaggaggtgaaaaggctttgcttggcttttgagcaacag

SEQ ID NO: 53293 - DNA, 141 bp, Glycine max
  Peptide Sequence Number=SeqID_170071
atggatacctcaaaaccctacgctggggcaatgaggggcatcgtgcatgagcctcaaacaacgattggtacctcaaagccctacactggggcaatgaggggcatcgtgcatgagcctcaagtaaacctaggggcagattag

SEQ ID NO: 53294 - DNA, 319 bp, Glycine max
  Peptide Sequence Number=SeqID_170072
tttatcagggaagattccccaacaattggaagaattaacctttctgtcgtacttgaatgtgtcacttaacaacctctcaggtcctatacctcaaaataagcagtttgctacattcgagggctgttcatttgagggtaatcaaggactgtgtgggaatcaattgttcaagaaatgtgaggatgatgcaggctcaccttttgctccaccttcagcaactgaagatgatcatgactcgggattttacattgaatttgattggacagtggttctgattggatatggggtggactttgataacgctaaatttaggtttaattga

SEQ ID NO: 53295 - DNA, 1170 bp, Glycine max
  Peptide Sequence Number=SeqID_170073
atggcaatgatgaaagagaatattattgaagtgagccttggaaggaggcaaatgtctatgacagaaggtgagttccaaggaacacggagcgtcaagagacgacgaagagaggttgctgcagccgcaggcagtggtgatgataaccaccaacagcagttaccacaacaagaagttggtgaaaatactacagtcaacactacaaagagaagctcaagatttcgcggtgttagcagacatagatggacgggtcgatatgaagctcacttgtgggacaagctttcttggaacataacacaaaagaagaaagggaagcaaggggcttatgatgaagaagaatctgctgccagagcatatgatttagctgcacttaagtattggggaacttcaactttcacaaattttccaatatcagattatgagaaagagatacaaataatgcagactatgaccaaagaggagtatttggccactttaaggagaaagagcagtggcttttcaagaggtgtatcaaagtataggggtgttgcgaggcaccaccacaatggtagatgggaagcaagaataggaagggtttttggaaacaaatatctctaccttggaacctacagcacccaagaggaagctgcgcgtgcttatgacatagcagccattgagtacagaggaattcatgctgtaacaaactttgatttgagcacttacataaaatggttaaagccttcaggaggaggcaccctagaagcaaatcttgaatcacatgcagcactagagcatcaaaaggtggcatccccatctaattatgctctaacagaagagtctaagtctttggcccttcacaacagttttttcagtccatattctctggattcccctgtaaagcatgaaagatttggaaacaaaacctaccaattctcaagcaataagtcatcttctcccactgcacttggtctccttctccgctcttcgttatttagggaattagttgaaaagaattcaaatgtttctggagaagaagatgatggggaagccacaaaggatcaacagacacaaatagctactgatgatgatctgggtggaatcttcttcgatagctttagtgatattccatttgtgtgtgaccccaatagatacgacttggaattgcaagaaagagacctgcactcaatattttga

SEQ ID NO: 53296 - DNA, 387 bp, Glycine max
  Peptide Sequence Number=SeqID_170074
atggaggaagaaaatgatacaaggagggaactaaagcagaaataccatggaccatgcatggccacgaatccaatcgatagttgttggcggtgtaggaaacattgggcacaagaccgttttagggaaaccggttcatcgcgcccaacaacaacgctgcaaaggaaatcccacaggcactatgcttcacctgaagtgtggagcaaatggcagtggaaatcagagaacgacctcttcataaatggggctacttttcttcagtcaggagcacctcttgggaagcttcctttcaacaaagggctcatgatgaaacctagacctggggcagaagccagcaggctcacacgctttgctggtaccctaaattgcaagctgggtaagccttgctaa

SEQ ID NO: 53297 - DNA, 321 bp, Glycine max
  Peptide Sequence Number=SeqID_170075
atgaggaatttagcttctccttaccatgagagactttacactttaggagttgatggggatggaagcagaagagggatggataaaggaggagaagggaagaatgactctagaagaggcataaaattcacccgatctcgcgctaagtgcgaccttctgggcctagcgcgatatggcggtgatcacacgcttagcgagtatggtggtgatcacacgacggcatctgagcttagcaagtatggtggtgatcacacgcttagcgcaaaatttgcgcctttaggcttctgtgtaggtcttttttgcgctaagctttgtgttgggtga

SEQ ID NO: 53298 - DNA, 153 bp, Glycine max
  Peptide Sequence Number=SeqID_170076
atgaacaatactgacataacccctactagcaccatcacgcgcccggctatgcccaacctcgacgctatcacaccgcttgcaccacctcaacgccaccttgcacaatgcaccatcgcgacttcgatggtgaaggttgaaggagaaggtaggtga

SEQ ID NO: 53299 - DNA, 306 bp, Glycine max
  Peptide Sequence Number=SeqID_170077
atgggcagtgcattttctgccctattcggccgcgggtccaccgtcgccgaagggtcgtcggagagtttacacgtgttgccgttccactcgtcggagcgctggcagctacacttcaacgaggttgtgatagatttcacggcgtcgtggtgcggcccttgcagattcatagctccggatgtggctaaggattttaaggtggaggcgatgccgacgtttgtgttgtgtaagaaaggaaaagaagttgatagggttgtgggcgccaggaaggacgagctccagaacaagattcagaaacattatcaataa

SEQ ID NO: 53300 - DNA, 269 bp, Glycine max
  Peptide Sequence Number=SeqID_170078
ttttggtgaatgaattgttggctgaaattttgatcctaagtgaatattcaactcctaaaactttggtaaacaagcctagtgagttcaacatacataggaaggttggaacggaatggagaaggaagagagagaggagacgccacttcaaggagaagatgagtctagaagaagctcaccaccataggaggccatggataagagcttggaggaagaaggagatgaatgaagggagagggagagaagagcacgaaattttgtgctctaaatga

SEQ ID NO: 53301 - DNA, 4122 bp, Glycine max
  Peptide Sequence Number=SeqID_170079
atggcttcgcacgataagtcaaccctggatcgtattgaagatgcaatagcaaaactcgtagccagccaaatccaggtcactgataagctggaggacttgctcctccacgtcgcgaacctggaacacaccgccaccacccactccccttcatcttcttcggccaacccccaccacacaaacagcatcatcaccccacccaaaatgaaactagatgttccccgtttcgatggctcggacccctcggggtggatttttaaaatttcccaattttttgcttaccactcaaccccagaatccgagagactcaccatagcctccttctacatggaagggccagctttagcctggttccaatggctttcccgcaaccaccaactcacaacctgggctagttttctcgaagccattgaggctcacttttctcactccccgtatgaagacccaactgggattctcttcaaattaacccaaaagggcaccgtctctcagtaccttcagcaattcgaagcccttgcaaaccgaatcgtcggcctctcaccctcccttctcctaagttgcttcttttcgggcctcgaccacgacattcgatgggaggtgcaagccctccaaccactaacccttgtccacgccgcaggactagccagacttcaggaggaaaagttagccgacaaccgccgcgcgtttcgtggccgtgccaccctgaccactggacctcctccacctcaaccccaaccaccccctaccttactctcttccacaacctcaccacatcccccgcctctccctctgctacccactccacccaagccccctcccttgcctctcaagcgccttactccgaccgaaatggctctccgccgtgagcaaggactttgctttaactgcgatgacaaattcaccaagggacaccgccgtgcctcccgtttctcccttctaatcgcggacgaagataaccctccagaaccctcagacccttttatatccaaccctaacccgagccccgaaaacccgaacccacccaactcaaaccaacccgaacaaccccaggcccaaataagtttttgtgccctgttgggccactctccaccggaaacactccgcctcctcggccaggtgtctcaccacgccgttgtcatcctcgtagacagcggcagtacgcacaatttcgtgcagaatcgccttattcatcatctgggcctaactccacaaccaaccttccccttgcgcgttcttgttgggaatggtaatgagattgaatgtcacacgatttgccccaacaccatgattcaaatccaaggatatacattcaccactgacttgcatgtcctgcctatatgtggggccgatatcgttctcggcgtccattggttaaagtctctcggaccaattttaacttattgcaccaatttgacgatgaaatttgttcatcagggagcacttatcgaactccggggtgactcagtccaagatcttgaagtggtctctcccccgcagctccgtcgtatgattcagacggatggtgtcagtgacttcttccacatccgggtctgttcccctatacacacttctcccaccacacccccagaaattcaatccctcttacacaaatttgagcccctgttccaactaccatcttccctacccccatcccggccgacaaaccactgcatccaccttacctcagcctcatcccctgtaaacgtaagaccatatagatacccttattatcaaaaatatgaaatagaagcccaagtttcagcaatgcttcagaccggcatcatccgcccaagtaacagcccgttctcttcacctgtgcttcttgttaaaaagcgtgatgggtcctggcgattctacgttgattaccgtgccctcaacgcactaacaatcaaagaccgcttccctattcccacaatcaatgagctgttggacgagctcggtggcgccacatggttctcaaagctggacctcatgcaaggctaccaccaaatcttgattaacgaagcagacatcagcaaaacgacgttcaggatgcaccaaggacactacgagttcctggtgatgcctttcggcttatgtaacgccccctcaactttccaagctacgatgaacaacacctttggaccttatttgcgtaaattcattatcatcttcttcgatgatatactaatttatagcaagtccttcttggagcacctgaaccacttgaacaccgccttcgaggtccttcgtgacaatcaattcctccttaaactttccaaatgctccttcgctactcagcaggttgagtacttggggcacatcgtgtctcctcgcggcgtagaaccaatggcagctaagattgaagcggatgcattccaatggaatgaagcagctgataaagctttcaatcaacttaaggaagccttatgtcgcgccccagtcctccgcctgccggatttctccattcccttcgtcgtcgaaactgacgcgtccggcgaaggcatgggggcagtattgtctcaacaaaaccacccaattgcattcttcagtcagcaattttcccccaaacttctccgcgcgtccacgtatgtcagggagcttgccgccattaccgccaccgttaaaaagtggcggcaatatcttctcggccacccttttatgatcttaaccgatcatcacagtcttaaggacctgatgacacaagcggtgcaaacgctagagcaacatcgttatttggcgcgtctcttaggctttgactacaccattcagtaccgttctgggcattcaaacacagaactacgaaaggaacttaacaccaacactgaattcttggctctacgcgaccaaattctcactacgccagagaaatatccagattattcaattcatagtgagcttattttgcagaagggtcgcatatggctcccccgggagtttccattcatctccgctgtcctcgaggaatttcattccacccccacatgtggtcatatgggcattgcgaagaccctggccgaattaaatgatcacaagaagagctcaggtcttctgtgcccacttccggttccggcgagaccctgggaagatctttccctggatttcattgtcatccttcccccgtacaagggccactctgcactattagtcgtggtagatagattctcgaagggtgtacacttggggtctcttccagctcattacacggcatttgaagtcgcccgcctgttcatggagatttctgggaaaatccatggtccaccacgaagcctcgtttcagatcgagaccccctcttcatcagccacttttggcaggagttgtttaaactcagcggcacgaccctccgcatgagtactgcctaccatccacagacggatgggcagacggaagtgatgaacaggatacttaagcaatatctccgagcattcgtgcacacttcagtccactcaaccatgggcatgtcaccatatgaggtcaccttcggtaagaaacccccaaacttcccacaatacctcatcggagattccaacgttgatgttgtggatacatggcttattgatcgcgacacgatgattcaaagtttgaccaaaaagttacataaggcacaagcccgtatgaaggaaattgcagataagaaaagcttggaccttcaggagattgtccaaaagcttggacctgtcgcttacaagctcgcacttccggaatcatcaagaatccttcttgtctttcactgttcattactacggccctaccacacaccagtcacatccacgatcacccctgcaattctccctgattcagctgaggataatcaaccccttataactcctttcaccatcttagacaccaaatgggaaggccaagaacccgaaagacagttgtttgtactagtccaatgggcgggccttttaccggaagacacgtcctgggagccatggatgacattgaaggagacttacaaccttgaggacaaggttgttcttgatgcaggagggaatgttacaaccataggcaaggcacgaaacaacacagaggaaccaaaggcaatagcagaactacattcagaaacaattcaaggaatagaattaaggccaaagagggcaattgtcaagccttcgtacctaagggatttcgtggaaaagtga

SEQ ID NO: 53302 - DNA, 1290 bp, Glycine max
  Peptide Sequence Number=SeqID_170080
atgaaggaagcgacctgtatctttcatcaacagctacactctctctttcttcactcttcaccgcaactcacacttccggcgaaacctccccggaagccatggccagagaatgagtctccgccgattgccatgtcggtctcctgctccaactgcttccccgacgacgaccactccttcctcctctgcggcgaggactcctccggaatcatggattcctcgccggagtgttcctccgacctcgattcctcgccgccgtcggaggcggagtccatcgccggattcatggaagacgagcgcaacttcgtccccggattcgaatacctcaataggttccaatctcgctctctcgacgcctctgccagagaagaatccgttgcatggattctcaaggtgcaggcttattacgcttttcaaccggtcacggcttatctttccgttaactacttggatcggttcttgaattctcgaccgttgccgccgaaaacgaatgggtggccactgcaacttctctctgttgcgtgcttgtctttagcagcaaagatggaggaatctctagttccatctcttttggaccttcaggtagaaggtgctaaatacgtatttgaacccaaaacaattagaagaatggagctacttgttctgggcgtgttggattggaggctaagatcggttaccccatttagcttcctcgatttctttgcgtgcaagttagattcaactgggacttttaccgggttcctcatttcacgtgctacacaaattatcttatctaatatacaagaggctagctttcttgcgtattggccatcatgcattgctgcagcagccattctccatgcagcaaatgaaattcctaattggtctctcgttaggcctgagcatgcagagtcatggtgtgaggggttaagaaaggagaaaattatagggtgctaccaattaatgcaagaacttgtgattgacaataaccagaggaaaccccctaaggtgttaccacagctgcgagtgacaatatctcggcccattatgagattccctagggaaggggattttgcaaagtgtgtgtgggtgtgcgtgagagagaggtgggaaattagatacaaagatgcatttaatggtttggtcgtgcaagcgtggaagaaagaagtgtgtagtttggaattcaaagatgcgcttgttattggtgaaagagaagagaatggtggtgggacattgcttcagagcttggaagaagaaaaaaagcatagtctcagagcagatatcaatagggtattgaaagactttgaagtttga

SEQ ID NO: 53303 - DNA, 255 bp, Glycine max
  Peptide Sequence Number=SeqID_170081
atggttggagggtgttacattggtgtacattggttttgcacaatggatttattggtaaaaaacttcgtgcctcacccttccaaccccagacgtgctatctcaacacgtctttttggagggcttggcagagaggtttcagttcgatcaaagacaatggaagttcttgttgctctctttcgagtttgggtggtgatcgatgcagtgatgggtgatggtgatgatgttgtttcttgtttggttgcaagcctggattaa

SEQ ID NO: 53304 - DNA, 255 bp, Glycine max
  Peptide Sequence Number=SeqID_170082
atgattctgctatattgtggtaccatcaactggaattcgaagttattgatggttggagtagagagtgaaaaaacatttgatgccggttcagctgctagccctgcagatgaagctgaaatcgataagttggaggagcgagcctcatctctaagaagggagcttgccaacaagaacttgcacttgaagacactcatagatcaattgcgtgatcttatcactgatatatcaacatggcagagtcctttttcaacctga

SEQ ID NO: 53305 - DNA, 666 bp, Glycine max
  Peptide Sequence Number=SeqID_170083
atggcatgtttttattctatcggatactgcattaacttttctgggaccgttgtcctttctgctcatcggtattccgtgataagtggcgccaaaggacctgctgaaaactcagaatttgagcactcttcaattcctgcaaccataaagaagatgttcaacctttctgctaactttttgactcacagagatgcatgggctgggacctttgagcatgttgttggggatttaagttcacccagaacagattgcccagtttttgaaatagaaatcaaacacaccattcaacaacttggactaagaaacttccccaataaaaaccttattatgtgtaacaaagtattaagacaggcttatatgcgtattccagtgactttgccggatgtgacacctctaaggagcactgaagcaaaagaaaatgctggcctttctgagtttcagagtgaggtagttcaattggcagctgttcttaatggggatcatttcttgagcagtttccctgatgaaatgagcaagaagatgagtgtgaaggaagctcatgagtacgtgcgaggagctgtttcgagattcataagagccagcaaagaggccatcaagttaggggcggatgagtctgctattgtggatatgagatcctctctcactactagatcttcagttcataattaa

SEQ ID NO: 53306 - DNA, 680 bp, Glycine max
  Peptide Sequence Number=SeqID_170084
atgggaagtagcaaacccaaatcctccattctcatgtttgttgtgttcctttgtgtttttgcaacagcacaacgacagcaacctataaaaaccgttgttgttttggtcatggagaaccgttcctttgaccacatgctggggtggatgaaagagagcatcaacacattaatcaatggggtcacaggagatgaatgcaacccggtttccaccaaaagtccaaggaaggattcaatttgcttcaccgatgatgcagagttcgtggatcctgatccggggcattcatttgaggatgttttgcaacaggtattcggttccggttccggttcgatcccttccatgaatggatttgtggaacaagcattgtctatgtctcccaacctctctgagactgtcatgaaagggtttaaaccggactctgtgccgatttatgctgctttggttaaggaatttgctgtttttgacaggtggttttcttcaattcctggtccaacacaacccaataggctttttgtgtactcagcaacctctcatggttcaacaagtcatatcaagaggcagttagcaaaagggtatcctcaaaaaaccatctttgattctctgcatgagaatggcctagactttgggatttactttcagaacatacccacaactctgttctataggaatctgaggaaattgaa

SEQ ID NO: 53307 - DNA, 171 bp, Glycine max
  Peptide Sequence Number=SeqID_170085
atgtgttccaaattgactagtctgcatggagaaatgaggaagagaaggtatggacaagtgaggaagacaaagatactatggccatttgaaaaatttagaggtgcaggaaggaaacaggaaggtgcaggaagcataagcctgcaaactgaccacacatcgataggcctgtaa

SEQ ID NO: 53308 - DNA, 1602 bp, Glycine max
  Peptide Sequence Number=SeqID_170086
atgtgcacgcctgctattggctcaatcccagtagcgtttaaattctctttctctttctctatctttcactctttttcttcatctcttctctcttctctctctagggttgccttccttctctctcctttcctcctccttcccgttcgccggccggaatcctattttccggccatatttccggctgcctgcaattccccttcaccttccgaactcaatcaatcttttcaattcgaagctgttgctatcttttgcagcgatattggagcagagagagggaagatggcaagtcaaagcggtgcctctagaaggagtatttcgtcgtcgacgaggagagcctctgaatcaggggcgcctcgaaaatcaatttcctcttcgcgacctttggcattggccggagagcggactgtgaaatcattgcgacttacaaaggccctgacagtacctgaaacaacaactgtctatgaagcttgccgtcggatggctgcccgtagagttgatgctctattgctaactgattctaatgctttgctctgtggaatcctcacagacaaggatatagcagcaagagttattgccaaagagattaatcttgaagagacaccagtttccaaagtcatgactaggaatccggtatttgttctttctgaaactcttgctgcagaagccctccaaaagatggtgcaagggaaattcagacatttacctgtggtggagaatggagaagttttggctttactagacatagcaaagtgtttgcatgatgccattgcccgtatggaaagggcagctgagaaaggaaaagcaattgcagcagctgttgaaggagttgaaaaacactggggaacatcagtatcaccaacagattcagttctgacaacaacaaagaagatggttgaatttcgtgcaagttgtgcagttgtgacagttaatgacaaacctcgtggcatctttacttcaaaagatattttgttgcgggtaattgcacaaaatctttctccagaatcaacccccgttgagaaggtcatgactccaaatccagaatgtgtcataattgatacacccattgttgatgcacttcacactatgcatgatgggaaatttttgcatcttcctgtggttgatagagatggcagtgtagttgctgtggttgatgtgattcatgtcactcatgctgcagtggcgacagttgggaataatgaagctgccaccaccttgatgcaaagattttgggattcagccatggccttaaccccaaatgatgatgacgatgatactcgaagtgagggttcgttgaaagtggcttctgagggaggagaaacagggagatccattccttatctttcatcaagcattgccaatacattttccttcaaaatacaagataagaagggcagaatgcacagattcacatgtgatacccggagcatgatggaggttataacttcaatccttcagagacttggtgatgatatcgatcctaacaacataccccaaattctgtatgaagacgaagatcatgataaagttgtattggcttcagacagtgatcttgcagcagctgtggatcatgcaaggacagctggtttgaaggttaacttataa

SEQ ID NO: 53309 - DNA, 489 bp, Glycine max
  Peptide Sequence Number=SeqID_170087
atggtgcccagacagaaacaaggagaaagatgcttgagaaatgaaattggtgatgaagagtatctatatgttgacggcattggcataaaaacaggagatttctttcagttctactattcagatccaaatattgccttagcttcattaaccaaggtccatgatgccctcaagagtattaaactggaaaaaaaatccaagagttccaagggtgatggagacaacgctaccaatgtttttgggggtattatttttgcttgttacagccgtggtgaatccttctttggacgtcagaatgttgatagctcccctttcttggagaattttccaggagtgccagtgtctggaatattttgtggtggagaaatggtgcgtccttgtaccactgtgattggtcaatgtgaaggagcaagccccattagttgctgtctgcatgtgtacagcactgtctacttagcaatgtcgtatactcccccctctgtggaagattag

SEQ ID NO: 53310 - DNA, 261 bp, Glycine max
  Peptide Sequence Number=SeqID_170088
atgggtgggcatttctctggcatatataggaaggtccaattaaagccactaaagtggatcaaagtggccaaaagcaatggtgaaggtgcagaagaacgacctgttgaagctctgatggttcttaaatatgggggtgttcttacacatgctggcagaaagcagttgatagtaaatgctgaagaattaggaagatatttccgcaataatatgtatccagattatttgagattcttctttcaagtaggaatggtggttgcctaa

SEQ ID NO: 53311 - DNA, 285 bp, Glycine max
  Peptide Sequence Number=SeqID_170089
atgaatgaggatttaaaggagaatgagtcacccaaaaaagatggaagggttatattttataatataggtgatgaaaatggagatgttcctagtgcaaatgaagaaaagttctttacattcaaaggaagtagcgtggaagatttgaaggaaaagttaaaagaagaaacagggcatgatgatattcttgtgtgttgtcgcaacccattgaatgcaaaactttatccccttcgtttacaattacctcctaacaatactgacatacacgttgtggttactccttcttaa

SEQ ID NO: 53312 - DNA, 1250 bp, Glycine max
  Peptide Sequence Number=SeqID_170090
ttctcgtcgtgttcgccaagagttgtggatcgctgagagtttctgagttcgccatggcggaggagaatgatgaggaaggagttttcgcagcgcagaggataactattggagtatgcgtcatggaaaagaaggtgaaatgtggctacgagcttttttcggggcctatggagcagattcttcagaggttacaagcgtttggtgaattcgagcatcttgaaaagtttggaatccatgttccaaggtatgcccttgtaaatagagaagtaccataccaacatttggattacttcattgaggaagaagattttgttgaggttcatggtatgcgtttctggaagccatttgtggagaagcctattgatggtgataatcatagtataatgatatactatcccagttcggctggtggaggtatgaaggaattatttaggaaggttggcaacaggtctagtgagttccatccagaggtgagaagagtgaggcgtgaagggtcctatatttacgaggagttcatgccaactggagggacagatgttaaggtatatacagttggccctgaatatgctcatgctgaggcaaggaagtctcctgtggttgatggtgttgtgatgagaaatactgatgggaaggaagttaggtatccagtcctcctgactcctgctgagaaagaaatggcaagagaagtttgcattgcattcaggcaagcggtttgtggatttgatctcttgagatgcgagggacgctcctatgtttgtgacgtgaatggatggagctttgttaaaaactcacacaagtattatgatgatgccgcctgtgtgctgcgcaagatgttcttcgatgcaaaagcacctcatctttcttcagcaattccaccaactttaccatggaaagtaaatgaaccagttcaaccttctgagggactcactcgtcagggtagtggtattgttggcacttttggacaatctgaggaactacgatgtgtaattgctgttattcgtcatggtgatagaactcccaaacagaaggtgaagctaaaagttactgaggaaaaactgctaaacctaatgttgaaatacaatggaggccgacctagagctgagacaaaacttaaaagtgctgttcaacttcaagatctgttagatgccacacgcatgctagttcctcgtaccagaccagatcgagaaagtgatagtgaggctgaagtcgagcacgctgaaaagctccgtcaagttaaagctgtccttgaagag

SEQ ID NO: 53313 - DNA, 245 bp, Glycine max
  Peptide Sequence Number=SeqID_170091
atctgctgcacgcgttctcgcatttgccacgcgatcttaacttcattgatcataccagtgacattggctggaaagatcatcaacgggcgaggcctataattattgatccggggttgtatatgactaagaagcaagacgtgttctggattacgcagaggagaagtaggccaacggctttcaaacttttcacagggaagaaagtttcagttgctgtttctgcaattggatgcacttcctttgtctga

SEQ ID NO: 53314 - DNA, 2586 bp, Glycine max
  Peptide Sequence Number=SeqID_170092
atggctgaggctgttgttgaaattgtgcttgagaaattgaactcgctcattcaaaaggagctaggactattctttggtttcgatgaagacatgaaaaggattgccagcttgctcactacaatcaaggctacgcttgaagatgctgaggagaaaaaattctcaaacataggtattaaatattggctgggaaagctaaaggatgcagctcgcatcctggatgacatcttggacgagtgtggtccatcaaacaaggtacaaagctcttacttatcctcttttcttcccaagcatgttgttttccattacaaaattgttaagaaaatgaaaagggtaagagagatgttagaagaaatttctgatgaaaggaataagtttaatttgactgagatggttcttgagagaagtcgagtcattgagtggcggaaaaccacatcatccataactgatcgacaaatctatggaagagaagaagataaggataaaattgtaaattttttggttgatgatgctcctcaatcggaggatttatctgtctatccaattgttggtctagggggacttggaaagacaacacttgcccaactcgtcttcaatcataagaaggtagtcagtcactttgagttaagattttgggtatgtgtttcagaagatttcagcttgaggagaatgataaaagctatcatcaaagcagcatctgggcatgcttgtgaggatttggatcttgagccacaacaaagaagacttcaagatctgcttcaaagaaaaagatatttgcttgttttggatgatgtgtgggatgataagcaagagaattggcagaagttgaaatctttattggcttgtggggcaaagggcgcttccatcttggtcactacccgtctatcaaaggttgcagaaatcatgggaacaataaaaattcctcatgaattatctttgttatctgacaatgattgttgggaattgtttaagcaccaagcctttggaccaaatgaggtagagcttgagaacatggggaaggagatagtaaagaagtgtcgtggattgcctcttgctgcaaaagcactaggaagtcttttacattctgcaagaaagaaacatgagtggttcatgaatgttaagggaagaaaccttttggagttatcactcgaagataactccataatggcttccctaagattaagttactttaagttaccaataagactcagacaatgttttgcttattgtgcaatatttcccaaagatgaacgaatatggaagcagcaattaattgaactttggatggctaatggatttattttatccaatgaaagattagatgctgaagatgttggtgaggatctatggaatgaactatattggagatcattttttcaagatattgagaaagatgaatttggcaaagttacaagttttaagttgcataatcttgttcatgatcttgcacgatctgttacagaagatgtttgttgtgtcacagaaggcaatgatggatctacttggactgaaagaattcaccatctctcagatcataggctgaggcccgattcaatccagttgcatcaagtgaaatctttgaggacctatttattgccacatcagcgtggtggtgcactttctcctgatgtattgaaatgttattctttgcggatgcttcacttaggagaaatggaagaattgccatcttcaattggtgatttaaaacatctaaggtacttgaatctttctgggggcgagtttgaaactcttccagaatcattatgtaaattatggaatttgcagatactgaaattagaccactgtcgtagtctccaaatgttgccaaacagtttgataatcttaaaatatctacaacaactgtctttgaaggattgctacaaactatcaagcttgcctcctcagattgccaagttaacttccctaaggagtttaaccaagtactttgttggcaaggaaagagggttccttttggtagaactaggagcattgaagcttaaaggagatcttgagatcaaacatttggggaaagtcaaaagtgtaaaggatgccagtgatgccaatatgtcaagtaagcaactgaataagttgacattgtcatgggacagatatgatgaagagtgggaattacaagaaaatgttgaggaaattcttgaagtgcttcacccagatacccaacaacttcagagtttgtgggtgggaggatataaaggtgcttacttcccacaatggatatttagtccttctctcatgtatttgaggattgaaagatgcagagagataaacagtttgcatgaagctttacaacatatgactgtcctgcattcattatcactatattaccttagaaacctagaatccttgcctgaatgtcttggaaaccttcccttgcttcatgaattggctattggtttctgttccaagttgaggagtcttccaatgagcctaagccttggcagtctgaaaatgttgaggatttggggctgccctgagttagagaagcaatgtgggaaggaaacaggggaggccttgtcaaaaatagctcaatttccagaaattagagtgaatggttatcttataaaaggttaa

SEQ ID NO: 53315 - DNA, 1290 bp, Glycine max
  Peptide Sequence Number=SeqID_170093
atggccactgacgtcaagtcattcattcatcagtgcaacatatgtcaacagttcaagcatgttacgcgcaaattagccagtttgcttcaaccaatcctgatacctaatggcgtttgggaggacctttccatggattttgtcacgcatcttccaagctctcacgggttcactgttgtcttcgtagtggtggatagattttctaagggagtccacctcggtgcattgccgacacactttacgacgttcaaagtggccaacttgttccttgacaccatatgcaagctccatggctttccccacagtatcatttctgatcgagacccgatcttcattagctccttctggcgagagttgtttgggataagtggcacgacattacgcatgagcactgcctaccatccacaatttgatggtcaaacaaaagttatgaatcgtaccattgaacaatatctcaaatcattcgtgcataaccagcccacggaatggtacaagttcttagctttggcggagtgggcatacaacacatcacaacattccgacactagtgtcaccccttatgaagtggtatacggcaaacctcccccttccattcccagctatctcatgagttcctcgtgcaacgatgcagttcaaacaatgatactcacgagagaagagattcacgctaccctcaaatgtaaacttctcaaagcccaagacaccatgaagcacttcgctgataagaagcgacgggatgtccaatatgaggttgggcaaatggtttatgttaaactccggccccaccgtcaactttcactccgtactcatcaacccaataagctcacgaagcgttacttcgggccatttcgcatagtggaacgcattggtagtgttgcgtatcatttacagctaccggacgagtccagaatccaccctgtatttcattgttcactattacgtcctcaccatggtcctttcgaactacaaacctccgtccttccaccagatgcacttcataatcatcctatactagagcctttaaccattctcgattcacgaatggatcttttgactgaaccgcctactcacctcgtactcgtgcaatgggttggtctcgtcccgaaagattctacctgggagaaatgggacgacgtttgtagtacccatcaccttgaggacaagatgattttcccagggcaggataatgatagcatcaacgtcaccaaggtagcagaagataacacaacttcacgtaataaccatccacgaagggttatctcgcgcccaaagcatttggaagattacgtgtaa

SEQ ID NO: 53316 - DNA, 2163 bp, Glycine max
  Peptide Sequence Number=SeqID_170094
atggtcgaacacggaacccggcgcaccaccaccgacaaactggaagaagccatctccgtcctctccgagaagcattccgagctggccaacaagcctcctactcctcagcgtcctccagtcaagcttgatgtcccttgtttcgacgaccacgatccattaggatggatcttcaaaatttctcaattttttaattaccaggggacgtcgaaagaagaccgcaccactgtcgcctccttttacctcgacggagccgcgctcaggtggttccaatggatgtttaggaacggcttcatcacgtcttggccaactctactccaggcaattgagactcgcttcgctccttcattctatgatgacccccgcagcgcattattcaagttgattcaccgagaagtacagggactacaacctacatcattacctcacgcgacagctcttgctcgactccaagaagacaagctcaacgatcgccggaaacactctcgatctccttttccccctccacaaccacaagccttagcacctcctaaccaaaaccaaacacctcaacttaaaactctgtttattcagcgtacccaggaggatatggcctacaggtgcgagaacggcctgtgttacaactgtgatgaaaaatggaactcatctcatcgttgtaagggccgagtcctattcttcattgtggattccgatgacccttctccttctgaattcatctcaccggaaaacccaaaccctccaactgtcaaacctactccaccctttgaccctaccccactgcaacctcacatcagtctccacgccatggctggcgtccctgctaccgatacattccgcctctacggagttgtcaatcatgctcgtgtcaccatcttggtagacagtggtagtactcacaacttcgtacaaccacgagttgcgaagttcctcaacctaccaatagaggatacgataccccttcgagtgatggtggacaatagttctgttctggattgccgacagctctattccgccactaccttgttcattcaggaccatcctttcacggtgacactacgcatcttactgttaagttgtgccgacgtcgtgttagaggtagagtggctacgcaccttgggcccaatcattactaattacacctcctttaccatgcaattcacccacctgagccagcccattacccttcgcgctgatgtacaatcaaatactgatccagcttcagcccaccatgtaaaatgcatgatccacactcattcaacatcaggacttttccatttgtctcttttacccgttacccatcccgaaccatccattgacccgcatcaccccattttcgccattaatgagtttctgctcaagttcagctcattatttcaacaaccctcgaccctacccccaccccgccaacatgaccaccacatcaacctcattccctctaccaaccccgttaacgtcagaccttacagatatcctcattttcagaaaaccaaaattgagaaacaggtaatggcactgctggactccggcattattcaaccaagtcgtagtcccttctcttctccggtgttgttggtgaagaagaaagatgagacgtggcggatgtgtgttgattatagggcacttaactccatcacagtgagggatcattttctgcttctgacaatcgaagaactccttgatgaattaggtcgtgcttcatggttctctaagctcgacctacgacaaggcttccatcagattttaatggcgtataaggacgttccaaaagtagcttttcaaacacatcatggccattacgagtatcggcgtcaaatcgattactatggccacgtcgtttccggcaacgacgtacaacctgacccctctaagatccaggccattagtgactggcctactcctcgatctccgaaggaccttcgagcttttctcggcctcacatggttttatcgaaaatttttcaagggttacacagcaattgcagcacctttaacaaggttactttgtaaagatgctttccagtgggtgccaaaatcccaggttgcgtttgacaagctgaaaggtgcaatgacctacgccccaatgcttgcccttcccaacttcacccttccttttaccctagaaacaaacgtttcaggcatcgctatgggcgttgtcctctatcaatga

SEQ ID NO: 53317 - DNA, 510 bp, Glycine max
  Peptide Sequence Number=SeqID_170095
atggggaattgccaagctgtggatggtgcagtgcttgtgatccaacacccttgtgggaagatagagagattgtattggccagtcactgcaagtgaggtcatgaggactaatcctggccactatgtttctttgataataccattgcctgtgccaccacaggagcagaatcaagagaagaaaactgtgcgtttcacacgcgttaagctgctccggcctaatgagactctcaaccttggccatgcttacaggctcatcaccactcaagaggttatgaaggtgttgaaagcaaagaagcatgcaaagacaaggaagccacaggctgcggagaccgagaagccgcatacggtgctgccggagaagcagagttcagctagtgaggcacacacaggaggggattctacacatcaggaggttgtgtttttagtctaccccaacagtcaatccactgaacactttgatctatctatacccccagttcacatcatatggcacatggtctacagatgctga

SEQ ID NO: 53318 - DNA, 1593 bp, Glycine max
  Peptide Sequence Number=SeqID_170096
atgctcaagcttccatcgtacatgacaaacattggggggccaaattttccaatccagcagagaaaaagtggcttggacttggcaaacatcactcattgtcaaatggattcgtttagcactgacagcgacctcttcttccacttcaactcagattctcatcgttttttccctgccgcgcttcgcgacactcttcaaatccactgtcagaaagtggtgaacctcttgtacccttatgtcgaaatcaccttccctgagttctcaggagagagactcaagcgtagcgaagcttacactgccattcaaacctatctcagtgagaattcttcgcaactagccaaaagactcaaagctgaagtggtgaaagatagccagaagcctttggtgcttagcatggacgacgacgaagaggtcaccgatgaattccaaggtgtgaagctctggtgggctgctagcaaaactgcctctaaccctcatgcatattccttctcttactattctccccctgatggaaagagatatttcaagctcactttcaacaaaaagcatagggatctcatcaccgtttcttacatcaaacatgtgttggaagaggggaaagaaattgccttgagaaacaggcagaggaagttgtacaccaacaatcctagcagtggttggtatggctacaaacaatcaaagtggagccacatagtgttcgagcaccctgcgactttcgagactcttgcaatggagcattggaagaaggaagagatcatcaatgaccttgtcaagttcaggaatgggaaggattactatgccaagattggaaaggcttggaagcgcggctacttgctcttcggtcctcccgggactggtaagtctactatgatagctgcaatggctaatttcatgaactatgatgtctatgatcttgagctgactgcagtgaaggacaacactgagttgaggaagttgttgattgagacttctagtaaggctattatagttgttgaagacattgattgctcgctcgatctcaccggccagaggaacatgaggagggaaaggggtgaggaagaggaaccaaaagatcctagtaagaaagatgaagaggagggtaacaagaatagcaaggtaactctatcagggttgttgaatttcattgatggcatttggtcagcatgtgggggagagaggattattattttcacaacaaactttgtggacaagcttgatcctgctcttattaggacaggtaggatggacaaacacattgaattgtcctattgccgctttgaggcattcaaggtgcttgccaagaactacttggatgttgattcgcactatttgttcgctagaattgcgaatttgttggaagtgaccaatgtgactcctgctgatattgctgagaatctcatgccaaagtgtttgaatgaggatgtagagtcttgcttgctgaatttgattcaatctcttgagaaaaaggtggcagaagaagaagaggaagaagcagggttgaatgaagaaaaggtcaagggggaacctactcagcaggagaacaaaaataatgggcacagtgtggaagatgtgaaggaaaatggattcgtgctttga

SEQ ID NO: 53319 - DNA, 186 bp, Glycine max
  Peptide Sequence Number=SeqID_170097
atggagaaaattggacggatgtgttcggcgatgtcgacgcgatcaagcattagatttaaggacacagcaccatcttatccgggttacagaaacttgcatacgttgtttgtttggttgcctagaaaatgtgagagaaataaagggaagatagaaagaaaggtgaaggtagaaagttctaggaattaa

SEQ ID NO: 53320 - DNA, 113 bp, Glycine max
  Peptide Sequence Number=SeqID_170098
atggccaaatacggcttcaatgtaggatgcgagttgaagtggattagtccaaaaagtctaaattcaattcaagctttgaaaatgaggcctaagctaggtgaaaatcttaggag

SEQ ID NO: 53321 - DNA, 1326 bp, Glycine max
  Peptide Sequence Number=SeqID_170099
atggctgaggctgttcttgagactgtgcttgagaatttgaactcactcattcaaaaggaattgggactatttctgggttttgaccaagacgtgaaaaggctgagacaattctcagacagatctataaaggattggctgcaaaagcttaaagatgcagctcacgtcctggatgacatcttggatgagtgtgcctatgaagcatggaggttggagtaccaaggagtcaagtgttgtctatcagacaaggtacaatgctcttgcctgtcctcttttcatcccgagcatgttgttttccgttacaaacttgctaagaaaatgaaaaggataagtgagagattagaagaaattgctgatgaaaggactaagtttcattttactgagatggttactgacaaaagaaatggagtcttggagtggcgccaaactacctcattcatcactgaaccagaagtttatggaagagaagaagaccaggataaaattatagactttttggttggtgatgcttctcattcagaggatttatcagtctatccaattataggtctaggtggacttggaaaaacaacacttgcccaactcatcttcaatcatgagagggtagtcaacaactttgagccgagaatttgggtatgtgtttcagaagatttcagtcttaagagaatgacaaaagctatcattgaagtagcatcggggcgtgcctgtgaggatttgcttttagagatactacagagaagacttcaagatctacttcaaagtaaaagatatttgcttgttttagatgatgtgtgggatgatgagcaagagaattggcagaagttgaaatctatattggcttgtggggcacagggggcttccgttttagtcactactcgcctttcaaaggttgctgcaatcatgggaacaatgcctcctcacgaattagcaatgttatccgacaatgattgttggaaattgtttaaacaccgagcctttggacctaatgaggtagaacaagagaaacttgtgatattagggaaggagatagtaaagaaatgtgggggagtgcctcttgcagcaaaagcactaggaggtcttctacgcttcaaaagagaggaaagagagtggctcaaaattaaggaaagcaacctttggagtttgccacacaatataatgcctgccttgagattaagctacttgaacttaccaataaaatttagacaatgttttgcttactgtgcaatatttcccaaagatgaaaaaatagaaaagcaatatttaattgaactttggatagctaatggtttcttttcatctaatgataagttagatgctgaagattgttga

SEQ ID NO: 53322 - DNA, 1179 bp, Glycine max
  Peptide Sequence Number=SeqID_170100
atgacctgcaccccagtcttggccacccctgacttcacactccccttcatcgtagagacggatgcatccgcggttgctatcggagctgttttggtccaacaggaccacccaattgcatactatagcaaggtgctctgtccacgattgcaacgcgcctccgcctacgtcagggagttgcacgcgattacctcagcggtccgcaaatggaggcattatcttctgggcgcttccttcaccatccttacagaccataagagtcttaaggagctcatgtcgcaggtcatacagacgtcggagcaacagacttacttagtcaagcttttgggatacgattacaatattcgctacaaaccaagccccaccaacactgtcgcagatgctctatctcgcatccctaccggagactttctatctctcacagtacctcactgtgacttcctggacactctccgacgagcattaatggccgacactcaatatcgtgatttactccaggcaattcagacgacccccgcggaccatcctgctctcttggtccgtaatggactcatcttcaaggaacgtcgcatatggataaccgttcctaccccactcacatcaacgttactcgaggaatttcatacctctcctctcggcggccacaccggggttgcaaaaacactccatcgtctccagcagagtttcgactggccaaccatcaagtctgatgttcagcatttcgtatcccattgccttgtctgccaacagacaaagtatgaaacaaagaagccctccggtctgctacaacctttatcgataccagccagaatttgggaagaaatgtctattgacttcatcaccggcctcccgccatcacaaggtcacacggtcatcatggtggttgtcgacaggtattccaaaggggctcattttggagcactccccacccatcacacagctcaccaagttgcagtccatttcctcaacctcgtctacaaacttcacggctttccccgaagtctcgtctccgacagagacgccttgttcctcaaccatttctggaaggaactcttccgtctcagtggcacacaattgcgcatgaccaccgcctatcaccctcagttcgacggacagactgaggtcgttaatcggaccttggaacaatatctcagagcttacgttcatcacaaacccagttag

SEQ ID NO: 53323 - DNA, 387 bp, Glycine max
  Peptide Sequence Number=SeqID_170101
atgagcgtagcctttgatgaactttctgtaaaagcctgtgaggccgagaaacccacggaggctagtggtggatgtcggggtgggccaatccaccatagcttgaattttatcaggatcagaggctatacctgccgaggagatgatgtggcccaggtagaattgataggtggtgagtgtcgagaggaccgtgtccaggtgagagacatgagaaggaaggtcgcggctatagacgagaatgtcgtcaaaaaacactgcaacaaatttccagaccgaagggcattatgcgaaactcgtaatggccctggtgtgtgcaaaacgcagtcttcgggatgtcggaagttgccatgcgaatttgatggaagccctgtcggagatcgagcttcgtaa

SEQ ID NO: 53324 - DNA, 212 bp, Glycine max
  Peptide Sequence Number=SeqID_170102
ggacagcgagtcaggtggcaggcggagataccttatggtcatccgcaccttcgtcaaccgaggggaacgaattcgacggttttactctcgttgtccttaaacattcaagcccaacgacgcacgagattcttctatgctgggcagggacgatagagtgcaatggcgtagggaagtgtcgtggttgtccgactttgtcgcttccaagacactga

SEQ ID NO: 53325 - DNA, 414 bp, Glycine max
  Peptide Sequence Number=SeqID_170103
atggtttctagccctctaaaaaggggtcaaaggagaccaactacattggaggaagttgttaaaaggtgtgagtattgtactcggctagtgagcttagtaagtgtgctagtattttttacaagttactcatctctgttatggattcatttcgttacaggaactattaggtttcatgttgcattgtcaaatggtgtttcaactgtgggtcccagatacaaggcagcctcagttaaatcaaacaatgctgattgttcaacatggctaactgctaggagggaagggcaacaggaaaatcttgatggtcagagtattctacttgatatcaacaatttggtgcgcaactatttgcatattttttgggcaaaattacaattcatgttgtcaagaaattttttgaaaattgttaagaactag

SEQ ID NO: 53326 - DNA, 186 bp, Glycine max
  Peptide Sequence Number=SeqID_170104
atgaggaaggcacaaggatcatgtatgagcaaacatgtagaacaaaaagttaagaaggtgatatggaccttccaacctcccgtgacaaaagatgagacccacatacaacgcatgtgtgacggcatgatgcagatgcgcaaaagcgcaacagggggatgcacagagtacgacaatatccataaataa

SEQ ID NO: 53327 - DNA, 234 bp, Glycine max
  Peptide Sequence Number=SeqID_170105
atggtgcagaaagatgttaaggtcatgatgcagcgaatcgaggtggaggttggggacaacgagaaaacatggacgatgcagagatctaagcggcgaggttacagtcatggtcggaggaggagcacgctcagcctcagaggaaggcggaggatgctaagaagggaccggcgcgggtctgttttggcacaaatgactttcagtgaggggtttcctagttttgttagatttggatga

SEQ ID NO: 53328 - DNA, 4141 bp, Glycine max
  Peptide Sequence Number=SeqID_170106
tgttatcaaagtgcttccttgttctggtgttcaatatgctggggaatctgattgccctcagcagagttcaggaacagcatttgtatacctggaacaacctaattgtccagaaaatggtgaacaagtcaactttgtagctgctcgattgaatgaatcatcacataggatgcaagggcctcagatagaaagacaaggtgatttgtcaactaattcagattgtcaatgcattggagcttcatgttgtgactgtcaagtagattaccaacatgaatattgtggttttcatgattttgaagaagacatggtaaatgaacctttcttgacatctgagaactctgtctctgttgtggatacaattgaaagtgaatcaccaaacaacagtagggaaggagacttgtcatgttccgaacccaagtggctagagggagatgaatctgtggcattgtggatcaaggctggtatccgatgtgcaagggctgactggccgtcatcaactttgaaagcaaaaccaactcatgacagaaagaaatattttgttatattttttccacacacaaggatttattcttgggcggacatgctgcttgttagatcaattaatgagtatccccatcctattgcatataagactcatcaggtgggattgaaaatggtaaaagacttaactgttgcacggaggtttataatgcaaaagctagtcgttggcatgctgaacatggctttgacagaaactgcacgtgatgtgaaggtctggaaggaatttgcaatggaggcttctcgttgtaatgattattccaattttggaagaatgcttctaaagctgcataatgaattatttgattctattttgtggaatggggttaatactctctgggatgcagttgcaccaatgcaaccaacattaggttctgaatggaaaacctggaagcaggatgtaatgagatggttttctacaccaccctccttatcaagcagcaaagacacccggcaacagagttctgatgatttgtaccaagcaaaccttcaggtttgtagaaaaaggcccaaacttgaagttcgtcgtgcagatacacatgcttcacaagtggaaatcaaggaccaaactattgctcttgaggctgaccctggcttctttaagaatcaggacacattgagcacattagcagctgagtcttgcaaacaggaaggcgttagggaggtgtctgtggcaactgcttcacctagtaatttggccaataaatggaatgaaattgtagttgaggctaccgattctgattttttgcataccaaagaaatggaatcaacacctacaaatgaactgactgttgcaaattctgtagaacctggtagtaagaatcgacaatgtatagcttatattgaagcaaagggaagacagtgtgtgagatgggcaaatgatggtgatgtatactgttgtgtacatttgtcctctcgatttttgggcagcccaacaaaatctgaaaagcctgttccagttgatactccaatgtgtgaaggtacaactgttctgggtactagatgtaagcatcgtgccctacctggctctttattctgtaagaaacaccgaccacatgctgaaacagagcagacatcaaatttaccccagaatacactaaagaggaagcacaaagaaaattatactggttcagaggacatgtttggcaaagacttggtattggtaaatcttgaaagtccactgcaagtggatccagtgtcatctattggtgctgattctgtacatggagaaagcaactttaatgagaaacccatgcattctgaaaatgatcataatgcaatggtgacaatgcactgtataggttctcctccctttgataagaaaaatccttgtatggaaggtcctaaaaggtattgcttgtactgtgaaagtcaccttccaagctggcttaagcgtgcaagaaatgggaagagtagaatagtatcaaaagaagtgttcacaggacttttgagggactgcagctcatgggagcaaaaggtacatctgcataaagcatgtgaactattttacaggttattcaaaagcattttatcattaagaaaccctgttcctaaggatgtccaattccagtgggctttgactgaagcctctaaagattccaatgtaggagagttttttacaaagttagttcacagtgaaaaggcaagaatcaagttaatatggggattcaatgatgacatggatataacctctgtcatggaagaaccaccactcttgccatccacaattaatgataactgtgatgaggaaaatgccatcaaatgtaagatatgctctgcagaatttcctgatgaccaagcacttggtaaccattggatggacagtcataaaaaggaagcacagtggctctttagaggctatgcatgtgccatttgtctggattcgtttactaacagaaaactattggaaactcatgttcaggagagacatcatgtgcaatttgttgaacaatgcatgcttctccaatgcattccttgtgggagtcattttggaaatactgatcaattatggcaacatgttttatcagttcaccctgttgattttaaaccatcaaaagctcctgaccagcaaactttctctactggcgaagattctcctgtaaaacatgatcagggaaattcagtccccttggagaataattctgagaatacaggtggtttacggaaatttgtttgcaggttttgtgggttgaaatttgatttactacctgacctaggtcgacatcaccaagctgctcatatggggccaaatctggctagcagtcgccctgcaaagaggggagttcgctattatgcatatagattaaaatctggcagacttagccgccctagatttaaaaaaggtttggcagcagcatcatacaggcttagaaataaggctaatgctaatttaaagcgaggcattcaggcaacaaactcacttggcacgggaggaataaccataccacctcatgttactgaaagtgaaacaacaaatattggtagattggcagaacatcaatgctcagctgtttcaaagattttgttttctgagattcaaaaaacgaaacctcggcccaacaatcttgacattttatcaattgctcgctctgcttgctgcaaagttagtcttgtagcctcactggaggagaaatatggaattttgcctgaaaagctctatttgaaggcagcaaaaatttgcagtgagcatagtattttggtaaattggcaccaggaggggtttatttgtcctagaggttgtaatgtatcaatggatcaagctttgctctctccgttagcatcgcttcctagtaattctgtaatgcccaaatctgtgaatttatctgatcctgcaagtggtgagtgggaggtggatgaatttcactgcatcatcaattcgcgtaccttaaaattaggttcagtgcagaaagctgttatcttgtgtgatgacattagctttgggaaggaatcagttccagtgatttgtgtagtagatcaagaacttacgcattctcttcatatgaatgggtgtaatggacaaaatataagctcttctatgccttgggagaccattacctatgttacaaagccaatgcttgatcaatcccttagtcttgattcagagagtctgcaattgggatgtgcctgctcatacactagttgctgtcctgaaacttgcgatcatgtatacctttttggcaatgactatgatgatgcaaaagacatatttgggaaaccaatgcgtggcaggttcccatatgatgagaatggtcgaataatcttggaggaaggttatcttgtctatgagtgtaatcatatgtgcagatgcaataaatcctgtccaaacagagtattgcagaatggagtacgagtcaaattggaagtctttaaaacagagaaaaagggatgggcagtaagggctggtgaagctattctacgtggcacatttgtgtgtgaatacattggtgaagttttagatgtgcaagaggcacgcaataggcgcaagagttatttctacgacattgatgctcgtgttaatgatataggcagattgattgaaggacaagctcaatatgtaattgattctactaagtttggaaatgtctcaagattcatcaatcataggtga

SEQ ID NO: 53329 - DNA, 798 bp, Glycine max
  Peptide Sequence Number=SeqID_170107
atgagacgcgtgcttttgattgctgagttgtgtatagagaattacaataggagaaacatgataaataaaagaaaaagagaggaagagaaatggttgaatcctggggggccaagtgatgcaaaaattctcagacccaaatcatcaaaagcatggaactgctgtgaatccttgtcacttatgggggatattaggcttacccgggtagagcaaggtcaaacaaagattagaaatgttccaattgctgtcacccctgaaggattttggtgttgccctactcctgttgggtttcagaaaagcctcaaacctcaaaaccctttgaataaactcaaaccctcttcaccacctccaaagcctagttcccagaaaaaggctgtttcggagagtcagagaaaaacagtgccttccccttcaagattggcggtttcagatgctcaacaatgtaatgatgatccagaaagacctccgactagcacttctgtgcctgcacagagagcacccaaaaaggtggctattgagtttggtgaacctggaacttttgacatgaagctgcttctccttggaaagcagggattttgtgtgaagttaagtgtgcacagggatgttctaatagagaagagtagcttctttgctgataaactttctgaacaatctagtttgtcatgtctccaagttgatgactgtgaggatgttgaaatatatgttgagactgttgggcttatgtactgcaaagaaatgaaacagcagctaatgaagcaaagtgtttctcgcattcttcgaatactcaaggtgatttgctaa

SEQ ID NO: 53330 - DNA, 1119 bp, Glycine max
  Peptide Sequence Number=SeqID_170108
atggggactaacaggcaggagcatgaaatttcaggaggatctgaggcaacatatcaggagatgatagaaaatgaagtcaaggacactcaggaaggctcaacacacaaattaataactgagagctgcaaatcaaacagcatggttataaagatgttttattttatgttatgttccactgaagctgaaaaatggtctaaattgacaccaaaacagaaacgacatacgttgattcctgctcacatcatagctgaagccatatcaactattgccgatcttgacattagatggtcaggtccaatcacaccaaaagaaatggaatacgttgaacaatatgtccttgcaaagtatccagaatattcaggcctcatgaaaggagatggaaatgggataaacttgtctagctttatcatctatgaggagccttcagaatccatgatagatgataggggaaagtcaccaagagagtcttctacatatttttttggcagtaataatctccctgaaatggatagggccaagatccagttggagccatcaagattactagacattctcaacaagaaatcctcattccttggaagtttcatctctatcccagaaatccaagctcgcaataagattttgaatcattatggtttgccagatgaagagtaccttgttctcttcactccaagctacaaggatgccatgatgttggtgggagaaagttacccttttgttaagggaaactactacatgaccattcttgatcaggaagaagactacatcagggagtttgcttcttttaaggagtccaaggtgatctcagcacccaagacatggctggatttgaggatcagcgggtctcagctgagccagaacttcaggaggaggtgtaagatcagctcaaagggcttgttttcctatccggttgatgcaaatggaacaatgcattggatttctgaggctcataggaacaactggcatgttctacttgatgcatctgccttggtagtgggaaaggatcggctacatcttcttgcgctccaccgcccggattttgtgatatgtaatcttgaaaacactcattccaatccttcaagagtcacttgcctcttagtgagaaagaaatcctttgag

SEQ ID NO: 53331 - DNA, 615 bp, Glycine max
  Peptide Sequence Number=SeqID_170109
atgtttctgatctgtaaatcagtggtgtgggtggtgatgctggcattgcttgagattagtcagggggctagtgcacagccatcctgcatggtggccgttggccagggctgcgaagcatggtggaatgctagatccaattgcaagccacagtcacaaccaactgtcgttaggattattgggcctccaattggaggaggtgcaattgatttgtcccttcttcggtcatatagagaccattgtgttaggcatgtctggattcgtcaggaacgaccagaggtgaagcttgtgagcctcgatgcccaggatacgtcttccttccacttacctattggagaaatgactatcactttggattataagtcttgcctactgcacttgcctatgacaagaaggcccattgattatgtctcctcagtctttgataaagaggaggtgaagatcctcctgatgtgttatctaggcagtccgacaaagacagaggcttttgcaacggcaaagacaggtgccagagtgagcttgacgtgtacgatatttgccaacaagtcctcgactcgcatccatgtctcttacctccagtaccttgacaacttggatggtttccacgagtatgcatag

SEQ ID NO: 53332 - DNA, 665 bp, Glycine max
  Peptide Sequence Number=SeqID_170110
gaatacatgtcctcgcctttagagggctgcattccatcgcctttagagggctacatgccctcgacttcagagggatgcatgcccttgccttttgtggactacgcatcctcaccttcagatggttgcacgccctcgccttcaaagggctacatgccctcaccataagaggagtacacgtcctcgccttgagaggcctgcacgaccttgccttcagaaggctacacgccctcaccttcagaggactacacgttgtcgccttcagagggctgcacaccctcgcctttagtggattacacgtccttaccttcagagggctgcacgcctttgccttcagagggccacatgccctcacctttagaggactacatgtcctcgccttcatagtgctgcatgccctctccgtgagtcggcttcacgccctaacaggactacatgccctcaccttcagagggctacacgccttcactttcagagtactatacgtcctcgcctttaaaggactacacgtcctcgccttcagagagttgcatgtcctcgtctttagaggactacacgtccttgcctttagagggcttcacgccttcgccataagagggctacacgtcctcaccattacaagactacatatcctcccctttggatggctacacgccctcgcattttga

SEQ ID NO: 53333 - DNA, 222 bp, Glycine max
  Peptide Sequence Number=SeqID_170111
atggtgccggagcttaacagttgttgcctccgcttgcctagccattgtagccaacatgtcctattaccttgcaccgccgcaataccaacgagacccactgtctggcctccttacataaactcacttgtcaggaaaacttttgatacaaaggactttcatgtccatggatccaccgccaattcatcttacttgtctgagtcagtcactaagttgaaccattga

SEQ ID NO: 53334 - DNA, 1313 bp, Glycine max
  Peptide Sequence Number=SeqID_170112
atgctccgttcaactccaattccggcaccgtacaattcggtgccagttctctctcgcgcccgcacgtgtcactctctagcacctgcacgtgccgttcattcccattcctctttcgtttcgcggctcgtgttcccacaattccggcaatacatcgtaaatgttcccggccgagtgtttgtcgcggcagccgcaaagaagcaacggcgcggcggcgctgaactcgctgtaacggacgacggtttcgacgatgacgaggagtacgacgacgacgatttttatgatgagtacgatgatgatgatgatgatgaagaagaagagtttgatgatgatgaagatgatgaggggatgctttcattggagaagatgaataaatggtttgagaagaagccgaggggttttggcgaagggaaagtttacgacacttcggttgaggataagctgctcgaggaaatgcgccagagtagaatagcgcaggctgagaacttgaagaagcttatgagcaacccagtaaaacatgcttccaatgaaagtgttcaaaagaagaaagccggtgatgatttaatccttgaaagaaaattcttatttagtcctgaacgtgtaaaaaatgcagaacttgttccaattggaggtcgagtgtgcttggtgaacctaccaaagaaaaagaacatccataaagatctgaaatcagctttgcaagggattcctggcataattaatatagtcccagctgttactggaaacaagaagacgagggacccaatctgcaagggttttgcatatgttgatttcaagcgtgaagaagatgcagttaggttcgtagagttatacactggacaaactattacttttggtaaaattcagaagcagataaaatgtgagcttctaaatgtacagtcttcatcttctctgaaattaagcaaaaaccttagtgctgctccgcaacttgtggccgctgcctttgaagaagattcaaatgaggattctaacttggatggttctgcccgtagttcctgggatgagaccaattcttcagatgatttggatgacctggactatcagatgaatggagaagaacaggaagatgatgaggataatcaagagtctgtcactgctttgggggtagatcatgatgataatgtggaaatgaggatcgatcctgaaaatatttcacttccctcagagcaggttgacagaaaccccgcagctgtgcagaagtcgtctgccaaggttaaacaggagaatgcccgtaagaaaaaaccaatttccaaagagaaaaccaaaaaagttttagatgttcctggatcctcaagaag

SEQ ID NO: 53335 - DNA, 288 bp, Glycine max
  Peptide Sequence Number=SeqID_170113
atgtgggtgcaagccattggtctgtttgctcaagcaacctgtgctcctgagtttggacttccaagaccgttcaataagagattactcgtcttgcacattggtgggggtgccgtaaaacaacgaggacaacccttcccttgtgttcaagaatcccctacaacaagagacccacggtctcttaatcccttttcagaaataagaagaagagaagaagaggtctctcttaaaagagatggattgtacaatgaagatcaatcaaatatctttattgaatatgcaagtggttga

SEQ ID NO: 53336 - DNA, 228 bp, Glycine max
  Peptide Sequence Number=SeqID_170114
atggaggagcccctgggcattccattgagcattgattttcaagtgcaagccattggtcagtttgctcaagcgacctgtgctcctgagtttggacttccaagaccgttcaatcagagattactcgtcttgcacgttggtggggttgctgtaaaacaacgagtaaagttcaaaacaaataagttccaaaataaaaaagggggttcaaaaagaaaaagggcatttgattga

SEQ ID NO: 53337 - DNA, 219 bp, Glycine max
  Peptide Sequence Number=SeqID_170115
atggttcatggtatgatggttgaaagcgtaggagaaaatagaatgctgggactgagatttactccaaggcacaaacgttcaaagagatttggaaccatacaagaggacttgcttttttcttatctttactgtgttttacatggcagtcttcctgataagaaaagaattgaggaggataatccagataatcacattcaggcctcagatcgaatgaagctg

SEQ ID NO: 53338 - DNA, 264 bp, Glycine max
  Peptide Sequence Number=SeqID_170116
atggaatgcactttgacaagtgaactattctcacaggtacgtgtatatacaccaaagagggtgtttcaagagctagaagttgcaaaggacgaatatattcgagctaacttaggcatacgcaaggaccaaaaaatactcttaccaaagcttgttgagtcattcaccaaggactcagaaacggtacagcgaaatacaatattgcagtgtgacaacactgtaaataatctttgttgctactctaaatctgatgttaacgtgccttga

SEQ ID NO: 53339 - DNA, 444 bp, Glycine max
  Peptide Sequence Number=SeqID_170117
atgggcgcgtgctcatcttctgcttccgtggaaatggaaacgacaacagcaagtgtgaataagggtggtggcggcggcggcggcggtgcacctgcgtcggaatctttccgacgaccgtcgtcgatcatggtgatggacatggtcggtcgcatcaatgagtacaagcaaccaatccccgcgagaaacgtgctttcggagaatcctcattactacctctgcaactcggagtcagtgcacatcggcacgtgcatgccacgtgtccccgatgaagaagagcttctagccggtcgaatctacttccttgtccctctctcgcattccgataccccactttcactccctctcctctgtgatctcgccgttaaagctggttccgctcttcccaaccctaataataaccgttactatggtcagggtaaaaaagccgccgataagcgccgttaa

SEQ ID NO: 53340 - DNA, 2390 bp, Glycine max
  Peptide Sequence Number=SeqID_170118
atggaatttaataaagatggtgccttaagggctaaaaaacttgctgagaagatgcttttacagagggaatttggaggggcaagaatactcgcaaagaaggctctagaattatatcccaatcttgatggtcttcctcaatttctagcaactattgaggtgtatatctcttccgaagatagagttaatggagaacttgattggtacaggatccttggtgtgcaacctttggccgatgaagaaactattcgaagacaatacaggaaactggctcttactctgcatcctgataaaaatagatccgtaggtgcagatggggcatttagccttatctcacaggcttggagtttattatctgataaagccaagagaatcacctatgaccaaaagtgcaatttatggcgtaatggaaatcctggtgggaaaccttctatgccagccagtcagaatggttcgcatagtaacatctttaatcctgtgttgttgaaacccacattttggaccttttgcagtttctgcaagacaaattttgagtaccataatgtttatgttaacagcaatcttgtctgtacctgctgtcataagccatttttggcttccgagacattgcctccacctggatacagaaatgtttcatccactcagatgaagcaacataacttcaactcaatgagaatggaaagaaattatcatttttcaggaaggacgcctatgtctgctgtcaattcatcacttgggtcaggtcctttctctatgcctgatggtatttcccgtgttccagcatcagcttctagtgctgcagaagctcctggtgtttttaggatgtcatctgagaatttgaagagaaggcatgaagattcagcaactttcttgagggaggatgcccattttgggaatgctcatgctgttgatagaactggtgctggttcagcttttcagtcctctcgttttggttcaaattctattatgaaaggagataggccaaggaaaaacaggcccactgatgaacataaagttggtagtgatagaagagatatggaaaacaaaacagcatctcaaaatgaaggaataaacttggcaaatgaatttggatcaggaagggttaatgctgcaggaaatcacaaacgcactggtgttagggacagatcacagcatcaaataaagaacatattggtggaaaaggctcggaaggagattgttaaaaagcttgatgaatggaaagcttcttctgcatcaaataatttagacaagtcaaagaatactgacacagaaatcagagagaagggcaaagaaagggaaggaaatgttgtaaaacctggtgcacaagttgttgattctgagaccgtcaacaagaagtgtttctctgctgatctagagccagagctgcctggttctctctcaatgaatgttccagacccagatttccatgattttgatggagaccgtactgaaaatgcttttggtgagaaccaggtatgggctgcatatgataatgatgatggcatgccgcgttactattgcttaatccatgatgtaatctcaaagaatcctttgaatatgaggattagctggttgaatgccaaaagcaatgatgaattggccccaatagagtgggtcagttctggctttcccaagaccagcggagatttcagaataggaaagcgtgtatcctatagcactcttaattccttctcccacagggttaagtggacaaaaggttcaagaggggttgtccatatatatccgaagaaaggtgacgtatgggctttgtatcggaactggtcccttgactggaataaatttactgaagatgaaatcatacagaaatatgacatggtggaggtgcttgaagactactgtgaagagaaaggtgtgaatattgccccacttgttaaggtttcaggtttcaagacagtattccgccagaatgccgatccaagaaaggtcaagaatatttcaaaggcggagatgtttcgtttctcccaccaggtaccttcacactggcttactggtgtagagggtcacaatgctccgaaaggttgcttggagcttgatcctgctgctactccgatggaacttcttcaggtgttagccgaggatctggagcaagtaattctaatgacaactgaaaaatctgtggaagatgaattgaagcacaaagagaattccagggaggagggtttgatcaagatgtgccagacaactaaggacgaaggttctgatgaagggttgggagagaagaaaaggaagtctgagagctgcctgacaactaaaaaagaaggttctgatgaagggttgggagagaaggaaaggaagtctgagagctgcctgacaactaaggaagaacgttctgatgaagaattgggagagaaggaaaggaaacccaagatctt

SEQ ID NO: 53341 - DNA, 327 bp, Glycine max
  Peptide Sequence Number=SeqID_170119
atgcatgttgattatgacggaggggagagacggattctcggtgctgcagggagggaaaggaggcgtcaatggcgtggaagaagttgttggtgcaggaagaataaccctaatatagcagcccaaaacaacaacaagcagcgagagaaagagggatttgggactcgtggctcgtgggtgagtgcagagagtgaacagattgccgcttcgggtttcatggcggtggacggaaagcggcgatggtgtctcacgatgacagagggcgacttgcaatgcccgcgagtggccgtgttacggtttagggattcgcagagacggtactgggtttga

SEQ ID NO: 53342 - DNA, 1749 bp, Glycine max
  Peptide Sequence Number=SeqID_170120
atgggttgggtgaaggggttcgtggggcacagatgggtggtgtttgtgtgcgcgatgtgggacatgtcgtttgcggggacatcttacatgttcgggagcatatcgccggtgataaagagcagcatgggtttcaaccagaagcaggtggcgttcttgagcgtggctaaggatttgggtgacaacgttggtcttcttgctggaaaaatcagccaggcttcccctgtttgggggcttatacttgtcggggtcgtgcagaatgttgttggctatggccttgtttggctcgtcgtcactcaccagctccccgctttgcctttgtggttgctatgcattgtaatctttgtgggacaaaacgggtcaacatattacaacacagcagcactagtttcttgcgtgcaaagtttccccgagagcagaggccccgtggtgggaatattgaagggcttcgttggccttagcggtgcaatttggactcagctaatagccatgatccaactccctgaccaagcctctctcattttcatcatagcagttggacctgcaatggtttcattaaccttcatgttcatcataagaccagttgagagttatcgacaatcaagatcctccgatgggactggtttcacgtttatctacagcatttgccttctcttggctgcttacttgatgggagttttgttgctagaaaacatgtttgatttggaccaaagcaccatcacattgtttgcagttattttgatcattctcatatttcttcctatcatagttcccattctcttggttttcttctctggaccccaaagtgctgaccaagaagccctcttggagccaccaatgctagaagcaactaagcctaagcactttgttggggagagtagtactagcactacgaaagtaaccaagcacttcgaaaacgagaagaatccttcgaagctagaggtgctgcctctgtcagaagggcctagggatgtttttcagtttcaagctagactttggcaagctgttaccaaagctgtgaagaagatcaagcgaaaaaatgggccccatagaggagaggatttcaccttgtcacaggcaatggccaaggctgatttttgggtcatgttcttctctcttgtcatgggctgtggatcgggcttgacaatcataaataacatgggtcagatttgccaatcattgggagacaacaatgtcaatgtttatgtctcagttatcagcatatccaacttccttggtcgtgttggtggtggctacttctcggaggtcatagtaaggaattttgggtacccaagacttgctgcattggcagtgattcaagcagggatgtctttgggactttgctactatgtcttgggtttggttggacaagtttacgtggtggccatatccaacggttttggctatggtgcccactggtcaattgctttagcagcagcttcagagctatttggcttaaagaactttggaactctctacaattttctcactatggctagcccagcagggtctctctttctatctggatttgtagcaagcacaatatacgactattacgcggagcagcaagcaaagcaccaaatgctcactggaaataacaatgacttgcttctttgcgagggaaacatttgcttctccataacatttggaattttagcagtagtttgcttatgtgcagcttctttgagcttgattgttgctcacagaacaaggaagttctatgcacagctttatggagagtctcgaacttaa

SEQ ID NO: 53343 - DNA, 315 bp, Glycine max
  Peptide Sequence Number=SeqID_170121
atgggagaagaagaggccgcaacagcgaggaagaagaagacgcaacagcgaggaagaagaagaggccgcaatcaaccgacagtgtggagaggcagtgcggaagaagaagaaaacaacaacgaagaagaattggttggaatcggattagggtgcgtccaagaggcaacaaggttagaaaaccctaagtgtctaacccaaaaaatggtgtggccaagggggaaccaccaccacgaggggtggcacacatccacggcgccactagtgcaaggtcgccacagggtccacagtggtagcgagacagcagcaacagtgtga

SEQ ID NO: 53344 - DNA, 270 bp, Glycine max
  Peptide Sequence Number=SeqID_170122
atggctaatacagataagccaatggaggtagttgacgtggctaaagtgaggtttccaactcttctagcagaccatccttggagtatgcaattacgattagggaaacagaaaatggaaccaccaactaaacaatctttaagccattgcaccactgttcaagcaagcgttagggctacattggtagctcctacatccacaatcattaatacccctatagtatccataataacaactaccaatcgtccagatttatactggaagactgtgtag

SEQ ID NO: 53345 - DNA, 178 bp, Glycine max
  Peptide Sequence Number=SeqID_170123
atgactaaggggcaaaccacgcagatgccattcaatatgtcaccccaaaacatgacagtgccacaaatggctggtatacgacactccactatgacagagaaccccatacccacttggactgaggtgagaatgactgcccctcaaaccatagatgctaatatgatagcaaattcaattt

SEQ ID NO: 53346 - DNA, 432 bp, Glycine max
  Peptide Sequence Number=SeqID_170124
atgtcatgctctcgtccgtcgtcatcacgttggaccagccttaatgaggaattggagcaatttcttgcgactgtgcccaagcacggagaatggagggaaatggcaaacatgatgcagaatgtcgcggttccaccaaatactattttccagaccgttcacgccagggaccaagtcatattttcggtgaagttagtaagccattgtagcagggtgaacagcactacgagatttttaccagctgaccggagatcatctagtatccttaactcattatggatgttccaagcaacatgtattattttcttaaagacaaaggctgaactcatttgcacttggagaacgttgcagaatgtcggtttgtgttcaatcattggaggaagacacttaaaattggagttggatgcaaatatttttgtgaaaccttgtccttga

SEQ ID NO: 53347 - DNA, 375 bp, Glycine max
  Peptide Sequence Number=SeqID_170125
atgatggttcccgaggaccgtctcagaatgtccgtcattctaagacggtctcgaggtcaaaaggcactggttttcttacatggattcccagaaatatggtatacatggaggcaccaaattattgttgcagcaaatgctggctaccgggctattgcctttgatttcagaggctatggactttctgagcatcctgggaagtcacaaaaattaaacttacttgaccttgttaatgatgtcatgggtttgttggattcattaagccttaccaaggagggtgggagggcagaagcatattttgttcgctttgatgttaagttagttataacatatggaacattaacatcacaaagagtaacatcaaatagaactagttaa

SEQ ID NO: 53348 - DNA, 858 bp, Glycine max
  Peptide Sequence Number=SeqID_170126
atggaagaaaagaggcagcatgcaaggagtggagtgacaaggagctgtgtgtggatgaagaagaggctagaagaaattctggaagggacaatcccatttgcctggaatctcattacagctggatatgttgaacaatctatatatggggtagtggtcagcacattaagtctcctgtttattgggaagctgcttgaaccaatatggggctccagggaattctttaaatttatctttgtggttaatcttctaacttcagtatgtttattcatcactgctattgccttatactacattacaaggctggagacttacctttacatgccactttctggatttcatggagttgtatctggtttcttggttggcattaagcaaattataccagatcaagagcttcctttcattaagataaaaacaaagtggttgccatctatcactgtattgctttccattgctattagcttctggacactagaggctacagcatatcttccaaccattatatctggcacgtatataagctggatttatcttagatactggcagaggaaaccagaaactaaacatagaggtgatctgagtgaagattttgctttctccacatttttcccagaatttttaagaccagtcatagaccctatcgcttcaatatttcatcgaatgctctgtggaagatatgatgcttctaatgatggtcaaggcaacagtctggaaagtgagcctttaccaggttcggactcaattgaggcatccaggagacgagaaagaggtgctcgagcactggaagaacgattggctgcagagaggttggctgttgcacgacgtgagttgcaaagagaggctgaggaaaatgtataa

SEQ ID NO: 53349 - DNA, 825 bp, Glycine max
  Peptide Sequence Number=SeqID_170127
atggcgcctaaacatgacttagcctacacgaaaccaggttccgccgtggaagtgagcatcgacgacgatggcttcagcgggtcatggttttccgccaccattgtcagcagctgggccatcgacaggtttttggtcaagtaccataacctcgttgagaatgaactaagtcacacgccgctgcaagaagttgtctgtctccaccagctccggccactgcccccgccggaaaaacatcgggacttcaagtccggcgataaggtggacgcatttcacaacgacggctggtgggagggtcacatcacgggaaaattagggaatggaaggtttcgtgtgtatttcagggacacggaggagaacatggtcttttccaagaagcagctcaggacacactgcaagtggatcaatcacaattgggttttcccaactacagatcacaaggtatcggtaagtggtaaagaaacagaggggaagaaacggaggcgagacgagagggacagaatcagtgagttgccagactgcattctgatgcatataatgagtttcttggacacaaaagatgctgttcaaacttgtattttgtctaaacgatggaaagacctctgcaaatgtctcactgatctcacattccgctccccgtttagatgcaaatgcaagaagtattttaggaaatttgtgtcttgggttttgtctagtcgaaatgactcttgttccctacttaatgttgatattaacaacagctgtattgagactgaagagtttaagcagcagacccaatttggattccctccctttggtcttttgcagcaagtctttgacttcccttaa

SEQ ID NO: 53350 - DNA, 168 bp, Glycine max
  Peptide Sequence Number=SeqID_170128
atggcctttgcggataactgggtggtgggtaaggaaaaggtttgttattggttgagtaatgacattgttggacccgcttcgatccttttgccagcgaagaccaaatccgcaaagcttgaagggaaacacttgggttgtcagatccctccacctttgggcgtattttga

SEQ ID NO: 53351 - DNA, 234 bp, Glycine max
  Peptide Sequence Number=SeqID_170129
atgcattggcatgtgcatgttgtgtatgttcatggggggtgcattgaccttgtcggacgacccattcatgcgggactagagtgtgcattgaccttgttggatggcccattcatgggggacaagcgtgtgtatgttcaagcggggtgctttgaccttgtcggatggcccattcgtgggggactagtgtggttaaagaatctaagcattcgctgtggggatgctcaggcgctttaa

SEQ ID NO: 53352 - DNA, 480 bp, Glycine max
  Peptide Sequence Number=SeqID_170130
atgcatgacaatgcaaaagttctccgtatatctaattctaccctttcccatttgaaaataaccagttacataagttttcttacaacacaagctttccaaattgcactttctacaccaaatcttagttctttcactatcattggttttgctcctcaccaactctcttcctcgtgcaatcttgcttttcttggatcagtgtatattggtgtgtggtttgtctcaagttcaaccttcataagatgcctgcaagtgctagccaatgttaagatattgaagctaagttgggaaacgcttcaaatgatactatatgatctctcaaattccaattcaacaatgcctcaacccccttgctttgttagattggagtcgttgcatgtggaaaaagaatcatgccaacgatctgatggagaaataaacaatgtggtggagtacttgcttcaaaactctccaaaggctagagttgatatcataagtgcttaa

SEQ ID NO: 53353 - DNA, 855 bp, Glycine max
  Peptide Sequence Number=SeqID_170131
atggaatggagcgatgtacggatctttctggcggtgatgcgcagcggatcctatggcgaggccgcgcgccggctcggcgtcagccatccgaccgtgggtcgtcgcattaaggtgctggaagcgcaggcccatcaggcgctgtttcgccgcacgccggatggcctggtgttaaccgatgccggtgacgccgtgttgggcctggcggaaagtatggaaaatgctgcgctggcgatggagagacggcttgcgggcaatcacccgcgactggaaggcattttgcgcatctcctgtgccgagtggtttgccaccgccgtgctggcgccggtactgagcgagctgacacagcgccatcccgctatcgtgccagaaattatcgccagctaccgtttgctcaatctgtcgcggcgcgatgccgacgtggcttttcgcattgtgccttttaccgagccggatattgtccagcggcgcctgatgagcatgccctatgcgttatacggcacgcctgaaaatgcccgcgcattgcaacacgaccccgcctctgtggggctgatcctgatgaataccgcgcaagcgcattttccggacgtcgtctggctgctcgatcaatttccacagtcacggcgggcttttaccagcaccagccgggcggtgcaggcgcagatgtgccggcgcggcatgggcgtggcggtgttaccccagccgctgggcgatgccaccgccggactgcagcgaattcccaccccgcagccgccgccttcacgcgatatctgggtaggctatcatcaggatctgcggcacatggatcgcctgcgcgccatgctggatattgccgatgcgctgctgattgcgaagtaa

SEQ ID NO: 53354 - DNA, 291 bp, Glycine max
  Peptide Sequence Number=SeqID_170132
atgaagaagcttcaggacaaagttgccctcgtaaccggcgcatctaaaggcattggtgcggcgattgcccgccagctggccgccgacggcgcaaagatcgtcgtcaactatgccgcggataaaaacggggcggataaggtggtcgccgctattgaggctgccggtggcacggcggtggcgctggcagcggatgtcaccgatcagccgcaggttgaggcactcattcaatctaccctcgcgcagtttggccggctggacatcgtggtgaacaatgccggtgtgtatcagtga

SEQ ID NO: 53355 - DNA, 501 bp, Glycine max
  Peptide Sequence Number=SeqID_170133
atgaaggtcgacatggaggccatgaaagaccaaatggccgccatgatggatgccatgttgagcatgaataaaataattgaaagcaatgcagccgcaattgccactacaagtaccacagctgagggaggagaagcattggggagcacaggcagcccccatgtagtgcaaagcaagaatcctttcccaccatacgacttgtctcccaactatacaccacctaatgttccgcatactcccaatgagagcatcaataactctgctcccatacccattgggagccaacaaccccaatctgatcatgcacatgtctctcaacccataggggagacacatgaagtaccccaccacaatctagccgactttgagcctcgcctcagatatgccactgaagggcaaataagggaaaggctaagggctattaaaggaggtggagattatgctttcgctgacattgcaaaattgtgcctagtacctaacgttgtcatccctccgaagttcaag

SEQ ID NO: 53356 - DNA, 957 bp, Glycine max
  Peptide Sequence Number=SeqID_170134
atgggttttttgcaagatgataaagaattcattaaggcaatcaaagaagcaaaagactggggttcagcacattatataagaaaactatttgtgttgttacttttgactgcaacaatgaacaaacctgaacaagtttgggaccaaacttggcattggatggctgatgacattgtctataattataaaaaatcatcagcaagtccagcattacagcttgatgataggactcttcaaaatctgttcttgcttgaaattgaacaactgttgcaagcaaatcaaagatcgcttagagactatccttcaatgtcatatctagaagatgcgaattgcccaacctatctagacaatagttttatattagctgaactcaatgacaacaatcaagaacttagatcagagtttaaacatctattttctcaaatgacagatgaaggtggtatgtgttttctctatggatatggaggtacaggaaaaacatacatttggaaaacacttgcaagttcactaagagttgacaataaaattgtaattatggttgcttccagcggcatagcttctctgttattgcctggaggtagaactgcacattcaaaattcaaaattctagttccagtttttgaagactcaacttgcaatatccatcaaggaactcaattagctacactattaaatcagacgagtctgatcatttgggatgaagcacccatgactcacaaattctattttgaggcacttgatcacagccttagagatatcatcaaacacaacttaaaggactgtaaaatctttggaggtaaagtaatggtctttggtggagatgtctggcagatcttgccagtcattccaagaggcagccgctctgatattgttaacgcaacaattaattcctcttatctatgggatcattgtcagatcttgagactgacaaaaaacatgcgcttacaaaacaacatgtaa

SEQ ID NO: 53357 - DNA, 117 bp, Glycine max
  Peptide Sequence Number=SeqID_170135
atgactttgagccctgtgaaagatatagatgaggactttgagttctacgaaagcataaagcaaaggatgttgagtcctatgaagcaagccaatagatacatgcaaccttcatcttga

SEQ ID NO: 53358 - DNA, 410 bp, Glycine max
  Peptide Sequence Number=SeqID_170136
gagttgcactgcctcctgagcttgaggttggtccttcagctgctcgtgtcagcacaaaggagaattgtgttgatccctcagggaatgatccagacaaatgcgggttgtacatcgatgaaaatcctccccaactggttgccctaggaagactttatgagggatccacaaccattcacaacattcctttgttgcatgatcaagtcaaggttggtgttaaggaggttagagatacagaggctccaatttttgtacccactgaagaggttaagttagtggggcaggcacttaacaccttccttgcttggccaacacatcttatcaagtgtttatctgaacagctttttctgaagccgttacgggttatgtgggatgctactgtgtttggggtgtataatgacaacttcccctag

SEQ ID NO: 53359 - DNA, 267 bp, Glycine max
  Peptide Sequence Number=SeqID_170137
atgaaactagaattgaagaaacttaaggaagacaacaagaagagggaaatgaccttgttcctgcatcagtgccttcgtgccaggaggcttgagcctaatgataacatgaccgcgactgattgggatacgcaaacacccgcaccagcgatagtaccagaagaaacgacactgctgaatgatggtgatgatgggtccaatatgaatgctaatggggatgatgagatgattatgcctccatttggagatgatgctaatccacaactctaa

SEQ ID NO: 53360 - DNA, 462 bp, Glycine max
  Peptide Sequence Number=SeqID_170138
atggcctctgaggaggatttaattctattgtgggcccttcaaaccggtcttcaaattgactgggcccatcttgtccggtatcgtatgcataaggaattacgggcaaatgcacctcttccatatcctcaccttgtcactctttttctccattattttaatgtccctttagatgatgaaccatttgttaaagtcaaatgttcttttgctattggtgcttgtgttattccctcctttggataccgaaaggatgtggatggccaatgggtgtggaaacaagaccttccccctctgattcctaatgaacgaacaccctccccaccaccacaaagggattcctcatcttcactgcggcatgatgttctcattgaacttagggatctttgggcatttgtcggcgatcttttcgatgctatggattcatgcatcatgcgtcttgaggatgatatgagcttcattcgatga

SEQ ID NO: 53361 - DNA, 513 bp, Glycine max
  Peptide Sequence Number=SeqID_170139
atggtagagacacatgaaattccccaccacaatctagccgacttcgagccttacctcggatatgccactgaagggcaagcagttagtggtatacccctgcaaaacactttggagggacctcagtatcacccacaaccacaccccttgcattccacagtgggtaaaaaccctcatgctatggcagaaatgggaaagttggatcatctagaggaaagacttagggccattaaaggaggcgaagattatgcctttgctaacctaaaagagttgttcctagtacccaatatcatcacccctctcaagttcaaggtgccggactttgacaagtataaggggactacttgccccaagaaccatctaaagatgtattgtcggaagatgggggcatacgcaaaagatgaggaactgctgatacatttcttccaagaaagtcttactggggcagctgttacttgctacgctaacttggaaccttcccgaatccattcttggaaggacctaagccttcgttag

SEQ ID NO: 53362 - DNA, 231 bp, Glycine max
  Peptide Sequence Number=SeqID_170140
atgcaagtgggatcagcaactttcattatcagagtaatcaagcacagcggtatctgtagtggcgacagcaaaattctgcaagttgcaagtcgtttccaggatgtcaagacatctcacgtgacatcagctttctactccccctgtctccatgcttctactgctgtgaagcagttcactgcggcattctgcaagttgcaagtcgtttccaggatgtcacgacatctcacgtga

SEQ ID NO: 53363 - DNA, 120 bp, Glycine max
  Peptide Sequence Number=SeqID_170141
atggtgtcatcatccagttgtaccaatggacttctttggcttacaaggtactggaaactcaagaaagaaagcacgaaggttcttccaacgacctccttccttcaacgtcttaccacttaa

SEQ ID NO: 53364 - DNA, 332 bp, Glycine max
  Peptide Sequence Number=SeqID_170142
tgttatgacacgttctccagacaagataaagagcatcgatggctcaaaagaaagtcttaaactcagtgtgaggatcagtgatctatggtttattggcacgcctaacaaatttgagcaagctgaaatggtgtttgtggactccgatggtgatgagatccaggctgtttgtaaacaagaccaattgaaggagtgtgttgtaggggacatcccttttagaaaatacaggtttcctggatttgtagatgttgtggctggccagtttgaacgtggactattggttgatgttattggtgttgtggaggaggttgtctttcggcaagtttcaggaaaag

SEQ ID NO: 53365 - DNA, 613 bp, Glycine max
  Peptide Sequence Number=SeqID_170143
atgtgggtttttggccaacaggccgtattttgccgcggagcggcatttcatttgcttccagggtggaaacagggatattcaggagagaacgtgacaaaaatccgccagttatgtttggtcagtatgttgctgacaagcgggattgccagcgcggcgaatgtccgtttgcaggttgaggggttatccggggcgctacaaaaaaacgtgcgtgcgcagttatcgaccatccagagtgatgaggtgacgccggaccggcgttttcgcgcgcgcgtggatgatgccatccgtgaagggctgaaagcgctggggtattacgagcccaccattgattttgacctccgtccgccgccaaagaaggggcggcaggtgcttattgcccgcgtttcgccgggtgagcccgtattgattggcggcaccaacgttatcctgcgcggcggggcgcgtaccgaccgggactatctggatttgctcagcacgcggctgaaaatcggcaccgtgctcaaccacggtgactacgaccatttcaaaaaagagctgacgagcgtgtctctgcgtaagggctactttgacagccagttcaacaaaagccagctcggtattgcgctggcgcgac

SEQ ID NO: 53366 - DNA, 849 bp, Glycine max
  Peptide Sequence Number=SeqID_170144
atgcctgtggcgaccttacacgccgtcaatggccattccatgaccaatgttcctgaaggtatggaaatcgccctgtttgccatgggctgcttctggggcgttgaacgcctcttctggcaactgcctggcgtttacagtacggcagccggctatacgggcggttacacgccaaacccaacctaccgcgaagtctgctccggcgaaaccggccatgcggaagcggtgcgcgtggtgtatgaccccgcggtgattagctacgagcagctcctgcaggtcttctgggaaaaccacgacccggcgcagggcatgcgtcagggcaatgaccacggcacccagtaccgctcggccatttatccgctcaccccggagcaggacgccgcggcgcgcgccagccttgaacgcttccagcaggccatgcgtgaagcgggcgatacgcgcgaggtgaccacggaaatcgcgacggcaaaaccgttctactatgccgaggacgatcaccagcagtatctgcataaaaacccctatggctactgcggtatcgggggcatcggccgccacgcgagccgcgtggcgcgtagcattgctgaccgaaccgtaatccatcactttgccctgcagcagcaggttaaagaccggcgcctgcggtcggttcagccgcgtctgcagcaggtgcacagcctcaatccccaattcccggcagggcaccgtgacgcccgtgaccggcctttccagacggtgcgccagattccaggcaaaatcggtggtaatgagcgaaatatcttccgggatacgcagcccccacgcatcgagcgcctgctcggcctcgtctgccgtaaaccactccgtgactaa

SEQ ID NO: 53367 - DNA, 381 bp, Glycine max
  Peptide Sequence Number=SeqID_170145
atggctacaccgcacaactctcctcctcatcctcctcctactggtgcaacatcgcattcaccgtctaccttgaagtggacaagaaaggccacacgcctaagatcattggcgattagaccaattggagcagaaagacccctggttcatgtggatcctgataccgggaaagtggacaatccctacagaaagaagttaaaaacatatttggggatcgttgctcgtgataagccgacaaggacagttttgatgatattgtatgcgaaaaatacagcattagcaaggagaaataggcctaattttctcagagccgtaaagaccctttgtgggaggatgtgcgaaaaaaggcacaggccatccagaaacaaaacactgccctcatga

SEQ ID NO: 53368 - DNA, 333 bp, Glycine max
  Peptide Sequence Number=SeqID_170146
atgaagaatgacactgcagaattgaagatggaagctgaagtcactaaagttgtgttacaagatgcagaaacaacgcttagagtagcggtggaagaagtggaagcagctaatgcagcagaggcaagtgctgttgataagattaaggtcttatgtatgagaactagtccttctcattcatcaccttctgaacctggtgcaagaattacaatttcaagggaggagtttgaatccttagtttataaggttaaggagtctgataaattagcagatatcaaagtggctgctgccacaaccactttgaagttgcaaagactacccaaaacaaagttgtaa

SEQ ID NO: 53369 - DNA, 1263 bp, Glycine max
  Peptide Sequence Number=SeqID_170147
atggagttcaaagataaaagaatgaaggcaacgtctgagattctgaatagtatgagaattctaaaactgcaagcatgggagatgaagttcctatcaaagattattcagcttaggaagactgaggagacatggctaaagaaatttctagttggtacagcaattgttagatttctcttctataacaccccaacttttattgctgtggttacatttggtgaatgtgctcttatcggaatcccacttgaatcaggaaaggtcttatcagcacttgcaacattcagaattcttcaaatgcccatatatagtcttcctgacaccatttcaatgattgcacaaactaaggtttcccttgaaaggattgcatcatttcttcgtctagatgagtggaagactgatgtagtagagaagcttccacgggatagttctgataaggcaattgaattagtagatggaaatttctcttgggatttatcttcccctaatccaacattgaaaaacgtaaatctcacagtttttcatggggaagtaccaaagatatctgggaccctaaagatatgtggtacaaaggcttatgtttctcaatcaccatggatacagagtggcaagatagaagacaacatattatttggtaaagagatggatagggaaaagtatgatgaggtgctagaagcatgttccttgacaaaagaccttgaggttctaccatttggtgatcagaccactatcggagagaagggaatcaatttgagtggtggacagaagcaaagagtgcaaagagcccgtgctctataccaagattctgatatatatctgtttgatgatcccttcagtgcattggatgctcatacaagatcccatctctttaaggagtgcttgcttggccttttaaaatcaaaaactgttaattatataactcatcaagtagagttcttatctgatgctgatctaatattggtcatgagagaaggaagaataactcaatcaggaaaatacaatgacattctcaggtcaggcactgattttatggaacttgtaggtgcacacaaagcagctttgtcttcaatcaagtccttggagagaaggccaacatttaaaacatcaactaccaccaaggaggacacaagttcagtaagttgttttgaacttgacaaaaatgtggtatatgatcaaaatgatacgtcagatgacatagttgaacccaaaggacaactagttcaagaagaagaacgggaaaagggtagagtagggtttaatgtctactag

SEQ ID NO: 53370 - DNA, 600 bp, Glycine max
  Peptide Sequence Number=SeqID_170148
atgacagacacttgtttatatatacacatgcttgtcctacctaggactgaaaacaacatcataacaccattaggaattgaagtagcacaaacattctggacttcattaaacacacacacaaagtccaaatcatacatgagtcagtttattagagccaagcagtgccgtaatatcgtccagccagtgtacgatgttttcataaactaccgaaaggttgataacggaagaacgttcgttcctttgctctatgatcatctgaggatcaagggaatcaaacccttcttagacaccatgaacatgaaacctggccataagctgtttgagcatatcaacaaggccatacatagctccaaggttggtgttgctgtcctcacacatcgttattgcgattcctacttctgtctccacgaacttacccttctcaacgagtccaagaaaagggttgtccctatcttttatgacatcaaaccctcacagcttcagcttaagggcaatgcacgttatcctcctcaagagctccaaaggttcatgtcagctcttgaggaaactaaatacactgtaggagtctcctttgattcgttaaatgggtacagggcttaa

SEQ ID NO: 53371 - DNA, 552 bp, Glycine max
  Peptide Sequence Number=SeqID_170149
atgccaaaacgaaggaaacttaatatggatttaagaaataaagctagtgacaatattctgagtcaaaacccttgtcagaacggtttttcaaaggaagcgcaaaacatacaatggtggttccaaagtcagaaaagatgcaaaggcgagctgaaactaacaaggaacaaacatagaatcatggttacctcaaggaaaaccacgaaggtcagatcgggcttcgttctaaaccgaaaccgcgaggcaagttggaagattccgcttagattgaagggttcctctcggtgtggggtttcaacggagaacaatggcggtttgtggtggctgtgggtgatggagaaagagcttggaacattggaaatggctacacggaaagcaaaggctgaaacactcaagtgtttctactcgcgagaaaggaagcgttcctcacacgtcaggcgacgtagagaagatcgcaacggtcagatcgtggacaagtgttcggtgaagctgcagaccaaatttcgagaaaatccaacggttaacgaaggctgggtagcgtttttaccgagatag

SEQ ID NO: 53372 - DNA, 243 bp, Glycine max
  Peptide Sequence Number=SeqID_170150
atggttgaagtagaggagacattcaatcttataacacaacgtgacgaacaaaagtggttagttaacctgaatgactattattgtcaatgcggaaagtattctgcacttcactattcatgttcacacattattgttgtttgtcgttactggtctattgggaatgaagcaacaattcctacttctgatgactcatggacacgtatccctgatccaagtacaattcgtgagaaaggtcagccataa

SEQ ID NO: 53373 - DNA, 234 bp, Glycine max
  Peptide Sequence Number=SeqID_170151
atgtatcaggtggacgtgcctgtctatactgcagggatcgccagaggatgtggttggcaacactttctgcttatattgaccttgcaacatagatactctcatcactgtaataaaatccatgctgatttgtttaaccaagttaggatagtttcaagtgtgatgagcgagctgagagaagaaaagctaatgcttgtagacatggcaggatcagaaaatattgaacaagttggataa

SEQ ID NO: 53374 - DNA, 267 bp, Glycine max
  Peptide Sequence Number=SeqID_170152
atggacatgtataactttataactcaacaagaggccaaagagtttgggctcattgataaggttattgatcagagacctatggctttggtttctgaagctgttggcaacaacaaatccttaaatctaaggctccataaggaatgccaagggaagttcagttcaccatttagctataaccgcataacaaacatagtgctaaaactgagagaatcccaaagccctaaatttcctaaacttgaatacttgccatcagcaactaatccctag

SEQ ID NO: 53375 - DNA, 597 bp, Glycine max
  Peptide Sequence Number=SeqID_170153
atggctagaaagaaggtcgacattacatacataagcaatcccaccaagaggaaggcaacttttaaaaaaaggaaaaatggtttgctcaaaaaggtttctgaaatcagcaccctttgcgccactgaagcatgtgctataatttattctccagatgaacctgcaaagcctgaggtatggccatctgaccaaggagtcaaaagtgtgatttccagctttagggaagtctctaaactggaacaaagcaagaaaatgttgtgccaagagagcttgctgaggaagaatttaatcaaagcccaggagcaactgaaaaaactgaaaacagaaaataggaaaaaagagatgtcccttctcatgtctcaatacttcacaattgagaacaaccttgagaattccaacaccgttgatctgaatgataactcattcttggctgataaaaacttggaggaaataagaatgaaaatcgatatgcaccaaccccaagaggtggcaccaactgttgagaagggaggagaaaccatgtatctaggagatcaaggacttgtgaattatcatgtccaaggacctgagaccaatggggatgccatgccaaatctctga

SEQ ID NO: 53376 - DNA, 171 bp, Glycine max
  Peptide Sequence Number=SeqID_170154
atgtcgcagaactttacggattacctaacgatgggtgttaagtacctcgaggcggtcaagcgaaggttgcatgccaccaaacaatggtccccggatgaaattaggatagtttacacacctgttcatattcacacttatgtttacacaccagacacctatttgctaaaatag

SEQ ID NO: 53377 - DNA, 204 bp, Glycine max
  Peptide Sequence Number=SeqID_170155
atggaccctaagaaaataaaggtcattcctaattggcccactccaccaagtataagggaaatctggggctgccatgacttaacaaacttttacaaaagtgtcgagggaaggagcccagagtatgaagaacctcgggatttgaggtcaaatcctttccaaggtggagaggatgatgcaatcatatcccccaagggtattggatag

SEQ ID NO: 53378 - DNA, 581 bp, Glycine max
  Peptide Sequence Number=SeqID_170156
atggctcccaaagaactcgagcagctgactcaacaaatcagggaccagctagaggagtcgatcacagaaaaacctgaggttggtccctcagctggtcgtgtcagcacaaaggggagttgtgttgatccctcaccaatcgatccagacatgggtgactcagacaaatgggggttgtacattgaagaaaatccttctcgcctggttgccctaggaagagtttatgagggatccacagcggttcacaacatccctttgttgcatggccaagtgaaggttggtgttcaagaggttaaagatgcagaggctcccgttcctgtacctgctaacgaggcagttgtctctccagcaaaacctccagataggccagatcatgaggttatgtgggatgctaccgtgttcggggtgtttaatgaagacttctcgttgcatctgactgagacaagtatgcgagcggggaattccaatgtgtatggattcctcgagccacagtccattcagagatctgggcaatcacaatttgaatcagaaagttacatgaagagttcaaaacgcgatgtctaccttggagcctacctgaatgg

SEQ ID NO: 53379 - DNA, 801 bp, Glycine max
  Peptide Sequence Number=SeqID_170157
atgtgggcctttcataaaggtttacaaattgattgggcacaccttgttagatatcgcatgcataaggcattgcgattgaatgcctcattgccttgtcctcatcttgttacccttttccttcaacacttcaacatccctcttgattctgaaccttatgttccaatcaagagatcattccttataggtgcttcagtcatagcatcctttggttatataaaggagcatgatggctcttgggtgaagaagggtgctagaaatgttggtgaagaaggaaatgaaggagaagattcatctctttttttaaagattatggaaaggtttgatggttttcaaacctttattggtgagaggtttgatactttggaactgcaagtggatatgcgcttcaatgaaatggagtcaagaatgactaaggttgaagaagattcttgtattttggctatattagtatggtatttgaacaatttactatttccttatttgcacgaagttgtcatcatcaaaaagggggagattatagaagcaaagcttcatagtgaatcaaaggtgattcaaaggtgttttgatgataacaatgatgatgacaaaggtgatgacaaaaagctcaaagatcaatcaaagaacaactcaagtgaatcaagaagaattcaagagttcaagaatcaagaagaattcaagactcaagaagaaagcctagaatcaagaatcaagattcaaggttcaagatctcaagaatcaagatcaagattcaagactcaagattcaagaatgaagaaaagactcaatcaagataagtattaa

SEQ ID NO: 53380 - DNA, 483 bp, Glycine max
  Peptide Sequence Number=SeqID_170158
atgtcctcagctaatgagcctgcaattaatagagaagggtattttgatcttggtgaccaactcatgcagtgtagccactgtaatgcaaatatgtggtatgatgaaagaatctcaaaacatgaaagaactacaaattcaagattcagcttatgttgtggaggtggcaaagttgaacttccattgttacaaaatccacctaaatatctctaccaacttttgtatgatcatgatacatctgatagtaaaaattaccaacagaacataaggacatataacatgatgttggcctttacttctgctggtattaagttcaacaaatcaattaatcattcaagaggacctcctacaataagaattcaaggtcaaccatgtcatataataggtagcatgttaccaatgcctaggaaagaacctaaatttgcacaattgtatatctttgacacagaaaatgaagtgcagaataggattaatgcaataaggtag

SEQ ID NO: 53381 - DNA, 741 bp, Glycine max
  Peptide Sequence Number=SeqID_170159
gatgaatggaaaattgaaggggatgtgaatcatcgcattcaagcaggatggatgaaatggagaaaagcatcgggggtgttatgtgatgcaaaggtaccgatcaagctaaagggaaagttttatcggactgcggtaagaccggcgattttgtacggaacagaatgttgggcggtcaagagccaacatgagaataaagtaggtgtagcggagatgaggatgttgcggtggatgtgtggtaagactcgacaggataaaattagaaacgaagctattagagagagggttggagtagcgcctattagaagaccggtagactctgtagtgaggagagtagaccagatggagagaagacaaacaattcgaggcagaggaagacccaaaaagactataagagaggttatcaaaaaggatctcgaaattaatggtttggatagaagtatgttactgtatgcaataatcattttattgtctaccaggcggggagcaatttctattactatgtataacttcggttctcccagggttggtaacaaaagatttgcagaagtttacaatgagagagttaaagatagctggcgagttgtgaatcacagagatattatacctacggttccccgattaatgggttattgtcatgttgagcgacctgtatttcttgctgcaggggttttaagacatgccctagcttttgttgacaattttaatagcctaattgatttggctattattgacaatatttag

SEQ ID NO: 53382 - DNA, 879 bp, Glycine max
  Peptide Sequence Number=SeqID_170160
gattgtcgcgcgtgataaggtcgacgtcacatatgagacctggaaggaagtccctattgctcaaaaggatttgatatgggaggatattcaggcggaattagaaatccctgaagcttctgacaataggacggacagtgtggctgacactgtctgtgaaaaatacggcattagcaaggataaatggagccagttttgtaagacacgcagagacccttcttgggaggatgtgcgaaaaaaggcacaggccatccagaagcaaaacactgccctccacgtgttgtcttgtgggggttatgaatatttagaagaaaaactcataagtgagaaaacaaaaaagaaactggaggaagttgctagaggcaaggatgtcgtcatcgacccttcttctcccatcagacaccacgtgaagtggaagatggcccgcacgaagaaaactgggcagatgacgtctgagtcagcaaaggaaatcgctcaaaagattataagtcattttcaattaacaattgcaactatcattgtttattatgtgaatgccttcaacaaatatatgtcttttgtacaggattctttggaggagcaggcgtcacaaggatcgttcgtccctcatggacgtcaggatgtcctgactgctgccattggacctagagcaactgacccaacaaatcagggaccagccggaggagtcgatcacaaaaaagtgactcagcagctcttggcatccttcagccagatgcagtcccagcttcaatcacatatgcaatcacagggacttgtactgcctccaaagcctgaggttggtccctcaaggcctcatgtcagcacaaagagaagttatgttgatccctcagggaacgatcctaagacgggtgactcagacaa

SEQ ID NO: 53383 - DNA, 633 bp, Glycine max
  Peptide Sequence Number=SeqID_170161
atgggggagacacatgaagtaccccgagattgcactatagccgacttcgagcctcacctcgaatatgtcactaaagggcaagcatttggtggcatacccctgccaaacactttgaggggccctcagtaccacccacaaccacacttacaacccttacattttgcggtggggaggttgcctcctaccatggtggaaaatgaaaaatttgatcatatagaagaaaggctgaaggccattgaaaggggcagagactatccttttgctgacatggcaaaactgtgcctagtgcccgacatcgttatccctccgaagttcaaggtgtcagacttcaataagtacaaatggactacttgcctcaagaatcacctgaagatggatttggcagctcaagtaacacccccaatgatggagagggagatgataacaatgatagtggacacgttagtggtgttctactatgaaaagatggtggattacatgccttcaagctttgcaaatttagtgtttgcgggtgagaggatcaaagtaggcctaaaaagaggaaaatttgattacgctgcttcgatgaattctggtgataggaggcctggggaaaatggagggaataagaaggagggagaaacccatgttgtg

SEQ ID NO: 53384 - DNA, 228 bp, Glycine max
  Peptide Sequence Number=SeqID_170162
atggaggccatgaaagagcaaatgaccataatgatggaagccatgatgagtatgagaaaaatgatgaaggtcaacacggctacagtcgttgccacaagctacagaggtgaagcattgggaaatacgggcgacccccatttcatgcaggtccaaagcaagcattacatcccaccatatggcttgcctttcaactatacatcacccaatgttgcacatgcttctgattag

SEQ ID NO: 53385 - DNA, 237 bp, Glycine max
  Peptide Sequence Number=SeqID_170163
atgagggtcataggatcacctaatgacactagccttcgatttctacaaagtgataatgctcgtagatatgtgagacaacttccacaatatccaaggcaacaatttactgctacttttccaagtatgtctcctggtgctgttgatttgttagagaagatgcttgtctttgatccaaataggcgcatcatagagtttgctgacctctgcaagtttcttaagttagaacaaccaaattaa

SEQ ID NO: 53386 - DNA, 510 bp, Glycine max
  Peptide Sequence Number=SeqID_170164
atggctaaggtgggctttcggacttcacacatcgggtttatattaggagttgcctttgttaagaggacaagagggaatacttgcaaaataaaggactttgacactcaattttttaggtcgacaaggggtttgctcttgctcctatgtatctccagggaggaaaaaggagaattgagtgatcatttatttgagtatttttactgtcataccctaatttcgtccggggacctttgctcgatgacgtgcgaccattctttggtcctcgtgaggtgcttggcacccatcattaggcaatttgtgaaattccaggacatgccgaaaaaccaaaaaaatattgatgcacaatcccagaggggggtgtacttagtaaaaatgggggtgcaaatagcacccaggcccacttgggccctccggaatattcctccagaaggcggttgcttctggaggaagcaaccctgctcgcctgggcgagctgggcggcaaccacctcccctattttgctataaatag

SEQ ID NO: 53387 - DNA, 681 bp, Glycine max
  Peptide Sequence Number=SeqID_170165
atgttcgaataccgcttcagcggcaacggcgaactggccggccacaacctcggcaacctgatgctgaaagcgctggatcacctgagcgtgcgcccgctggaagcgatcaacctggtgcgcagcctgctgaaggtggacgcggcgctgatcccgatgtcggagcagccggtggatttgatggcgcacgatcacgaaggcaatcacgtttacggtgaagtgaatgtcgatcagctggcccatatgccgcaggagctgatgctgtcgccgccggtcagcgccacgcgcgaagcgctggacgccatcgcgcaggccgacgtgatcctgatcgggccgggcagtttcctcaccagcctgatgccgctgctgctgctggacgatctcacccaggcgctgcgccgcagcagcgccagcatgatctatatcggcaacctcggccgcgagctgagcgtggccgccgcggcgctgtcgctacaggataagctgacgctgatggaagagaagattggccgccggatgatcgatgcgctgatcgtcggcccggcggtagacgccagtgaagtgcaggatcgggtggtgattcaacagccgctggaagcgagcgacatcccctacagacatgatcgccagctgctgcgccaggcgctggatcgggcgctggtggcgctggccgcccgccgctga

SEQ ID NO: 53388 - DNA, 333 bp, Glycine max
  Peptide Sequence Number=SeqID_170166
atggccaaggcaatcggtgaaaccgagcggcgccgcgccaagcagcaggcctacaacgaagccaacggcatcgtgccgcaggggctgaacaagaagatcggcgacattctgcagatcggccagccggtcaaccgcgccaagagcaaaggcaagggcaaggcggcggacggcggcgcttcgctgcagaaccttacgccgaaagcgctggatcagaaaatccgcgatctggaagcgcagatgtacacccacgcgcaaaacctggagttcgagcaggcggctgcgctgcgcgaccagatccaccagctgcgcgagcagtttattgcgatttcctga

SEQ ID NO: 53389 - DNA, 411 bp, Glycine max
  Peptide Sequence Number=SeqID_170167
atgagaggagtgccatcggaggaaagcatcacacctttcatcgcatggggtttcagtgaccccaacgcgagggtacttcaaggagtttgcaaggaatgggatgacgtgcgaaggaaggacaaagagcttaggggaagtagtaatgggatcatcgacggttatcgtaagaggctgagattccacacacaaggtttggattggctcccaaagcaaagggctgcgagaggggaagaagccaaagctccggaagaaagtgaggaggtacaagccctaaaggcggaacttgagaaagcccaggcagtcaaggagaagttcaagtcaacagccatcaaagttcgcaggcagtatgatgaactgaaggatgttggatcaagtggccttagaataattaagaagagggggttgaattaa

SEQ ID NO: 53390 - DNA, 262 bp, Glycine max
  Peptide Sequence Number=SeqID_170168
tgctttgagaggacttgatgatactccacaacctaaatccaaggctggtgctagatggattattgttaagtgtaatagacaaaaaggaaacactgagtgtggccattacgtcatgcactggatgtccacaataatcttaggaagtttcaagaataattgggaaatgtattttaatgatgtcagaccattggaagcagagagattgaaggcgcttcgcatccagtggacacagtatcatctcaaagttagaaatcaaacttag

SEQ ID NO: 53391 - DNA, 417 bp, Glycine max
  Peptide Sequence Number=SeqID_170169
atggagcagcgtggccatggaatgtattatacgccaccaacattttctcagtatccttcgcagatgtatcagtatcctttcgaaggtcatgacactgatatgtctgcaagcgaacattcgtttagtggtgttgcggaaacacatcctcatttttcatggccgaccatgaccccttcgcagcaacatgatgccccaatggcaacacctaatgccccattagttccgcaatggaatgtacccggagcaataactgatatgggtgacttattaggtgttgatttgcgtcacgagttttctgctgaggctgagcaacaagggcggagacagcgcgcaagaagaaatcttgatcgtgaagcccgaaggtggaatcgaccatgtggcacatcctcacaccatcacggacaccataatgactga

SEQ ID NO: 53392 - DNA, 493 bp, Glycine max
  Peptide Sequence Number=SeqID_170170
tgttatggcacgttctccaaacaagataaagagcatcaatggctcaaaagaaagtcttaaactcagtgtgaggatcagtgatctatggtttattggcacgcctaacaaatctgagcaagctgaaatggtgtttgtggactcggatggtgatgagatccacgctatttgtaaacaagaccaattgaaggagtgtgttctaggggacatcccttttagaaaatacaggtttgctggatttgcagatgttgtgactggccagtttgaacatggactattggttgatgttattggtgttgtggaggaggttgtctttcggcaagttttaggaaaaggtagaagggtagttttcaaattaaaggacttgagccagcaattgctatcttgcactttgtgggatgattattgcttgcagtttgtgaagttcttagatgattatgaaggtgatggtccaattacagttctattaagccattgtaggatcaaggaagcgtag

SEQ ID NO: 53393 - DNA, 605 bp, Glycine max
  Peptide Sequence Number=SeqID_170171
atggctaagtttgacccagatatagttttggagttttatgctaatgcttggcccacagaagagggagtgcgggacatgcggtcatgggtggggggtcagtggattccctttgacgcagaggccctcagccagttcctgggtgacccgctagtgttagaggaaggccaggagtgcaagttcagtcagaggaggaacaaggccgatgggctcgacgaagaggccattgcccaactattatgcacaccgggccattgccattcgcccggaccgctgcagggaggcgggtgcggatcatgcacaccatatgaccaccttgacccagatgtggatgacattgctgctcagcaatgtatgccacccaccaggtaccctttagacccagataagtctaacagggctctggggtttccagcattgatcatgggcctctgccagtcattcggggttcccgtcaaacctagtaaggtgatccgaccgccaatcacccaggccttcattgagaagtattgcacgcctaggcaggcacagggtgatgcaccacaggccgcagacgcaccgccaccacctcatcaggttgatcttgctgggtcattagtcatggagcg

SEQ ID NO: 53394 - DNA, 141 bp, Glycine max
  Peptide Sequence Number=SeqID_170172
atgtcaaatgcaagcccaaatgaaagcaattcaaggtatgaggaagtctctagggaagggaacaagctccttatactcgaagcctacaaataccttggttgggaggagcaaggtcgcaacaaaaatagaggtcttttttag

SEQ ID NO: 53395 - DNA, 276 bp, Glycine max
  Peptide Sequence Number=SeqID_170173
atggataatacccatcgatccttgacagacaactggaaacacatagaacttgtgcaacctatctaccaagatgggacatacaccaagaaaaaggatggggaggaccgaatcaaagagcaggaaaaaggttatatgccaaaagagaaacatcaatttgggaatgacacacaaggagaggaaggtttcgtaaaaaagagtcaacatgttctagacaatggtcaacttgcgagggtagattcagaccataatttatgtgaagcagacctgcctaaatag

SEQ ID NO: 53396 - DNA, 159 bp, Glycine max
  Peptide Sequence Number=SeqID_170174
atggcttcagaaaaagctatgggatggtcaatgtcatcagatataggggatcatcaacctcatgatccgacctatctggctcaagcgactttcattcatccaacttcgatccatctaaataataactccgtcatacttcgaaactcattcaatgcatga

SEQ ID NO: 53397 - DNA, 408 bp, Glycine max
  Peptide Sequence Number=SeqID_170175
atgtataatagcataataacctatattggtctccactgcaatgcacattggcaaatggtcatcattttgcctaaggaaaatgttgtcatttggttttgttcgttgcataataggccagacaactacctcaaaggcataattaacagtgctttgaaaggacttgacgatactcaacaaagtaaatccaagcctcctgctaggtggattgttgttaaatgtaatagatcaaaaggaagcactgagtgtcggtattatgtcatgcattggatgttaactataatctcagcaaatttcaagaataattgggaaatgtatttcactgatgctagaccattggaaccagagagattgaaggcgtttcgcatccagtgggcaaagtactatttgaaagttaaaaatgaaacttag

SEQ ID NO: 53398 - DNA, 294 bp, Glycine max
  Peptide Sequence Number=SeqID_170176
atggttcaagaagggcatcttcatcactctgatggtgcactgatgagggtttggtgcgttgatgagagagagcacttccggcaatgcggtggtgaaaaaagtggtggcatggtggtggaaaaatgttggcacaatgatgagggtttggaggtccaaagagtgaacacaaacgcttttctaataagcactgtatataaggtgctatatatcatgaattttggcttagtgattcatgctcctatcaaagaggttgttcttaagcaacaagaaacccctgagtgttatccctgttaa

SEQ ID NO: 53399 - DNA, 202 bp, Glycine max
  Peptide Sequence Number=SeqID_170177
gccccctactaatcgagctttcatcaagaagtactgcggctccaggcaggcgcagggcgaaacaccacagcagcctggggatggccaacagcgggcaatagacgcaccgccatcacctctagagttcacctcagctcatccacaaaaagccatcaagcgtccagctcaagacgttaaagaagcgctactaggaggcaaccta

SEQ ID NO: 53400 - DNA, 409 bp, Glycine max
  Peptide Sequence Number=SeqID_170178
atgctttacggtgccctcatcgaacttgatggagctagagtaatgggtgaagtagaggagatacaagagacgatgaaggccgacatggaggccattaaagagaaaatggccacaatgatggaggccatgatgagcgtgaagaagataatggaagccaatgcggttgcaattgccgctaccagcgttgttgctaaggtgaacccgacgcccccatccggcatcaatgaatcatccaacctcagatatgggcaagcagttggtggtatacccctacaaaaccctttggagggccctcagtatcacccacaactacacctcttgcattccacgacaagtaaaaaccctcatgctatggcagaaatgggaaagttggatcatctagaggaaaggctcagggccattgaaggag

SEQ ID NO: 53401 - DNA, 117 bp, Glycine max
  Peptide Sequence Number=SeqID_170179
gaggttttcggactatggaaagctaaatcctctgttggatcttcccttgggaactggtctgattctaaagtcctcggtagtacgagactaagtcgttgtgctatcacgagggattag

SEQ ID NO: 53402 - DNA, 498 bp, Glycine max
  Peptide Sequence Number=SeqID_170180
atgtgtccttgtctcttgcatctgcctgtgacaggaaaacacattgatcatgttccctccatctttgatagagatgcagtgaagattctactaatgactcaccttggcatattgacagaggaagaggctatgacggtgacaaacgcagctgctagggtgaggttgacatggctagtagagctatatcaccgatacattgagtcaggctccaacctggatgtttgccatgagtacacatggggagtcactacattagcgtacctatacgatcatctctcttatgcaagccagtacaccaacaatcaagttggaaggtatatgacattactcattgaaatcatgggttatgtgcatctgcctagtgttggctattcagaacatgggaccggtgctctagatgatccaatagccaatagatggaagccaaccaaaggtttcaggttcactcatctaataagggagaagctagataagttgaagatggatgttgtcatctag

SEQ ID NO: 53403 - DNA, 207 bp, Glycine max
  Peptide Sequence Number=SeqID_170181
atggcttcctatggtggtgagtttgttcttgactcatcttgtccttggagtggtgtctccaatcacgtttcttccttctccattccactaacattgatcttcgagaagcaaaggactccattgatgaagaagacccaaggcctacaagcttcacatggagctacatcacctctaatagctaagctcaccctatgccaaaaaacatga

SEQ ID NO: 53404 - DNA, 246 bp, Glycine max
  Peptide Sequence Number=SeqID_170182
atggccaaaatacaaggtcaaaaagaaggaaaacctattctaatatttacaatgaagagtggacccaacattggtccatgggctcataaatctaccctgaggttcatgagaatcctaggtgatgcaatcctacccccaagggcattggaaagaagactccaagaagattgggccagagatgcagaagaatgccctagggttctcatgagccttagagtagattttgggcccatgagcgaagtatga

SEQ ID NO: 53405 - DNA, 1478 bp, Glycine max
  Peptide Sequence Number=SeqID_170183
atgccggttttccgcctacgcaaccgagttgaccgcatgtcatccaacgccgccccggcccgtatcgccatcgtcatgggttccaaaagtgactgggctaccatgcagttcgccgaggaaatccttaacagcctggatgtcccgttccacgttgaagtggtctctgcgcaccgtacgccagataagctgttcagcttcgcagagcgcgcagccgacaacggttttcaggtgatcatcgccggtgccggcggtgcggcgcacctgccaggtatgctggcggcgaaaaccctgctgccggtgctgggcgtaccggtacagagcgcagcgctgagcggcgtggacagcctctactccatcgtacagatgccgcgcggcattccggtcggtacgctggccatcggtaaagccggtgccgccaacgccgcactgctggcggcgcagatcctggcgattcacgatcgcgagctggctgcacgcctggccgcctggcgtcagagccagaccgatgaagccggcgagccgctgggcatcgccgtgtatccggtcgggctggacgcggagccgtcggcactgccgatcgcgcaaagcgtaatcaccgcggaaatcgagcgctggccggaaaccgcgctgacgcgcgagctggctaaccatccggcgttcgtcaaccgcgatatttttccgcgcctcgccgatcgcctgacgcaaaagcagctgctcgaccagctcaacctggcaaccgcgccgtggcagttactggctgataaaagcgagtggccggcggtatttagcacgctgggcgagctggcgatcgtcaagcgccgcaccggcggctacgacggccgcggccagtggcgcctgcgcgccgacgaaaccgcaacgctgccggatgagtgctacggcgagtgcatcgttgagcagggtattaacttcagcggtgaagtctcgctggctgatgccgcaaaacaacatcagggagaagcgatgctgagcgcgatcatgcatgagctgaagtacgtgggcgtgatggccatggagtgtttcgtcacaccgcagggcttgctgatcaatgagctggcaccacgcgtgcacaacagcagccactggactcataatggcgcctcaatcagccagtttgaactgcacctgcgtgcggtgctcggtctgccgctgccgcaaccggtggtgtttgcgccgtcggtgatggtcaacctgattggcaccgacctcaataccgactggctgcagctgccgctggtgcatctgcactggtacgacaaagaagtccgcgccggacataaggtcggccacctgaatctgaccgacagcgatccggcacgtctcaccgccgcactcaatgcgctggtaccactgctgcctgatgcctatgcgagcggaattgcatgggccgtggcgaatctgtatttctgcggtgttcccctcacccttgccctatcccacaagggagaggggattatagg

SEQ ID NO: 53406 - DNA, 462 bp, Glycine max
  Peptide Sequence Number=SeqID_170184
atggataagattgatcgcaagattcttgctgaactgcaggccgacggccgtttgtcggtgaccgagctggccgagcggatcgggttgagcgtatccccctgccaccgccgggtgcgggcgttagaggaatccggggtgatcagaggttaccgcgcccagctcgatcccggcagcctgggctataacttttccgccctggtgttcgtcaccatgcgcgaaggcgatcgccgcgccgttgaaactttcgaaaacgccatgatggacattccccaggtggtgcaggcgcagcggctgttcggcgatcccgactatctgctgcacgtgatcgcccgcgatctgcccgcctttcaacagctttacgacgagaaactctccgctctgccgggcgtgcagcgcctgagctccaccctggtgatgaaaaccgtagtgccggagcgttcattcctgccgctgggaaaatga

SEQ ID NO: 53407 - DNA, 243 bp, Glycine max
  Peptide Sequence Number=SeqID_170185
atgtgctcctcaatcataagaataactacttttaagtttgaaaacgtgactgcaacaccatccacagtggattgtaggcaaaagggagcagttacacccatcaaggaccaaggtcaatgtggatgctgttgggcgttttctgccgttgcagcaaccgaaggaattcatgcactgtcagctggaaaattgatctcattgtcagaacaagaacttgttgattgtgacacaaagggtgtggactaa

SEQ ID NO: 53408 - DNA, 473 bp, Glycine max
  Peptide Sequence Number=SeqID_170186
atgaaaatctctgtgctcgccctgctgacgggtatggcgctaagcggctgtgcgccgcaccaaaccaattcctcttctcctgctgtgcaacctctcgcgcaagtggcgcaatccgacagcgtcgtcaaacgccaactggcttatggcttgtatgaaatggcgctgacgccagggggagatgcgctgtacgtcgccagcgccgaaagttttaaagatgtgcagggcggcgtggtctataagctggacgccaagaccctgaaaacccttggcacgacgcataccgacctgaaaaatttcgccatgcaggccgctgcggatgggaaaaccctttatgtcagcaattcgctggacggcggcatcagcgcaatcggcgccgccgacggtaaggtgaaagggcgtttgctgttcagcgagcgcaatgagaaagggttgccgtatggtgcgcgccaaattctggctcacgacaacacgct

SEQ ID NO: 53409 - DNA, 1020 bp, Glycine max
  Peptide Sequence Number=SeqID_170187
atgccgatttcaggcaagcggggccgttctttttccacgaggaaagcgcaatggttctctgttcagtgtggcgcagcgcgtttgagagggcggcggtatgacgctcgctctgttcgccgctttttgggcggtatcgattttgttggtgatcacgccgggtatggattgggcctatgtgatctcggcgggcattcgcggccgggtggtggtgcccgccgtcgccggcttgctgtttggccatttgttgatgattgcgatcgtagtggcgggcgtcagcgcgctgctggtcggcaacccgctggcgctgacggcgcttaccttgctgggagcggcttacctcttgtggatcgatcagcgttccgactcctggctgcgctgggccggcaagggcgtgtgcgtcagcggcctgaaccccaaggtgtttctgctgtttttggcgctgctgccgcagtttaccgacgcccgggccgaatggtcggtgccgatgcagatgctggcgttgggcgtcgtgcatttgatcagctgcggcctggtgtatctgctggtgggattcggatcgcagtcggtactgcgcacgcgcccacaggctgcgaaggtggtggggcgcatctccggcgcggcgatgatcgtcatcgccctcgggctgctggccgaacaggcgctgaaatagcattaccgccgatagatgtccggccgggcgatctgccagacaaagtcggggcggttgatggcgctatagcccactttttcatagagccagggggcggtgctggtgaccagcatgactcgccgcagcgtcgccatcagcggatgggcctggcagcattccgccagccacagacccagcccgcttttttggtacgtttccagcacgtacacgtcgcacagatagccgaaagtggcgtaatcggtaaccagccgggcgaaaccgatctgcctggcgccgtgatacaaaccgaagcacaggctgtgggcgagggactggcggacggtctctttatcaatgccttccgcccatga

SEQ ID NO: 53410 - DNA, 1056 bp, Glycine max
  Peptide Sequence Number=SeqID_170188
atgacgcaattacagattccggacgcccccaatggcaatcccgccagcgccgccggtggcgaggtgccgctacacggctgggccaccgccattattctcatcgcgacccattatcgcctgccgtgctcgccgggcatgatcatggctgccagcgaatggcagggcaaacagtcacgtgataaagcactgcgccatctggcgcgtcaggccgggctgtcgctgcagctgtatgaagagcatcagtgggagatcagcagctggcgcttgccgctggcggtggaactgagcgacggccaggttggcgtcatcaccagctttgatggcgatgacacggtgcgcgtgcacctggccggcgatgaacaaccggcgccgatcgcgctgaacacgctgctgccgcagatccgctacgccgcggcgctgcgtccggtgacggccgccaaagatagccgtgtcgatcgctatctcgccacggtcaggcccgactggctgcgtcgtctggtgctgcacgacatgcgtccttacggctacgtgatgctgggatcgttcctgatcaacctgctggcgctggtcggcatcatcttctcgatgcaggtgtacgatcgggtgatcccggcgcagtcgtaccccacgctgtacgtgctgtatatcggggtgatcctctcggtggtgttcacctatattctgcgcgtcggtcgcgatcacgtcaccgatctgctcggcaagcgcgccgatatgcgcgtctccgatcgcgtgttcggccacgcgctgcggctgcgtaacagcgcggtaccgcgatcgaccggcacctttatctcgcagctgcgcgagctggaggcggtgcgcgaaatggtgacgtcgaccacggtgacggcgatcgtcgatatgccgttcttcctgctgtttatgctggtgatggcgatcatcgcgccgcagctggcgtggatcgcgccggtggcggtgctgctgatgatcctgcccggcgtgctgagccagaaaaaactggcgaagctggcgcagcaaaacctgaaagagtcgacgctgcgcaacgcggtgctg

SEQ ID NO: 53411 - DNA, 150 bp, Glycine max
  Peptide Sequence Number=SeqID_170189
atggacacggatgactttttttggtcaacttttttggatgagtcttccaaggattgtgttgccttctctaacttttcttccttttccagcgataagtggcttaaaggtgtaaatgcacagtccttccaagcgagcaactcaaaggtgtaa

SEQ ID NO: 53412 - DNA, 340 bp, Glycine max
  Peptide Sequence Number=SeqID_170190
atgagattttcgtcagacagccgccgggcaaaaaccggtagcatggccgatatcatcccaaacgccgtagggaaaaaagatgaacaacaaacccgtcttctccctgctggaagccatcgagagcttcatcgaacggcaggcgctcagcgaaagcgaaatcgcggcggcggacgacgcgctggatctgataagcgtgctcacccatcggtcatagtgaaaaacgatcccccggtgacgaagaaaccgacggcccatcacatgtgggccgccgtcgtttctgtatcgcttagaagtcgtaagttaccgacgctttcagcgttctcgcctgtccctggaagac

SEQ ID NO: 53413 - DNA, 342 bp, Glycine max
  Peptide Sequence Number=SeqID_170191
atgacgccgggctgcaccgtgcaagcctgcggcctgcgggacaacatggacgaattgaaaaaggccggcgtcgaagtgctgggcatcagcaccgacaaaccggaaaaactgtcgcgcttcgccgaaaaggagctgctcaacttcacgctgttgtctgatgaagatcatcaagtgtcgcaacagtttggcgtgtggggcgagaaaaccttcatgggcaagacctacgacggtattcaccgcatcagtttcctgatcgacgccaaaggcaagattgaaaaagtgtttgatgatttcaaaaccaccaatcaccacgacatcgttttgaactacctgcagcagtaa

SEQ ID NO: 53414 - DNA, 351 bp, Glycine max
  Peptide Sequence Number=SeqID_170192
atgcctgaacaaacattaggttgtcaggtgggtaatttggtggccactaactcagaaggtgagaaaataatgggttttcgcatagcaggtattgttaggcggacttcgttttatacaacccaagcagcctccaagagggttgacgtaccaaaaggctatgctgcagtctatgttggagataagatgagacggttcacaattccagtatcatacttgaacgaaccttcatttcaagaattactcagtcaagcagaagaagaattcggatacgatcatccaatgggtggtcttacaataccatgcaaagaagaggagttcctaaacgttaccgctcacttgaatgagctgtaa

SEQ ID NO: 53415 - DNA, 1224 bp, Glycine max
  Peptide Sequence Number=SeqID_170193
atgcgttggcaagggcgtcgggaaagtgacaatgttgaggatcgtcgcgggcaatcttcaggtttgggcggcggcggcttccgcgtgccggtgcgcggcaagggcggcatcgtcattctggtggtggtgctggtggccggctattacggcatcgatctgtcgccgctattgaacggcggtaacgttgcgccgcaggggcaacaacagagcgccaacatcagtccgaaagatgatgagctggccaaattcacctcggtggtgctggcctcgaccgaggacaactggaaagagattttccagcgcatgggcaaaacctaccaaccgccgaagctggtgatgtatcgcggcgtgacgcgcaccagctgcggcaccggtcaggcggcaatggggccgttctactgcccgggtgacagaacggtgtatatcgatctgtctttctatcaggacatgaaaaccaagctgggcgccggcggtgatttcgctcaggcctatgtggtggcgcacgaagtcggccaccacgtgcagaacctgttgggcatcgagcccaaggtgcgccagatgcagcagggcgccagccaggcggaagtgaaccgtctgtcggtgaaaatggagctgcaggcggactgtttcgccggggtgtggggcaaatacgccgagaagcagcagatgctggaagagggcgatctgcaggcggcgctgaatgccgcgcaggcgattggcgacgatcggttgcagcagcagagtcagggtcgcgttgtgccggacagcttcactcacggcacctcgcagcagcgctacacctggtttaagcagggcttcgacagcggcgatcccaatacctgcaacacctttgcatcccgcacagcggctggcggcgacgctgccgggcgactggccgtgggtgggggaaaacccgccgcccggcctgacggcgttggcgagcggcgcggtgcgccaactgctggggcaggaacggctgcacgcggtgttcgacgccggccaatcgctggacgtggaggcattggcggcgctgtgcggcgcactgcgcgccggcagctggctgctgctgctgacgccgccctggcggcaatggcctcagctgccggacggcgacagcctgcgctggagcgattgcccacagccgatcaccaccccgcatttcattcaccatctgcagcagcacctggccgacgaccgagaagtgacgatctggcggcaggatga

SEQ ID NO: 53416 - DNA, 1237 bp, Glycine max
  Peptide Sequence Number=SeqID_170194
cgattttcccgtcgaccactccgacaggaaaagggactcgcgccgggagagctgcggcggctcggtatagtgactgtagcgcgtatataaatcgccgatcaggttttggggttggcatattcatcgcggtaacgcgcttcaaaattggcgagggtgacatcgataaagcagacccttctgcggttaaagtcggctggcgcgccgtccgcatacaccatgccggtggtcaaatcatgaaagccgtactttttatagaaggccagtttttccggcacggaatagatgaaaatcttgccgagcggcgccaaatcttgcatcacccggtccatcaaccggcgccccagcccttgcccctgaaagcgcggatcgatcgccacgtcggccagataagcgaccgaggtcaggtcgctgatggcgtgcgcggtggcgatcagctcgtcgccgataaacccccaatagcaaaactgactgtgttggtaaacgcgctgcagggtgtgcggatcgcgcttgcccagcccggcggcctccagcaattcacacagccgctgccagtcgatggcgcggcggttcgggtcggtgataatttccatcgtttttctctaaccaataagactgaggttggcggcatagtgccgaatggcgcgctgatacccgcagatgaaactggaaagacttcattgatgagatgttgggcaactgacacagcgttgaagcagatggcaaggttgagtcattggaaagtcactgaaacaccttgggaacgagattatcgctatcactccccggcggccgtcgtattgcctgccggatgcgctttgcccgggaagcggcggcgcaccagcacgaagaacagcggcacgaagaaaatcgctagcagggtggcggagatcatgccgcccatcaccccggtgccgaccgcatgctggctgccggaaccggcgccgctgctggtggccatcggcagcacgccgaagatgaacgccagcgaagtcatcaggatcggccgcagacgcatgcgtgatgcgtcgagcgtcgcggacatcagatcctgccctttgtggttcagctcgttggcgaattcgacgatcagaatggcgtttttcgccgacagcccaatgatggtggcggcgaccgcgccgatcacccccagcggcaccaccagcatcaccgagaacggtatcgaccagctttcatacagcgccgccaggcacaggaacaccaccagcagcgagatggc

SEQ ID NO: 53417 - DNA, 339 bp, Glycine max
  Peptide Sequence Number=SeqID_170195
atgtggttcatagtactttatgatcatgtattcagtattggttttcttcttacttccaaaaacttattcagagctgtcaatctggtcggcttaaggtttactggttgctatcggtcacatgcttacaatcatttgaagaagcatgtgagatgtcttaagcatatccaccattggattagccataccacgatgcctgaacaaacatttggttgtcaggtgggtaatttggtggccactaactcagaaggtgagagacctctgagacaataccatgtgatcctttctccctcagtagaccccatcatggcccactgtgcagttggattgcagaggtcctag

SEQ ID NO: 53418 - DNA, 270 bp, Glycine max
  Peptide Sequence Number=SeqID_170196
atggcacaaaagaaaaagctgcgtgtttctcctctcgacgagccacccattgcttcctctttcgatttcaaggaagaagagccacaacaacaaaaaccatcctcccaaaagcatgaagaagagaaagacaaagaaatttcctctgcaaaagaagaagaagaagaagacaaagatctcccaccaccactagtttccaaaaaccattcaccccctcccacaaaccttcagccccaacactcttcctccgaatcaggatttgagaccgaataa

SEQ ID NO: 53419 - DNA, 540 bp, Glycine max
  Peptide Sequence Number=SeqID_170197
atgtggttcatagtactttatgatcatgtattcagtattggttttcttcttacttccaaaaacttattcagagctgtcaatctggtcggcttaaggtttactggttgctatcggtcacatgcttacaatcatttgaagaagcatgtgagatgtcttaagcatatccaccattggattagccataccacgatgcctgaacaaacatttggttgtcaggtgggtaatttggtggccactaactcagaaggtgagaaaataatgggttttcgcatagcaggtattgttaggcggacttcgttttatacaacccaagcagcctccaagagggtggacgtaccaaaaggctatgctgcagtctatgttggagataagatgagacggttcacaattccagtatcatacttgaacgaaccttcatttcaagaattactcagtcaagcagaagaagaattcggatacgatcatccaatgggtggtctaacaataccatgcaaggaagaggagttcctaaacgttaccgctcacttgaatgagctgtaa

SEQ ID NO: 53420 - DNA, 318 bp, Glycine max
  Peptide Sequence Number=SeqID_170198
atgggatttcgtttacctggcatcagaaaggcatcaaaagcggcggacgcaccaaaaggctatcttgcagtctatgtcggagagaaattgaagcggtttgtgattcccgtatcatacttgaaccaaccttcattccaggacttgttgagtcaagctgaggaagagtttggatatgatcatcccatgggtggcctcacaattccttgcagtgaagatgtcttccaatctgcaaggtccgaagcacacgaggtaccttccctgccgaagcaggtgcaaaatacagttggacgtaacaccgaggtttattttcttccttga

SEQ ID NO: 53421 - DNA, 306 bp, Glycine max
  Peptide Sequence Number=SeqID_170199
atgggtttccgtttacctgctgttcgacgggcatcgttcacggctagccaagcagcttcaaaatctgtacaagttccaaagggctatcttgcagtgtatgttggggagaaacaaaagcggtttgtggttcccgtatcatacttgaatcagccttcattccaagatcttttgtatcaagctgaggaagagtttggatatgatcatccctcggtgacctggactttggctcaagctcctactataactcttgcttatgctacaactcgtgcttatgctataactcctacttctgttgtggcttcttga

SEQ ID NO: 53422 - DNA, 438 bp, Glycine max
  Peptide Sequence Number=SeqID_170200
atgggttttcgcttacctggcatcaggaagacatcaattgctgcaaaccaagcatcttccaaatctgtggaggtgccaaagggctaccttgtagtctatgttggagacaaaatgaggcggtttcttatccccgtatcatacttgaaccaaccatcctttcaagatttgttgaatcaagctgaggaagaattcgggtatgaccatccaatgggcggtctcacaataccatgcaaggaggatgagttcctaaccgtcacctctcacttgaatgacctggaaggccacccatgggatgatcatatccaaactcttcctcagcttgactcaacaagtcctggaatgaagggacatcagataggagtcatgggaccaaatgagagacatggcatatggggtgttgtcttagaggactttcttaagaatcaacgtaacaagtga

SEQ ID NO: 53423 - DNA, 405 bp, Glycine max
  Peptide Sequence Number=SeqID_170201
atgaccactcaactaaaattgagtaacgtgaaggtaaaatgtttatactcacctttattatcattcaagtcaatctcgccatgggatagaaagtatagggatcgatcatactgtagatcaccttatgcatcaagaagccgcaacaaaagtaggagttatagcttaagcaatagttacatccacacacctccactgttgggatttgcaaagaattgtctgtggagggagaaatatgcatcgcacgaagcattacaaaatggaggcttcaatcccttctctttctctctaacgtttgggaactctatcagagcaatcagaggaaaaattgaggaatctcagaaaattgctagagatgccgctatcgctgtcggaagacacgtgatcccgcttagaggtaagggatga

SEQ ID NO: 53424 - DNA, 735 bp, Glycine max
  Peptide Sequence Number=SeqID_170202
atggctcagaaacttacatgcagtgaaaaattgcagtgtactgttttagatgtggaggtagtagaagaccatggaactactattgattttgttttagttaatggtgttcttcacgaagtagaacaaatagttgtctgcggaatgccggcaagggccaattgtcaccacaatccaagctttattggcacctcatccaataaaggaactctgtgtcaaggcagagggagtgcagtatgtcttaaaggtctcaactcagcaatgatggtcttattttggggaacatatctgcatcacaaaaaaatcaaagctgcaatgggtgtaaaaatcactgcccaggggcttgaacatgccattgctggcactgatttgattggaactccaatctgcattccttccagagagttcattgatattggtcgcgttgcctccattgagaataaccatctacctgttgattatgcaaggaaggggcagaaagtagccattaaggaagcaaaaagattataccttttgcacaatgttgaaaaggaaaaaagatcattaataaaaattagcgtacccccgtgccagaaggcacctcatagtcctcgctatgcgaagataccagggcgggtcattgtaggcatgcaccttttgctttcatatgcaaaaagccaccttgctgttatgctccaatttcttttacagattgttggtagcaatcctggacttgatgatcctcttctagaggattga

SEQ ID NO: 53425 - DNA, 292 bp, Glycine max
  Peptide Sequence Number=SeqID_170203
atgaacaatgcgcaaacccacaccaatcgtggttgtggtggaggcggtggcttcggtggtggtggtggaggtgacggcggtggatacagtggtcgtaggagggagacaagggaggagccaaggggtacaagagtccttaagaactttcttgaggatggtctgcagtacgttgttacctacactgagcacgttaagaggaagacgggtaccacgatggatgttgttgccgttctcaagaggcaatgtagggtggagtggtgctacgagcttcctcgtagtgtctcctctactg

SEQ ID NO: 53426 - DNA, 150 bp, Glycine max
  Peptide Sequence Number=SeqID_170204
atggatacggacacgggaaggaagaaaccgagagagaatgagaacctcggctccccgatgttgtgtatcatgggtcacgtagataccggcaaaaccaagctcttggattgtattcgtggaacaaatgttcaggagagggtgaggctggtg

SEQ ID NO: 53427 - DNA, 378 bp, Glycine max
  Peptide Sequence Number=SeqID_170205
atggatcctaacttcaaagattataattaccgaagtcctcttcgcattgctgcagctgaaggtttatattttatggcaaagttgctattagaaggaggaactagtgtttttaccaaagacagatggggaaatacgacacttgaagaagctcggatgtgtggaaataagaacctaatcaagcttctagaagatgcaaaatctgctcaacagtcagaattcccatcccaagaatatacagaccaaaatgcatccaaagaagtgcacaatggattgcataacaaacttggaccagggatgctgagctggcaacctgtcattggagggagaagatcctgtctgctagaatccaaattctgttattgcttccctgctccatag

SEQ ID NO: 53428 - DNA, 162 bp, Glycine max
  Peptide Sequence Number=SeqID_170206
atgaagaaagccctatcggacagtgtggatttgatccaaaggagaacaaggcttaggttggaggtgttgttattagcaagtgtcaagagagaagagcttgagttggccatggatgaagatgaacgtgaaaaaaattgtggctctgataccataaagaaatga

SEQ ID NO: 53429 - DNA, 426 bp, Glycine max
  Peptide Sequence Number=SeqID_170207
atggcatggactgccattgataaaacctttcaagcccaaaccagagctcgtcgtatggctctaaaaccacaactccaaacccttaacaaaggttctctttccatgattgagtatattgagggtaaacgctccattgcagattcccttactgaaaatcttcaccccatatcagatgaggatcttgttggttatctcttgagtggcctagactcttcttatggtcctttttccactgcctttatgatgaaggatgcttatgcctcagttgatgatcttgctggcctgcttcttgaatataagagagtttcatttctttatgagcagaaattctactctatggatcctagcgttcgaggtctaggtttccagctcagcatccctggtccaagtttgttatgcagtccctctagcattgaggacgtgtga

SEQ ID NO: 53430 - DNA, 192 bp, Glycine max
  Peptide Sequence Number=SeqID_170208
atgactctttttttttcagatgatcgtgaaaagtttacgaaagatagtgtgcgtgagcaagaggaatatgttagctatttaggtgtaacttattggaaacctatgttcctaaccgcaacaggcgccagaaattgtgggttaaccaggcatagagaaattccaaaggttgtgagttgtaagaagtctttgtaa

SEQ ID NO: 53431 - DNA, 4530 bp, Glycine max
  Peptide Sequence Number=SeqID_170209
atggctgattccggcactgatcgagtcgaggccgccttagaccgcctcacttcgcgcattgaagacctccttcagcacgtgaccccttcaccatcaccaccctttccctcttgcaaccccgttcctgcacagacacacagaatgaagttagatgtccccagattcgatgggactgatcctatgggctggatttttaaaattacacagttcttcgagtaccacggtactcctaatcaggaccgcatcaccattgctgctttttatatggagggaagggcccttgcttggttccagtggatgtcaagcaacggccaattcacctcttggtccgtattcctacaggccttgcagacccggtttgccccatccaactacgaggatccctcgggatctctgttcaaacttactcagcgaaccacagtgacagaatacttatctgaatttgaggagcttgccaacagggtcgtcggactcccaactccatttcttctcagctgctttgtttccggacttgcgccggacattcgccgcgaagtcatgatcaaccagccgctcacggtggctcaagccgcaggtctcgcgcgcctccacgaagagaaattgcgtgacctccgcttcgattttcgccatcctacccgccctcgaaccccccaaccaccacctatagtctcacagcaccctccgacactaccctcgtttccctctccacgcgccccctcactttcccctttacttccattacccccacgtactaacccaccaccgccacctacattccgtcgcctgaccccggaagagctagcctcgcgtcgggagcggggcctctgcttctcttgtgacgaaaagttccacaaaggccataggtgcgcccctagggttcaccttctgatagcagacgaggaggaccccgtggagcacatgggttctaatatagacccatcagtccctattgacccgggacccggcccaatggaaatacccgactccccagcccatattagcctcaactccttagcgggccatttagcccccgagaccctccgactcgtcggcgacatctccggcatccctgtcctggtcctcatagacggtgggagcacccacaatttcctccaggagcagcttgtggttcaattgggccttacctctcatcccacctcaccattaaaggtcatggtcggaaatggacagtaccttcagtgtcacacgatttgtgactccgtcactctcatccttcaacagcactcgttcacagtggatttctatgtgcttccaattgccggcgctaatgtcattcttggtgtccaatggttgcaatcattggggcctgttttaactgattacactcaccttagtatgcaattttttcatgatggcaggttagtcaatttacaaggggacccagaggctcatcgtggcctgttatcttctccacagttccggcgagcttgccgcactcaaaaccagagtctctacttccacatcaccatgcttccaaacgacttagactccccgttgaccagaaccgttgaccctcaggtacaacacctccttcaacagttctccatcctctttcaggagcccaacgcccttccgccggccagggacacggatcatcaaatccacctaagaccccatgccactccagtcaatgtccggccatataaatacccctattaccagaagcgtgagatcgaaactcaggtggaaacaatgcttcaacgaggaatcattcaacccagcaagagtccattctcctcgccggttttattggtcaagaagtccgacaacacatggaggttctgcgttgactatcgtgcgctgaatgccctcacaatcaaagatcgttttccaatcccaacgatcgatgagcttttagacgagctaggcggtgctagttgcttctccaagctggatttgttgcaggggtatcatcagatacgcatgcaaccggatgacatccccaaaacggccttccgcacgcatcacgggcactttgaattcaaggtgatgccctttggcttgtgtaacgcgccttcatctttccaggcgactatgaacacgcttttccgaccgtatctccggcgttttatcatcgttttcttcgatgacattctcatatacagcgtctctctcagtgatcacctgcgtcacttacaaaccacctttcaggtgctttatgagaatcattttgtgcttaagctctccaaatgtctctttgctcaacccgaagtcgagtatttaggccacctggtttcatacaagggcgttcaacctgtcattgcgaaactcgatgccattgctcagtggcctcaacctcgatctgttcgcgctctccgaagtttcctgggccttgccggcttctaccgcagattcatccgcggttacgccaccatcgcggcaccactcgtgaaggccactactgttgaaccccttcaatggacttcctcaacccagactgcttttgaaaccctcaaacaagctctcacctcagccccggttctcactcttcccaacttccaatttccttttaccattgagactgatgcatccgcaattgggatgggggctgtcctatcacaacagggccacccaattgcttatttcagtaaaccctttagccagaagatgctccgcgcctccacttatgtccgcgaactgtttgccattaccgccgccgtgaagaagtggcggcaataccttctcggacatccttttaccatcttgaccgaccaccgtagcttgaaagaattaatgactcaggtggttcaaacacccgaacaacacacctatcttgctcgattgctgggttatgactaccagattcagtatcgttccggtagccataatcaggccgcagacgcgctttcacgcttgccggaaaatgcttttcaagccctactcatcctctttgtcccatgtctcacttttttggaagaacttcatgcccaacttggtgccaatcattcctttcagaacatgttgcaggaggttcagcaccaccccgacactcaccctgatttctctatagccaacaagctattattgtataagggtcgcatatggttgccgtcggacttacccataatccaaaccttgttgacggagtatcacgccactcctacggggggacacgccggtgtagccaagacggtagctcgtctcacaaccaatttcttttggaatggccttaaggatgatgtcacgcgtttcgttgctaactgcgtcgactgccaaatcaccaagtatgagactaagaagacagctggccttctctgcccccttcctgttcctagtcaaccttggtctgacttgtccttggactttatctgcggtcttccaccataccgcggcaacacaacgattcttgtcgtagtggatcgtttctccaaaggcattcacctgggcatgttaccccagagtcactcagctctcgccgtggcgcgcctcttcttggacttggtggttaaaatccacggccttccccggagcatcgtctccgaccgagaccctctttttgttagtcatctgtggcaggaactattcaaattaagcggcacccaactccgactgagctcggcctatcatccccaaagcgatggacagactgaggtcttaaacagagtggtggaacaatacttgcgtgcttttgtccatcggaaaccggcaagttggggcagattgcttccatgggtcgagtggtctcacaatacctcatggatggcgaacaccggcaccaccccttacgagatcaccttcggccggaagccttttaatttcccagattatattgcgggaacttccagggtcgaggccgtggaggagattttaactgatagagacgccaccttccaattgatccgcaagaagcttttaaaagctcagagcaagatgaaacactatgttgatcaacaccgcagagatgtccaatttgccgtcggagattgggtcttggtccgccttcgcccatatcgccaatattccgcgaaggagccgcaccgtaccggagagaaactagctcgccgctactatggtccttttaaagttgccgccaagctcggacctgtcgcgtatcgtttggaactcccagaaggggtacgtttacaccccgtgtttcattgctcaaagctgaaaccatttcgcggggacccggaactatcgtcaccaccttccctcccacccactttccatggaacccaacctctcatttctcctttagctatcctggcgtatcgtcgcgcgaccactgatccccacagcccatggcaggtcttggtacagtggcagggcctgtcaccagaggagacatcatgggaagactggcagcagctttgccaggactatcaccttgaggacaaggtgatcctgcaagggccgagggatgatacgggtgcaggaaacatagagagtgataaagaaggtgctgaggaagaagagcagaagaggagggaagaagaaagggaggtgcaagaagaaggaaggcccaaaaggaagatcctgaagcccaagtacttaaaggattacgtttaa

SEQ ID NO: 53432 - DNA, 1032 bp, Glycine max
  Peptide Sequence Number=SeqID_170210
atggttgccaaaaaacatttcaatcatatttcattggcaatgcttctctgcatgacattcttggcttttcaagtcacatgtcgcactcttcaagatgcatccatgtatgagaggcatgagcaatggatgactcgttacggcaaggtgtataaggaccctcaggaaagggaaaagcgtttcagggtatttaaggaaaacgtaaattacattgaagccttcaacaatgccgccaataaatcttacaagctaggcattaatcaatttgcagacctgactaacaaggagttcattgcacccagaaatggattcaaggggcatatgtgctcctcaatcataagaacaaccacttttaagtttgaaaatgtgactgcaacaccatccacagtggattggaggcaaaagggagcagttacacccatcaaggaccaaggtcaatgtggatgctgttgggcgttttctgccgttgcagcaaccgaaggaattcatgcgctctcagctggaaaattgatctcattgtcagaacaagaacttgttgattgtgacacaaagggtgtggaccaaggttgtgagggtggtcttatggatgatgctttcaaattcatcatccaaaatcatggactcaacactgaagctaattacccatataaaggtgttgatggaaagtgcaatgcaaatgaagcagccaagaatgctgctacaattactgggtatgaggatgtccctgccaacaatgagatggcactgcaaaaagctgtggccaatcaaccggtttctgtagctattgatgccagtggctctgactttcagttttacaagagtggtgtcttcactggttcatgtggaactgagttggatcacggtgtcactgccgtgggatatggtgttagtgatgatgggactgaatattggttggttaagaactcgtggggaaccgagtggggtgaagaaggttacattaggatgcaaaggggtgtggattctgaggaaggactgtgtggcatagctatgcaagcatcttaccctactgcataa

SEQ ID NO: 53433 - DNA, 330 bp, Glycine max
  Peptide Sequence Number=SeqID_170211
atgtcttccactgcttcttctactgcttcaatctgcgccacttccagaactactttctcatcgaagcacgtcgcgagaagctgcttcgtcgccgttcccaatcgcgcgttctcgaagctcaatttcagattcaaacccgtcgctatggctacgctcggcgctcgcatggtggccgctgcaccctctgttactcctccggcctcgcttgacttcgaaagctccgttttcaagaaggagaagattaacctctctggacacgacgagggacctgctcaggcgcagaatttgcgggactcgcttgctgatgcaaagtctgatattgtggttaag

SEQ ID NO: 53434 - DNA, 1122 bp, Glycine max
  Peptide Sequence Number=SeqID_170212
atggctctgtcttcgccacttcagaacctctctgcactcatctccgccaaaggcaatgccaccgccgtcgccacaccccggccgccgagagggcggccctgggcggttcacgcggcggcgtccgacaccaccgcctctgcgtcggtgcaaatgggtgagtacgaagaagggaagctggagcgaccaaagtgggttggggagacccctctttcacgtctcgttcaagctctcatctccttcaagcctttctactctgttctcaagcttggtgctagaagggctttgataagtacagctgagaagaacaacataccttggaggcaaatggcgaaagagattttagagtcagaagtttatagggagctggacaacattcaaaaccagtctttagtgtaccctgattattatttgaatccattccatgcatatgatgagggcaatcttacatggctggcggcagcagaagcagaggctgctacattgtcaatagctaaacgagcaattccagatgcttcttcaacgcaggaagcaaatcagatactgcgtggcaattggcttcgtgcaattgaacaacaccatatgcagtattcagaatcatctgtgatcaatgacattctagatattggatgctctgtaggtataagcacaagatatcttgcagacaagttccccacagccaaagtcaccgggctagatctgtcaccctattttcttgctgtggctcagcataaggaaaagaatgcaccgcctagaaaatttcctataagatggatacatgcaaatggagaagacacgggcctgccttctaaatcattcaaccttgtttctattgcttttgtggttcatgaatgtcctgcaagagctatagtgaatttagtgagggaagcattccgtctccttcggcctggaggcacactagctttggtagattctacgacaaagtcaaaggtccttcaggaattgtctcctgtcctgtttacattgcttaagagcacagaaccctttctggatgagtattacttgactgatatggatgaaacactgagggaagctggttttgggaacataacatcaatccttacggaccccagacacgtgacaattactgcaacagtgccttaa

SEQ ID NO: 53435 - DNA, 327 bp, Glycine max
  Peptide Sequence Number=SeqID_170213
atggctctgttgtggccaattcagaacctctcagcagtaatctccaccagcggcaatgccaccaccgccacgtcctggccgccgagagggcggcactgggcggttcacgcggcggcgtccgacgccgccgccgccgccgcgtcggtgcaaatgggtgagtacgaagaagggaagctggagcgacccaagtgggttggggagacccctctttcacgtctcgttcaagctctcatctccttcaagcccttgttctctgtcctcaagcttggttctagaagggctttgataaggttcctacccttcctcactttacttattcattggtaa

SEQ ID NO: 53436 - DNA, 669 bp, Glycine max
  Peptide Sequence Number=SeqID_170214
gtagcagcagaagcagaggctgctacaatgtcaatggccagacgagcacttccagacgcttcttcaatacaggaagcaaatcagatactgcatggcaattggcttcgtgcaattgaacaacaccatatagagcattcagaatcatctgtgattaatgacattctagatattggatgctctgtaggtataagcacaagatatcttgtagacaagttccacacggccaaagtcactgggctagatctgtcaccctattttctagctgtggctcagcataaggaaaagagaacatcacccggaaaatttcctaaaagatggatacatgcaaatggggaagacacaggcttgccttctaagtcgttcgaccttgtttctattgcttttgtgcttcatgaatgtccaacaagagttatagtgactttggtaagagaggcattccggctcctttggccaggaggcacactagatttgacagattttttggtatataaagtccttcaggaattgtctccagttctctttacattggttaagagcacagaagcctttctagatgagtattacttgactgatatggatgaaacactgagggaagcaggttttgtgaacataacatcaattcttacagaccccagacatgtgacaattactgcaacagtgcctcaatga

SEQ ID NO: 53437 - DNA, 645 bp, Glycine max
  Peptide Sequence Number=SeqID_170215
atgtcaatagctagacgagcagttccagatgcttcttcaacacaggaagcaattaagatactgcgcggcaattggcttcgtgcaattgaacaacaccatatacagtattcggaatcatttgtgatcaatgacattctagatattggatgctctattggtataagcacaagatatcttgcggacaagtaccccacagccaaagtcaccgggctagatctgtcaccatattttctagctgtggctcagcataaggaaaagagtgcaccacctagaaaatttcctataagatggatacatgcaaatggggaagacacaggcctgccttctaaatcattcaacctggtttctattgcttttgtgtttcatgaatgtcctactagagttatagtgaatatagtgagggaagcattccgtctccttcggcctggaggcacactagctttgatagattcttcgatgaagtcaaaggtcgttcaggaattatctcctgtcctgtttacattgtataagtgcactgaacccttcattgatgagttttacttgactgatatggatgaaacactgagggaagctggttttgtgaacataacatcaattcttacgagtcccagacacgctacaattacagcaacagcgcctcaatga

SEQ ID NO: 53438 - DNA, 1263 bp, Glycine max
  Peptide Sequence Number=SeqID_170216
agacaagccaccaaggatgccgggaaaatcgcgggtttgaacgtgttgaggatcatcaacgagccaaccgcagctgctattgcttatggtttgaacaagaaagggtggagagaaggaatgtttaaggttaaggccacggtgggagatacccatttgggaggtgttgactttgataacaaaatggttgactatcttgtgagtattttcaagaggaggtacaagaaggacattggtgaaaatcccaaagctcttggaaggttgaggtcagcgtgtgagaaagctaagaggatactctcttcaagttctcaaaccactattgagcttgattctttatgtgggggggttgatttacatgcaaatttttcaagggccttgttcgaggaattgaacaaggacttgttcatgaagtgtatggagacggtggagaagtgcctcaaggaggcaaggattgctaaaagtcaagttcatgagtttgttcttgtaggagggtctactagaattccaaaggtgcagcaacttttgaaggacatgttcagtgttaatggtaacaaggagctttgcaaaagcatcaaccctgatgaggccgtggcgtatggtgcggcggttcaggcggcgattttgagtggcgaaggagacaagaaggtggaggatttgttgctgctggatgtgatgccgcttagtcttggaattgagactgatggtggtgagatgtcagtgttgattcccaagaacaccatgatccccaccaagagggagagtgttttctccacgttttctgataatcaaacaagcgttttgatcaaagttttcgaaggggagcgagcgaagacagaggataacttccttcttgggaagtttgagctttctggtttcactccatcgccaaggggagttccacagatcaatgttgggtttgatgttgatgttgatggcattgtggaagtcactgctagagataggagcacggggctgaagaagaagatcacgatcagcaacaagcatgggaggttgagtcctgaagagatgaggagaatggtgagagatgcagtgaggtataaggcagaggatgaggaggtgaggaacaaggtgaggataaaaaacttgcttgagaattatgcttttgaaatgagggacagagtgaagaaccttgagaaggttgtggaggagaccatagaatggcttgacagaaaccaattggctgaaactgatgagtttgagtacaagaggcaggagttggaagaaaaggttttgaagtttatgtaa

SEQ ID NO: 53439 - DNA, 759 bp, Glycine max
  Peptide Sequence Number=SeqID_170217
atgcagactgttggggaaagtgttaaaaagttatattcagaaattgtgggagatttacttcccccaggtgaaaaggtaagcattgaattgcctattgataaatgtgcggatgctgggctctataagaagccattccatgtttataaggaaagacatgtaaaagctgataccaagcaaacaactgaggattcaaggattgttcttggtgttgataatgttgccagacttgcttcttccacattatctttgagaaattctgtcaaagaaagcaattttagttcaccttcaagacagtatgttagaagaatggatgttatatcaaaccttggtattgatgaaaatccagtaaataaaaaaatggctgtgaccaatataatcaatgaaaccactttggcagaaacagttgcatgccggacatcacaatcttgtgagatctcaaatgaaaatgaaaatcagaaccatggagttactgtttcaaagccagcctcagcaaaagtggcaaggcttgcctctgacacagattgttcaaatgaaattgaagatgctagtaccaaacaattccccaatgttccgcaactagttaaagcagctgaagagaaacccgttgataaaagttcttcctcctgtgtcccatttggagagccagttgaactcagaagtactaactggtttcaagcccatggacctatttttggtgggaacttgaatatcgagaaagtgtatcatggtgctgtttgttttttagctaatattgcatga

SEQ ID NO: 53440 - DNA, 390 bp, Glycine max
  Peptide Sequence Number=SeqID_170218
atggacgaagggctaactggtgatttgatccccatcgttttggagattaacgctacttgcaggaggcgcaatgcagagaaaaataggaaatttttgcaagacttagaagcagcagcaactccagaagaaaaagctcgatcttccgaggtgtcttctagatttcctattccagggaaatctcatatagatttaattgaagaagttatcatggctgaagagccaaggagagtgaccctagaagattactgtcaagtgtgctgtaatttttcaccagcattgcacaaccaaagagaagctaagaggtggcttcactcgttcaaaggcaacagtcttaagacttgggacaaagtggttgagaaatttttgaagaagtatttacacggcgtttaa

SEQ ID NO: 53441 - DNA, 944 bp, Glycine max
  Peptide Sequence Number=SeqID_170219
gtttggcagttatcacagtgatgctggtgaccacttgtttgatgtcactggttattgtactttgctggcaccagaatgttctccttgcacttgggtttgttttcatatttggctacattgaggttctcttcttctctgcttctcttatcaagttcctgcaaggagcatgggtgcctatagcattggcacttgtgtttctgacttgcatgtgtgcttggcactatggcacactcaaaaagtatgaatatgatgttcaaaacaaggtttccaccaactggctactcagcctatgtcccggcttaggtattgtccgagtgcgtggggttggccttatacacaccgagctagtgtctggaatcccagtaatcttctcccactttgtaaccaatctcccagccttccatcaggtcctagtttttctatgcatcaagcacgtgccggttccacatgttacacctgaggaacggtttctagttggtcgcgttggtccaaaagagttcagactctaccggtgcatagtgcgatatggataccgtgatgtccacagagatgatgttgagtttgagaatgatcttctgtgctgcatagcagagttcatacgcacagaaagaactgggtcgaactcttcaaatgatgagcccgtaaaggatgacagaatggcagttgtagggacatgttctacacattcccttttgatgactgagaataaagtagataatgtggagaatgtagacttgccaggaccatcagaactaaaggagataaagtcacccaatgtgatccagcagcagaagaaaagggtaaggtttttggtaccagagagtccaaagattgacacaagtgtaatggaagagttggaggaggtgatggaagcctgggaggctggggtagcttacattataggacagacacacatgagagcaaaatcagggtctagcatgtga

SEQ ID NO: 53442 - DNA, 264 bp, Glycine max
  Peptide Sequence Number=SeqID_170220
atggatcctcctttgcctgtggtcaaaagagtgtccccattggaagaatcaaaagaattggatagtctctggaaaagaagatcgggtatgggtaggcctgcactcaaaagtttgcagcttcaacagattcaagatccaaggatttgttttcagccttcaacttttcctagtgttgcttgcttgcttgatttcttgggggcatctcacatggcggcgatgcagagtatgggtcatgcttgtgtgaatacatcagtaaattggtaa

SEQ ID NO: 53443 - DNA, 231 bp, Glycine max
  Peptide Sequence Number=SeqID_170221
atgtatattggggtagagggtgtcacactagtcatcttggtcaataagaaagatgagacttggcgtatgtgtgtggacttctatgctttgaacaaggtcatcattctagacaaatatccaattcctaccattagtgagctattggacgaattacatgggtctcaaattttcaccaagattgatctcaaatcgggcatccatcaaatttggatgcgaaagaaggatatctag

SEQ ID NO: 53444 - DNA, 234 bp, Glycine max
  Peptide Sequence Number=SeqID_170222
atgacaattgaccacaagtgccttgaattgaaagtcacaaatggtggcatgttctcagcggtcttggctcatgacgagattcgggatgttcattttgatagtgatagattcatattcaaatacataaatgacatcaaatttcagatcaaatcaaaacaaatacatttaactcaacccaccccttgcaacttcaagaaggtctcccaccctcccccaaaaacaaaaaaaccatga

SEQ ID NO: 53445 - DNA, 902 bp, Glycine max
  Peptide Sequence Number=SeqID_170223
tatgtttaaaggtttgcgcattacagattctagaaggagggattggggtacggcgcctagatgggttgctttcgtcgatttttttcttgcttctcgtgcaaaatatgccgccatttctggagctcaccaccgtgtcgggactacatatgctcaattaatcgctgcactggctgcagcatacaatctgggggacaagtctagttcaaggtttacattccttagcagtttccagagtaatttgttgattgatggcctaaagaatcagggtggttggggccatgtgtggaacagatatgctggtccattgagttgtcgcaaccagggcaatcaatgtgccttcacaccagttctcccttctgcttggtgggacggtctttggcagtctccaattccaagggatattaatcgtctggcttcctatggcatcaaattatctgctcttggcactatggagcatgggtgggttgactgggccgaccagtatcgaagaccgtcttcttcttcattcctccttctttccgtttcggtgtgtgccatcgtagaactgaagattcagttcgggatttttgcgcttcgtcctcaatttgcagcgcgaagacgcattggcctcgccaaagcctgcgaaaaccctacttgcgctgaaatcggtgattgctgcagctatctgaagcttccttttgcaattgagatagacaaggcgtaccctcgtgatttcatgcagagagggcgcgtgagggtgttgctgaagaaggaggatggaactctctttaattcaaccatctcatccagaaagcaactaatggtaaaggttgcagagatggtacctaggcatcatggaaggaccaagaagcaggagacttcatcaacatcaactgctggaccttccaccaaatctgggaagg

SEQ ID NO: 53446 - DNA, 261 bp, Glycine max
  Peptide Sequence Number=SeqID_170224
atgggtttcttcttagggggcttgaaggaagaattgaagtggcagccttggaaccaatcagtagattttcaaaggtgggagacaagaaaggaggtcaaggacaagataagtagcaatgtgagagggcaatttaaggggactagcaatctctcttatcaagagcttatggagagacagagcaagagacgaaataacaacccaacaccaattcttggacaagcatctcaggctccttattttggaagggagatggaaatctga

SEQ ID NO: 53447 - DNA, 252 bp, Glycine max
  Peptide Sequence Number=SeqID_170225
atggagaagaaccttgccgagaattctggcaaagccgaagacatgaacaccggcgacaacactaccaattcgccggcagcgccggagcccgaagataataaactcgacgccaaaacggacggcgaaggagaaaaagccgcggattcagatcacgccgagggagaccaagatcccaaagaggaagagaagaggaagaagagaagagaaaccgcggaggctccaccggattctccccctccaaacctcggagag

SEQ ID NO: 53448 - DNA, 1014 bp, Glycine max
  Peptide Sequence Number=SeqID_170226
atgatccagcttctcaatttcgcggagagtgtcgccatgacgaagcgcgccagcgagaagctcttcaagttcctcgacatgtacgagaccttgagggacgttattcccgacatggagagcctcttccccgccgacgacggggagatcaaggccgagacgacctcggccaagtgccgcctcggcgaggcggcggtgctgatattctgtgacctcgagaactctatcaaatcggaaaccggaaaaactccggtagccggcggcgcggtgcatcccctcacgcgctacatcatgaactacttaaggctagcgtgtgaatacaaagacactttagaagaagtgttcaaagaacactccaaaatggagcgggcagattcaacaagcaggccacaatacgaagataccaaaccaaacaacaacaacaaacagaaagaaaacgtgtcacctttcgcggcgcagttaatgagggtgatggagcttctggacacaaatctcgaaggaaaagcgaagctgtacaaagaagtaccactgagctgcatattcatgatgaacaacggaaggtacatagttcagaagataaaaggctctacggagatctacgaagtgatgggagaaacgtggtgtcgcaagagatcgacggagctgagaacttaccacaagaactaccaggttgaaacgtggagcaagattctgagttctcttagccctaaaggtttgaacgagaacgggaaggtgcacaagccggtgctgaaggagcgcttcaagagcttcaacgcggcgtttgaggagattcacaagacgcagagcgcgtgggtggtgtacgacgaacagcttcagtcggagcttagggtttctatttccgcgctcgtgattccggcgtacaggtccttcttgggaaggttttcgcaatacttagatcccggaaggcaaactgtaaaatatattaagtatcaagctgaagatgttgagacttgcattgatgagttgtttgatgggaaccctcatgggcgtcgctag

SEQ ID NO: 53449 - DNA, 1980 bp, Glycine max
  Peptide Sequence Number=SeqID_170227
atgaatttttttccagatgaggtaattgagcacatatttgactatgtgacttcacaaagggacaggaatgacttgtctctggtgtgcaagaactggcacaggttagagagatgcagtaggaagagtttgttcatagggaactgttactccataagtcctgagagagtgatagagaggttccctgagctaaagtccttaactttaaagggtaagcctcattttgcagattttaatttggttcctcatggttggggtggttttgtgtctccttggattgaagcaatggtgaagagcagggttgatttggaggagctgaggctgaagaggatggtggtcacggataagagcctggagctactttcgcgttctttcatgaatttcaagtctttggttcttgttagttgtgaagggttcaccaccgatggacttgcagctatagctgcaaattgtaggttccttaaggagctggatttgcaggaaaatgaagttgatgaccacagaggccagtggctaagctgctttcctgattgctgtacatcacttgtttctcttaattttgcttgccttaaaggacagattaatctgggggctcttgagagacttgtggcgagatctcctaaccttaaaagcttaaggttaaatcataccgtgcccctcaatgcactccaaaggatattgaggcgagcacctcaaatagtggacttgggtattgggtcatttatccctgatccaaattcaaatgtcttcattaagctaatgaacaccattatagagtgcaagtcaataaccagtttgtcagggttttttgaggttactcctcgatgccttccagctatatatcctgtttgtatgaacttgacagctatgaaccttagctatgcagcagggattcagagcagagagctaataaaactaatttgccgctgtgggaaacttcagcgattatggataatggattgcattggagactttggactacatgttgtggcttccacatgtaaagatttgcaagaactaagggtttttccgtctgttcgtgttggtagaaatgaccctgcaggagtcacagagaaaggacttgttgcaatctctatgggttgccctaagcttcactcattgctctacttctgccagcagatgacaaatgccgccctcataactgtggctaaaaactgcccaaattttatccgctttaggttgtgtatccttgacccaacaaaacctgaccctgatacagtgcagccactcgacgaaggttttggcgcaattgtgcagtcttgcaagcaacttcggcggttgtcactctccggccagctgactgatcaagttttcctttacattggggtgtatgctgagcagcttgagatgctgtctattgcatttgctggagaaagtgacaaggctatgctctatgtgctgaatggatgcaagaaacttcgcaaacttgagataagagatagcccttttggtgactccgcgcttctcatggacgtagggaagtatgaaacgatgcgatccctttggatgtcatcctgcgatgtcaccattggagcctgcaaggcacttgccaagaagatgccaggactaaatgtggagatctttaatggaaacgaaaaggtagatcgtgatgtggacgatggccagaaagtagagaagacgtatttgtatagaacactggttgggagaaggaaagacgcaccagaacatgctcctcatggtggtgatggtgatccacgtgctggtagtggtagtgcggcggcggaggcggcggtggatgcccgttatcgaagtaaccctgataggagtcgtacggcggacgctgcggcggctgcggcggagggtacccaccgtatccgtgaggcggcggcggcggcggagggtacccttcatgaggcggtgcggatgggtaacccggttggggtggaggggtgggattcgtgtgatattctctggaaattgctcattggacttgttttctga

SEQ ID NO: 53450 - DNA, 294 bp, Glycine max
  Peptide Sequence Number=SeqID_170228
atgtatggaaagtggatagcagacgggtacggatctccttaccctccaccccaaccgggttacccatccgcaccgcctcatgaagggtaccctccgccgccgccgccgcctcacggatacggtgggtaccctccgccgcagccgccgcagcgtccgccgtacgactcctatcagggttacttcgataacgggcatccaccgccgcctccgccgccgcactaccactaccagcacgtggatcaccatcaccaccatgaggagcctgggtgcttttcgttcctccgaggctggtga

SEQ ID NO: 53451 - DNA, 240 bp, Glycine max
  Peptide Sequence Number=SeqID_170229
atgatgggacttgttatagagttgtggtttttcttttttcgggtgcttgggcacaggttgaggctgcaagcagaatctaaaggattccggcttgacgatacagggctatttccagctactcagggttctggcggcaaacggggtgcaaaaggtagtgcaagtttgaaatttaatactgaaaaggagatatttgatttcctagacttcccttgtcttgaaccacatgaaagaaatctctaa

SEQ ID NO: 53452 - DNA, 1128 bp, Glycine max
  Peptide Sequence Number=SeqID_170230
atggcgacgaggtactgggtggtgtctctccccgttcaaaattccgcatccactctctggaacaaactgcaggaacaaatctccaaacactccttcgacactcctctctacagattcaacatccccaatctccgcgtcggaaccctagactccctcctctccctcagcgacgataccgtcaagtcgaacagtttcgtggagggagtgtcgcacaagatcaggcggcagattgaggagctggagagagtgtccggcgtggtgagcagtggtttgacggtggatggagtccccgttgattcctacttgacgcggtttgtttgggatgaagctaggtaccccactatgtcgccgttgaaggagatcatcgatggaattcatggtcaggtggcaaagattgaggatgatctcaaggttcgtgtttctgagtataacaatatccgcagtcagcttaatgccatcaaccgaaagcaaactggaagcttagctgtccgtgatctttccaacttggtaaaacctgaggatattataacttcagaaaatttaaccacccttcttgcaattgttcccaagtattcacagaaggattggctatctagctatgaaacattgacaaattatgtggttcccaggtcttccaagaaattgtatgaggataacgaatatgttctttatactgtaacactcttcagtcgtgttgcagacaattttagaactagtgcacgggaaaaagggttccaaattcgtgatttcgaatacagtcacgaatcatacgacagtaggaagcaagagttggagaaattggtggaagatcaggaaagtttgaggagttctctattgcagtggtgttatgcaagttatggagaggttttcagctcctggatgcacttttgtgcagtgcgtgtatttactgagagcattctgagatatggtcttccaccatctttcttggcatgtgttttagccccatcagtcaaagcagagaagaaagtacgctctatccttgaagggttgagtggtagctcaaacagtgcttactggaagaccgaggacgaaggagttgggatggctggcctagcaggtgatgctgatgcccacccttatgtctccttcactatcaatcttgtttga

SEQ ID NO: 53453 - DNA, 982 bp, Glycine max
  Peptide Sequence Number=SeqID_170231
atggatgcgatagctcatgtcccagatgtttctgaaatagctcatttgccgggtgtttctcaaattgctactgtgattacatttattaaggatcaaattgggtacatatcctcctacgaggaaaaccttgaaaagcttatgaccgaggttcaacgtctgaaggatactcaagacggtgtgcaacaccgggttgttgaggctgaaaggaatggagagaagattgaaaatattgtacagaactggctcaagaaagcaaatgaaattgttgctgcagcaaataaagttattgatgttgaaggaactagatggtgtctgggacaatattgtccctatctgtggacaagatgtcagctgagcaagagttttgaaaaaatgacaaaagagatttcagatgtcataaagaaagcaaaatttgaaacaatttcttaccgtgatacgcctgatgtcacaattacaccatcttctagaggttatgtagcactggagtccagaacatcaatgctgaatgagattaaggaaattcttaaggatcctaaaatgtacatgattggggtgcatggcatgggtggcgtgggtaaaaccactcttgtgaatgagttagcttggcaagtaaagaaagatggattatttggtgctgtagccattgccgctataaccaattctccagatgttaaaaaaattcaaggccaaattgctgatgcgttggatctgaaacttgaaaaagagtcagaaagaggaagagcaataaacctgcgtcaaaggataaaaaagcaggagaaagttcttattattctagatgacatttggagtgaacttaatttgccagaagtgggaattccttttggcgatgaacacaatggttgcaaattggtgataacttccagagaacgtgaagtgctgacatacatggaaactcaaaaagattttaatcttacagctttactggaggaagatagttggaatttgttccagaaaatagcag

SEQ ID NO: 53454 - DNA, 216 bp, Glycine max
  Peptide Sequence Number=SeqID_170232
atgtctgttcttaagaaggagcatgcaaatgagttgaataagtgggctaggaggtttgaaggattggaagcacttctaacatgcttcatgaagcaaagcaacccaaatttggatgatgaagctttggatgacatgctaagaaatgttgtagctaatgaaaatagtaatgtggcaatgctatcctctacatcaactaatatatacaacaattactaa

SEQ ID NO: 53455 - DNA, 212 bp, Glycine max
  Peptide Sequence Number=SeqID_170233
gtgctgaggaggtggatctcgtagaggagcttggcgccgccggtcttgaaggcggcaaggaggtcggggttagcgttggactggaccagggagttgccgtggaatgtgaggagggagaagagaggaggcaagactcagccatgtggaggaagtggcaagggcagtgtggtggcggtggctcatgcggtggtagtgacgatggtggtggttag

SEQ ID NO: 53456 - DNA, 2091 bp, Glycine max
  Peptide Sequence Number=SeqID_170234
atggaggcaagagacacacattacacattcataaatgagcttagggactcttcattattgcttgaaggtgaacttgattgggttggaatgcatgatgttgtgcgtgacgtggctaaatcaattgcatctaagtctcgtccgaccgacccgacctattccacctatgcagatcagtttcgcaagtgccattatattatatctgagtatttgactaaagtcccagatgataactttttctttgggatgggagaagtgatgactttgagtgtatatgaaatgtccttcacccctttcctaccctccctcaatcccttgataagccttcgctcattgaatctaaatagttgtatattaggagacataaggatagtggcggaactctcaaatttagaaattctttccttgggggggtctagtattacagagctcccaggagaaataaaacatctgactcgtcttcgtttgctaaatttaacatactgcgattcactaagagtcattcctacaaatcttatatcaagtttgatgcgcttagaagaattgtacatgggaggttgctataacattgaatgggaggttgaaggaaaaaaaagtgaaagcaacaatgctaacgtacgtgagttacagaatttgcataatttgacaactttggagatatcattcataaatacttgggttttgccaaggaacttccggttccctgcaaatctcaaaagatacaacatattgattgctaatcatatgctggcatacaacatattgattggtagtgatagggggaaatgggagttgtcttcaatatggtatggtggagctctcgaaagaacacttaagctcacagactattggcagacgagcagatcgttgttcaccacagttgaggacttgagccttgctaaattaaagggtgttaaggatttgtatgatttggatgtggatggttttcctcaattaaagcatctgtatatccatggcaatggtgaattgttgcacctaattaacccaagaaggttggtgaatccccattctgcatttctcaatttggagactttggttctttacaatctatataagatggaagaaatatgtcatggtccaatgcagacacagtcttttgcaaagctaaaagttattgaagttacatcttgccataggttgaagaatctatttttgtattctctctcaggaaacctttctcaacttcatgagatgaaaatttctagttgtgaaggtatgacagagatcatagctgtggaaaaacaagaggatcagaaaaaacttctccagattgttctgcctgaattgcattctgtcactttacgaggtttacttgagcttcagagtttctattgctctgtaacagtcgatcagggtaatccatccagtcagagcattcctttggcactgtttaatcaaaaggtggtgactcctaaacttgaaacattggagttgtatgacatgaatgtatgcaagatatgggatgataaacttctagtcctttcatgctttcaaaacttgacgcgtttgatagttgtcaaatgtaattgtttgacaagcttattcccatctggagtggcaagagtactggtcaaactacaacatgttgagatttcctcgtgcgaaaggctgaaagtgatatttgcccaagaagagaaaatagaagccgttagccctacttgtgatatgacgcatgtttaccttgaagttttagctgtacgagagtgtcaaaatatgaagaccataattccatcctttgtgctatttcagtgtttagatgaattgattatgcccagttgtgatggacaggaaatttgcggaagcagtaatgagggtgatggaccagtactggatgagattgcttttatgaaattggaggaattgacattgaaatacttaccgaggctcacaagcttttgccagggaagttacagcttcaagtttccatcattacaaaaggtacatttgaaagaatgtcccatgatggagactttctgtcatggaaacttaaccacaacaagccacattgaggtgcgatgcctatatgacgaatcagaagatcattgggatggtgaccttaaatactactgttag

SEQ ID NO: 53457 - DNA, 111 bp, Glycine max
  Peptide Sequence Number=SeqID_170235
atgaattatccaatatcagttgttagcaatagcaaggcttggtacatggcacttgggaaccctagaattcatgaagttcactcgagattgcaatttgtaactgctgattaa

SEQ ID NO: 53458 - DNA, 774 bp, Glycine max
  Peptide Sequence Number=SeqID_170236
atggcgttaggagctgaactagatggacccatcaaatatgaggtccatggaaaggttgcagctatgcggtgtattgatggacatgtcttaggcctctatgaacccggcgaggatttacttagagaaagtggcattccctatgcaatcgtgaggccttgtgcattaacagaggagcctgctggtgccaatcttattttggatcaaggagataatattacgaagtatcaagaaaaggttgctagcaaatccaagaaaaagtccaacaatcttgcttgcattcaagctaaagatcgtacgacaggaagaacagagattgcttcttgtgtcaaggttgttgagattagagtgggtgcccatatatatcctcaaaatccagttcttcacattggaagtcctttcaacctaagcataaaaggtttgagtgatacagtttctggacagtggtttaccacaaatggaagtgtaatatcagttgatacattatctgggatggccaaagctattggggaaggttgtgcacaagatccagttgaagctgactcatgcaaagagcatttagttccacttgcggatatggtgaacacatgttacaaagctgcagggaatcatgtgttgcctaacttagcagtcaagagacacgtgcaaatgggttctcaccaacaagaaccatggctattgcagaatgggaaaccaagggtgttgaccaaggagaccaggcatggccgttctgcacacagaatgtcctccacctctttgcgcaagaaatctagctga

SEQ ID NO: 53459 - DNA, 315 bp, Glycine max
  Peptide Sequence Number=SeqID_170237
atggattttatttgcttaggtgcttctgcaattggtaaatgtttggttacatactctcctacgagaacaaccttaaaaagcttgaagcggaaaggttggaggatactaaagccagtgtgcaataccgtgttgatgaggctcaaaggaataatggaaaaaaaaattgaagatgttgtactgaattggcagaaggaagtgaatgtttgtaatgctaatgcaaggaaacttattgactgtgaagttggttatattgtctgggacaaagtcccaatccatggacaagaaaacaacttagtaggagatttgaagaaatga

SEQ ID NO: 53460 - DNA, 701 bp, Glycine max
  Peptide Sequence Number=SeqID_170238
atggcatcaccacctcaactagatcttcttattgaaatgctaggcgatagtaaagagccaaagctgtctgatggcatgattagtgatgtaatcctccctaggaagggaccagtcactagagccatgagcaagaggctccaagaggattgggctagagctgttgaagaaggccctaggattctcatgagccttaggcttcctttctacgcttcttatccagggcactctcttggtggtgaagcttcttcttccatggcttattttctagaccttattgaagctcaaagatccagcctccatagaagcttctcaagcaagcttccatcaattagtccacttttagagttggaagactttgaactggataggctactattagatgatgctcatattcctactgcaactgttggcatcctcccaatggagtttgctagtcatgatcgactaacgactaccttaaaaggtgatgttttagccaatgaagaagaatggacaagtttggcggaggatcttgatgctgaaaagggaattgccaaactatgcaagccacaagcagatcaggctaggcatttgaagctattatatataaaggcaatgataaatgggagaccaattaaccaagcctttgtagacaatgacacttttcataatgtgatgtcttactccactatcaagaagccaaggcacacttctctaaggaa

SEQ ID NO: 53461 - DNA, 375 bp, Glycine max
  Peptide Sequence Number=SeqID_170239
atggttggtaaacaacactctactttgatggagaacccgatacccacttggactaaggcaaggacgaattcccctcaaaccattcaactacctgatggactaagaattcctcctccaaaagagttgaggaataaaagatattgtaagtggcctaatgcttacagccattcaacaactaattatttggtgtttagaaataccacacaaagggcccggaaggaaggacaactagggttagtcaaaaaagggaatggcatacaggtggatgtcaatcctttaccattggcagaaattagtatggtgtcaacatcaagatgcctcctagaaggagatacgacacaaaacaaaggagattgcctggtgaaaggcaagtag

SEQ ID NO: 53462 - DNA, 117 bp, Glycine max
  Peptide Sequence Number=SeqID_170240
atggacaaggatgcggaagaattggctaaagttgaagctaaattggttggtttgtcactactatttgatttcttattgataaagattggaaggctagcaatggagctaaaaaaatag

SEQ ID NO: 53463 - DNA, 240 bp, Glycine max
  Peptide Sequence Number=SeqID_170241
atggctcacatagacccgagtatagggcctaatatctcaatgtgtgtgcaaaggatcgacaagggtgttgcccttgctcctatgtatcctcaggcaaagggtcactttgggccagttgcagctcgcccaggcaagctaaaacttagtgctgaagcaatgagctcacccaggcgagctggtatcttcatcatgaagctatttggtggccaagcgagccaaaggctagcttgggcaagctag

SEQ ID NO: 53464 - DNA, 366 bp, Glycine max
  Peptide Sequence Number=SeqID_170242
atgatccaaacttccgtaaaaagagtcctcctagaaaaagaaagaagcaacaaggcccaaggtcctaggtccaacaaggtatgtataaataaagtaagactctcaggtacccctccttcagacaaatcccattcaaggacttggaggacaaatagcaacaagaaaccattcgaccagaggaagaagtgttcgaccattatttggcaagaacataagaagtgtttggccaccgtgggaccgagtaagatagttcccgatgccaagtgttatggtagtaacacgaacaagaatggatatgacaaaacctatccagctaggacaacaacatcatcctcaagaagaagtacaagtaaaagatcatactga

SEQ ID NO: 53465 - DNA, 234 bp, Glycine max
  Peptide Sequence Number=SeqID_170243
atgggttatgattggttgaacggtccacaacgcaacaagcatggagtctataggcataaatgcttaagttcatatgtgagggagtcaatccttatgggcactatcagtcaaacgattctcatagtaggaggggaaaagttgaggtcaccttcagtggcgaaccatatcgttgaagaggctcaattgttgaagaaaagcaggaaaattgcaaatgtcattgtgaaaaataagtaa

SEQ ID NO: 53466 - DNA, 503 bp, Glycine max
  Peptide Sequence Number=SeqID_170244
aactggacactacaaaaacccgtgcaagacctaagaatcaagagaaggtgtagtggtctacatcatgtttgtacaattgttgtggctaaggagcttcaacagctccaagtgcttgaaatagggaggtttgaaaatatagaaaccattgttggaaagagtgatagtggtgatgcacaagatgagactgcttctacgaaattggaggaacagaaagctagaagtgagaataagggtgatacgttaggtgggtttgcttctatgaacttggaggaattaatacctagaaatgggaataaaggtgatgctccaggtgagatagttttcacaaaattagaggcattgttcttgatctccttaccaagccttacaagcttttgcaaggcaagttacaacttcaagtatccagcacttgatgtagtaatggtttctaatgtgatgtggagaaggcaggttggagctgcagggacagggagcagctgtagcattgcattagtgggtcagag

SEQ ID NO: 53467 - DNA, 558 bp, Glycine max
  Peptide Sequence Number=SeqID_170245
atggcttatgctaatcacctcggcgaagttgtctccatgaagcaagcgtcgtcgatggaagtttcgacgcgagatttgctcctagagcttcttctcactcgcaaagagagttcagacgcagaccttgctcatgttgatggaggattttcccacactgtcgtagacctggtggtgatggtggtgttagtagtttctggcacaatttctattgaatcttgtttgttgttgggtttgtcttcagaggtggaagggtcaaaggggttgatgtgggagataaggatgttgcgaaactcgtcttctaagtgggccacggcgatctggatggcggagttgactttgttggaggaggcggagacggagacagaggagagggaatgttcaaccactctttctctctctctctttatcgttgttgaagacctcgatgacattgggaagaggagaaaggaagaaggacaacaagaagaagacagcgagccagaggagaggaacgaacacacacatttcaaagttaaaattatccacattcaaagacagtttttgcgaaaccatctttaa

SEQ ID NO: 53468 - DNA, 687 bp, Glycine max
  Peptide Sequence Number=SeqID_170246
atgagagaagtcaaggttcttgatttacatggaatgaggcttgcaccttccccaccaccttcacttcgtctcttgacaaaacttatatcattgaatttgtatggatgtgtattgaaagacatagcaatggttgcagaactcacaaggttagaaattctcaaccttgaaggatctgaaattcaagagctcccaaaagaaattggacagctagtatatctgcgactgttgaatttaacaaactgccttcaactagaaatcattcctgcaaatgttttatcaagcctaacaaacttggaagagttgtatattgggaattgtaatattcaatgggaggttggtggaggaaaagaccgtgcaagtctaggtgagctaaaccatttgaatcagctaacaactttggacatatcaatccaacatgcctcagttttaccagtagatatgaatgtattggcaaatctacaaagatacaacatatttattggccaaatgtggaatggggatgctcgagaaacttcaagaacacttaagctcatcgactcttatacaaatatttggtcaaatcgtgggcttcaattgttgttccctacactagagtacttaagtttacatcatttaaattttgataagggagagtttgatcatccacatattctttcgcccgtatccaatcaaaaggttaacacttaa

SEQ ID NO: 53469 - DNA, 550 bp, Glycine max
  Peptide Sequence Number=SeqID_170247
ggacgacgccaccgttcaggtccccgtccccaaggttctgtcgccacttccgcctccgttcgatgttgttcctcttggccctgacgcgctcgatgagtctgcctccatgaaggcctttgttttgtgttcacgtggaggcttgtctgttgcattacttgaaatcacagggggcaaagcttctattcaagttaatggcaagacatatcgaaagaattctcgtctgattttaagtggaggtgatgaggagactttgtgcaaggcacttgcgaagcattttggtgctaggctactaattgtcgattgtctctcgttgcctggggaccaagctatggctcccggggcaaagttctgcttgcttttgaagataataggtcttcaaaaattggggttaggtttgataaatcaattccatatggcaatgatcttggaggcctttgtgaggatgatcgtgggttcttttgttctgttctttaccggtccaaaagatgcctctattcctgaagaagtatatctaacacccttctctgttttgtgcataggttacctctaa

SEQ ID NO: 53470 - DNA, 129 bp, Glycine max
  Peptide Sequence Number=SeqID_170248
atgcttgcaaaggctgtagcaactgaagctggagcaaatttcattaacatttcaatgtccagcattacttcaaagatagacagagcttcaatgctagatgaggccatagaatatttaaagcagctctag

SEQ ID NO: 53471 - DNA, 285 bp, Glycine max
  Peptide Sequence Number=SeqID_170249
atgcaacagacaagcctccacgctgaacagaatccaaataacaactggtcagtaatattgaaagacatggaaatgctcaactgtggttggacactgaacacaaaacaaaggccttcatggaggcagactcatcgagcgcgtcagggccaagaggaacaacatcgaacggaggcggaagtggcgacagaaccttggggacggggacctgaacggtggcgtcgtccctgcatgtgtcgacgaggaagtcatggagcgctcaaacgtcgtggagctcaagaaccctag

SEQ ID NO: 53472 - DNA, 309 bp, Glycine max
  Peptide Sequence Number=SeqID_170250
atggatgtgcacaatgcatttttacatgaggaccttgaggaggttgtgtacatgatgccgcctcctggctttcttcctcagcaatatggaattgcacctaaagaggcccattgggaggctgttctctgtgttattcgatacctgaaagggaatccaggacaggtgaatggtgagtatttactcaaggtggggggattcaacgacagtttcacgtgcaaacctgaaacagctttcaatatttacgtcattgtcaaaaggtgggggattcaggaagagattactgtttcagttattatttataaaatttaa

SEQ ID NO: 53473 - DNA, 666 bp, Glycine max
  Peptide Sequence Number=SeqID_170251
atggaagtccttgagatggcatcttgcaacttgaaaacaattcctggtttcttaaagaactgttcttcattagtcttattagacctttcagataatcagattcaaggaatagttcccaactggatttggaaactagataatcttgtggagctaaatatttctcacaattttttgactggtttggaaggaccttttaagaatctcactggcgaaatgacattggcaatcacatgcctttcacatattatgtctctttcaaacaatactttgcatgacaacatctcttattccctctgcaatgcttcatatcttcaagtgcttgatctttccattaatagcatttctggaacaattccctcatgcttaatgatgatgatgaatggcactcttgaggcattaaatctgaagaacaacaatctctcaggccctattcctaatacagttcccgtttcttgtggtttgtggactttatcttcgtggaaatcaattagatgggccaattccaaagtctcttgcttattgctcaaagttagaggtattggaccttggatcaaatcaaatcacaggtggctttccatgcttcttaaaagaaatatccacgcttcgtgtcttgattttgaggaacaacaaatttcaaggttccctaaaatgtttgaaagccaataa

SEQ ID NO: 53474 - DNA, 300 bp, Glycine max
  Peptide Sequence Number=SeqID_170252
atgacaaatccagtcaactcacattcatataggcgtaggattttcagatttttgaaatgggaaaatgtttctgccactggggatgataaattgttgttatcaagaacaatgactgatagattctcaagtcttgccaaggaaggatccaggggacctgagagattgcaccttaacatgctcaattcttgcaggtcatgcattgacatatgcactacaccattcatgtcctcgagcggttatagttacaccatccagatacaatttcctaatattggtgagattatggacaagcttttgtag

SEQ ID NO: 53475 - DNA, 309 bp, Glycine max
  Peptide Sequence Number=SeqID_170253
attcagagtaaatatggtttttccaacatggaatctgcaaaatgcacaagcctagcagtagagtggacctccaatcaatgggggttgaagcatcttgtaatcctccaatactccgtaggaatgcttcttcctcttcaaatattatgggggaaatccaatagaagagatacatcaaaattggaagatcaagctgtaaaatctgagaacaaatctcttttaacctgtgatattacaaactacaaagaaacacaggttattaacaaaatgcggaaattacagatcaaaacatacctccagccattgctatga

SEQ ID NO: 53476 - DNA, 312 bp, Glycine max
  Peptide Sequence Number=SeqID_170254
atggccgagtatgaggcgttaattaggcaagctttgaaaagtgttgtttttcaccttctcgctaagtcaatctgccttggtgtgggcggcccaccgtctaaggcaatacatgctgagccatactacctggtgttgctatccgaatttgacatcgtctatgtcaccctgaaagtgataaagggaagcaccttggcagattatctggcccagcaacccctcaatgattatcagcccatgcatcctatgtttccagatgaggacatcatggccctattcatggaaaagctggaagacgaagacaaggacaaatag

SEQ ID NO: 53477 - DNA, 363 bp, Glycine max
  Peptide Sequence Number=SeqID_170255
atggtgtctctgcctttgcttgcgactattccaacaaaggaatggttttcttcgacggctgaacgttatttgcggcgagctttcaggaattggaggaggatttgtcgaggagtgtgtgtgtgtggttttgttgatttcatatccgaggagggagacagtgtgtctgttttcctcgtgcacatgacttcacccctcacctccatccagccacaccaccaatatttgttacgaattgagcaatttgtaatagccatcacccttgggaaagacgaagagcctagtcgctggaagcacgttgatgagattgaggtggtgggagagaggaagcttgaaagaaaaatgagtgtaaaattgggattttag

SEQ ID NO: 53478 - DNA, 2109 bp, Glycine max
  Peptide Sequence Number=SeqID_170256
atgacaaaagagattttagatgtcataaagaaagcaaaatttgataatagattttcttaccgtgatgcccctgatgtcacaattacaccattagagcgaggttatgaaacactggagtccagaacatcaatgctgaatgagattaaggaaattcttaaggatcctaaaatgtacgtgattggggtgcatgggatgggtggcgtgggtaaaaccactcttgtgaatgagttagcttggcaagtaaagaaagatggattatttggtgctgtagccattgccgatataacgaattctcaagatgtgaaaaaaattcaaggccaaattgctgatgcgttggatttgaaacttgaaaaagagtcagaaagaggaagagcaacagaactgcgtcaaaggataaaaaaggaggagaaagttctgattattctagatgacatttggagtgaacttaatttgacagaagtgggaattccttttggtgatgaacacaatggttgcaaattggtgataacttccagagaacgtgaagtgttgacaaagatgaatactaaaaaatattttaatcttacagctttactggaggaggatagttggaatttgttccagaaaatagcaggtaatgttgttaatgaagttagtataaaaccaattgcagaagaagtggcaaaatgttgtgctggtttgcctcttttgatcgcagccgtggcaaagggtttgatacaaaaggaagtccatgcttggagggttgccctaacaaaactaaagaaatttaagcataaagagttggagaatattgtctaccctgctttgaagttaagttatgataatttagatacagaggaattgaagtcactattcttattcattggttcatttggactaaatgagatgctcactgaagatttgtttatatgctgttgggggtggggcttttatggtggcgtggacaaattgatggatgcacgagacacacattacgcattaataaatgagcttagggcctcttcattattgcttgaaggtgaacttggttgggttcgaatgcatgatgttgtgcgtgacgtggctaaatcaattgcatctgagtctcctccgaccgacccgacctatcccacctatatagaactctcaaatttagaaattctttccttggccaagtctagttttgcagagctcccaggaggaataaaacatctgactcgtcttcgtttgctaaatttaacagactgcagttcactaagagtcattcctacaaatcttatatcaagtttgatgtgcttagaagaattgtacatgggaggttgcaataatattgaatgggaggttgaaggaagcaaaagtgaaagcgacaatgctaacgtacgtgagttacaggatttgcataatttgacaactttggagatatcattcatagatacttcggttttgccaatggacttccagttccctgcaaatctcgaaagatacaacatattgattgggagttgggcgttgtcttcaatatggtatggtggagctctcgaaagaacacttaagctcacagactattggtggacgagcagatcgttgttcaccacagttgaggacttgagctttgctaaattaaagggtgttaaggatttgttgtatgatttggatgtggaaggttttcctcaattaaagcatctgtatatccaagacactgatgaattgttgcacctcattaacccaagaaggttggtgaatccccattctgcatttctcaatttggagactttggttcttgatgatctatgtaagatggaagaaatatgtcatggtccaatgcagacacagttttttgcaaagctaaaagttattgaagttacatcttgcgatgggttgaagaatctatttttgtattctctcacaggaaacctttctcaacttcatgagattgaaatttctagttgtgaaggtatgacagagatcatagctgtggaaaaacaagaggatcagaaagaacttctccagattgacctgcctgaattgcattctgtcactttacgaggtttacctgagcttcagagtttttattgttctgtaacagtcgatcagagcattcctttggcactgtttaatcaacagatataa

SEQ ID NO: 53479 - DNA, 584 bp, Glycine max
  Peptide Sequence Number=SeqID_170257
atgtgttttcagggtgtgacaatattaacaatatcaaccataatcccaagcctgcaccctccaaaatgcataagagacgcgaccagacgctgcatgccagcaaacaacatgcagctgatggttctctacatagctttatacacgacgtccctcggcattggaggcttgaaatccagcgtctcaggcttcggcacggaccagttcgacgagtcggacaagggagagaagaagcagatgctgaaattcttcaactggttcgtgttcttcataagcttggggacactaactgcagtgacggttctcgtgtacattcaggatcatatagggaggtactggggctacgggataagtgtgtgtgctatgctggtggctcttctggtgttgttgtcgggcaccaggaggtaccgctacaagagactggtgggaagtcccttggcgcagatcgcgatggtgtttgtggcggcttggaggaagaggcacttggaatttccctctgattcttcattgttgttcaacttggatgatgtggctgatgaaactctcaggaagaacaagcagatgttgccccatagcaagcagttccg

SEQ ID NO: 53480 - DNA, 204 bp, Glycine max
  Peptide Sequence Number=SeqID_170258
atgtcttacagtggcttgaacagtcgcgaagatggcaatagtgaggtatctgtcaatcagagaatgaaggtaatagacaagggaatggtcacaaacctgccgataaaagtgtcagctacaaaaccaccgaacaaacagagcatgaaagaggttcccatgaagttggtgaccgtgttggcagaattagcactgcccaaatgcatc

SEQ ID NO: 53481 - DNA, 1275 bp, Glycine max
  Peptide Sequence Number=SeqID_170259
atgagcatcaagaatgatcgggaatcaatacggcctaatcaagtgcctccaaattcctttcatcacaagctgaagattgacattagtggctgtgaaagcatggattttgtctttcccatatctgcggctacagagcttcggcagcaccaatttcttgaaataagatcgtgtggcataaagaatatttttgaaaaaagtgatagtactagcgatatgacgcatgtttaccttgaaaaaataattgtagagaggtgtacaggcatgaagaccgtaattccatcctgtgtgctatttcagtgtttagatgaattgattgtgttcagttgtcatacactgctaaatattataaggccatcaacaaccacaagtttaccaaaactccgcattttaaggataaggggatgtaatgagctagaggaaatttgcggaagcagtaatgagggtgatggagcagtactggatgagattgcttttatgaaattggaggaattgacattgaacaacttaccgaggctcagaagcttttgccagggaagttacgacttcaggtttccatcactacaaatagtacgtttggaaaattgtccaatgatggagactttttgtcagggaaatataaccacaccaagcctcacagaggtggaatatggaagttacgactacaggcatatgctgagtgacggtcctccaaattcgtttcattgcatggatagtacaggcatgaagaaaataactgtagagaagtgtacaggcatgaagaccataattccatcctgtgcgctatttcagtgtttagatgaattgattgtgttcagttgtcatacactggtcaatattataaggccatcaaccacaagtttaccaaaactccgcattttaaggatatgggattgtaatgagctagaggaaatttgcggaagcagtaatgagggtgatgcaccagtactggatgagattgcttttatgaaattggaggaattgacattggaatgcttaccgaggctcacaagcttttgccagggaagttaccacttcaggtttccatcactacaaattgtacgtttgataaaatgtccaatgatggagactttttgtcagggaaacataaccacaccaagcctcacaaaggtggaatatgaaagttacgacttcaggcatacgagtgaagatcatcggcgtatgctgagtgacggtcgtccgcatatgatgagacaatataattggtatggcgaccttaatactactgttagaacagttttcactaaaaagctttag

SEQ ID NO: 53482 - DNA, 825 bp, Glycine max
  Peptide Sequence Number=SeqID_170260
atggagaggaagtggtacctctcaaccctaaccgacgtggaagaggtcaaaatggtgcaaagaatgctccccgtgtgggccaccaccatcatgttctggacagtctacgcccaaatgaccacattctcagtccaacaagccaccaccatggaccgccgcataatcggaaactccttccaaatccccgccgcgtcgctcaccgtcttcttcgtcggaagcgtcctcctaacggtccccgtctacgaccgcgtcatcacccccatagctaagaaactctcacacaacccacaagggctcacccctttgcaacgcattggggtagggttagtgttctcaatcttagccatggtgtcagcagcacttatcgaaataaaacgcctaagaatggcacgtgcgaacggtttggcgcacaaacacaatgcagtggttcccataagcgtgttctggcttgtcccacagttcttctttgtggggtcgggggaggcatttacgtacatagggcaactagattttttcctgagggaatgtcccaaagggatgaagaccatgagcacgggcttgttcctcagcacgttgtcgttagggttttttcttagctcactgttggtgactttggtgcacaaagccacgcgccaccgcgaaccgtggctcgcggataatcttaaccatgggaaactacattacttctactggctattggctttgttgagtggtgtgaatttggtggcgtacttgttttgtgctaaggggtatgtgtacaaggacaagaggctcgctgaggcaggcattgagttggaggaaacagacactgcttcccatgcttag

SEQ ID NO: 53483 - DNA, 771 bp, Glycine max
  Peptide Sequence Number=SeqID_170261
atgacatttaattatttaattactgttttctcaaacattgtgcaggtgagtcaccatccaactgtcgttggctgccactgtgaaggtagaggttggaaattttgggctgacagtaacattcggtcaaagttttggggaaggtcaattcagcttgacccagtgggagttctgaccctagagtttgatgatggtgaaatatttcagtggagcaaggtcacgactacaatttataatcttatccttggcaaaatatattgtgatcatcatgggaacatggacgtccgtggtaatcgccaatattcgtgcagactcaagttcaaagaacaggcgattcttgatcgaaatcctcaccaggtgcatggctttgttgaagatgtaacgggaaaaaaggttgccacattatttggcaagtgggatgacagcatttattatgttaatggcgaagtgaatgtgaagccaaaagatttcactatgtcgtcagtcacaaacttgttgtggaaaaggactatgccaccttctaatctcacccgctacaatttgacatcatttgccatcacactgaatgagcttactcccgggctaaaggagaagcttccacccacggattccaggctgagaccagaccagcgacatctagagaatggggaatacgagaaggctaatatggagaaacaaaggttggaaaagaggcaaagaatggtatgtttgaactctttcgtgctttgttcgagaaacgtgcattctatcctttctttttacctttcgttgtaa

SEQ ID NO: 53484 - DNA, 795 bp, Glycine max
  Peptide Sequence Number=SeqID_170262
atggcattgtttactgatcctctctcccatccaaagaaaaatcataatcatgaaccatgcatgtgtttagtttctagatgtggaagcttctgttcccctgctgctaatattgaacctgaggccactgccttgcatgacagtgaataccaattaacaaagaatgaattttcaagtctaggacgtggaaaatatagtgaatgcagtactactgaatcatctgatgatattgagaagcaggagatggaggaagtgtcagatgaagatgaaatctcatattatgacactaaagagtattttacagaacatggttttaggtgtgggtcaacaggaggtttggatccaatgaacatgtctggggaagttaacacacaatgcatagatttggagaacagtcttgttgggcagacgatcaatgaatttaggtaccctctgatagcaaggcgaaagaagcttccagatcctgttgagaaagagaaaggcgtcagtctttggtcaattatcaaagacaatgtgggcaaagatctcacacgagtgtgccttcctgtatactttaatgagccaatatcatctcttcagaaatgttttgaggacttggagtactcttttcttctggatcgagcttatgagtatggaaaatcaggaaacagtctacttcgggcactgaatgttgctgcctttgcaatttctggatatgcatcatctgaaggtcgtcattgtaaaccctttaatccattgttaggggaaacttacgaagctgattttcctgacaaaggagttcgtttcttttctgagaag

SEQ ID NO: 53485 - DNA, 426 bp, Glycine max
  Peptide Sequence Number=SeqID_170263
atgaaaattggagaatcgtactgtatataccttgagatggacgacggaggaagaggaggaggaaggaggtttgtgattcttacggcgcacggtggcggatgcggcttctctggcgagacggttggcggtgacttctccgatgaggcggacgtcgtcgaccggagagaggaggttgaggttttccggccagcggatcttggcgtaggagaggacgccattgcggaggaggaaccagcgggatctccatcccttgccgtaattggtccacttgtagagaactccggccacagtagcctccgatccccgccgcgcaatgacgtcagatccgcccgccggaagactcctcgtcctcgacagcgccgccgcctccggctccggcgagtcgctcccgatccccggactctccagcgagatgcagcacaacgg

SEQ ID NO: 53486 - DNA, 1317 bp, Glycine max
  Peptide Sequence Number=SeqID_170264
atgacgcatgtttacattgaagttttagctgaacgagagtgtcaaaatatgaagaccataatcccatcctttgtgccatttcagtgtttagatgaattgattgtgcccagttatgatggacaggtaaatattactatatcgccattatcaaccactagtttacaaaaactccgcattttaaggataagtgaatgcgatgagctagaggaaatttgcggaagcagtaatgagggtgatccaccacttggcgagattgcttttatgaaattggaggaattgacattgaaatgcttaccgaggctcagaagcttttgccagggaagttacgacttcaggtttccatcactacaaattgtacgtttgaaagaatgtccaatgatggagattttttgtcagagaaacataaccacaccaagcctcacaaaggtggaatatagattgagtggagataattggtatacgagtggagatcattggtatggcgaccttaatactactgttagaacagttttcactaaaaaggatcaatataatccagacttggggaaactggctatcagagacaacaatgatctgaagtccatatggccaaatctagtgactccaaattcctttcctaacctgacgaaaattgtcatttcttcctgtgaaagccaatatgtgtttcccatccatgtggctaaagtgcttcggcagctccaagttcttaaaataagcttttgtaccatagagaatattgtcgaagaaagtgatagtacttgtgatatgatggttgtttatcttcaagtacagaagtgtcatgatatgatgaccatagtcccatcctctgttctgtttcattctttagatgtattgcatgtgtactggtgtgaaagactagtaaatattataaggccatcaacaaccacaagtttgccaaacctccgcattttaaggataagtgaatgtgatgagctaaaggaaatttatggaagcagtaatgagggtgatggaccagtactggatgacattgcttttatgaaattggaggaattgacattgaacaacttaccgaggctcacaagcttttgccagggaagttacggcttcaggtttccatcattacaaaaggtacatttgaaagactgtcccatgatggagactttctgtcatggaaacttaaccacaacaagccacattgaggtgcgatgcctatatagatggcgtaatgaagaatcagaagatcattgggatggtgaccttaatactattagaaaattttcactagaaaggtacatgtcaaccaaacttccaaacttccaaacttcaggtttctag

SEQ ID NO: 53487 - DNA, 288 bp, Glycine max
  Peptide Sequence Number=SeqID_170265
atggcaaggcaagagagtctaatgaaaagcttgtccaaagctaaaaccaggggttctgcagtggatgctgggatcagtctaaagttggtcccaacgtcgcaagttgtagccatggctactatggtcgtacctagtaaggagtgttggtggtggctcagggttggaagaagaaagaagatgaaagaattttacaagttgagaaaaagatcaaagtggccagcggcacacccaccatgggaactaaagtgctcaagaagccctacatccaacggtgatcctgagtcctaa

SEQ ID NO: 53488 - DNA, 1377 bp, Glycine max
  Peptide Sequence Number=SeqID_170266
atgggagaagtgatgactttgagtgtatatgaaatgcccttcatccctttcgtaccctccctcaatcccttgataagccttcgctcattgaatctaaatagttgtatattaggatacattaggatagtggcagaactctcaaatttagaaattctttccttggcggggtctagtattgcagagctcccaggagaaataaaacgtctgactcgtcttcgtttgctaaatttaacatactgcaatttactaagagtcattcctccaaatcttatatcaagtttgatgtgcttagaagaattgtacatgggaggttgtgatagtattgaatgggaggttgaaggaagcaaacgtgaaagcaacaatactaacgtacgtgagttacagaatttgcataatttgacaactttggagatatcattcaaaaatacttcggatttgccaatggacttccagttccctgcaaatctgaaaagatacaacatattgattgggatttgtcagttctcttcattatggtatggtggagctctcgaaagaacacttaagctcacagactatagttggacgagcagatcgttgttcaccacagttgaggacttgagctttgctaaattaaagggtgttaaggatttgttgtatgatttggatgtggaaggttttcctcaattaaagcatctgtatatccaagacactgatgaattgttgcacctcattaacccaagaaggttgatgaatccccatttggcattcctcaatttggagactttggttcttgacaatctacataagattgaagaaatatgtcagggtccaatgcacacacagtcttttgcaaagctaaaagttattaaagttacatcttgccatcggttgaagaatctgtttttgtattctctcacagtaaacctttctcaacttcatgagattgaaatttctagttgtgaaggtatgtcagagatcatagctgtggaaaaacaagaggatcagaaagaacttcaacagattgttctgcctgaattgcattctgtcactttacgacgtttacttgagcttcagagtttttattgttttttaaccgtcgaccagggtagtccatccaatcagagctatactttggcactgtttaataatcaacaggtgttgatccctaaacttgaaacattggagttgtatgacatgaatgtatgcaagatatgggatgataaactttcagtcctttcatgctttcaaaacttgacgcgtttgatagttatcaaatgtaaacatttgacaagtttattttcatctggagtggcaagagcactggtcaaactacaacatgttgagatttcctcatgcgaaaggctgaaaatcatatttgtcctagaagagttatga

SEQ ID NO: 53489 - DNA, 1080 bp, Glycine max
  Peptide Sequence Number=SeqID_170267
atgtcagagattgtgcctgcagagcccattggtggcatctatttcgagccaggagagacatcaacggcaacggcatcagcatcagaggcaccccgtgtcacgttggctattaccaatggcagcaacaccgttgaatatgttccagaaccctttgacagtgaaagattgccaacagtttttgcttctgaaatccaaaggttccttcgagtggctaacttgcttggaaaggaagagcctcgtgttgcttatctttgtcgtgttcatgcctttgtgattgcacacaacttggacaaaaattcaagtggaaggggtgttagacaattcaaaacttcactacttcatcgacttgaacaggatgagcatgttacgaaaaagaagggaacaagtgacattcgcgaacttaaaaatgtataccgtgcttacagggattattatatcagacatgaaaaagcatttgatctagaacaaagtcgaagagagagattgataaatgcacgagatattgctactgttctgtttgaggtgctaaagacagttacagatccagctagttctcaggcccttatccaaggaaatgcaatccataaaaaaactgaatttaacatccttccacttgagcaaggaggcattcagcatgcaattacgcagaagtctgagattaaggctgccgttgcagttattcgcaatgttcgtggtttacccccagcacaagatttcaagaagcacggagcctttgtggatctatttgattttctacagcattgttttggattccaggaagccaatgtggccaaccaaagggaacatcttattctactcttagccaacatgcagactcgtcaaactcataaccagacatctgttttgaagttaggggaaggaggtgtagatgaattgatgagaaagtttttcaaaaactatacaaattggtgcaagtttttggaaaggaaaagcaatatccgttgttcttctgataaaagacagggtgtctttcttttttctgaccttctgttttacttagtaagcccgttacttgttttgcagtttacctttagtgaagcaggaatcccaacaatataa

SEQ ID NO: 53490 - DNA, 657 bp, Glycine max
  Peptide Sequence Number=SeqID_170268
atggcatatgaattgcatggaattttatgtggtgctatcagtttaacaacatgggaaaaagtcatgcctgcatatggaggagaacctgagtctttccttaacaatgttgtcacccgaatatacactgtcataaaacaggaagttgacaatagcaaaggaggggcggctgattattctgtatggagaaactatgatgatctgaatgagtatttctggtcccctgattgtttcaaaattggttggcccatgcgtcttgatcatgaatttttctttgtaaagtctagaaataaaccaaaaccagatgtcaagaatgctcttgttgtgtcacctggtaaaacaaaagagaagaagaagagagaaaagagggatgaagaagaaccagaggatacaagggaggaaatccatgaaccacaatggctaggaaagacaaattttgtagagattcgttcattctggcaaatttttagatgctttgatagaatgtggagcttttttattctatcccttcaggccataataatcattgcttgtcatgacttgggatctccaatacagttattagatgccgtagtatttgaggacataattaccatcttcattacctctgcatatcttaaacttattcaaggtatggtgttcttttatatcattaattga

SEQ ID NO: 53491 - DNA, 330 bp, Glycine max
  Peptide Sequence Number=SeqID_170269
atgaaattagaggaattgaacttgagaggcttatcaaggcttagaagattttgcaaggaaagttacaacttcaagtttccagttcttcaaacagtaagtgtgattcaatataatgtgtaccaagtaaatactttctgtcgcggaaatttaatcagacccagtctctcaaaagtacaatattcatggggagatcgagaagaagatcgttgggatggtgaccttaataccactctggaaagaatagcaaaagaatttaagtctgacaacatcaaaacgtctcagtatggcatcaaaaagcctgacagcgaaatgtctgacaatgaaatctga

SEQ ID NO: 53492 - DNA, 329 bp, Glycine max
  Peptide Sequence Number=SeqID_170270
atggcggttcatggcggaaacttcgtcttctccgcgagaactcctcgctacaggccgccgttcgtgacagatgcgtcgctgccggagctcgtcgccgccgtttgtgccggtgcgtcgctgccagaggtcgtcgcggctgtgtgcgcgtgcggctgcgggtgtcgcggctgggtgcgcgtgtggggtgcgggagggatgcggctgggtgcgcgtatggggtgcgggagggacgccattttccgccaccccgccataaccgccacgaccgccatggctatggcggccgtcatggcgccgccatcccaaacccgccacgccaccgctattcg

SEQ ID NO: 53493 - DNA, 1474 bp, Glycine max
  Peptide Sequence Number=SeqID_170271
atgtctagagagagaaactccagcgagagagagtgcagagaggcaaacactggggagtgggagagggttaggtatagagtgaggaacaccgagagaaatggagcgagtggatttcgggttccccgtcggatccacgagggcaacagggatggccaaaaactaagctacaatcgagctaattggagggacaaaaatgatatctcgtccttttacttcacacgtatagctgaaggtgtcacagaactggacatctggaaccagttcaggaagtggggggctgtaagggagatttttatttctaagcaaaggaatagaaatggctggagattcggttttgcgagattcactggagtggaggatgcgcacaggctagctaagcaactggaccagataattataggaggtttgaggctgtatgtcaatgtacctaaatatgggagagatgagacaaggaaggtaggggcacaaatgcaacctgaaaggatggacggaaagaagcagaacgaaaacctgcacaggaaacaatatcaagcctcgacggacatgacttcgtatgcggaggtggtggctagaggaaagcgcaacaatagccactcgagcaaacctatcaatcaaagaggagaatctcagtcatcccttcagcttgacattacggcgactgataaggaatggttgcggaacacatgggttgggcgcttgaaaaacttaagatggtatgatagacttgacgaagatccattgtgggactttggagaagatataaccccgaagtatattgggagtgatatggtgctcttactgggcctcacggatgaaatggcagagtgcatggcgaaggagataacggaggcagaagcactgttctattccctggagaagtggcaccctagccttcgacccgggaatagactgacctgggtccattgctggggcattcctcttgaagcctgggataagaagaacattcagaggattgtctcggtgctaggagacatggtggacatcgacgacgatacagaagagtctcgtaggatggatcgagctagggtgctacttcgtacgtcacggggtccagcaatccaccatacgataaacgtcgatataaggggggacgctcacagagtgcaggttgtggaggaagtaagtcgtagtggtgagacatgccagtgttggagacggcgatcggaatggtcatcggaggaaatagaatctgatgatagtgcttttggatcaccgataaatgaatcatttgatccatgcagaggtgaagacaggtttcgaacatggaacctagctgatatgttggagacggcaaggaatccggccaaagatactgcagggaccatcgttggacaccaattgcaggcgccggaagttccaagtccactattacccaaaggtccatccattgatgttggaccaatgtataaccagcattattcagtggacacagtttcgaattccgacggtccct

SEQ ID NO: 53494 - DNA, 5266 bp, Glycine max
  Peptide Sequence Number=SeqID_170272
atggcactaagcaccattgagcacaacatgtgcaaggcgttgcatccaaattttatcattcaaaacccgaaatacattaagaatgctctaggcaaaggcctcatttatgaagataggggacatgctcgggtagttggctactcagatgcccgctggtctgactcctttagtgatagaagatccatatctggaatacaggaccatggtgttagtaacttgagaactcatatggctgaaagtctgaaacagcttcatagagagctcaagttccctgaagacacaacggaaaaagacttgtggtaccatttcaagcaggcaggagatgtgagggagattttcatctctccaaaacgaaacagaaatggcaggagatacggttttgtcagattcaaaggggtggaagatgttcatcagatggaaaagaagctggacagtatggtttttggagggttaaagatgtatgtcaacacccctaaatttggcagaacacatcgagtaaattcacaaccagttgttagggggagaatggagggccaacatcacacagaaggggtgagagacgtgtaccagggaacgaagcaagcagcaaatgtgaagttcccgcaagggtcatatgtagaggcagtaaggaggcataccccaagaacagagcagaggtggacccaagctaaggagaacagcaggtgctgcatctcgacgtcatcagtgagcctagatatacaggtgatagggcaacaatggctcaaaggggcttgggtagggagattaaaaaatttggccctgtttgacagtctagaggatgaaatgctatgggacatagatgaaaccatatctccaagatacattggggatgatatggttttactcatcggtctcaccgacaaaaaagcccagaatgtgatggaggaagaagatgcaggttggagtgaactgttctactcagtggaaaaatggacaccacagctgcgtcccggttatcgtttgacatgggttcaatgctggggaataccattgatagcgtgggacatgcagcatattaaacagatagtgccctccatcggtgacatggtggacgcagatgatgatattcgaggagaactacatgtggtacacatagtggaggaaaatgggaaatattgcgccaattgccagcacaggagaagcaatagccaaagttcatctgaggagattcaatcggaggaaagtaatgtcggaacgcttctaggagatgtcccgccaccgtggtggaacgaaatgagattgaaggacaaaatgggtgtgtgcagcgaacccagcggcaacgcgccgaggtcgggggaagggaaggaggaagaaagctcgcctgaaacaaaaggaccatgtaggtcggaggggacaagcccaccgacaattgtcgacgtgcaaggcggcgacgcggggaaccagctcgcggagtcaccgacatggcaggatgataacatgcaggaacctctggagtaccaaacgggtaacgatgacgaagaacagccacccacggggcacgggacagcggaaaaccaggcggacggcggtggcccgatctcggatggaatggtcgtagcgcaagggcctgacgggttgagcttgggtccagattcagcgagtaaagccattaaccgctggatattaaacctagctgacactgtgcaaccctatgttgcaggggttcagagccaaagttggggggaaggggagacagcaaaatctaccgtgcaccaaattggggaaagaagtgaccccaggggatatgcctctggtgaaatcagagagagcattcacaaaaaaggaaaagtggaggcagagatgaacgttggagagcctgataattttaaatacgggagacctaaggcacgtgacaaggaggtggagaggcagatggacttggggggcaaaaagaaattaggccacaaaagtgtggctctctcttcgtgggatgacacaaacacaacaggaaattcttcaactataagtcagcagcaacatgaagaaacaaagaaagggaatcagctaagcaaattactgcagaaacatcagatcacaacacaggcaaggtcagatggagaaaataaaaaaacagctaacattcaacatgcagagcagatttggagtatgatcaaggacctggggatgaccactggaacttcacaaagggattatactcaacagctggtggaaatggaagtaagagatggaattcgtaggctggtcagggagcaccacatagacatgctgtgcatacaagaaacaaaaaaggagagtgtagagagatcaatgtgtcaagtgttatggggggattcaggattcagctgggagtcatatccttcttctaatgcagctggaggcattctttgtatttggaatgagaaatcgttcaaagtagaaagaaggatttcaggagcaggcgttataatggtaacaggcaagtggggtcaggagtcacaaccaaggcatataattaatatctattcgccgtgtagtcttcaagacaaaaggctgttgtgggagaggattaaacaattgaaataccaaaatcctggaggttactggggtttcaatgaatggattgaggagatggaagttgaagaagtgccttgggtgggaaagagcttcacttggtttaaaccaaatggcaaggtgaagagcaagctggataggttcttagtgtcccctaaatggttatccaaatggccaggctcctaccaaaccgcgcttcataggaatttttcagatcattgtcctatattgcttagatccaacaatgctgattggggtccaaagacttttcgaatattagactgctggcttgcagaaaagtccttcaagaaattgatcgaggaaaattggtcatctaatcaatggagtggttgggggggttatgtgataaaacagaaaattaaagccatcaaagcaaagattaaggtgctacttagaaagcaacttcagcaacaattgtgggaggcagccaaggcacatgagtcattgttgagacaaaaggcgagatccaaatggattaaggagggagattgcaattcgagattctttcatttgttgatcaatgctagacgcaggtctaactgtttgaatggtgtgctagttgatggagtgtggctagaggagccagcaatggtcaaagaggaagtaaggaggttcttcatgcagcgatttcaagaaaatgatcactcaaggccaacactagatggcattcgtttccagaccattgacattcagcacaatgacatgttggtggaacgctttggggaggaggaggtcaaaagggcggtatggagttgtggtagtgacaaaagcccgggcccggatggaatcaattttaagttcatcaagcaattttgggatatcattaaatctgatttcctaagattccttgatgaatttcatgctaatggagtttttcctagaggcttgaatgcttctttcatagccttaatcccgaagaaagtggatccacaattgttgaatgaatacagacctatctcactcataggatgtacttacaagatactagctaaggtcttgtctaatagaatgaagaaggtcatgcatatcctcataaatgaacgacagtcagcattcatcgaaggcaggcacatgcttcataatgtgatgatagcaaacgaagtggtggaggaagcaaaaagaggacaaaagccatgcattattttcaaggttgattatgtgaaggcgtatggctcagtgtcgtgggagttcttgttctatatgatgaaaagaatgggtttttgtacaaaatggatacattggattgctggatgcctaaaatcagcatcggtatcgatcttggttaatggaagcccttcacctgagtttataccccaaagagggcttaggcagggagatccactatcacccatgctttttaacattgtagccgaaggtcttaatggtttgatgaccaatgctttagagaaagggctattcaggggtttcttatcaggaacaaataaggtggaaatcagtctcctacaatacgcggatgacacaatattttttggggaggcaaccatggagaatttgtggggcttttgggatgtcggaccagtggataagagatgcagccagttatcttcactgtggcttgatatcctttcctttcacataccttggcatccctattggggccaatccgagaagatggtccctaaaaaggtggagaacaagttggtgcgactacaaagaaaattcttatgggggggcgcatctgagcaagacaaaattgcttggattagttgggacaaggtgtgtttgccaaaagaagatggaggattgggggttaaagacatacggtctttcaatacaactttgttgggcaaatggaaatggaagctgtttcaaaatcaaggagacttgtgggctagggtaattgaatcaaaatatggcggatggaggagtttaagcgaagcaccgagagccaataaggagtctacttggtggaaggacttgaagaacatatctcaacatccacaacaggggcagctgttgaatgctccgatatcatggaaggtgggccgaggggataaattcaaattttgggaggataattggatagggggagacatttgtttattagagaaatatcaaaggctatacaatatatcggttcagcaagaccaattaattcaggatatgggagaattcaaagaaacaggatgggaatgggacttcaagtggaggagaccactatttgacaatgagatagatcaggcggttgcatttattcaagaggtggaggggatcagaattcagaatgtcattgaggatcagtgggtgtgggaggctgatatcagtggaaggtactcggttaagagtgcttatagtgtgcttagaaaggatatactgcaggaggctccagctgaagcatttaaggaattatggaagcttaaagtcccatctaaagtgactacgtttgcgtggagcatcgaggagagcgcgagtcatctatttttccactgcagtaaagtactttcgctgtggtgggaatccttgtcttgggtgaatatggtggttgtcttcccgaatcacccaagacagcactttatccagcacatgtatcaatcgtatgaaggtctgatggcgactagatggaaatggtggtgtgtttttattatggacttggctgagacatttagagaaggagtggttccttctcagactattttgtctgattacggaaccattcccatggcaacttcctttctgtatttcagtacctctg

SEQ ID NO: 53495 - DNA, 213 bp, Glycine max
  Peptide Sequence Number=SeqID_170273
atgtcgctagcacgacaaattgtgggtagcctggaatttgaagaggcacaatgcaaattgtgggagcgtcacagtttctcggcgatagaggttggaaatgagtgcgaggagaaactctgtgaagcggaagccatggaagttgaagaaggatatggaaaattcgaagagaagaacttctacgaaaaattggctctatataccattttagactga

SEQ ID NO: 53496 - DNA, 435 bp, Glycine max
  Peptide Sequence Number=SeqID_170274
atggggaccttcaaggatgcaggttgggagtgggagtttaggtggagaagaccattgttcgataacgaaatagatatggcggtctcattcctatcggatgttgcaagccacccaatacagccgcataaaggtgatcagtgggtatggaaggcagacccaagtggacaatacacggccaaatccgcatatgatatggtgtgggggcaaacatatgaacagcaacaggatggagtatttcaacagctgtggaagctcaagcttccgtctaaaattactatgttcgcatggaggtcatctattctttcattgtggcaagataatgccagtatggtgggagtccttatcttgggtgggtatgttgggtgtcttcccaaatcacccgaggcagcactttctccaacatatacatggagtgacagagggaatgaggtctag

SEQ ID NO: 53497 - DNA, 1395 bp, Glycine max
  Peptide Sequence Number=SeqID_170275
ggagaaggagaacaaatcatctcatgttgtgccggtagaacaaagaggagaactgactgaagagaacggggaaatggataaaaagcagagcagacttcggaaaagagttgctgctttgatgaaaaaacagaagaagctacaagcaatgggaatagtccgaggacaagatgattggaaagcttggggacaagaagctcaagtaaaggttggatctcgattgatgcaactattaatagaaacagcctacattcaaccgcctgccaatctgattggagatggtccaccggatatacgacccgcatttaagcatacccttaaaacactttcatctgagtcacagaaggaaactaggagatatggtgtcattgaatgtgatcctctggtgcaaaatggccttgaaaagtctgtaagtaactctagggaatgtttgtacttgaattcatgtccacatttcattaagagggcaaggcacatggtcatcccctatatgccaatgttggtgccacctataaactggacagggtatgacaaaggagcatacttgtttttgccatcgtatgttatgagagtacatggagcaaagcagcaacgtgaagcagttaagagggctcccaagagtcaacttgatcctgtttttgaggcccttaatacccttggcagtaccaaatggagggtaaacaaaagggtactctgtgtgatagatcaaatatgggctaatggaggacgcctggctgatttggtggatcgtgaaaatgttcccgaacctaaggaaccagatacaaaagatgaagcagaaatccgaaaatggaagtggaaagtcaaagctgtgaaaaaggagaataacgagagacattcacagcgatgtgacatagaacttaaacttgctgttgctcgaaagatgaaggatgaagaaggcttctattatcctcacaatcttgattttcgagggcgagcttatcccatgcacccatatttgaaccatcttggttctgacttatgccgaggcatacttgagttttcagagggacgtcctttagggaagtcaggcttgtgctggttaaaaatacatcttgcaaatttgtatgctggtggtgttgacaagttatcttatgatggtcgaatagaatttactgagaaccacctggatgatatatttgattctgcagacagacctcttgaaggaaagcgctggtggttgcaagcagaggatccttttcagtgcttggcagcatgcaccaatctctctgaagcattgagaagccccactcctgagactaccatttctcatatgccagtacaccagagggcgagccctggtgcagcggtaaagttgtgccttggtgacttgttggtcatgggttcgaatccggaaacagcctctttgcatctgcaagg

SEQ ID NO: 53498 - DNA, 354 bp, Glycine max
  Peptide Sequence Number=SeqID_170276
atgaagaatatcctaggcttacaagctccaatggaacttacatcacaaccttggcccatgggctcagaaatctaccctaaggttcatgagaaccctagggccttcttcaacagctctagcccaatcctcttggagcctcttgctcatggctctagtgaccggtcccttcctaaggctgaaaggaaagtggctcaagtgcctgatgaagtggtacttgaggctgtcaaagcattgcctgaggaaaaacaacataaggcaaaacttgctaaaaggattcagtcagccatggagcaaagtgctaaaatcttctccacttatactgctgaaagagaagacaactacaacaagcaatag

SEQ ID NO: 53499 - DNA, 786 bp, Glycine max
  Peptide Sequence Number=SeqID_170277
atggttacctggagtttagatgataaacaagccaatatttgtctcatggcaggtgcagatgataagactaaggaaaaagcatgttatgaatctaatactttttctagtgcttcatcagatgatgaagagaatatgccttatgatgttcttcttcataactatcatatgatttcccttcagtgcaaaaggttcaaagaaaaatttaaagcatttgtttgtcaaaatattgaactaatgaaatccaatgaagatctaaaaaagaaaatccagactttaggagagagtctaagtaaggcaagtaagactgatgaatcctccccaattaaaagactaagagaggaagtagcttgtcttactaaagactttgggaagtttttggaaagttctaaaacacttactatgttgttaaaattccaccaacacccacataaaaagtctggcctaggcttggaaaaaggaacttcatcctccaaatcacagtctaagtcagacaagtgttacttttgtggtagaattggacattctaagttcaaatgcatccacaagaagaaaaaaaattctaagggtactaactatgatggacacaaaaagatatgggtaccaaaatctcagatagtccatgttgcagatacccttggtaggaaaatgctagggtttaagctagtacctggacaatggatgctcatgacacataatgggggaaaggttttgatgatgccaaaacatttacttgatgagcacggattgaatcaaatcaacaaacaagatcaagaaaatctaagataa

SEQ ID NO: 53500 - DNA, 165 bp, Glycine max
  Peptide Sequence Number=SeqID_170278
atggttcaggagttgtttacgcataggaaaggaaaaaaagcgaagggaaccgttaaggcgttggaccttgaaatgatctcaagtggaaaaggccatttggtgcagctggagctcgcccaagtgagccaattgcttaggcttgaaggtatcagcttgcccaggtga

SEQ ID NO: 53501 - DNA, 1512 bp, Glycine max
  Peptide Sequence Number=SeqID_170279
atggatttgatgatgatgcctgtgtcttcagaattgttttctgctaaggttcgttggcctgttttcctcttggcaaataagttttctacagctttgaccattgctaaagattttgagggaaaggaagagattcttgtcaagaaaattacaaaagacaaatacatgttttatgctgtaagagagtgttaccagtcactgaaatacgtgcttgaaattcttgttgtgggtagcattgagaaaaggatcatatgtgatatactaagcgaaattgaaaagcatatccaagaaacaagtcttctaaagaactttaacttgaaagttctcccagctctacatgctaaggttgttgagctagctgaacttctgggagataaagaccatcagcacaaagtagtgaaggccttgttagatgtgtttgaacttgtaacaaatgatatgatggttgattcgagaaatgatgatcaactatttgacagtgtggaaatgaatagagatttctatccatttgccaatgagaattccatccattttccattgccagaaagtggtcctctgatggaaaagatcaagcgttttcatttgttgcttacagtcaaagatacagcaatggatgtgcctgcaaacttagatgctcgtaggcgcatatcattctttgctacttctctgtttacagatatgcctgatgctccaaaagtgcacaatatgatgccattctgtgttataactccacattacatcgaggacattaatttttcgcttaaggagcttggttcagataaagaggaggactccatcatcttctacatgcaaaagatatatccagatgaatggacaaattttttggaacgcatgggttgtgataaccgtaagagtttagaagatgaacacaaaacagaagatcttagactgtgggcttcattccggggccagacactaagcagaacagttagagggatgatgtactacagagaagccttaaaattacaagcatttcttgacatggctgaagaagaagatattcttgagggttatgagactgccgaaagaggtaatagggcattgtttgctcgtctagaagcactagcagacatgaaatacacctatgtcatttcctgtcagtcatttgcatcacaaaaggcttcgaatgatcctcgttatcaagatatgatcgatttgatgataaggtacccatctcttcgtgtagcttatgttgaggaaaaagaggagatagttcagggtaaacctcataaagtatattcatctaaactggttaaagttgtcaatggttttgaacaggataattacttggaagaagctctaaaaatgagaaaccttcttcaagaatttcttcaacgccaaggaaggcgtcctcctacaatacttggtttaagggaacacattttcacaggaaggaaactgagcaagattcctgatgcagcgaaacatgaagggaaagggaaggggaaacgagggctcaacatctcattgattcctaagaataccgagggttga

SEQ ID NO: 53502 - DNA, 258 bp, Glycine max
  Peptide Sequence Number=SeqID_170280
atgaccacccaacctcacttttatttccatttctcagcaaactccaaagtcttcttcacttccctctgctgcatccgcttcagcctctcaccatccacaaacacaacgttttggagtggcctagcgccgactgcaacaatctcgttcaagaaagactattacgcgttctacgacaaggaatgttcgaggattgcagagcatgtgtacttggggagtgacacgatggcgaagagtgtcgagcttctgcggcagcactga

SEQ ID NO: 53503 - DNA, 1728 bp, Glycine max
  Peptide Sequence Number=SeqID_170281
atggatgttctcgatgctctttttaacttcagtgtgtcttctttggcatggttcatgtcatatcaagagaccagctttgtcactattggtcaaaggcttctggctaatcctctcagggtgcgcttccactatggtcatccagatgtatttgatagggtttttcatatcacgagaggaggaataagcaaagcatctaaaacaattaacttgagtgaggatgtttttgctggatttaattcaactttaagacggggatgtatttcctaccatgaatacttgcaaattggcaaaggtcgtgatgtagctctaaaccagatctcaaaatttgaagccaaggtagcaaatggaaactgtgagcaaactataagccgtgacatgttccgccttgggcggcaattcgattttttccggatgctatcatgctatttcactacaattggattttacttcagcagcttgatttcagtgataggaatctatgtatttctctacgggcagctatacctggtgcttagtgggttggaaagagcacttatcattgaggctcgaatcaagaatgtacagtcgttagaaacggctcttgcctcccagtccttcatacaacttggacttctgacaggcttgccaatggtgatggaaatagggcttgagagaggtttcctcacagccctaaaggactttgtccttatgcaattgcagttggctgctgttttcttcactttcgcccttggaacgaaaacacattactatggccgaacgcttttgcacgggggtgcaaagtacagaccaacagggcgcaaagttgtcttccatgctagcttcactgagaattacagattgtattcaagaagccactttgttaaggcgtttgagctattgctgttgttgattgtttataacatgttcaggaggtcctatcaaagtagcatggcatatgtgttgataacatatgccatttggttcatgtcattgacttggttgtgtgcgccttttctctttaaccctgctgggttcagttggaccaagacagtagatgactggaaagagtggaataaatggatcagacaacagggtggtataggaattcaacaagataaaagttggcattcttggtggcacgatgagcaagctcatcttcggtggtcaggtttcggttctaggttgactgaagtattgctttctctccgttttttcatctatcagtatggtttggtctatcacctagacatctctcagcatagcaaaaactttctggtttatgtcctttcttggattgtgattgttgcaattttcctcttggtgaaggctgttaacatgggaaggcaactactcagtgctaattatcagcttggattcagatttttcaaagcattcctgttcctggctgttcttgccatcatctttactctttctattatatgtgaattgtcattgacggaccttttcgtttgctgtctagcattcatgccaaccgcgtggggattgataatgatggcacaagctgcaaggccaaaaatagagcacacagggttgtgggacttcacacgagcacttgctagagaatttgattatggaatggggatagttctttttggacctatagctattttggcatggttaccaattattaaagctttccatgctcgttttcttttcaacgaggcattcaaaaggcacttgcaaatccaaccaattctggcaggaaaaaagaagaagcacagaacttga

SEQ ID NO: 53504 - DNA, 1184 bp, Glycine max
  Peptide Sequence Number=SeqID_170282
atgcaagtcgagttacatgctcttcaaatgaacaatacttggactcttactactcataaaactgccattggatgtcgttgggtatacaagattaagtacaaagctgatggctctatcaaacagtataaagcacgccttgttaccaagggctatatgcaaatggagggattggattttttggataccttctcacctgtggcaaaacttactactgttcgcttcctgttagctcttgcagccctcaatggatggcatcttcgacaactagacatcaacaatgcctttcttcatggcgagctccatgaggaggtatacatgcaacttcctccgggtctctctgttgctaatccacaccaagtttgttgtctccagcgttctttatacggtctaaagcaagcaagcagacaatggttcacttgtctttcttctttccttatttctcatggttttcaacaagctgccgttgatcattccctcttcttaagcttcattggtaattcaactactgctctccttgtttatgttgacaatattgtcttaacaggaaacaacattaatgttattcgtcatatcacgactcttctcgatcacactttcaaaataaaggatcttggtattttaaaatacttccttggtcttgaagttgctcggtcccaacatggcactcatttgtgtcaacgaaaatacactctggatattctctccgattttggtatgcttggttcccgccccaacacaactcctatagactatgttactcgtttgcatgccacattaggagatccgctatctactaaagctttatcttcctatcgtcgtttggttggccgcctcatttacctcacgaacacacgtcctgacatagcccatgctgttcagcaattgagccaatacatggcccaacctaccactgctcattcacaagctgcttctcgtgttctacaataccttaagggtactcctagctcaggtattttcttctctgccaaaggttctctccagctcaaatcttttagtgactccgattgggcaggctgtcgtgattctcgtcgttccatcaccgatttctcagtctatcttggtcactccattatttcatggcgctcgaagaaacaatctatagtgtctcgtagttcctccgaagccgagtatcgagctttagcctcaacaacttgcgagctgca

SEQ ID NO: 53505 - DNA, 264 bp, Glycine max
  Peptide Sequence Number=SeqID_170283
atgagtgagagagtagagcaaacacctagcatggatagttgcctctacctccatccgagcgaaaacccaacagtagctcttgtatctccagtcctagattcttctaactatcattcatggagcagatcgatgatgacatctttgagtgccaaaaataaggtggaattcgtagatggaagcgtacttgaaccaccaaaaacagatcgaacgcatgatgcatggtgtcgctgcaacaacatggtcgtatcttggattgtacatttg

SEQ ID NO: 53506 - DNA, 237 bp, Glycine max
  Peptide Sequence Number=SeqID_170284
atggatgctcgggagctgcagaaactaagcgaggcaaaacatccacggtgtactctgatacacggttttcacacaaatatccttcagttttatcctattttacatttgtataccaaaattcaaaacttcaaagttattgatgcttctttatcggagttgcaggatgaaatcgcggaatatgtgcagaataacatgtggagtccagagtaccctacattagtttacaagaaagaatga

SEQ ID NO: 53507 - DNA, 141 bp, Glycine max
  Peptide Sequence Number=SeqID_170285
atggaatacgattcgctttcaagatgccttggtggtgaaatagtagacacgcgagactcaaaatctcgtgctaaagagcgtggagattcaccgttaaaaacacttgtagatgtgaacttgaaagaggaaagtagtatatag

SEQ ID NO: 53508 - DNA, 141 bp, Glycine max
  Peptide Sequence Number=SeqID_170286
atgccttccataattgaagaacatgaagtggatgatgtcatggctacaccaccaagctcccttcctcagtcatcaactccttcaaagtctacatccaagaggcctaaacaatccacacgactcagaagcttgactacttag

SEQ ID NO: 53509 - DNA, 480 bp, Glycine max
  Peptide Sequence Number=SeqID_170287
atggcccagcagattccaccaacaggtgcgaaatatgtaaaccatagttccagttcggaagtgcaccttgacataccgctatcagggagaaaatggctgcaggacgcatgggtggggagactaaaaaatctcaccatgtttgatagacttgaggaagacatgctatgggattttggactgaacacaatgccgaaatatattggggacgacatggttatgatccttggacttacagaagaaaaggccagacaaatgatggagagggaggaagaggggagggatgtcctgttttgttcgctagaaagatggaacccgatagtgagagcaggttatagactcacatgggtgcaggtgtggggaatacctctaatggctttggactcgcaacagatgacgaagatagtggcgggaattggaaaagcggtggatgtcgacgatgatgttgaggaattgaggaaaatggatagggctaggatcctg

SEQ ID NO: 53510 - DNA, 516 bp, Glycine max
  Peptide Sequence Number=SeqID_170288
gtactagaggccctcaagggttcaacatcaaccagaccagccatatttgctatgtcaaatccaacaaagaatgctgaatgcaccgctgaagaagcattctccattttgggtgacaacattatttttgcaagtggaagtccattcagtaatgtggatcttggaaatggtcatattggccattgcaaccagggaaacaacatgtacctctttccaggcattggtctcggaactcttctttcaggcgctaggatcgtctctgatggcatgctgcaggctgcagctgagcgtctggctacatacatgagtgaagaggaggtactcaaaggaattattttcccttcaacatccagaattcgagatattacaaagcaggtagccacagctgttataaaagaagcagtggaggaggacctagctgaaggatatcatggaatggatgctcgggagctgcagaaactaagcgaggcaagttatgtttgcttgagaatattaaacatttttgcatgcctgtcctaa

SEQ ID NO: 53511 - DNA, 291 bp, Glycine max
  Peptide Sequence Number=SeqID_170289
atggaactcggtaatagaacaataatgaaacagaaattaaatagcaatgatcaatgggttcgccaatggtcacaacatttgcagaacctgaatcatgaagaacagaaaggtgaatcagagagggtcataaaggatcagagaggacaaaaaagatatttcatagggatataccacacgcataatgagctcatggcacaaaattcttcaataaaacattctctctcctttgtgtcacacttttccttcgatcccccacttgcggatcatgctccatgtgacttttctgattaa

SEQ ID NO: 53512 - DNA, 240 bp, Glycine max
  Peptide Sequence Number=SeqID_170290
atgacacaagaaagctttgtaccctatggtcatcaggatatactgaccattgtcattggacaaccagagcacccaagtcatgttcgtgctatgggacttggtgtcaccattagccaatactttggacatgcatcacatggctccaagagttctacatccattatcccacaacatctgactaagatgatacaaaaccttaaagaagagtggaagatagaaacaaaagaggagaacaaataa

SEQ ID NO: 53513 - DNA, 588 bp, Glycine max
  Peptide Sequence Number=SeqID_170291
atggcaaaaaacacgcgtttgaaagatttgcaagctgaagttcgtggtcaagctgacgatatcaagaaattgatggagctcctggatcttcgtgatctggaaccacgagatcatacgaaacaacctccgttcaacagtggttcaccgggaaacaattcaacatgcggggtaactccacttcgtagtgtgattcatgtcagagacatttccctgggttttcctcattttgatggtcattcttcagtgctagaatggatttttaaggctaagaatttttttgattatcaccatacacctgatgctaatagagtggatattgctgcaatacactttgagaaagaagtcgtaccgtggttccaaatgttgcaacgcctctctgcaattaagacttgggcagaattgacaacggtgttgaaatcacagtttggtccatctcccttcgattgttcgatggtggagcttttcaaattacaacaaatcggtacagtctctgattattatttgaaattcatgtcacttgcaaatagatcttcgggtttatcggatgatgctttgttgaattgctttctgagtggtcttcatgcttaa

SEQ ID NO: 53514 - DNA, 198 bp, Glycine max
  Peptide Sequence Number=SeqID_170292
atgtggaaactaatgacatcacctgcctattttgcagaagtcatgatgaggatgaggctcacttattcttcacttgtgctaacatcttgccgctatggtgggaatcgcgatcatgggtcaggagacataacatttggaggaagcagtcctcgtagatcaagacgatctcgttctgtcatggaaaaagctgtcccctaa

SEQ ID NO: 53515 - DNA, 1695 bp, Glycine max
  Peptide Sequence Number=SeqID_170293
atggcagtggttgatctgaagaggcttgaagttcaagctagagatggaccttctgatcctaatgcattggccaagtggcggatacttaaccgcttgcatgacagaaatgagactatgtactataagtccaacatcggatggagatggtttggtcgtttgctgtccagtgttgaagttcccagattaggaaccaacaaagggagtttaggaggtgacatgtttggtggttctcctatactagtcatttgtctgttgtcaggagagctgtatcgagaatcatcggttttgattgccaaaatagaggaatatgcaccaatagtgtatactccaacagtgggtcttgtatgtcagaactatagtggactgtttagaagaccaagaggaatgtacttcagtgctgaggatcgtggagaaatgatgtctatggtgtataactggccagctgagcagcacgtgaatttgcttgaaaatgtgatacccaattttcatccttcattggatttgtttccaatgagggcgagccctggtgcagcggctgcgtacaacatccctcccccataccttcgcatagcgaagagcctccgggcaatggggtacgaacctctttgcatatgcaagggtaaggctgcgtacaacatccctcccccataccttcgcatagcgaagagcctctgggcaatgggaatcttgggacttggagatcttggagttcaaggaattggcattgccattgggaagcttgatctatatgttgctgctgctgggataaatcctcaaagggtacttccggtgatgattgatgttggtactaataatgagaagttactcgaagatcccttatgtaaggatcctttaatggattgtgttaggaagtcctacattgcctgtctcaattcttggggtgtagcttatatatctgttggacaacttcacttagtgcatttgtggaggggaggtgttaggaaatcccacatcgcttgcctcagttcttggggtacagcttatatatctgttggacaacttcacttagtgttaattggttttaagttgaaatctaacggattggagcagcatcgtcttgatggggatgattatcttgctgtagttgatgaatttatggaggctgtctttactcgctggccaaatgtgattgtgcagggaacagctggagttgcaattgctggacttctaggtgctgtacgggcgcaaggaagaccaatgattgacttcccaaagcagaagattgttgttgctggtgctggaagtgctggaattggggttcttaatgcagcgagaaaaacaatggcaaggatgttgggtaataatgaagtagcttttgagagcgcaaagagtcagttttgggttgttgatgcacagggattaatcacagaaggacgtgaaaatattgatccagatgcccttccttttgcaagaaatttgaaagaaatggatcgccaaggactgagggaaggagcaagcctcgtggaagtggggtatggaattgtaagttctacgctgaatttggaaatagaactgggagctctgagagcctttctcaagcttgggggagcatttgctctcatttggtttatacttatccctctctgcttttacttcctttctgttactgtcaagcaagtgaagcctgacgttctcctaggattatcggctgttggaggattattctcaaaagag

SEQ ID NO: 53516 - DNA, 216 bp, Glycine max
  Peptide Sequence Number=SeqID_170294
atggaggggcggtggccttcggtggtggtgaagggccgcgacagcagcaagtgcgcggcggtcacgtggcgcttcagcagcgacgacgagttcctcacgtgcttcaacagcatcgccattttcttctgttctttgttttctgtgaaaatgagatctaatctaagcgttctgagtttgcgtttcacttcatatcgttgcggtcaaggcaggaaataa

SEQ ID NO: 53517 - DNA, 239 bp, Glycine max
  Peptide Sequence Number=SeqID_170295
atgagcaatgttaccattctcacaacgatcaccgacacccttactcttcctcctcttgctacattctcacgtaaaaaattaagaaacagcaacaaaatagcaccattgagcacggaattgaagacccacgcgccaatcccgttacacccacctgtcaaaaaatgcgacaagagtaacgtcacgtggcaaaccaagttgcacccaagcagcgcaatctggcagttgagcacgagtgaaag

SEQ ID NO: 53518 - DNA, 282 bp, Glycine max
  Peptide Sequence Number=SeqID_170296
atggcagcggaatggagaaggaagagagagaggagacgccacttcaaggagaagatgagtctagaagaagctcaccaccataggaggccatggataagagcttggaggaagaaggagatgaatgaagggagagggagagaagagcacgaaattaggggcagattagaagttctcacttggattagcccatgtcatcaagttttagcaggattgacagacccttggcatcactctatgactttaaatcaggaaagtttcacttggtcacataccaaagtgtga

SEQ ID NO: 53519 - DNA, 615 bp, Glycine max
  Peptide Sequence Number=SeqID_170297
atgaagatgcaaaaagcaagaaggggccctaaagggtgcatagaaggaattcaacacttcgaaataaaaactaactggtcgatgaacaaagaacgaacgaagaacattgaagaacgatgtaggaatcgatcacggaagctattcggaagcgcctcagccttatttttcttctttctccttcttctcactaatttcactaaaatgctctcaatatatgaagctgaaccccttccttcagccccctcatgcctatttataggaaatgaggggaggaggttgaacagcagcttgcccagacgagctggttacttcactcctaagttttccagtgggcccaggggtctaaaaaagcctccaaatgacccttttaccctccttcttgggtattatcgcaacatgccctttggcgggcaagcgaggcgaggctcacaggtgcgctttccaaaggaggaaagatgcccagagtcgccaccaatgtttatttgtggaaaacatcagaaaaaccgaaggaaaccggtcaaaaagaatgttccaagttcgggagttgtatttacgtttgaggaaggtattagcacctctcacgtttgtctcaaaggacaacaacctattttttag

SEQ ID NO: 53520 - DNA, 744 bp, Glycine max
  Peptide Sequence Number=SeqID_170298
atggcaactagtgtatatattcaccaagtcattgagaggtccatggggacaagcacggtgatagcctccactaaccaagcagtccagtggatcactccccttggtcttccagtagtacaaccctaccgacagtttggaagacatcttatcaagacttcccttcagatattgacattacaacgggagactaacaaggtcatggttaaacggcagagaacagcttttcccccaaatttcgttcactctcttgatggttctcacatgatgatgactacagttgcttgtaaaaaagcagggttgaactttgcaggggttcatgattcatattggacacatgcgtgtgatgttgatgaaatgaacaggatactcagggaaaagtttgttgaactctatgatgctccaatattggaaaatgtaaagtattttgtatctttatttacaggcttttttattgggttaaatgtgccgccttttaaactttcttctttgggatttctgtacaatgaaactaattacgtagcagattgtattcatgttgaactgttgttggagagctttcaaaagacttttcccgcattgaacttccctcccttacccgaacgaggtgactttgatcttcaggagataaagtccaatagcgtgaaatttgtatgtatatatatgcatgggattgagaaagccccaacgacaacagtcatggagaagaaagaagtgtgtgaagcaagaactaggttgccaaattag

SEQ ID NO: 53521 - DNA, 555 bp, Glycine max
  Peptide Sequence Number=SeqID_170299
atgacaaaaactaatgaagtgagggcgagccctggtgcagcggtaaagttgtgccttggtgacttgttggtcatgggttcgaatccggaaacagcctctttgcatatgcaaggaatgacatctcaacgtcttgatgctgtggaggctgacctcgccgccatcaaactcgctcttcaatcacatgaatcttccatttccacccaatcttccaagctcgattcactcgtctcctccatcagcgagctctcgaagtctatttccatcctctgcgacgagatgcatgagtctcgttcttccatctccgacagtccactccgccatgcccctgacgatggcaatctgtacttgaagcgcgttgatcttctcccatttacgggcaacaaccctatagggtggttagctaaaatggaaacctatttttctgttcaaaacaccccaccagaaatgcacatttccctagctcaaatttgtatggagggaatgacaagacattggttcatggtcctctcctactctaatccacacctaatacggttctggttactgatcgcttga

SEQ ID NO: 53522 - DNA, 216 bp, Glycine max
  Peptide Sequence Number=SeqID_170300
atgacacccacccccaagaatttctccatttatcagttgattcctcatggctcgaatggtcatagattcaagtgcttccgtaatagagacctaataaggcttgctaaggaaggcattgaggataaacttgtagatgcattcgaagaccttggagagcccctagcaagcacaagaaccaagagatacaaaggaattggaagggaaactcaaccgtaa

SEQ ID NO: 53523 - DNA, 654 bp, Glycine max
  Peptide Sequence Number=SeqID_170301
atggctccgaaaaagctttccacgaagaggtctagaagagacaccgcagcggaaaggtccagtgccgcccccgagtttgatagccaccatttctggagcgccgagcaccagcagtgcttcgaggccatcaaaggatggtcgttccacaaagagaggcgcaggagggagtgcgagaggaggaacagggccgatgggttcgacgattacggtgacctgctagttttggaggaaggtcagcagtgtgagttcggccagaggaggaacagggccgacgggttcgacgattacaggcctctaccagtcattcggggttcccgtcacccccagcaggtgcagggtgatgcacatcaggctgcaaacgctcagccaccacctcatcaggccgatcccgctggatcactaggcatggagcgttatctacaacacttggttcgccagcggacgaccaaccaccgggggcaggggcagggtttcactccttttgcatgccctactccagagcagtttggggctgaggtcgcatggcccggagactggcccgaggcccaggcaggggaggagcccgcaggatcccccggtgaggtagaggaggcccgtatggatgaagaaatgacggacttgctcggtttcttgggaggaagcggagccacgtga

SEQ ID NO: 53524 - DNA, 147 bp, Glycine max
  Peptide Sequence Number=SeqID_170302
atgaagacgcatgaaaccaacgttgccttgctagactatggacaggtgaaggatctcccagatcagttgaggctggcctatgctaatctagttcttgcgattgctaatggtgatccattaagagctgtagagagctataggtactaa

SEQ ID NO: 53525 - DNA, 654 bp, Glycine max
  Peptide Sequence Number=SeqID_170303
atacaatcacaaggacttgcactgccttcagagcctgaggttggtccctcgactgcttgtgtcagcacaaagaagagttgtgttgatccctcagggaatgatccagagacgggtgacttagacaaatgtaggttgtacataaaagaaaatcttccctgcctggttgtcctaggaagagtttatgacggatccgcaaccattcacaacatccctttattgcatgatcaagtgaaggtcgatgttgaggaggttaaagatgcagcagctcccgttcctacacttaacaccttccttgcttggccgacatatctggtgaagcgtttatcagaacagggagttgtgggagctgtgggacccgcaaaacctgcagataggccagatcatgaggtcgatgatcccctatatttgcttacactcgatgctaggtggattgttgttaagtgtaatagacaaaaaggaagcacagagtgtggctattacgtgatgcactggatttccactataatcttaggaagttttaggaataattgggaaatgtattttaatgatgctagaccattggaagcaaagagattgaaggcgtttcgcatccagtgggcacagtattatctaaaacttagaaatcaaactttggatgttacggaactatgttaa

SEQ ID NO: 53526 - DNA, 624 bp, Glycine max
  Peptide Sequence Number=SeqID_170304
atgactaatttaagtgctgggcaggaaaggttcaggactctaaacaattcttactatagaaaagcacaaggaatcattctcggcatgctaactttatgtgtacataagaataattttgtactcatcttctatgaggcgattttacaggcggaatggaaatgcaaaattgatggcatatgtgggatgtttcatgcaaaagtaaataaagatactaactgcttggtggttggtggatcactcaattatgaagctgagatgcggaaggcaagagtgatctatgggaggatgaaaataccaatagtcagaaaggactatttgattggctgcttagcaagaaagaaaaggcttccatttgatatgtacaaggttgaaatgattggtgaggcttctagcatggtcaccattaaagtgaagggacatagtgctgttcacgaggcttctggcctacaggattccggccacatacttgaggaaggtggcggcgccatcgagactccgacgaacaatgccgatgccatcgagactccgacgaacaatgccaccgcgagaacattctctctctaccgcgcctcctgtcctcccgtgatcatcaccctccacggttctcccttggaccctctttag

SEQ ID NO: 53527 - DNA, 249 bp, Glycine max
  Peptide Sequence Number=SeqID_170305
atgatgagaatatgcggaagctactctcaagcagatcaagggaaatatagcaaggaggagaaacatggagagtgtgagagggagaaatatagagagagggatgatgaggaggatccagtggcacaaaaagggttgtgtgagaaggagaaagaagaggatatagggaagaaggagctagacgaagagacagatggggaagatgctatggatttgtttgctttggggtgtgcagaacaagagagcacttga

SEQ ID NO: 53528 - DNA, 519 bp, Glycine max
  Peptide Sequence Number=SeqID_170306
atgccacgaggcaggccatcaggctccaagaataagcccaagaccacttccctcctagtggcccaacccgttgagccctccatgaagcttgtcatcatcaacgttgaccgaggtaaggacatcatgcaaactattcttaatgtcgctcaccagggttgcgtcagcctcactgtcctcagcgcctctggcacagtcactagtgtgactctttgcaactcacccaacgatggcggtggtgccctcatgctccatgggcctttcaccttactctccatcaatggctcatacttctacaacaacaaccaatacaatcttcactctggagcaacccgttcccctcctgtatccttcgggatccacctctccacctctaagggcaagatccttggcggtgcaattggcggcaatgtcatcgccggtgacgatgtcagcatcacactctccaccttcagccaccctgagatttacatgtacgttcctaaggatgaggaagaagacaatgatgaaaaaaaacaataa

SEQ ID NO: 53529 - DNA, 486 bp, Glycine max
  Peptide Sequence Number=SeqID_170307
atgaccgacgaagacaaacccaaagccttctccggccaccaccatcaccctcctccaccgcagccacaaccctttcccgccgcccagtacggcaccttccaaggcgtcgccaactaccctcctccgccgcagccgcaccccgccatcggcttccctcaccccgttccgccgccaggcgccgccgactcctccgcccctcctccgccgtactacccggggtaccaagccgttcccggttatgcagttgctgaaggaagacctgtaagagaacgccaccttggttgctgtggccttggttgtggctggtgtctgtttatattaggcttctttcttgctggtattccatggtacgtcggggcaataattatgctttgttccagagtagactatcgagagaaacctggatatattgcttgtgtagttgctgctgttctgggtacaattgcgattattcttggtgtgacaaagggagtagatgattggtaa

SEQ ID NO: 53530 - DNA, 198 bp, Glycine max
  Peptide Sequence Number=SeqID_170308
atggcacttcaaggagaagatgagtcaagaacaagctcaccaccatatgaagtcatggataagaacttgaagttaaagagggaaactgataaagaggcaagagcaccaaaagagagaagaaaaggaggatttccaaacttcttcattgagcatggcctttgctggcctccacgctacaatttaatttccgtagtataa

SEQ ID NO: 53531 - DNA, 222 bp, Glycine max
  Peptide Sequence Number=SeqID_170309
atgtcggaccttatcaaagacggtgtatttgtaaacaccgttgtagacatatcgactgtcaaagacggtcggtgtctcctgttgaggtcaatctccgtcgcaccactgtcagctccgcaaaaggaagggtacattgtcacggctccactacctctgcgtcgcgtattgttcgcggcaccaccgcaacctagggtacattgtcgtggcaccatcgccacctag

SEQ ID NO: 53532 - DNA, 1101 bp, Glycine max
  Peptide Sequence Number=SeqID_170310
atgggagttaccttgtcggagaaacgtgagaagttggtagataaactaacagtgatggagcagtgggatagtaagctgaaaaagaatactatggagatgatgaatccttccattaactcaactggaggacttctttgtgtatggaataaggatacatttcatatgaataatgtttttagaggacatggatttattggcttggagggggtgtggcttgatggactagagaattcacattgtttccatgggatgttgaaagaggtgtggagaaatatcaagatggaggggtgggatgctttcgtccttaaaaaaaagctaaaaggtgttaaggaggctttgaagaaatggaatgtgaaggagtttggtttgttaaacgtcaaaataaagaaaatagagaaagactttaatgagttggatattattgaagaacaacaaggtgaactttgtgaaaaggattgcaagaaaagattacaactccaagaagattattggagggtagctgagctcaacgaatctttgttatgccaaaagtcaaggccaaaactcgatggagtggagttcaaatacttatctagtgaagctaatctcatgctcattacaaaatttaatgaagagaaagtgaatgatgctatttgggagtgtggcaaagtgccttccttggtgggagacaactcttacataatgagattggtggccaatgaggtggcagatgatgaggacaaaactacagtggaaaagtatgctagcatgttgaattgtaaaattctcactctacaatttagttatcaaggtcttcctattggtgctaaccctaggaaggtggagatgtggcatccgattattcgtaaatttgaaaagagattggctctttggaagcataagcacatatattttgtgggttgggaagtctgttctaaacttgtggggattcaaaggaggatcttatggggtggtgatgatgtgaataacaaaattgcttgggtgaaatgggaggacatttgcaaaaccaagaagttgggaggtgaggtgtggagtgaggtgctaatttcaaagtatgatgggtggcatggtcttagggaggataatcatcagattgactaa

SEQ ID NO: 53533 - DNA, 306 bp, Glycine max
  Peptide Sequence Number=SeqID_170311
atggaaagggcttcaccaagggtggaccttgggtttgttgagccttggaccagggatgtgtttgtcttgggttttgtcaagcctacagagctgtgtcgaggcttaccaaggacaggccttggattttgtagacctgacttaccaagggtagaccttgggttttgtgagctctctggagaattgactagggaattgttcaacctaggttttgtgcaccatggtcatgcatacatgccactcaccgtgggtgacacgcactggagacgtggtgatattctcctgtatatatgtcactactgtgggtga

SEQ ID NO: 53534 - DNA, 751 bp, Glycine max
  Peptide Sequence Number=SeqID_170312
gattgcatcagctagtacctctgctgctcctactccttcttcccctcctatggatgttgttgagaaggttactcctgctgctgttgaggctgttgtgctagccactcaggctgattctattgtggtgccatcatcctccatcgtggcacctttgttaagtgctggtgtggtggccaccagtgctccgatggtgctgcctccttcctctacggctctggtggcttctccctctactgttttggtgttggtgatgtcgccttcttcgtcctcttgcccttgtgtctcacttgatcacttgtacacctctagtgatgcttactcactgtggggtgcaacttataagtcaaatttttctcgaaaggagtttggcaattctagaggagattgggctacaacaccaagagactatgtagaaggtggcgaccttacaggcgaaggttggcaacaccctaaggtagctaatgctactattgcttttgctaaggtcgtaaagtcaaacaaccaattgtttgctaaagttggtggtgtattgggcaagttgttgcatacccagttagatggtgatgagctatttacacgctgcaaggacttacaaatagagaagatagatttgggtggcaaagtagagtgcatggaggatgagaaggacaggctagccaaggtagttgctgatttagaggcctggcttaaggagtcagagtccaggctggaggagttcgagttgggggttgccaaagaaaggggagcttga

SEQ ID NO: 53535 - DNA, 282 bp, Glycine max
  Peptide Sequence Number=SeqID_170313
atggatgtttatgttttctcaaacaatgtagagagaagggacgacagaagggacaaaaataagagattgttcgatggtggcttagatggtgggctcgaagaatttggcttctcccatgaccctttgaagatggtgcaccaagtgcagctttccctactcgttgatgcaagttatagaggagtcaaacagcaagatgggtcgagtgctcataatgatggagggactgaagggtttcataggactgggattggagctttggttcaagggatctggacaaaatag

SEQ ID NO: 53536 - DNA, 327 bp, Glycine max
  Peptide Sequence Number=SeqID_170314
atggcccagctcagcgagccatttgtgagccttgtgatcatcaatgtggactcggatagggacattacaaagtctattcttgaaattgctcatcgaggtcacgtcaacctcataggtcttagcatttctagcacagtcaccaaggtgaccctgcataactcgctccatggcattgtcgccttcacactccatgggcccttcgccttgctccccctcaatgactcatacttattcaacaatcactacaaccttaactatggagctacccttccccttcctttggtagtgccattggtggctaagtcatcgccagtgacaatgtcttaa

SEQ ID NO: 53537 - DNA, 1008 bp, Glycine max
  Peptide Sequence Number=SeqID_170315
ggtacatcctttgtggtacaagtagatggtatatctacttgggttgttgtgactgagaacaagagatggtacatctcttgtggatcagttctaggggagggtacatccactaggttgttcaaagagaacaagggagggtacatcccttgtggatctttgcttgtaaaggattttacaaggttgaaaagaaatctcaatgaccgtaggtcgcttggggaatggatacttgatggtaggacttttcaattatctattgttgttcctcctgctaaagaagggggtcaacctgctgttgaggttggccctattgctggtattgtcgagatcccccgcggtgctccttcctctgctttgaataagaggaagcaggctacaaagttgacacccgatttgggtcgccctttgattttgcaagatctgcctctgactccatcggccgtcgaggcatctgctcatgctgttgctgaagttgccaaatggagagctactgcttgcaaaatcaagagagtggagcaccctaagtcgaaccaccaactgtcttccaaggttggcactgttctggaaatgtcactatgcaccaagttggatggtgatgaattgttcgaaagctacaaggacttccataaaaagaaaaaggatttaactggcagggtggagcacattacggtggataggggcaagcttgccaagatcatggcagacttcgaggcctggttgaaggagttagagtccaagctgaaggagttcgagcagcgggcgactagggagagagaggtcaggcagcaacttgaagaagagttgctgatctacaagaatgaggttttggagcagcatgagaaaggctttaaaaaggttgtcaagcaggccggattcttccaaaaggaccttgacttgggtctttttgaccctttcaattgtttttggaagttagttgatgacaaagtgcacatcagcagcaaacaactgacaggattagccaatattgtggtatctatattggctaactag

SEQ ID NO: 53538 - DNA, 276 bp, Glycine max
  Peptide Sequence Number=SeqID_170316
atgggaggaattaaggacgctgaggctgacgcggccctggtgatcgacattaataatagacttcatgatgtccaacccgggtccacattgatgataaaaagcttcatggaaggtgcaacaagttggggcactggagggaagaggagaaaggaaattctaggaaagggagttcgccatggaattgtttgtcataatgacaaagaggtgaatggaatgagaggaggaaaaaatgtgttcccagaagtgatcaagaacactttaatcgattacttctaa

SEQ ID NO: 53539 - DNA, 435 bp, Glycine max
  Peptide Sequence Number=SeqID_170317
atgctgatgctctgccagattctccttcgcgctaagtgcgctgaagatgcgcttagcggagaaagaggttgtccattgtcaaaggagatggtcccgtgtcgagggaaattgtctgatgttgagggcagtagccttgacaagtttatcaagcttgtcaagccctttagcctggataagtgttgtccaggctacttttgccgagttgtcccgagtggacatgcttttggttttgtaggggagcgcacacacaatactcttgtatatgtgtcactcatggagtgggcacgtactgaagacatggtgcatggggagaaaaaggaatctcatgaagagagtacaagtggaggtttcaatcccttctccgtctctctgacgtttgggaactctatcagagcagtcggaggaaaaactgaaggaatctcagggaaccgctag

SEQ ID NO: 53540 - DNA, 147 bp, Glycine max
  Peptide Sequence Number=SeqID_170318
atggaggccagctgcacaacggaatttgtggaaccagtggtcacaattggttttgtgcaaaaatcgatggttctatgcttctttcgcaggaagatctcacgcaactgcactagtcaattttcatctttcccaaaggtacatgcctga

SEQ ID NO: 53541 - DNA, 357 bp, Glycine max
  Peptide Sequence Number=SeqID_170319
atgccaaggtctttcttcagcgaagtctggcaattttggaagaaaatgggcaaaggcaccaagagggatattgctcacacagtcatgagagtggagtgccctaaggtagctaatgccaccatcacctttgttgaagctgtaaagtccaaccaccaactgtcttccaaggttggcagtgttttgggcaagttacaatgcaccagggttaatgaaaaagaaaaaggacttattggcagggtggagaagggcgagcttgccaaggtggtggtggacttcgaggctcggctgaaggacttgaagtccaagctggaggagtctgagctgtgggctactaaggagagggaggccaacaagtaa

SEQ ID NO: 53542 - DNA, 567 bp, Glycine max
  Peptide Sequence Number=SeqID_170320
atgccgctccctccgctgccgattcgtcggcatcaaagcccgcaacctctcaccgccgtgctggagccaacaagaggaagtctgatgccctcagcgcctctggttcctcctcctcgcgacaaggcctcaccgctccaccctcctcccctccataatggccccctcaccagggcccaccaaacccccaacaaccgcacccacccttctgctgccgagtctgccacgctcaccgagcagctcaagaaggagagtgagtgggagactctcgaggccgcgattgaagtcgaatttgaagctatcagatctcgtggtgccaaggctcacgtgttcttcaagattagcgaggaagtggtgattgacgcaacggataagggcaatattgcacgtttaataaaccattatgagcaatccaaaactggacaatcagtacctatcagagttggtggcagaacatcagaagcttggacccttcatgcaagtgcttcccatatgcagccgcctcctaaatcaagctacttcaaaggacttgagattgtggccttgcagcaattcttatttggcaaatag

SEQ ID NO: 53543 - DNA, 462 bp, Glycine max
  Peptide Sequence Number=SeqID_170321
atggtcagggagaaatctcttgtgaaacccaaaactggtcctgtttcaccatctagcatgagaactccaggtccatcttcggtccccaaggaagctagcacagattcaacatcttctcttacttttgtgcgctatgaaggcataactcagctgcacatagttggtgaaacaagagctctactcctccctagaaatttctcaatagattcctttgtcacaacattggttaggcttccaagtttgaaattcctcactttggtttctcttggcatatgggatccattgccggaagagattgtagcagctaaagggtatatatctcaaacaatgaagttcagaacaattggtctgcctccttatcgagctttctcactagaagagattgtagcagctacaaacaactttgactcagcttcttttatgggtgaaggttctcatggaaagttatgccacttgttttaa

SEQ ID NO: 53544 - DNA, 1293 bp, Glycine max
  Peptide Sequence Number=SeqID_170322
atgaatctcattatgtatggcaaaaattcatttttatgggaaggcaccacaccaaaagtgatcatcacagaccctgagcaaatcaaagaagtcttcaacaagatccaagactttgagaaacccaagttgagcccccttatcaatttgttgggcaatggacttacaaatttacaaggcgagaaatggaggatacatcgaaagattatcgaccctgctttccattttgaaaaattgaaggttatgttaccaactttttttaaatgttgcgatgagatggtttcgaaatgggaagggatgctatcttcagacaacaaatgtgaaattgatgtatggcctttccttcaaaatttgacctgtgatattatttctagaacagcgtttggaagtagttacgaagaaggaaaaagaatatttgaacttctgaaagagcaagctgggttgattatgaaattacgaaatgtttacattccaggatggtggttgctaccgacaactacacataggaggatgaaagaaatagatactgatatacgggcgtcacttaaaggaatcatcaacaaacgagagaaagcaatgaaggccggtgaagtcttacaccatgatttattaggcatgcttttggaatcaaatcgtatggaaatacatgaacatggaaacaataagaccgttgcaatgactagccaagaagtaattgaggaatgtaatgcattctacatagcagggcaagaagctacatcgactttgctggtttggacaatgatattgttgagtagatattctgattggcaagcacatgctagggaggaagtattgcatgtttttggtaaccaaaagccagattatgatgggttaagtcacctcaaaattgtgaccatgattttatatgaggttctcagactctacccacctgcagtttatttcaatcgagctatcaagaatgatgttgaacttggaaaaatgtcccttcctaaaggagtgcaagtttccttaccaatattgttgattcaccaagatcatgatatttggggtgatgatgctaccgaattcaaaccagaaagatttgctgatggagttgcaaaggcaacaaaaggccaagtctcgtttttcccatttggacggggtcctagagtgtgcataggccaaaattttgctctattagaagcaaagatggttttgtcattacttttacaaaaattctcattcgagctttctcctgcctatgcacatgctccaaccattgggttcactcttaatcccaaatttggggctcatatcattttacacaagctgtag

SEQ ID NO: 53545 - DNA, 579 bp, Glycine max
  Peptide Sequence Number=SeqID_170323
atggcgctgatttacgccggcgcgtcggcagcgggttcgacgctgagcgtctggtcaccgcagctgctgaaatcatttggcctggataacttcaccaccggtttgatgaatgcgatcccgtacggtctggcatcgattctgatgattgtctggggccgcagctctgaccgcagcggtgagcgtcgctggcacaccgcgctgacactgttcctgattgccggtggactgctggcggcgttcctgaccgatacgctggcgggcagcgtggtgattctgtcactggtgctgattggtgcttattcgatgaaagggccgttctgggcgctggcctcgggctggatgtcctcaaccaccgcagcggccggtctggctgctatcggcgcgatggccaacctgattggtggcgggctgatggtgaacgtttacggcatcattaatgagaaaaccggcagccatgcgatggcgatgattcctctggcgctgctgtgcgcggcgggcgggattgcggtattgctgatgggacgcagcaaaaagctgcacgttgaagcggaacagccggtggccagcaccgggaaataa

SEQ ID NO: 53546 - DNA, 1081 bp, Glycine max
  Peptide Sequence Number=SeqID_170324
tgggcgcgcgcatctggatcgcgcgcatcatgatttcgtggggattgatttcgatggcgaccgcgttcatcagcggccccgtcagctttgccgttgcgcgcttctgtctcggcgtagcagaggccggctttcccccggcatctatctgttctttacctactggtttcccggcagctggcgcgccaaaatcaccgccgcgttcctggtcggcattccggtggccaatatcatcggctcaccaatttccggcgcgctgatgcagatcaccggccatgagcatatccgcaactggcagtggctgctgttgattgaaggcttaccggcggtgatcctcggcgtcatgtgcctgtttgtgctgagcgaccggccggagaaagcgcgctggctggcgccgcgtgaacagcagttactgagccgctggctggccgatgagcaacagcaaatcgcggcaacgcacggttcccagatgcgcgacgcgctgcgcaatccgctgctgtatctgctggcgtttattaacttttgcggcattgtgggttcgatcggcgtgggactgtggatgccgcaaatcatcaaacagctcggtgtgagccatacggcaaccggctttcttgccgcgctgccctatgtctgcggtgccgtgagcatgctgttgtgggcgcgccgcgctaatgcatcagcgcaccgtattcgctggatcagcggcgcgctggtgatcgccgccttagccctgatgtgcagcgcgctgagcgatgcgccggtgatcaaaatgctggcgctgtgctgcaccgtcagcggtattctggcgtttcaggcctcgttctgggcgctgccttccggctttttgaccggcaatgccgcggcaggcggcttagctatgattgtctcgattggtaatctcggcggcttcttcggcccgtcgctgatcggctatgtgcgtcagtctaccggcggctttatgtgggcgctgctggcggtggcggcagtcctgatgattggtgcactggcggtcgccatggatgaaagcaggataacggcagacgtgataagccagatacgtgccctccctggcacaggctcatga

SEQ ID NO: 53547 - DNA, 234 bp, Glycine max
  Peptide Sequence Number=SeqID_170325
atgcttgtggcgcagcagctgccacagggtgatatgaccaatcgctttgcgctgggcattctcttcagccagtttgccgctcagccagttgcgctgttctctgcgggaagaaagccagcacgcccagcacaatcgccggggaatctcttcgatgataaacagccagtgccagccgcgcaggtcggaaccagccgtccatcgtcaggattgcgcccgagatcggcgagccaataa

SEQ ID NO: 53548 - DNA, 960 bp, Glycine max
  Peptide Sequence Number=SeqID_170326
atgcccgtatgtcgccccgccctgctcgccctgtccttgctgatgccccccgccttcgcgcaggtgccgccgccggtccagctgccggagcccattgccgagaagaccggacccgataccgcggcgcgctcgccactgcacgcccaggtgcttctggatcgcgccaatttctccccgggcgagatcgacggtgaagtcggcagcaatcagcgccgggccgtggcaggcttccaggcggcccacggcctgacagtgagcggagagctggacgatgccacctggaaagcactgcaggccgatgcgaccacgccgcttgccagttacacgttgaccgccgaggacgtggccgggccgttcatcgccgttccgaagacgcccgccgcgcaggcaaagctgaaggcactgggctacagcagcgtcgaggaatcactgggagagcgtttccatgcgtcgccggcattgctgaaggcgctcaaccccggcgtcgatctggccaaggccggcagccgcatccaggtgcccaacatcgcaccggctgcattgccgaaggcggcgaagatcgtggtcgacaagtccgattccaccctgcagctgctggatgtgcagggcaaggtgatcgcgcaggtgccggtctcttccggcagccagcatgatccgctgccgatcggtgaatggaagattctcggcgtctatcgcgacccgccgttccactacaaccccaagctgttctgggatgcgcgcaaaggcgagaagaaagccacgctgccgccaggcccgaacaatccggtcggccgggtctggatcgacctgtccaagccccactatggcctccacggaacgccggtaccgggccatgtaggcaagaccgaatcgcatggctgcgtacgcatgaccaactgggatgcgctgcgcgtggccgatgcggtggatacctccgtccccgtggtgatgcaggagtga

SEQ ID NO: 53549 - DNA, 99 bp, Glycine max
  Peptide Sequence Number=SeqID_170327
ggaggggccgaaagagagaactgcagcgatgaaggagcagaaggaggatatagccgagttcatggctagctttaaaacgtcttcagactatctcgccca

SEQ ID NO: 53550 - DNA, 443 bp, Glycine max
  Peptide Sequence Number=SeqID_170328
ggtacatcctttgtggtacaagtagagcgtacatctacttgggttgtaatactgagaacaagagagagtacatctcttgtggatcagttcaagtggagtgtatatccacttggttgttcaaagagaacaagggagggtacatcccttgtggatctttgcttgttaaggattttacaaggttattggaaatctcaggaaccagtggttgcttggggactggatgcaacttgtccagcccatcaacacagtctctacatggaaagtcaacaatgcctaatgctggagccaatcataattttgcatcatcatccaacaccgataccaaaaacatgaaatgcttcaaatgcttaggtagaggacatattgcttctgactgtccaaccaggatgatggaagcttgcttgtggagcttctatggaggatggatctttgagcttcaatga

SEQ ID NO: 53551 - DNA, 381 bp, Glycine max
  Peptide Sequence Number=SeqID_170329
atgagtatttctccctccacaattattattttgcagatcccaacggcgaatatgcgtggaagtgaagcaggaaccacatatcaaattttcacgacaatccaacggttaatgagtcaggatcgtggttttactgagacagttttgggtttctacaggaaaagaaaaagctacgatgcaaagggtttggtgatatcgcaacctacccttcggcgggagggcgacgcgagggctcacgggtgcgtcttccaagaaaggaatacgcgcggagttgccaccaacgtttatttgaggaaaacgtcggaaaaactggaaaagatgtggtctacgaactttaagtgtgaaaggtttgagagttgtatttacgcacggggaaggtattag

SEQ ID NO: 53552 - DNA, 525 bp, Glycine max
  Peptide Sequence Number=SeqID_170330
atgaagaaaatagatacagtccatcaaagtgtgtcattggagaataagacaggagattcaactgtgttgaagataggagattcggctaaagttgtgataaaacaagacatgaagggaggagagcataaatatgggtttaacaacaataaacgtgagaagccacagaaggtaaggctggtggatgatgaaactggcgacaaacatgagctgtttgattgttcttacatagaattgtacaaaaatattctatttgctgcagccgccacaaatgctgtccctgccattactttcatcatggctgttttaattaggatggaaagcatttccataaaacgtgtgtatggattggccatgattttggggtccgttctaagccttgctggggcaataacatttgctttagttaaaggacctcacctgggtttcatgaaatggtatcaagaaaatcataaccatacttctcaccctttaacaattgtgcactccaaaggtgatactattagaggctctcttttgatgctgtga

SEQ ID NO: 53553 - DNA, 489 bp, Glycine max
  Peptide Sequence Number=SeqID_170331
atgggctttaaaaatagcattggagaagatgatgttgttcctatgcttcgaaatcgaataactgagagcaaaccaccaccactgccatctttttccctgcaaccctacagaagctccatagatatgctgaataaagtgctgacccggatgattcaagtggagcaccaaaaaagttgctgcgacaaagtccaacaagtggttcaaagatcagaggaaatgtgcaaatctgcagcatgtcattatgttgagaatttgtcaaatgggtcagcacttgaagtgctgccaacagctaagaatggggtgtggagagtgaagttgttgattgacctgagactaggaaactgtctatggctggagtggaaaacaagagtgttagaaggcatgattaatgattggagtcaaatcaaaggcaagcgagaggcactgccgtggtcactggtcagagaagggaaaggtagacacatcttgcaaattacgaccctattatag

SEQ ID NO: 53554 - DNA, 162 bp, Glycine max
  Peptide Sequence Number=SeqID_170332
atggagctaccacccactattgcaacatgctttctcatgaatgcttccaaatctcaacaatccacgagttctctctcagatgataagaacgtagcaccgcatatcgtgacctttaaccatcacattgtcaacaaattcgacacggaattgttttttagctag

SEQ ID NO: 53555 - DNA, 201 bp, Glycine max
  Peptide Sequence Number=SeqID_170333
atggactcgcatgacatctataaactcgacaatataaacgtaccttcttcaaatcagacagtactggacaaagcggaggatctttggcacgatgaagacggatccacatgctgtgtggaggagcttgtcacagaggtgcttaaggaaggcaaagaggccaaagtcgaagactttgatgttgccaatggcatccaaaagtag

SEQ ID NO: 53556 - DNA, 444 bp, Glycine max
  Peptide Sequence Number=SeqID_170334
atggcgagtcgatgcgggggaccttcgatggcactcaaacaatgggcatgggacacagcggcacaaaagctagataacagtggggatgagggagctaggttgggacaaaagaaaatgagggagctcaatgtaaacatgtctgaaaataagtttgaggtcgtgagtattgtttattttcacgagcaatgtctgtgggcaaaagttgttttaggggttggacctgaatcaggaagggtgaccctgactggtcaccttatgatttcactcagtgagagtgacctgacatacccattgtgtggtgtgccttgttatgtaatcctaggcgccttgattttgtttttcattgacaaggtgaaccatcttatgatgatgatcatgctagagatgaagagacttagcctttctcagggaaaatgctctaatagatgtgacatcggggcatag

SEQ ID NO: 53557 - DNA, 501 bp, Glycine max
  Peptide Sequence Number=SeqID_170335
atgcttttagttgaattctcgaattcatttatttcaggcaaaaattcatttttatgggaaggtcccacaccaaaagtgatcatcacagaccctgagcaaatcaaagaagtcttcaacaagatccaagactttgagaaaccaaagttgagccccattatcaatttgttgggcactggacttgcaaatttacaaggcgagaaatggaggatacatcgaaagattatcgaccctgctttccattttgaaaaattgaaggttatgataccaactttttataaatgttgcgaggagatggtttcaaaatgggaagggatgttatcttcggacaacaaatgtgaaattgatgtatggcctttccttcaaaatttgacctgtgatattatttctagaacagcctttggaagcagttacgaagaaggaaaaagaatatttgaacttctgaaagagcaagctgggttgattatgaaattacgaaatgtttacattccaggatggtggtaa

SEQ ID NO: 53558 - DNA, 969 bp, Glycine max
  Peptide Sequence Number=SeqID_170336
atgtatgaggtattctctagactgaggttgggagaaacagaggagttacgcaacattggctccattcccaagtctctgcttccagattaccaacgactattgagttccatgccctctcgtagattaaatacatcaaagcttatagaaaacaacgaatattttcaaaataagttggtagacacgatacatttcatggaaattcttagttttaaagatagtgtggagagagacaccttcttccacaagcttccaaatttagctgagcaacagccgtgccagatattacttcctttattagcttctgcccttgaatttggtttagctgctgcctcagctttgattgcattgttgaaaatgggttcctggctttcagttgaggagtttaatatcaagttgcccttcttcaacatattgatcaatatggagagtcgttctcagcgcaagttgttgatgagcaaaagaaaaatctgtttaaggggagggatgaaacttgtaacattatctttaattattgtctcaaaggacaatgccagggtcattattgaagtatctgtcaaagttgtaggacatagatccttttttgaaccatatgttgttgacatctcttatctctcaaaatttactgataacctgactgccaatttgattgctattttgcagacaagaaaaagagttttgattaatgcatttacagtccgtgcattacgtgatacttttccacctgctagaggagcaggcattatggctttatgcaccaccagttcctactatgacatcactaaggttgcaactcggattcttccaaatgttgttgtgctcacaattgatcctgacagaactaagacatttcaagttgttgatcaatttttccagataccaaagcaacattatgaaaagacatatgcagcagataccagttgtggtgtgggaagctcatttgttccaggaaatgctactttgcttaggtga

SEQ ID NO: 53559 - DNA, 240 bp, Glycine max
  Peptide Sequence Number=SeqID_170337
atgggtgatcaagagcaaacacaggaacaaatgaaagccgacgtgtcggctttgaaagagcaaatggcttccatgatggaggccatgttaggaatgagacaactcatggagaaaaacatgggcaccgctgccgctgttagttcggctgccgaagcagacccaagtctcctagctaccggacaccatcctcccccaaaacgcggtaggacgagaaaggagcacactggggcacagcagtaa

SEQ ID NO: 53560 - DNA, 786 bp, Glycine max
  Peptide Sequence Number=SeqID_170338
atgaaagaaatagatactgatatacgggcgtcacttaaaggaatcatcaacaaacgagagaaatcaatcaaggccggtgaagtcttacaccatgatttattaggcatgcttttggaatcaaatcgtatggaaatacatgaacatggaaacaataagaccgttgcaatgacttgccaagaagtaattgaggaatgtaatgcattctacctagcagggcaagaaactacatcgactttgctggtttggacaatgatattgttgagtagatatcctgattggcaagcacatgctagggaggaagtattgcatgtttttggtaaccaaaagccagattatgatgggttaagtcacctcaaaattgtgaccatgattttatatgaggttctcagactctacccacctgcagtttatttcaatcaagctatcaagaatgatgtggaacttggaaacgtgtcccttcctaaaggagtgcaagtttccttaccaatattgttgattcaccaagatcatgatatttggggtgatgatgctaccgaattcaaaccagaaagatttgctgaaggagttgcaaaggcaacaaaaggccaagtctcgtttttcccatttggacggggtcctagagtgtgcataggccaaaattttgctctattagaagcaaagatggttttgtcactacttttacaaaaattctcattcgagctttctcctgcctatgcacatgctccaaccattgtgttcacccttaatcctaaatttggggctcatatcattttacacaagctgtag

SEQ ID NO: 53561 - DNA, 681 bp, Glycine max
  Peptide Sequence Number=SeqID_170339
atgggaagctcaacagaaattgcaattggagttgtagttctagtgtcaatgctgttagcctctcgggtcccaaaagtggaagatcctgttaccaatcctaatgcgtacagaaatgttgtctttactagaaatttctccagatttaaggtttcagaggttaggaagatgtatgcacatgcaattgaagatctatctgcttcatgcagcaagcactctaggcaggttcttcaagctgccaatccttcttcaccagatcctgtatttgttcagttagaacttggtcttgtggatatatttcttagtctttgcagatttgagtggcagacttgttatatagaattggccactgctttatttcaggctgaaatagagtttagtttattttgtcctcctttgctgctcactgatcagagtaaacacagactgtttgagcattttttgaacagtgatggtgctagagttggggaagaaggggctctcggttggtccacatggttggacaaagaggaggaaactaggcaacagcttatgaatgaggaactctcacgtgaaaatgaaggtggtggttggactggttggtcagaaccatggtctaaagataatgagggtattgccaatgttgaacatgaaaccatgaatgacgtggttatggagaatattcaagatgaagaggaatactaa

SEQ ID NO: 53562 - DNA, 252 bp, Glycine max
  Peptide Sequence Number=SeqID_170340
atgggtgtggagatttttctagattttgattatggggaaagtgataaatttttagagcaggattggttattcatggagttctatgcaattctgaaaatgggtgtgagaattttccttgtttttgcttctgggttcgaggctgtgttctttggatttgatttgtttgggaaagtggctcagggggttgctgagaaaaaaagaggaagaaggggtccgggcagtgttattggatccaagtcaaagtgtcattaa

SEQ ID NO: 53563 - DNA, 942 bp, Glycine max
  Peptide Sequence Number=SeqID_170341
atggccccgggaaagctgaaactcacattcataggcaacgattctaaaagaaaaaacgtatgcaagaaacggaagcagtcactgctgaagaagacggaggaactcagcatgctttgtggcgttgaagcatgtgctatagtgtatggccccaatgatcctcggccagtgatttggccatccgaattcggtgtcgaaaatgtactgcgaaagttcatgagcatgccacattgggagcaaagcaaaaagatggtgaaccaagagagtttcattgcacaaagtatcatgaagagtaaagaaaagttgcagaaaattgtgaaggaaaacaaggatattgaaatgtccttgttcatggctcattgctttaagacaggaatgtttcagcctgatatcaatatgaccacagctgatatgaatgttcttgcatcgataattgaacagaacctgaaagacattgataaaaggatggaaatgctgaaagccaaccaggtgataccaaaccagcccgatgttgaaacatcaacattgcaaccccagataatgcatacactgacataccaaccccctatgcaaacatttgcattccaaccgcagattcaaataccagaattccaaacccagatccaaacaccagaattcccaactcaaacataccaatccaagatgcaaacacaaacatttcaaccccagatgcagtcaccagcattattccaaccccggatgcaatcacttgcatttttccaaccccagataatgcaaacaccatcataccaaccccagataatgcaaacaccatcataccaaccccacatgcaaacaccagcacttgaagatatgacactgcttaattatggcaatggatcgggtatgcaaatgcagcagttcaatggtaatgggtatgagacaacaatgcttgcatttggaggtgctaacttccctctctaa

SEQ ID NO: 53564 - DNA, 2610 bp, Glycine max
  Peptide Sequence Number=SeqID_170342
atggcggagcacggcactcggcccacaaccacggaccgccttgaagaagccatagcagccctctccgagagacactccgacttggccaataagttcgaagcatggtgcgagcgtctctcccaccttacctctgcctcaccagcgtcttcccaaccttctccacacccacagccacccgtcaagcttgacgtgccccgctttgacggccacgatcctctaggatggatcttcaaagtatcgcaattctttgactaccagtggcctctttttacctcgatggaccagctctcagctgcccttctccaagcaatcgaagcaaggtttgcaccttcgttctacgacgatccacgcggaaccttattcaagcttgttcaacgtgggtctgtgacaaactacctcactgagtttgagagactcgccaaccgtatcacaggtctctctccctccatcttgcttagctgtttcatctccggtctcaacccgaaaatccgccgtgaagtgcaggccttccagcccatttcattaccacaagctacagccctcgctcgtctgcaggaaaacaagctattggatcgaaagaagcacactaccagggcctcgtttgggccttccctgccaccaaacccaactgtacctcacacacccacccaactcgcaccacgacccagggccccctttatccaaagaacccaggaagaaatggcatttagaagagaaaaaggtctatgttacaattgtgatgaaaagtggagttcatcacatagatgcaagggtcgagtctttctcctcatagcggaccctgatgatcccgccacgtctgaacctccatcaacggactacccacacttcccagcaactgaacctaaccccaccccggacgaaactaacccagttctcgacccaaacgcaccccatccccacattagccttcatgcgttggctggtgtccctgcctccgacacttttcgcttatacgggttgatcaacagtgctcgcgtcaccatcttggttgacagcagtagcactcacaatttcgttcaacctcgtgttgcgaaattcctgagcttacctgtgaaggagacaacaaccctcagagttatggtgggcaatggttccgtgttacagtgccaccaatcgtgctccgatacacaagtcctcatgcaagggcataccattacggtcacgttgtgggtgctaccattgagtggggcggatattgtgctcgaagtggaatggcttcacaccttagggcccataaccactgactattcatcgtttaccatgcagttcgtctataacgataagccagtcaacctacacgccgacgttcatgtcgataactctccagcatctactacccaggccctacaagtatccgcacttttagaagacgaaaatcgagaagcaagtatcggagttgttgacttccgacctcatacggccaagttgaagccccttttcatctccggtattactggtgaagaagaaagatggatcgtggcgcatgatcattttccgattctgaccattgaagagcttctcgacgaactggggaatgcttcatggttctcgaagctggacttgcggcaaggtttccatcaaattttgatggcgaacgaggacataccaaaaatagcgttccgcactcatcacggccatttcgagtacagggtcatgccgtttggactgtgcaatgcaccgtccacattccaagcggccatgaacgacttacttcggccttttcttcgtaaattcgcagcggtattttttgacgacatcttgatctacagtgtcacactccaagaccatgttcaccaccttgactccatctttagttcactttcgaaggccaaacactacctcaagcgttcgaagtgcctcatcggagaacgacagctagattacttgggacacatcgtctccggtgatggtgtacgacctgacccttccaaaatacatgccatcgttgattgggtcacaccacagaatccaaaggagcttcgagccttcctgggactaacaggcttcaacagaaagtttgtcaaggggtatgcagctatcgcagcactcctaactaagctgctttgcaaggacgtgttccactgggtaccggagtcccaaatcgccttcgagaacctgaaaacggccatgaccaccacactagtattagctcttcctgatttcacgatcccctttaacttggagacagtcgcgtctaacacagctatgggtgctgtccttcatcagcaagggcatccaatagcatacttcagtaagccgttttgccctcgtcttcaacaagcctctacatatgttagagaattgcatgcgatcgtagccgcagtttgcaaatggagaccgtacctcctcgggcatagattcacgatcttcacagatcaccatagcctttgtgagctcatgtctcaaataatacaaaccccagaacagaaattttacttggcaaagttgttaggatacgattatgatatccaatataaatcaggagcttcgaacacagtagctgattccctttcccggagggatacgtcgtcctcaagccagtatatggtgctatcagtccctcatcccgagttcatgactcagctatga

SEQ ID NO: 53565 - DNA, 198 bp, Glycine max
  Peptide Sequence Number=SeqID_170343
atgggtcggaagaaggtgaaacttgcattgatagccaacaataccaaaaggatcacaacattcaggaaaagaaagaagtcactgatgaagaaggcggaggaactcaacaccctttgtggcattgaagcgtggaatgttcaaccttgtaagaacatgaccacagctgatttgaatgttctttcatctatgattgaatag

SEQ ID NO: 53566 - DNA, 276 bp, Glycine max
  Peptide Sequence Number=SeqID_170344
atggctttgttggtggagaaaaccacacaagtggtctcgagtacaaggtcaatgacctttcctaggccgaggtccgtcagtggtcctgcaacatcttctccacctaggaccacgccgccaccactattgcctgcgacagagtactggtggcgcaccgagcgtgccctcgactggaccccgacgaaggacccaaccttattgtcgatgacggtggtgacgctaccctcctcattcacaaaagcatcaaggccgatgagctttatgagaaggttttag

SEQ ID NO: 53567 - DNA, 348 bp, Glycine max
  Peptide Sequence Number=SeqID_170345
atggcacttaaatgcgaaaacaaaatccccgtcaacggcgccaaaaacttgttagctctttggcaagtgtaccaaattgctcgtagtaataatttctcggccatagctaggggattagctactcatggtcatgagtgttttacaatgagaggaggggttgaggtccccgttcatgaaaatcgtgtaaaatacagatggagatgtatctgtagtgggaggaaattgatagcactggaagtactaggggcagatctagatctggacgaagaagtcgttaatgcagaaggagttaagcatggagcaacacgtgcggtaatggggggaaaactccgagacgatggtatttag

SEQ ID NO: 53568 - DNA, 210 bp, Glycine max
  Peptide Sequence Number=SeqID_170346
atgaatgcggccactatgagtgaccaatattttatgtattccactacattactacagcaggtgcattttacacctgttaaattgatcattttacatcgattatggatcgacgttgtaaaagacatcgtaaaaagagagttggtgttctacgatggtcgtggtcgcagagtgataactgctaaatgtgaaaaagggaggttcaacaagtaa

SEQ ID NO: 53569 - DNA, 285 bp, Glycine max
  Peptide Sequence Number=SeqID_170347
atgaaaaacaaaatccccaatctccaagatggtccctcttccatgggtgatttgtcgccaccttcaccaaccatgactaccacaactacaatgatcacaccctctcccccactcctaccctatttactattttcggagttccccaagtactcacttgaaaacagatgccagagggtggaggttggtggtcacggaagcagtaatgttatggtagccgccagaattgatatattgttgaaaccacctgtcccgacgaaaagtctgacacaccactgccaccaatga

SEQ ID NO: 53570 - DNA, 198 bp, Glycine max
  Peptide Sequence Number=SeqID_170348
atggctccaacaaaagaatctccctccaacatttcctattgctgcttatctgctcctatgaacggaggttcaagatcatcacaagtaccaatcacatggtacaaaattgcaagggtacttactgacaaagtttttactattttcatgaaattatgcaatttgaaacatgggtaccatcactgcactgaccttggctag

SEQ ID NO: 53571 - DNA, 165 bp, Glycine max
  Peptide Sequence Number=SeqID_170349
atggtgttaaataggcaactttggcaaagtgttgtttttcactctttcgctaagtgcaacattcagtggctaagcgcgaggaagaatctagaagaagatgagctgtcatgttcgctaagcgcaccactccagtcatcaagcgcaccgcttcagctcatccgctaa

SEQ ID NO: 53572 - DNA, 318 bp, Glycine max
  Peptide Sequence Number=SeqID_170350
atggctggtttgctgcctgtcagtgctgtcgttggtggatcaactatcaaggtatcaagggttactgttagggctaaggaagcagttgaagcagctggtgggtctgtgagaagggtgtattacaataagttgggcttgaaggcactggtgaagcctgagtggtttgaaaagaaaggaagattattgcctagagcagctagacctcctcctaagcaaaaggacaaagttgacagcattggtcggttgcctgccccaacgaagccaattccatttttagttgaagcaagcaaagatcttccagttcagcatcttagttaa

SEQ ID NO: 53573 - DNA, 1821 bp, Glycine max
  Peptide Sequence Number=SeqID_170351
atggcggtggacggtgataatggccgtcgtcgaccctcaccctcaccacccccttttgtaaatcagcacaatcgcgtctctcacagagaagataggaatggaggagaaggatttgatggaagaagtaagagtatgagtcgagaggagaagaggaaggcaatgaagaaaatgaagcggaagcaggcaaggaaggaggcctcggagagggagcggcgggaggaagaagagcgcctgatcgaccccgaggagcagaggcaaatgcagttgctggagcagcaggaggctgagaggatgcagagggacatgatcctcttccaggagagagagaaggagtggatggacacggttattgcccgaaaacaacagcagcagcagcaccaacaacaacgagaagaagaagacgaggacgatgaattcgattgcgtggaggaagaaggccctccagagatcatttggcaaggaaatgagatcatcttcaagaagaaacaactcagagttagggttaccgacaaggacaagccaaagcctaatgagactaatcaaaacgaccaccagccattcatcattgattatcatcctttgcagcaggaggataatagacctacatccaatcccttacccccggattcgacgctcgagaatgttgctcaacaaatacccaatttcggaactgaacaggataaagctcattgcccttttcatctaaaaacaggagcatgttgttttggcatacgctgtagcagagtccatttttaccctgataagtcgtccacttttcttatcaaaaatatgtataacggtcctggccttgcttgcgatcgggaccaagatgagggccttgagtataaagatgaagaggttgaacgctgttttgaagaattttacgaggatgttcacacagagttcctgaagtttggggaagttgtgaacttcaagtataaatctcttgattctgctctgcttgcttataactcggtgaatggtcgctactttgctgggaaacagagaaagttcagctctatactgaaagcttatgtcaggtttaaagttcagagtgagtttttccaaaggatggttgttttggttcacagatgttttacgatcaagtgcagaagacttgaattgcttgacgttgttcatatgtttttctcattattctcatctggctatgatttatggcagacttgttctcatggaacagcatgcaattttatccactgttttcgtaatcctggcggagactatgaatgggctgattctgacaaacctcccccgaaattttgggtaaaaaagatgatcactttatttggtttttctgatgattatgagacttcaagggagcaaggaaatttgagtttgtcaaaaacagattctgacagaaaacagcaagatgaaacaaagcatagaactcctgataaggattggaatgccaactttaaaaggaaatccagaggcagaactcctgattccgattcggattctgactgggaatggttagaaaaggaggaaaatagggaaaggcaccatgtatacactctgaatagtagaagccatgaagaagattctgatgtggaatgggatagtaggggtggcggtgatgcttctgaatccgacaaagatttgcttggtagaggagagatggaaacacaacatgattattactctaggaaaaggtcaagacacagaagaagatcaggtcttcaggatgagtataaataccatgagaatgaaaatgacaaagtttatggagattggtctcgtactggatctcgtatcatacttagaagattggctgaccttagtattggtggaaataaataa

SEQ ID NO: 53574 - DNA, 339 bp, Glycine max
  Peptide Sequence Number=SeqID_170352
atggagaggtccaaagtggtgagccagcaggagaaggagaataataataagcttcatcgtgcaagagaaaagagcctttacacggaattgattctcgatgaggaaatcaaagaagggatcaatagcatcatggggagcagtatccaagaggtctcaaacgaagccgttagtaagttgtccaaaattaacaccaagcccctgcatgtggccaccgagaagaagatgaagaagaaggtggccacgccagcgaaactcatttcacagaaactctttgtcctcgtccaacgacgtcgtttctactcccaccattcccctctatcgctctactctcccacttga

SEQ ID NO: 53575 - DNA, 174 bp, Glycine max
  Peptide Sequence Number=SeqID_170353
atgataatgacaggttattttcggccaccacttgaaagaccaccaataaacaatgtaggttttcagcatgcaaaccctagcaacatgcctgctcatcctatgtcaggatacggtgttcctcagatgtcatgtagaccagatattcctgcacttaattgttggaggcctacgtga

SEQ ID NO: 53576 - DNA, 114 bp, Glycine max
  Peptide Sequence Number=SeqID_170354
atgaaccaaggcgctcggggacaggtacgagtagacgctaggcctgcgattggcatgtcatcgccccgcgtccggcttcggatgatcaacaagcactactgggaggccgcgtag

SEQ ID NO: 53577 - DNA, 330 bp, Glycine max
  Peptide Sequence Number=SeqID_170355
atggctctgaagaaactctccacgaagaggtctagaaaggacgccactggagaaggctccagtgccgccttggagtttgatagtcaccggaatggcgcctacaaggcaccctctggacccagagaagtccaacagggccctgggattttcggctttgatcacgggcctctgccagttctatggagttcatgtcacccccagcaaggatgcgggcgcaccgccaccacctcggcaggccgattcggctgggtcactgagcgtggagaagtatctatagcatttggttcgccagcaggcggccaaccaccgtggaccggtgcagatacatga

SEQ ID NO: 53578 - DNA, 276 bp, Glycine max
  Peptide Sequence Number=SeqID_170356
atggttatgctcctgttcttgactgccacacttctcacattgctgtcaagtaaggaaattgagaaggaacccaaattcttgaaaaatggagatgcaggttatgttaagatgattcccaccaagcccatggtggtcgaaactttttccgagtatcctcctcttggtcgtttttccgtgagggacatgcgtcaaactgtggctgtaggagtcatcaagagtgtggagaagaaggaccccaccggagccaaggtcaccaaggctgcagagaagaagtga

SEQ ID NO: 53579 - DNA, 165 bp, Glycine max
  Peptide Sequence Number=SeqID_170357
atgagtttcagaattagagatcaagaaaggggcactgattctccaagagaggctggagagattgacacaagggctccattccaatctgttaaagcagctgttagtttatttggtgaagtagccgtctcaaaggaaaaacattctatcaagagaagatcatcagag

SEQ ID NO: 53580 - DNA, 930 bp, Glycine max
  Peptide Sequence Number=SeqID_170358
atgggccttgtttcccaggatgccctcaaccaactccaagctctcatggatcaagtgctacttgaggaggagccactgcagagaacgtttcagaatgttcatcaaggatgtgtcaccgaaaccttaacacggtttctaaaagcaagggagtggaatgctaccaaggcccataaaatgatagtcgattgtttgaagtggagagtgcaaaatgagattgacaacatattatctaaaccaataatccctactgatttatacagaggcattcgcgattcacaacttataggattgtcagggtactccagagagggtctgccagtctttgcaattggtgttgggcttagcacgtttgacaaagcatctccttcggcatcaaagaagcatgagcggcctattaccacatgtgtaaagattttggatatgacgggtctgaagttgtcggccctgaatcagataaagttgttaacaataatatcatccattgatgatctgaactaccctgagaaaacaaatacttattacattgtaaatgccccatacatattttcagcttgttggaaggttgtgaagccacttttacaagagaggacaagaagaaaagtgcaagtcttgcaaggttgtgggcgagatgagctgttgaagatcatggattacgcgtctctgccgcatttctgtagaagagaaggctctggatcatcaagacattcagggaatggaaatgaaaattgttattccttggatcatcctttccatcagcagctctacaactacatcaaggagaaatccagaatccatgaagctgttgaacccatcaagcagggatcattccatgtagattttcccgaacctcctgcagagaaagcagagattgtcaagacattagagtctgagctacacaagtttaagatcagcaatgtgaatggtgattga

SEQ ID NO: 53581 - DNA, 1569 bp, Glycine max
  Peptide Sequence Number=SeqID_170359
aatgtgctggaaaaggagactcaacttctcttggcccaaagagaattgaacaagataaagaaacagctagaaagtgctgagaacacaagatccaaaactctttccgagcttgataaggccaaagtgacacttcaggaactgacaaagaagctcaacagtgttagggaatctaagcaatcagcaatagaagctgctgaagctgtgaagaatcaggccaaagaacttgaacaggcactatcccaaaaagctataggatatgaagcatggaaacaagaactagagcatgcaagaaaggagtacaaaacaacagtgaaggaactagatgcttccaagcaagaactcaacaaaataaggcaagattttgacatagctttggaagcaaaactagctgcattccaaacagcaggcgaggctcaacgttctgcgaaattgaactcggaaaagctccatgaactcaaaaaccaaattgcaaccatgaaagagcaaattgaacatttgaagcttgcctcatcacaagccgaagaagaccaggcaaagatcatgagagaaagagaagcgcagcaaagtttctacgaaaatgccaaggaagaagcacagaataagttgattactttgaagaatgagtatgaacctgaactaacacaaagccttgaggccaaacttgctgaaacaagtgaagagattcaggttctccaagagcagatgaaagaggcacatgcttctgagatggattcagtgagacgaataactttggagatcaaagaagccacaaaaacacttcaggaagttgctgaagaagaaaactccctgagaaacctagtggattcccttagtacagaattagaacaagtgaagaaagagcaagaggaactcaaggagaaggaaaaggcagcagaagctcttgctgttgacctaactgatcaattacagagtaaaccaggagacacaatggaaaaagaatctgataaaattgatgagatagaattgaagatcaagcacctttcatttgagacagaaaccgcaagaagagaagaggaagaaatgagatccaaaacacaagagctgaagcaagaggctgaaaaatccaaagcagtggcagaagaactagagaagaaactagagctttacctgaagcaagctgagggtgcaaaagcatcagaacaaagggccattgaggagatgaagatgatgtcagacagtgacaacaacactcaagacacggtctcggttgcagattccaatgggaagattgtattgacagttgatgagtttgcagcactgagtgggaagataaaggaatctgaagacatgattgacagaacagaaacagcagcaatggctcaggttgaagcaatcaacacaaggaggaatgaagtggacagaaaggtggaggcaaaccttaaagcaattgaggaaataaaagctgcaactgatatggctctgaggaatgcagagatggcagattctgcaaaggttgcagttgagggtgaactgaggaagtggcgtcaagaagaacaaaacatggattactcggacaattcctcaagaccaatctctcttcgtatttag

SEQ ID NO: 53582 - DNA, 807 bp, Glycine max
  Peptide Sequence Number=SeqID_170360
atgacacaagtttatgtaacttatggttgggctgctaatgtttttaaggtagtccttattgtaaataagaactgcaggctaaagtcgattaactatgaaagatgtgaagtctttgcttcagattttagtttattatgtacgttacactcagaaggaaacattgtaccaaaactgaacaggtggacctgtaatattgtgggtaaaaccgctggggtcaatctaattgggaaaccaagtgaagattcagaggagctatttgagatcaatcttaaggagccatatttggatacaatatcagaagaaaacttcgagagcagtgtgttcctttctgatattcacatcaacgacaaagatgttgttcatgtggcagttgaccacgttggagaatcaagcatggaagcacttttatggactttgaatcatgctctgacaccctctaccactgttaaggtggagattatacttactgagggtgacaacattgccaaaactataactgacaatgttagagatcatagtataaggaaattggtgatcggaattaccaaatctaatttaagcaaatccgtctctagaaggcgaaatgccatagcagataaggccctcaagaatgcaccagaaatctgtgatattaaaataatatgcgatggaaaagaagtgattgatcaaatgattggttgcaactcatcatgttccagtgactgtaacagttccagagtttcaccagaagaaaatgaatcctgtggttttgttcctcttatgtgttttgtgcccaatcctatatggttatttagaccaagattttga

SEQ ID NO: 53583 - DNA, 330 bp, Glycine max
  Peptide Sequence Number=SeqID_170361
atgcagagcatgatcagattagtaaagctcaacagtgctggaacaccaacaagacaagaatcaacccaaaaacacaaaaactcattaagggttggacttggaagaccaagagaagaatccgaagggagagagagagaccaagatggaaaaagagttaaacttgaaggggttatggaggaaacagaagttggggaagagaagaattggaagaggggaaagtacgaagagaacaaaagagtacctaatttgaaggatcagaacacagcttcgttgcttttgcagagagagagagacactgtagatagggagctcctggtactggtagcttag

SEQ ID NO: 53584 - DNA, 348 bp, Glycine max
  Peptide Sequence Number=SeqID_170362
atggccattgttagagttgttcttgctctagcatcgattaatcaatggcacctccatcaattagatgttagcaacgctttcttacacggggacctcagggaggatgtttacatggagatccctcctggcttgcttggttacacatcaagtcagagttgcaaaatgaagaaatcacgctatggattaaagcaatccagtagacaatggcactcaattattggttatttcttctttatagtgatgcaatcctaccccctaagggtgttggatagaagactccaagaggattgggctagaactgctaaagaaggccttggggttctcatgaacctcaggatagatttctga

SEQ ID NO: 53585 - DNA, 318 bp, Glycine max
  Peptide Sequence Number=SeqID_170363
atgacggatagactcgaggatgccaccgctcgcctatccaacaaccaagcttctctcactagcaaatactctgagctttccggcaaagtagattcgattctcgatcatcttcgcctacgagaaaccaaccataaccactccaattcaagtgctcagttcaaccatcgaaatctcgtcaagttggatattccaaggttcaatggtgtggaagcaatgacttccaagattattttgatgatgccaaagaatcaagagttaagcaagttccaaagaatcaggagtcaaaaagcttcaagaatcaagattcaagaacaataa

SEQ ID NO: 53586 - DNA, 1437 bp, Glycine max
  Peptide Sequence Number=SeqID_170364
atggccaattgcaacatcatctgtaactatcctttcaagaaccatttaccagtgttcatcaacatgatggttctttctttcatttctaatgttcaagcccaagacagtactgacacagataccttgcctgctgattttccccaaccagtgcgtccaagcaaggtggttgtaatagtggctctctcaatattgttcactttctcatttctcttacttctctacataaggttccgtagaatcacccctcttgaactcatccaaagaagtagccatcactctccaaattttcaagcaacaactcgatcgaattcgaggtcacggctttctgggatagacagacaagtgattgaagcacttccatttttcaggttctcttccctcaaggggtccaaacaaggcctagagtgtacggtttgcttgtcacagtttgaggacacagagattcttaggctcttgccaaagtgcaaacatactttccacatgaattgcattgacaagtggcttgaaagtcactctagttgccctctttgcaggaacagtatcgaccctttagacatcaagaacttcacctactcaatcagttcaaggtccctaagagttccttcgaatttaaccgaggacactaaccttgaaatctttgttcacagggaatcatcatcaaggtttaacatgggaagcaggttttggaatttgggaaggaacaacaaagaagaacgtctccttgatcaacaggttgatggcaaacacatgcataagttcaatcacaaaatcgtggtctctgatgttgttacaaggagcaggtggagtgatctaaactcttcggacatgttatcattgaacagtgagatgcttcttgacatgtcaagcagaagattctctccctctaatgaaatgattcgtggagattcaagccttccctttattttcaatgatgatgaaagttcatttacgttattgaatactgctgagaagagatctatgtctgagattgctcgtgttcctaggttcatagaaacgtgcaagcagaatagaacggaagcaggtgtggcatcaagtgggagcaacgagagggaggagaggttgaggaggatttggttgggaattgctcaacgaacagtgcaatgtggagctggtaaaaggcacaaatggaacaaggctgaggttgacccagtccgaatcaagcgtttgacttggggcattgagactggttccggcccatttgctacattcgcccattcgatgcctaggactgcatcagtgccacttatcggaagcagatggaaggtgaccttgaaaggggggggaggtggaatagaaaagaaggtggaggaattaggcgatgcagggttggagaaaattgtgggtgctgacgctatcaatgaggatagtgaggcaagcatggttgatgatgccaaagagacggaaagtttcagatga

SEQ ID NO: 53587 - DNA, 459 bp, Glycine max
  Peptide Sequence Number=SeqID_170365
atgtggggcactctggttgtaatatacaaaggaaggtcacaagtaaagagcaacaaactaagtctcctcacttgtaagtatggacttttctctatggaagaaagcaaagacatacaatctagacacttcaaatttgaatgtccaaaactggagaaaggtcgggatgaaaagaaatacttcaagatcaaagaaaagaggggtcttatgagtagctgggaagatctaaatgacacctcatatgatgaagatggtgaagaagccaacatatgcctgatggcagatactaattcagaggaatctaaatcagataaggaagatgagggtcaagtaaaaatttcactgaacatatccactcagacatgtggagcttgtacgaatcttaaagaagaagagtctgagctatgtcttgagattgagacaatttccagggaaaaagctactcttcacaagaacttttaa

SEQ ID NO: 53588 - DNA, 285 bp, Glycine max
  Peptide Sequence Number=SeqID_170366
atggatataatgtgtccttcaagaaagataagtatgttgttctatgcaaagatcggtctcccttattctctgccaagagaaaaggcaacctctacaaaatcagattgggagaactctcagatcaaaaggtgccatgcttattgtttgttaaagaaaatcattggttatggcatagaaaacatagacttgcaagttagaggtgttgagggaaggagcccaaggtatgaagaacctcgggatttgaagtcaaatcctttccaaggtggagggaatctcgggatttga

SEQ ID NO: 53589 - DNA, 228 bp, Glycine max
  Peptide Sequence Number=SeqID_170367
atgaagatgaaaacaaacaaaacaagaaatgaattgaaagtctcggattcgaacacttgccggttgaagactgaagaacaaacgaagaacggacgaagaacgacggaaaatcttcacggatttgctcacggaaacgtctcgaaagcgttatggaaatatctcagcttggagcttcttcaaggaaacacgtttttttttcacccaaaacagctaaaatgcatagcatag

SEQ ID NO: 53590 - DNA, 129 bp, Glycine max
  Peptide Sequence Number=SeqID_170368
atggaggaggcaggactatcacgcgattggctaatcgctcaaactcaatcagagccccctttggatcttcacaaaatgatggcgcaaacttggattcaagagcctgtaggaagtcagactagcaggtga

SEQ ID NO: 53591 - DNA, 666 bp, Glycine max
  Peptide Sequence Number=SeqID_170369
atgagtgtgatgggagagttgaaactctatcttggactaaaaataaagcaaacacccaaaggtatctatattcatcaaaccaagtatgtgaaagaattgctgaagaaattcaacatgaaggaagcaaaagacatgaagactccaatgcatcccacaacataccttggattggacgaggaatcaacaaaggtcgacaggactcaatacagaacaatgattggcttactactctatctcgctgcatccaggctcaatgttatgttcagtgtttgtctatgtgcaagatttcaaaaagaacaaagggaagttcatctaactgtagttaagcgtatttttagatatctcattagaacttctaatcttggtcttctgtttaaaagaagagaaagttttagactcataatctacaatgatgttgactatgttggtgataaagttgaaagaaaaagcgtaagtggaagttgtcaacttattggtggaaaacttagtcacgtggatatgccttgcattaggcagatagttggatcccttttaaacttcctaaacatggatatttatagaaaagagtcaagaggtgctcaaaaattcgcccagacgaactgtagctcgcccaagcgaatttgtgacttagtgctgaaggcaccaattcccccaggcgagctgtag

SEQ ID NO: 53592 - DNA, 714 bp, Glycine max
  Peptide Sequence Number=SeqID_170370
atggttaagttcgatcttgagatagtcatggagttttatgccaatgcctggcctacagaagagggagttagagacaagcgctcctgggtgactggccagtggattcctttcaatgaggatgccatcaatcaatttttggggaatctacttgtcttggaagaaggtcagcgttgcgagttcagccagaggaggagtcaggcctctggctttgataaggaggctatcagccatttgctgtgtgttccggggcaggactttgctcggagcgtagaggggaggcggctacattctccccaacaaccacaattcagacctccccctgccaaagtgtcagctggtctacgcaatcatgactcaggcctctgccagttctatgaagtgtcggttgcccccaccaagctcatccggtctcccatcagcagagccttcattgagaagtactgcgtgcccaagcaggtgcagggtcaggcgccgcaacagccagagaaggaccagcagcagccagttgtagatgcaccaccaccacttctaaatgagagtcaggaccccattcctttcccttggcctacccccgagcagttcaaggccatggtggcctggcctggagacaagatcgatttagagacaaggtcagaacctgcagggggccctggggatgaccgaggagctcaggaggatgacgatatggccgacgtgctggatttcttcacttga

SEQ ID NO: 53593 - DNA, 666 bp, Glycine max
  Peptide Sequence Number=SeqID_170371
atgtctttgaaattgcctgtctattctgaattagttaaagccttttattctaacctcgaaattcaagaaagcactttgatttctaaggtttttgggataaaaatgatcgttgaccaatccctattatatgacttgacccaattatctagtgatggtgtaccatttgaaggtacactgaatgatgattggaaatttgatttctctttgcatgatgcccgccggttggtttgcaccaaccaagcagatttgaccggaaggttgcttgccggatcattagctcttgaaagtcgcatccttcactatctcattgtgcgtatgttacttccaagatcttcaaaccttgcacagagatcctttttgattggtgctgctgtgattgcatcttttggttaccgcaaagagcatgatggatcttgggcaaaaaagggtgctcaacccattgatgatgaaggacacttaccagttggagaggattcctctctccttcaaaaatttttggataggttcgatggtcttcaaacctatgttggtgaaaggtttgatgctttggaactacaagtggacatgcgattcgacgagatggactcaaggatcaccaaggttgaaggagatgtcacttgcatccgcatatgctttgatctaccaccaccaccaccatcatcttag

SEQ ID NO: 53594 - DNA, 288 bp, Glycine max
  Peptide Sequence Number=SeqID_170372
atgggggcagttgaggctactaataagaacatcaagaagatagttcagaaaatgattgtgtcatacaaggattggcacgaggttctccctttcgtgctacatgtgtatgggacggaggctgtgttgccatttgaagtagaggtcccctctttgaggattctggccgagtcaaggctgaaagagtcagaatgggcccaagcatgctttgatcaactaaatcttatagaggagtacacactctcgatcttgagtccggagtcatttggctccgtcaatggggtgccataa

SEQ ID NO: 53595 - DNA, 210 bp, Glycine max
  Peptide Sequence Number=SeqID_170373
atggtggggtacgcaccttcaagcttttcggatttggtcttcaccgacaaaaggatcaaagtgggtatggaaagaggcaaatatgatcatcctgctttgatgaatgcgaaaactggggcaaatgaagagggtgagaatgaaggagaaacccatgctgcgattgtcattcctacatggcccaacttcccaccagcccaacaatgtcaataa

SEQ ID NO: 53596 - DNA, 606 bp, Glycine max
  Peptide Sequence Number=SeqID_170374
atggctaccactctagctggagctagagagatggtaagtagggctgagagaaatgaggttaaactaggagtaatattccaagagagatacgctcctgacataaggaggttaaagaacgatatcttgaaagagcttggtagaatatatttgatagagtcagaattgaaatggtaccgtgatatgaagggatattataagagggatgagatagctaggagttggaggggcatgtggaacacggaaggaggtggagttatgacaaatcaagtggaagaggtgtctggatttgttgacaatttaactcatgatggaatcgaggtcgaggacacagcagtcgcgattatgagatacaagaacggagcattaggtactatttctcaaacagtctcaatgaagcccactacttaccaatacaggaagattagggtaaatggaagtaatgggtttgtggaaattactgacggtagtcttagtacagtcgcaattgagggtaaaatagaggagtcaaaatccagtgttgaatataagaaagaaacgatagctcaaccaggtaatttgcataaggagtttgctcagagatttcctaagggctctatcagaggataa

SEQ ID NO: 53597 - DNA, 399 bp, Glycine max
  Peptide Sequence Number=SeqID_170375
atggttatgggggatttcatcagcagactctccttccccgaaaacaccgagactttttcaagtctcacaagttatccagaactacgtaggtctgagttcctcattggaggatacgtaggagcaagagcctcgcttttgtcgaccacaccgccttttgttgccatgactcaagagctggtagcccgtggagacaccttacggttatccgcacctcgtcattcagtgaccccaagtgtgattgacgagcagaggtcaatgtggtcatctgcgccctttccggagatgtcagcattttccgatggagacttttcaagtctcacaagttatccagaactacgtaggtctgatttcctcattggaggatacgtaggagcaagagccttgctaattggggaatag

SEQ ID NO: 53598 - DNA, 237 bp, Glycine max
  Peptide Sequence Number=SeqID_170376
atggaattgctaaaagaaaggagggagagagagagagagagaaacataactctccctaatgattctgaattttttccccatttagggactttggggtggtatgatatgtggaattgttctccagaccttgctgctcttgttgatactttacaaaaccaattggaagaaagagctgaacgcatgcggatatggagtggacaagacattggagttgataagatagtggcttctgcataa

SEQ ID NO: 53599 - DNA, 306 bp, Glycine max
  Peptide Sequence Number=SeqID_170377
atgatgcggcaggaggagtcaggatcaggactgctaagtttatggtggctacgctttcattcattatttgatttgacactgcggcaaagtcatctccctcaccctctctctacgtcattttctccaacatccttgccacccaccaccattttctcttcttccatcatcgatgatggcagatctcacaactgcatgggaaccacgcgccacgtcgggatgatcacgacaacaacggagaggaagtgcatgagcagtcacgaggtgaggatggtgccagagaggtcgaggtggtggagggcagcatag

SEQ ID NO: 53600 - DNA, 564 bp, Glycine max
  Peptide Sequence Number=SeqID_170378
atggggaggttaagttttaatgaaaagagggtgagatggataaaagggggtattgaatcggcaacaatttcaatcttagtcaatagaagtcctaccaatgagtttaaagcacaaagaggactacgacaggagatcctattccaccattcttttctagttggtagcagaagggttaagtgggttgatgaggcaagcaaggagacaaaatgttttcaatgggtacttggcttttcgattggcgtgaatcatagtagagcctctatgtgggagcctattgttcaaaagttcaaaaacatgttgtcaacatgggagcaaagaacattatccattggtggaaggggaaatggagatggagggtatatagtggtcataattgcctttggcaacaagtgttatgttctaaatatagccaagatgggaaattacaaccttaaggataggtatgggagggtgtctatgaactcgaaccaaacggttgagatgataggggtgatggggtcgtgggttggtggtagttgggagtggaattttcattggaggagaccatggttccaatggggataa

SEQ ID NO: 53601 - DNA, 195 bp, Glycine max
  Peptide Sequence Number=SeqID_170379
atgacatattcagatcaaacagcagaaactaaacagcacaagcgtacctccagccattgcagatcagacacgaagcggtgcaagcacgaacctgaagtcaactttgtttttctagacccttactcactcaaaatagatgagataaggattgaacgtgggaggaaaatggaccaaattcagaaaacaaatttctga

SEQ ID NO: 53602 - DNA, 1053 bp, Glycine max
  Peptide Sequence Number=SeqID_170380
actcatcttctgcttgaagtggcgtctcctctttctcttccttctccattccgttgccattcatcttccaagaagaaaagtaatccattgatgaagaagatcctaggcctacaagctccaatggagcttacatcactaccttcgagctctctgcatagcactatcgtgattgcttttgctcctggagaggttgccctgactgaaggtggtcatcaagtccatgtagcctctggtcttgaatctcttacctgcaaagctaaggagcttattcgtgtgagggatatctatggaactgccctagtcgataaggaccctggacaccatgaagtttgcaatgatcatagagatgaccatggggtcgtcctggatgacggggttgatgcctttgaatggtgcattgacaaagtcaatatcaatgtctcgaatggcatggcgatggcattttcgggattggctggactgtcctccataggaaaattcgcccgcgatggtgttgattacacctctaatgtgttaggcggttcctatgccgctcctcttggtgttctctgggtcttgtccttcttggtggatcatggagtgcaatgcaaccttggggttaacattttggatctggacagttgtgcgcctaaatctatccatgaattatctgagagactcatcatctacttgtcacagactggccaaggcggtcgaggtcatggagtgagacttgttggtggcgtactgcgcactaaatcgttcaacgagggtgtcgaagctatctatggatttgggtgggagtccatcgtactaggtcaatgttgcccccttgagggacgtagggaagacacgacaaagaatcacgtcgtcactggtgtagaggttgaatggtttccaccccaagggtatgtctgcctctataatgcgatcgacaaagggatgccgatagacggtctgccttactggacggcaaggtgtgggcagattgctcatcgccctagggacagtgtttgtgtctctcacagcagccagatgaggatgggagtctttgaggggggtctcgcgtttgag

SEQ ID NO: 53603 - DNA, 2622 bp, Glycine max
  Peptide Sequence Number=SeqID_170381
atggagtcaaatggtagtggtgatctattattacatccaagaatgacggaatcacctacaagatcttccacaggcccttcaaactcttcttctcctgtcagggaagaaattacatctgctaaggatgaaaaatctagtacacaaaaaacaataactggaagaattgctcaaatctttagtaagagctctgatatgtcttcaactgcatcccgtagaagcattgacttggaccaatctgaaagtagtaaagtagaagttagtgagatgaaggctgaggatcagtcgtctaatgagacttttgaagaagctatgagaaagcttcagtctgcagaccaaggcagtgaaattcctagcaatttaccagcaggagtgtttattgatcaacaatatgtcattgcaccagaagacttgaatgagttactattttcatcagattcaaattttctcaagtcattggcagaagtacagggcaatacagaactcgaaataggaccttggaagtttgagaatgatggggagatcttcaaaagattagttacttacctcaaggctcctagtaaattaattaaggctgtcaaagcctatgaggaacacacatatttaaaagctgatgggaagaactttgctgttctagtcagtgtcagcactccagatgttatgtatgggagcacctttagggtagaagtactgtatgtgattacacctggaccagagtttccgacaggagaacagtgttcgcgtctggttgtatcgtggcgaatgaattttttacaaagcaccatgatgaaaggaatgatagaaaatggggctcggcaaggcatgaaggatagctttgatcagtatgccactttgttatctcagactgttaaaactgctgatgtgaaggaccttagttccaataaggaacaagctttggcatcattacatgctgaacctgaatcagattggaggctagcagtgcggtattttgctaacttcacagtattcacaacagtttttatggggttgtatgtgattgttcacatttggctggctgcaccaagcacaattcaagggcttgagtttggtgggcttgacttgccagattcaattggtgaatttgttgtctgtgcaattttggttcttcaaggtgaacgcatgctgggtataatctcacgcttcataaaggccagagcacaaaagggtagtgatcatggaatcaaagcacaaggagatgggtggttgctaactgttgccttaattgaaggaagcagtttagcttctgttgattctagtgggttgtctgatccctatgtggtgtttacgtgcaatggaaaaacaagaaccagttcaatcaagttccagaaatctaatcctacatggaatgaaatatttgagtttgatgcaatggatgatcctccttctgtgctggatgtggtagtttatgattttgacggaccttttgatgaagctgcatctctaggacatgctgaaattaattttctaaaagcaaacatagcagatcttgctgatatatgggttccccttgaaggaaagttggcattggcatgtcagtctaaactgcacctaagaattttcttggacaacactagaggtggtaatgttgcaaaggactatttaagtagaatggagaaagaagtcgggaagaagattaatttgcggtctcctcaaacaaattcagcatttcagaaactgtttgggcttccacctgaggaatttctcatcaatgatttcacctgtcatttgaaaagaaaaatgcccctgcagggccgcctatttctatcagcaagaataattggatttcatgcaaatttgtttggaaacaagacaaaattcttttttctttgggaagatattgaagaaattcaggttatccctcctacattctcatcaatggggagtccaataattgtcataactcttcggaagggtagaggtgtggatgcaaggcatggtgcaaaaacacaagatgaacaaggcaggctaaagttccattttcagtcatttgtgtctttcaatgttgcacacaggactatcatggctctctggaaggccaggtccttgagtccggaacagaaggttgagtttgttgaagaacaatctgatagcaaaagccttataagtgaagagagtggctcattccttggcctggatgatgcaagttacctcatggagatatttagcgggggtgagttggaccgtcgggtcatggaaaagcttggttatcttaattattcttatactccttgggtatctgagaaccatgatatctctgagagagcagtatattacaaatttgagaagcgtatttcaagttataaaggtgaagtgacaagtactcagcaaagatctccccttgcggatggaaagggttggcttgtggaagagcttatgaaccttcatggagttcctcttggtgattatttcaatatacaccttaggtaccaaattgaggatttacccccaaaagcaaaggggtgtagagtgcaagtgttatttggaatggaatggctgaaaagctcaaagaatcagaaaagacttacgaagaacatcctagaaaatttgctggaacgttttaaggtgacctttagtctagctgagaaggagcttttaccaaaataa

SEQ ID NO: 53604 - DNA, 423 bp, Glycine max
  Peptide Sequence Number=SeqID_170382
atgaagcctatgcctaccacaagaaatttaaatgttctcctgatcttttggtcattgttcagtctctttatggcaggttatggtgctgaaagtgacatctattgcttgcaaaccatcaagaaattggaccggtttaataacttacctagctgggattttgagagcaacactgaaggtgacatatgtaaatttaatggtgttgaatgctggaatcaacatgatgtggaagatagagtaatcagtctcttgctttctaccactactgtcctattagctttcatgtactattatgaaccttggacggaattcaaaaagaggagtaatgccattcatcccttaagaaagaagcagaaccatcaaaaggagactagacaaaaagctgaattgctaccattggccttgcaagatcaaggaagcaaagag

SEQ ID NO: 53605 - DNA, 183 bp, Glycine max
  Peptide Sequence Number=SeqID_170383
atgaaggcaaggcaacctttacttattcgaacagatagaagagatgaagggagacaaggtgactttccgctccccgcaccatcctccttatctggagatcgttcaccagtactgagtgcaggtgaatatgcccaggaagatccaactttgacagataacgattctccatataggtcatcataa

SEQ ID NO: 53606 - DNA, 2028 bp, Glycine max
  Peptide Sequence Number=SeqID_170384
atgtttttttattttcaatctctaattttgttgtataggactgaagttgagctgcttggagaaatcatcaacattgtcaatcttgaattaatgaggttggataagaatccagttagcttaaaaggacttattggaattgacagatcaattcaatatctagagtcgatgctacaacatgagtcaagcaacgtccgtgttattggaatttggggtatgggtggtattggaaagacaaccattgcacaagaaattttaaacaaactttgttctggatatgacggttattgtttttttgtaaatgtaaaggaagaaataagaagacatggaataattaccttgaaggaaatttttttttctacactactacaagaaaatgtgaaaatgatcacagcaaatggattgccaaattatatcaagagaaagattggtcgcatgaaggttttaattgttctagatgatgtaaatgattcagatctactagaaaaattgttcggaaaccatgattggtttggaccaggtagtagaatcattttaacaactagagacaagcaagtgcttattgctaataaagttcatgttgatgatatataccaagttggggtattgaaccctagtgaagcacttgaacttttcatcttacatgcctttaaccaaaagcattttgatatggagtattataaattatcaaagagagtggtgtgttatgccaaaggtattccattagttcttaaagttttgggtggtcttctttgtggaaaagataaagaagtgtgggaaagtcagctagacaaactcaaaaacatgccaaacacagatgtttacaatgcaatgagattgagttatgatgatctagatcgcaaagaacaaaagattttcttagatcttgcatgtttcttcataggattggatgtgaaagtggacctcataaaagttttattgaaagataatgaaagagataattcagtggttgttggattagaaaggttgaaagataaatctctcataaccatttctaaatataatattgtgtatatgcatgatatcatacaagaaatgggttgggagattgttcgccaagaatctattgaagaccctggcagtcgcagccgattatgggatgccgatgacatttatgaagtattaaaaaataataagggaactgagtccataagaagcataagagcagacttgtcagcaattagggagctgaagtatttccctctaaaatccttgccagagaacttttctgccaaaaaccttgttctcttggacttgtcttatagccgggtggaaaaactttgggatggagtacagaatttgaagaatttaaaagaagttaaagtctctggttctaaaaacttgaaggagcttccaaacctttcagaagccacaaatcttgaagtattggatatcagcgcttgtcctcagttggctagtgtgattccttctattttctctctcaacaagctcaagataatgaagctaaattatcagtcctttacacaaatgataatcgataaccatacaagctccattagttttttcacccttcaagggtctacaaaacagaagaaattaatttcagtgacatcagaggaattaatttcatgcgtttgttacaaagaaaaaccctcgtcttttgtatgtcaaagcaagctcgaaatgtttaggataaccgaaagtgacatggggcgcttgccttcaagctttatgaatcttagaagacagcgatatcttagagttctagatccgagggagcttcttatgatagagagtggctctgtagatgtcatagattgcaaatcattgaaggacgtattggttcttgttgaacaattcaggtataacagcagtgacgttgacattcagaattaccaaggattaatcgaagaatcggtggtggtggcattagatgcaatttcatcaactgttgaaactgtgtttgaccattcagagcttatagatgacaagatattaattcatattgatgaagaaaagttgaatccatcgaagataattgatgaataa

SEQ ID NO: 53607 - DNA, 150 bp, Glycine max
  Peptide Sequence Number=SeqID_170385
atgaggactgttgtttctgctaatgcagacaacacaaaggttcaccccccaacttctaagaatatggtgtattatcctcaagtgctaaataatcatccaggaatccagaatttgattatgtgccctgcgagtagtttgaagggtaattga

SEQ ID NO: 53608 - DNA, 696 bp, Glycine max
  Peptide Sequence Number=SeqID_170386
atggagaaaggaggaaagggcgcttcgctgttcagcaaagggggactaggatccctaaaagggaaagatgacattgcaacaaaatcagcaaagggaaggagggttcagttttctactgatggtccattatttgaatctggagtaagtagtaactcagccacttcactaaaatctggtggaaaagagcttccagaaaatatcaaatgcctgatggactgtgaggctgtggatattttacaaggaattcaagagcggatggtcatgttatctagagattcaactgtcaaaatgcctatatcatttgacaagggactgcaatatgccaaaagcaatagcaatcgtcttgcaaaatgtggtgtcactgatagtgagatatgtgtgattggtaatgtgtgcccagaaactattgatgaagtttttgctcttctcccatccttgaagcttagcacatacctaaatattttgaaacacatgtatcatgataggagaaacattgacagtcaagttcttaaggattcactgagtgagcttgctaagtttagacagacaatagtgcagattctattcatatcctacttggctgtacagattgtggatgacaatttgatgaattttgcatgcacaagaccgtggttggatcttgtatatggtaatggtacaggaaaacttggtgaatgcaagagaagatacatgtga

SEQ ID NO: 53609 - DNA, 1179 bp, Glycine max
  Peptide Sequence Number=SeqID_170387
atggaagcgaaagtgagtgtgtttatcattactttggtcactgcctccatgctaatacatagatttctactagcttttaacctttgtaccttttataatggtcaatatcagaacttgatcatgcctgcaatactgaatatacaacagtctttagtaaaagcaaatcttgctggttatataaaactggttgtcccttgcaatgcagatgcctatcagtcctcagcacttccttcccaaggggcattccggcctgaacttacccaaattatgagtcaattggttcagttcctcaactcaaacggttcgccatttgttgttaatatatacccctttcttagcctttataacaatggagatttcccccaagagtatgctttcttcgagggaactactcatgctgtccaagatggttccaatgtttacaccaatgcatttgagggaaactatgacactttagttgcagccctcactaaacttggatatggtcagatgcctatagttattggagaaattggctggccttcagatggagccattggtgcaaatattactgctgcaaaggttttcaatcaaggccttatcaatcacattgcaagtaacaaaggaacccctttgaggccaaatgctccaccaacggatgtttatcttttcagtttgcttgatgaaggagctaagagcacacttccagggaactttgaaagacactgggggatattctcttttgatgggcaggctaagtatccattaaaccttttacttgggaacaaggagttgaaaaatgctaggaatgttgagtatcttccatcgagatggtgtgtggcaaacccctctggtgatttgaatgatgtagtaaaccacatcagactagcatgtagtgttgcagactgcactacccttaactatgggggctcatgtaatgaaattggtgagaagggcaatatatcatatgcttttaacagttactatcagctacaaatgcaagattcacggagctgcaattttgatgggcttggtatggttactttcctagacccttcagttggcgattgtcattttcttgtaggtgttacagataaaggctccgattcatctacgtctcaaacaatggctccatcacatcagtggtggactctagtgttacttctgattttacatgggacttttttgctttcgatgtga

SEQ ID NO: 53610 - DNA, 318 bp, Glycine max
  Peptide Sequence Number=SeqID_170388
atgttccaagctatgcctgccaaccctatcggccaatcaacaggagagaagaaacaacatagacacgggtatcagactgattgttccggatcaaggaagaaatgtcatagcagctacaagcctacaacatatttttctgagcctgttgggatcaaaggaagcagagcttgcctctataccaacagtagaaaaagagagatgtgcaaggtggctcttgtttcatatggtctagttgatgacagcagaaaactattgagctatatatcactactagacagtagcggggcatcaccaattattttgagggggccaaagtag

SEQ ID NO: 53611 - DNA, 378 bp, Glycine max
  Peptide Sequence Number=SeqID_170389
atggatgcgtgcaaagcccaaatgggttgtgaacttgtgaggcagaatattaggaggacagcatcaaagagcattgtggagttgcaaaacaaagatgaagattcaaaatcttccataaaggttgaaggggctgaaggatctgcagatgagaaggaaagtgacgataagggttccaaactacgaaaatctgctctcaaaagattggagaaaggtattgaagagtcactgcttagccaggcaaccataaaaggatactttcccttggggggttggggtgggagaaaggagcaagatgttttgaatgcaatgggttcaatgtatgttgttgttacctccattggggttataaatggttcctcagtgcaacctagcaattga

SEQ ID NO: 53612 - DNA, 249 bp, Glycine max
  Peptide Sequence Number=SeqID_170390
atggagaagagagcgcgaaagggtacacagagaagaagaaagcacgagagggtaaacggagaagaagggagcgcgagcgaaataggtcgcgtcaaatataatttaaaatggcacaccaatttgtggtcagcagaacttttcaagttagctgataatgcctttttggcacaaagaatttcatatattaatgctatgtcagccttttgtgaggccactgggccgaagtttcacaagtttctcatgctctaa

SEQ ID NO: 53613 - DNA, 381 bp, Glycine max
  Peptide Sequence Number=SeqID_170391
atgcataaatgctacaaggattacaaagttgatcactcaaaggcagaagttgaggacaaaaatagtgagaataacaatgactggggtctcactggtggagtatggccaaaaaaattgggtctcactggtgggggaagcaaggaggcaatcattcaaaaattccagcaaatggaggaaagggacagagtacaagtagaagcaaagtcattgctaaaggagagaaatagtgagaataacaataagtggggtacaaagtcattgctaaaggagagaaaggcagaacttgatcactcaaagacaaaagctaaaggagaggaagacccgaagaaggcttccacaagaacaccaatggacaaaccaacttcaactacaacaaagtaa

SEQ ID NO: 53614 - DNA, 657 bp, Glycine max
  Peptide Sequence Number=SeqID_170392
atggggacaaatcaaatcggaaaaagattctatcaagtcaagattaagggcctagatgtcaccagccttaaggagttgggacggttgatgggacccctccagaggcaagccttccgcaaggcgtacgaaaagattttagatttgaccatagcggaggtatttacagaagccgttgtatccctcacccaatactatgaccagccattgagatgcttcacgtttgggaacttccaaatagtatcgactgttgaagaatttgaggagattctaggatgtcctcttgggagaagaaaaccgtatcttttctccgggtttcttccctccttgagcaagattgcagctgtggtcggggatttagcgagagagttggatcgtataaagcaaactcgaaatggtgtagtgggcctaccgcagaaatacttggaaggcaaggcaagggatatggcgaatcaagaggagtgggtcccgtttgcggatgtacttgctttgctaatctctggggttgtcctctttccaaacatggacagtttggtggacctagtcgcgattgatgctttccttgcatatcaccatagaaaggagagcccgatggtagctatcttggcggacttatttgatacatttgaccgaaggtgcgagaagaacaatgcacggatt

SEQ ID NO: 53615 - DNA, 819 bp, Glycine max
  Peptide Sequence Number=SeqID_170393
gacttccagctagtgccgactgtgaaagagtttgaagaaatcctgggatgcctactgggaggaaggaagccatatcttttctctgggttctatccctcctcgacaagagttgccaaggtagtgaaaatctcagcacaagagttggaccgggcgaatgggctttcttttattgacatcttggcgcttttgatctttggagttgtcctctttccgaatatggaagggttagtggacctagtagtgattgacgctttcctcgcctttcagcatggcaaggaaagcccggtcgtcgccattttggccatgtatgacacgatcgaccgaggatgtgaaaagagcggcgcaagaattgtttgttgtgcactggctctctatgtgtggctggtttcacacccttttctccaagaaggtaggcccgtctatccgctacaaggtcaccgctcgtgcgtcgaaaaaggaaaggcgaattgggaccaactcttggctaacatggaggggcgtctgttaattggttccctcgctagaaggaaggaagaatcaggattctatcttcatgcgaaggatgagtgccatcagacgaaagcatcacgcctttcatcgcacggggttttagtgaccacaacgcgagggtactccaaggagttcgcaaggcatgggatgcggcgtgaagaaaggatagagagcttaggggaagcaactgtgagagacgatgaggttaaagcttcggaagaaagtgatgaggtacaagccctaaaggcagagcttgaaagagcccgggtagtcgaagagaagttcaagtccatagccatcaaagtctga

SEQ ID NO: 53616 - DNA, 267 bp, Glycine max
  Peptide Sequence Number=SeqID_170394
atggctatggacttgaacttctcttcgactacccgggctctttcaagctctgcctttagggcttgtacctcatcactttcttccgaagctttaacctcatcgtctctcacaccacttatgatagccgccgatgatcccattactgcttcccctaagctctctatcctttcttcacgccgcatcccatgccttgcgaactccttggagtaccctcgcgttgtggtcactaaaaccccgtgcgatgaaaggcgtgatgctttcgtctga

SEQ ID NO: 53617 - DNA, 207 bp, Glycine max
  Peptide Sequence Number=SeqID_170395
atgccaaaagatagggggacttgtcttgatttcagggattgtcatcatcaaaaatggggagattgtagacaaaggatcaagctgaatgttttgataatgccaaaggttcacatgcgtgatgatgccaaggttcacatgcgtctcaaagctttatttaagacaaagcaatcaaagatattcaagatggatgatcaagacagtctatag

SEQ ID NO: 53618 - DNA, 1293 bp, Glycine max
  Peptide Sequence Number=SeqID_170396
atgggatcaaatcaagcacccttgtctaagaaaaggttctatcaagtcaaaattaaaagcctagaggttgctagtttgcaagaattggggcaattgatggatcagctccaacttcaagctttccgcaagacctatgggaagatttgggatctagctatgatagaagtctctatcgaagccattgcatccctcactcaatattacgatcaaccactaaggtgcttcatgtttggggactttcagctagtactgaccatggaagagtttgaagagatcttgggatgtccactaggagaaagaaagccatatctcttttctgggttctatccctccatggcgagaatagccaaggtagtcaaaatctcggcgcaagagttggaccgagtaaaacaaaacaataatgggatagtcaaaataccaaggaagcatttggaggaaaaggcgaaggcattggtagatcaaggtgaatgggattcattcattgatgtcttggaactattggtatttgggattgtcctctttccaaatgtggatgggctagtggacctagtggcgatcgatgccttccttgcatatcaccatagtaaggaaagtccggtcgttgctgttttggtcgatgcctatgacatctttgaccgaagatgcaaaaagagtggcgcaaggattgtttgttgcacaccagttctttatgtgtggctagtctcacacctctttcatcatgaaagtagacccgtctgtcccctacaaggtcactgcttgtatgccgagaaggggaaggaaaattgggagcgactcttggctagtatgataggagcattcattaattggttcccccgatggaaggaaggaagaaccaggtttttgtcctcatgtgagggattctcaaacgtccccttgatgggaacaaggggttgtatcaattataaccccgtccttgccataagacaacttggctaccccatgagaggagcactgtcagaagaaagtatcgtacctttcatcgcgtggggtttcagtaaccccaatgcaaggatattacaaggagtccacaaagcatggagcacggtgcaaagaaaagataaagagcttaggggaagcaacaatgggatcatcggcagctatcataagtggctgaaggcttggacgcaagagttggattggctcctaaagctaaaggtttcaagcgaggaagaggctgaaacccctgaggagagtgaggaggtgaaagccttaaaggcgaaacttgaaagagcacaagcggtcaaggaaaagttcaagacgacgaccatcatg

SEQ ID NO: 53619 - DNA, 527 bp, Glycine max
  Peptide Sequence Number=SeqID_170397
cgagtcattggttctccattgttttcatgttggcgtttaaggtggtggtgatggttctccgatttgaacttgagggtggtagtgatggagttggagtggtgggtgaaggatgggattggagcactggtgttgggggcctgggtggtggcgtgacgacacgatggtggtgtagggtttggggaatggacacagccgaagaagatctgttcccgaattggattgtgtgctttgatgggactcgtggtgttgatgtggggatcaagagtgttgtggatgagaatgaaagaaaatcatcgggtgatcatcatggtgctgcttgtcctgcgtgtgagatggctattgtttggatgcagaaccagctgagccgaaatcagacacaagatcagatactaagttacatcaaccagctttgcgataaaatgcctagcccgatgggagaatcagctgttgactgtgcgaatatctcttcattacctgtagtgtcctttactattggtggaagaacttttgagcttatcccagaggag

SEQ ID NO: 53620 - DNA, 900 bp, Glycine max
  Peptide Sequence Number=SeqID_170398
atggcctctgatcagcacaacacgttccataaggaaggaggtggcaaatcaacatgttccaggagcagaaagggtccaaagaagccaccccagagaggtttaggcgtggctcagttagaaaggttgaggcttcaagagtcttggaagaagatgaatgaagggtcttcttctggaggaggagtgctacaacatcctcctcgtttattcagggctgataatgttgttatcaataacgcagtttttgccaacctgctgaatccctattatactcatcccaatgagaatcctggtgttgctattgttgctcaggttctcaatggtgccaattatcactcatggtcgcgtgctatgctccttgccctgaaaaccaagaagaaggtccagtttgttgatagttctttgccttgtcctgctgtcaatgatcctaatttcactatttgggatcattgtaataccttggtggtttcatggcttcatcattcacttgatccagaaatcttgcaaaccattatgtggatggagaatactttggatatttggaatactctcaagaaatgctattatcaaggtgatgtgtttcacattagtgacttacaagaagagctgtatctgcttaaacaaggtgatgctactatcactacctactttacaaaattgaaagggggccttaatgaacaatactccacagttagatccaacatcatgatgatggaccccctccctgatttagacaaagtgttttctattctcattcaacaagaaaggcagcttgttgttcagtttgatgattcccgggtttttgctcaactggaaaccagtcatggtgcttatggcagaggccaaatggataccagccatgcttcttatggaagaggccattcattaagtggaagaggttga

SEQ ID NO: 53621 - DNA, 336 bp, Glycine max
  Peptide Sequence Number=SeqID_170399
atgaacaaaatagattcactggatcaaggggctgtgacagtggttgtgcgaggaagggaccacaacgatggcaaaagcgacggcgatggttgcgcgagggaagggccgcgatggtggtggcgcaatataatggatccaaacatcgatttagatgaagttttagaacaaatgatagacgaggaattgaaagacaacactgatgaacaaatcattaggttgatacttgagagccaacaacaactatatggaaacaccactaggtgtagccaaagaagaagagtggtacatcgtaattgtgaagaaggtcatgatcgattattcaatgattatttttaa

SEQ ID NO: 53622 - DNA, 173 bp, Glycine max
  Peptide Sequence Number=SeqID_170400
atgtctcaactcatcacacacacatatacttgtcaagttcaagctgaggccagctccttggtggatattgttatctactctgattggagaaatgatgtgctcgtctggctccctagatgtcatggagtcaagcagactagtcaactctctcaatcaaacatgaagagtgtcat

SEQ ID NO: 53623 - DNA, 357 bp, Glycine max
  Peptide Sequence Number=SeqID_170401
atgtcagcgttgatggtgatggtggtgacaatgacaatggtgggtggtggtggtagtgatgttggtggtggtgattgtagtgacgttggtggtggttgtggtggaggtgatattgttggtaatggtggtggtgatgacaatgacagtgatggtgacattgatggtagtggtggtggtaatagtggtgatggtgatgtcgatgaaaacgatggtggcagtgatgttggtggtggcaccaactattttaggaaaatattgattggtggatcaaaccttgataaaagcttgttctattattggtatagttttcttctagttgaacctacaagagttgggaaggatctcttggagcactag

SEQ ID NO: 53624 - DNA, 2481 bp, Glycine max
  Peptide Sequence Number=SeqID_170402
atggctgccacctccaccacccatttgttccaaaccagaatgttctttccacctacgacaattgcaccactcacttctccattttccacgttccttgggccacaccagaggctcctctcaaaagggtgcagacgcattggtcaaagacggagatgtagacactccatgtttgtgaatgcaaaactccttctcaaagatggcactctcagtgtcaatggcaaggatgcattaaagggtgtgcctgagaatgtggttgtaacaccattcactggttcgtcggctttcataggggcaacttgtgctgatgccagttcacgccttgtgttcaagcttggagtcattcagtatgcatttttctctgttggttatgaccgaatctgcgacatttgtctgcaatttctcgcaatattgctaattgccatccgggatgtcagattactgtgcctatacagatttaaaatttggtggatgataccacgagtaggaaactcagggagagacattcctattgaaactcagatgttgctcatggaagcaagagaaggaaattcacaatcatccaaggaacataattcatatttcattttcttgccggttctagatggtgaatttagaagcagcttgcaaggaaattcatctaatgaacttgagctttgtgttgaaagtggagacccagaagtagttacatcccagttcctaaatgctgttttcatgaattatggaggccatccatttgatctagtgaaggaatctatgaaggttttgtcagagcacactggtactttttcactgagggaaaccaaacaggctagaatgttagattgctttggttggtgcacttgggatgctttttatcacagtgttaatcctcagggaatcaaagatggactcgggagtttatctgaaggaggtacaccagcaaaattcttgataatagatgatggatggcaagacactgtgaatgagtttcaaaaagatggggagccatttattgaaggatcacacatcaaagaaaacagtaaattccgagcagtgggagatgtaactgaaagtggggcaccggttagtctaaaggattttgtttcagaaatcaagagctcttttggtctcaagtatgtctatgtatggcatgccctattgggttactggggagggttagatccaaatgcatctggaaccaagaagtatgatccaaaacttagatatccagtacagtcaccagggaatttagcaaatacaagggatttatctattgatgccatggagaagtacggtatcggtgtcatggatccagctaaaatttcagagttttatgatgatctacacagttatcttgtctctcaaaacattgatggagttaaggttgatgttcagaacatactggaaacaatttcaagtggtctaggaggtcgtgttcttctcactagacgctttcaacaggagcttgaaaagtccatatctactaactttcaggacaatagcataatctgctgcatggctcataacacagactccacttaccactcaaaacaaagtgcaatcacacgagcatctgatgactattatccgaaaaaccccacaactcagtctctacatatagctgctatagctttcaacagcatattctttggtgaaattgttgtaccggactgggacattctccatgatgcagctgagtttcatgcagtagctagagcagttggaggctgtggagtatatgtaagtgacaaaccgggccagcatgatttcaatgtactgaaaaagcttgtacttcccgatggatcagtgctcagagccagatatcctgggaggccatcgcgtgattgtttatttattgatccagttatggataagaagagccttctcaagatttggaacttgaacaaatgtgggggagttgtaggcatctttaattgccaaggaacaggttcctggcctggccttgaaagtaatgctgaagaagacatcacttttgagctttcaggcaaggtctctccctcagatattgagtattttgaagaggtttcaacaggtccatggactcaagattgtgcagtttttcgcttcaatacaggatggtcaatggactataggtttctgtttgaaatttcaggttctctgacacgactatctaaggaagaatcatttgatatcacattaaaagtattgcagtgtgaagtgtttactgtatctcctatcatggtttacaatcaaactattcagtttgcaccaataggactaacaaacatgtataactctggtggagctgttgaagcagttgactccagtgattcttctggatctaaaatacacataacaggtagaggaggaggtgactttggagcatactccaacttaaaaccaaagtcttgctatgtaaattctgaagatttggagttccaatttagagaggaagataatttttttggagtaacaattcgagctaaaaccagttcatgggaaatcaccatctgctactaa

SEQ ID NO: 53625 - DNA, 3498 bp, Glycine max
  Peptide Sequence Number=SeqID_170403
atggctttcttcgccgaggatcttcacctgttggctagtgctagcacggatgggagaatatttgtatggaaaatcaatgagggccctgacgaggacgacaagcctcaaattactggaaaagttatcctagcacttcaaatattaggggagaaggagcctctcaaatgttccattgataagttgattgatggggtgcaacttgttggtaagcatgatggcaatgtcaccgagttgtcaatgtgccaatggatgaagagtcgattagcttcagcatcagctgacggcacggtgaagatatgggaagaacgtaaggcaacaccacttgctgtcataagaccacatgatggtaaacctgttaattctgtgacgttcttgactgctcctcaccgccctgagcacattgttcttatcacagcggggccactaaatcaagaagtgaagatttgggtttctgataatgaggaaggctggctattgcctagtgattctgagtcatggaattgtattcagactttggatataagaagttcgtttgaagccaaccctgaagatgcattctttaatcaagttgtagcattgtcccgtgctggtctgtatctgcttgcaaatgccaagaaaaatacaatatatgctgttcacatagagtatggatccaatccaactgctacacgcatggattacattgctgagttcaccgtcacaatgcctatattaagtcttactggaactagtgatagtttaccagatggtgagcatatagtacagatatattgtgtccaaacacaagctattcaacagtatggactcaatttgtcacaatgtttgcctccacccctggacaatgttgaacttgagaaaacagaatcccatctatctcgtgcttttgatgctttggatggatcaatggaaactggaaatatgccacaagttctttgtggcagttctgaaagtgctcctgttgtgagcgttgctgtaaatttgccttcatcagatatttctgggttacctgaagcttctatatcttcgatatcagattcagagaccaagtcaaatgatttacctcctcgtaatggttttgaacttgtgcactctgcttcacctccacttcctcagagtccaagattgtccccgaagttatctggtttaaaaaattcatcaaataatttagagactagttcaacaagtgctgatcacagcagcgagcagacaaatcttgattcttctgctgaacagaaagtggaatctaaaaaagatatggcagatgtacctggatcaggtgacaatttgcgaaaggatgataaagttgttcaaagtgatgtttctgtggtttctaatgcccctacaacatataaacacccaacccatttggttactccatctgagatattctctaatgctgctttatcttctgataattctcataattctcaaggtatgaacggtcaagatgtggctgcccatagagatgcagaaaactctcaagtagatgttgaagttgtaggggagacagattctattcaagaaaatactgagtatgaaagagacagagactcacacacaaatgttgctgagaagaaagagaagttattctattctcaggcctccgatctgggtattcagatggctagagagacctataacatagagggagcttgtcaagctgataatattaagaccatcaatgcacctgatcaaagtggtaactctgttgaggaagaaattcaagacacaagtaaggatgtacctgcaaacatcagtgaatcagaaactgtggctgctgctgtgcaatctcctgcaccttctgtgaaaggtaaaagacaaaaaggcaaaaattctcacgtgtctggtgcatcttccacttctcccagtccttttaactcaacagattcatcaaatgatcaaggtggcaattcaggagggtcatccatggaggctgctttgccacagttatttgctatgcaggagatgatgagccagttattaagcatgaataaagaaatgcaaaagcagatgaatgcaatggtttctgtcccagttactaaggaaggcaaaagattggaaggatccttgggtcgaaacatggagaaagttgtcaaggctcacactgatgctttgtgggctcgattgcaagaagaaaatgcaaagcaagagaagttagagcgagaccgtacacagcaaataacaaatttgatctccaattatgtaaacaaggatatggtatctatattggaaaaaatcattaagaaggaaatatcttcaattggaacaaccattactcgttcaattagtcaagttatagagaaaactatatcatcagctattacagaatcattccagaagggggtgggagacaaggcattgaatcaactagaaaaatcagttagttcaaaacttgaagctacagtggctaggcagatacaggcacaatttcaaacctctggcaagcaagctcttcaggaagcactcaagactagtgtggaagcttcagtcgttcctgcatttgagatgtcttgcaaggctttgtttgagcaaattgatatcaaatttcaaaatggacttgtgaagcacacaactgctattcaacagcagtttgattctactcattctccactagccatgactttgagggatacaattaattcagcatcatcaatcacacaaactttgagtggacaattggctgatggccaacgtaaactgctagcaattgcaactaattccaaagtagctgcagatccctttgtagcgcaaatcaacaatggcttgcatgagatgactgaggatcctaccaaagaactatcaaggttgataagcgagggcaaatttgaggaagcatttacgggagcccttcatagaagtgacgtttcgatagtttcttggttatgttctcagattttgagtttttcctatggcaaaattgtaaatttctgggggtcctccatgaaaatatttgtatggttatatctgataaagtcaacgacaatgtctctaatgtatagtttcacatctcttcataaccaggttgatttagcccgtattttggcaatggtgccactgccattaagccaaggagtacttctgtctcttctgcaacagttgtcctgtgacatcaatacagagacacccaaaaaattgacatggatgacagatgtggctgctgctataaacccggcagatccaaggattgcagcacatgtgcggcaaatattagatcaagtgtcccgaacactgggccatcatcggattttaccaactacctccccttcagaagcgagcacaattcgccttctcatgcatggtaggcagcagttgaggctgggagtggctgtagcaagtattgactggtcattgtatcctgctacagcaggcttggccttcacaagaaattcacaagcaatgcaaaagcaactgttgtcgacatccggtagtaaccaatgtgttaccaaaccggagcagatcctctgcagtgagaaaaagcttgatcctcggcagtattaa

SEQ ID NO: 53626 - DNA, 489 bp, Glycine max
  Peptide Sequence Number=SeqID_170404
atggaacgggggaagaataagagagcaagagaagatgatgaagttgagattgggtcttcttttgagaattataacaacaatattgcaaagaagagaaatgtatatggcataagcttcaagaaggagaagaataatgaagtggaagagaaagattgtttcaaggcatgggattattcccatttgacaatgggagtgtttgatttcccttggctgaaagatggtgtcatatccaaatcatatgaatgcttggattttgaagacaatttcttgtcatctctagaacgccaagacactttcttcaaagcttcttctggcattgatttctctgaggagtatggtttgtgtgaaattccagaggcatcaatggctcatattcaagaagccaagttggttgaggatatgtggaagccatttgagagtaatgggttggagctggagccagaaggtggagattgtatttggagctttttactcaataaacctctttga

SEQ ID NO: 53627 - DNA, 897 bp, Glycine max
  Peptide Sequence Number=SeqID_170405
atgaaacaaagacgtgtttggttgacaccgtctttgaagcatactggagacaacgatgggacccaccgttcctctgccatcctttctcgaagcttcacccttttctctgtttcacgaaattcccaacctttctccaccaccctgtccaataacttccattccctccttcacccatctcccaataagttgattccgcttcaaaccaattttctgaattcatcattgacttcgagattcgggttttcttcaatagcctcgcatgagcatgcaagtgaagaagcaaaggtatctgatcagtctgaacaagctgaagctgtggatcaaaccaaagaatcagatgtagagagtgaatgtgatctatccagggatgatttgataaagcttgttgttgagaaggaacaacttttgaagttgaagcacaaggagattgagaaaatgcagagatggagaatgtcatggataggacaagaaaattttgcaaagagtttactagatgtagatgataatttgggaagagcttcctcagttgtaaaggacagcttttcaaaaattgaatctcttgaggagtcttctgaagcagcacaactcctaaaaacacttctagaaggtgttgaaatgatagagaaacaacttgcagagactcatggtgaactaaatcacatgcatgagaacacattgaactatgttcttcaaagagtttgggcacaggtggggatatcatctggtgctgctgcagttaacaaagttttctacatcagtcgaaaaaggaccattgtagaacacatgacaaactacatcggtcgtaaaaggaccgtcgtagaacacgtgataaacaaagtcattcctacgacagcaccgatgcagaaagtagtgctttctgcatcagtgctgtcgtag

SEQ ID NO: 53628 - DNA, 450 bp, Glycine max
  Peptide Sequence Number=SeqID_170406
atggtgtggttatggttagattccgtttgtgagatgatgtctcactttgctactcctgacgggctccaagactataccctttggagttgggagcttggggatcggtatacgttgtactcatatgtggcgatcactccctactatcatccatgtggttgtgtaagaccatcaacacctgggaggcttggtggcattgttgggccctgttatgtgtcgagtgtgaaattatgggctctaagacatcaagagtgttgtttgcctagaaaaaccacacgccatgattatgagcgaagcactcacccttacaaccaacaactttcaggtactaacattagaggagaccatgatgatttcatgcttgtggagataaaggagtacaaagagttgttgtggcaattagagccttcacctaaggaggatgaagatgacccttctgaggatccatcttag

SEQ ID NO: 53629 - DNA, 390 bp, Glycine max
  Peptide Sequence Number=SeqID_170407
atgggtacaagagtatggctacatcacaatcccatattagggaaactaatcatttatggttatggaaaaactagaaatcccaataaagaacacagacataccaaaagagaaggagacttgaccagaattcgtccaaatagtgatctctactctcctccacagctaaaagactccaacacaaccctcttctctctcagaacactcaagaacgttatcaaaaatttaaaatgtcaaaatcacactcccaaaaatattctccttggatttgtcaaatcttatgaaaatagattaagtcaagatctaaaattcctcaatcgccatcaaaagaagagctctactacacaaacctgctctaacaaaaaggaagtgatgtctggttgtagtgtttga

SEQ ID NO: 53630 - DNA, 2190 bp, Glycine max
  Peptide Sequence Number=SeqID_170408
atgccactagcacaagggagtgagggactacatcacaaagctgctaaagaaagccacttcaacacactacctcgagcatcttcaaaattggctgatttggctggtgttgcttctcatggtgttgagaattgccaagctactttcaaaggatgtcatcattgccctcttgacttcatgaacaatgctttaaagggtctttgtgaaatttgtgtagtggtttctaaattgttcacaagccatttcaaagcttcaatttccaacgacccagaaaagggtttggtgaaaaatgccaatttggttctcatttcaaattccggaacccccttaatgcccaagaatttgagtttgaaaccaaggtcttcggatgatgcacttcacaaacgcaacgtggagatcacgattttgggtcgccacggcaagctcgacgaagcaaggaagctgttcgacgaaatgcctcaacgagatgacgtttcttacaattccatgattgccgtttatttgaagaacaaggacctacttgaagccgaaacagtgttcaaggaaatgccacaaagaaacgttgttgccgagtccgcaatgattgatgggtatgccaaagttggtcgcttggatgatgcccgtaaggttttcgacaacatgacccagaggaatgcattttcctggacaagtttgatttctgggtattttagttgtgggaaaattgaggaggctttgcatttgtttgatcaaatgcctgagagaaacgtggtgtcctggactatggtggttttgggttttgctcgcaatgggttgatggatcatgctgggaggtttttttatctcatgcctgaaaagaatatcatagcttggaccgctatggtcaaggcatatcttgacaatggctgcttcagtgaggcttataagctcttccttgaaatgcctgaaagaaatgtacgttcttggaacatcatgatctcgggttgtcttagggccaatagagtggatgaggctataggtttgtttgaatcaatgccagataggaatcatgtttcgtggacggctatggtgtccggtttggcacaaaacaagatgattgggattgctaggaagtattttgatctcatgccttataaagatatggctgcatggactgcaatgataactgcatgtgttgacgaggggctcatggatgaagctcgtaagctattcgaccagataccggaaaaaaatgttgggagttggaacacaatgattgatggttatgcaaggaatagttatgtaggggaagccttaaatctttttgttttgatgctaaggtcttgctttagacccaatgaaaccactatgactagcgtagtaacttcctgtgatggcatggtggaactcatgcaagctcatgcaatggtcatacaccttgggtttgagcacaacacatggcttacaaatgcacttattacactgtattccaaaagtggggatctttgctcagctaggcttgtttttgagcaactaaagtcaaaagatgtagtatcatggactgccatgattgtagcctactcaaatcatgggcatggacaccatgccttgcaggtatttgcacgcatgctagtatcaggaattaagccagatgaggtcacctttgtgggactcttatcagcttgtagccatgttggtcttgtccaccaaggtagaagattatttgattcaatcaagggtacttataatttaactcccaaggctgagcactattcctgccttgtagacattctaggtagagcaggacttgtggatgaagcaatggatgtagttgccactatccctccttctgcgagggatgaagctgttcttgtggcattgcttggtgcgtgccgtctccatggggacgttgcaatagcaaattccattggtgagaagctattagagctagagccgtctagttcaggggggtatgtactactagccaatacatatgctgcagagggtcaatgggatgagtttgcaaaagtaaggaaaagaatgagagagagaaatgtgaagagaattccaggatatagtcaaatacagataacggggaaaaatcatgtctttgttgtcggggaaagatctcatccccagattgaggaaatttacagattattgcaacagaaccttcaacctttgatgagggaaatgggttctacaccagagaacttgttgctagttctcagttaa

SEQ ID NO: 53631 - DNA, 1609 bp, Glycine max
  Peptide Sequence Number=SeqID_170409
atggggaattcatttgggtgttcggcttccggcgagaggttggtgtcggcggcgagggacggcgatttggttgaggcgaagatgcttctggaatgcaacccttgtcttgcaaagtactcaactttcgggggtctcaattcccctcttcattttgcagcttccaagggccataacgagattgtggcattgttgcttgaaaatggagctgatgtgaattcgagaaattactgtgggcagactgctttgatgcaagcttgtagatatggtcattgggaagttgtgcagacccttctgctcttcagatgcaatgttgtgaaagcagattatctcagcggtaggacagctcttcactttgcagccatcaatgggcatgcaagatgcattaggcttgtcttggcagattttgttccaagtgctccttttgaagctttacatgctcgcatagatgctgagggtgatggatcaaatgtgaaaaacaaacatgaacaaaggtttgcacagcagtggggacatgatctatgggtttgccattcaccgccggctgaatcaccatttctcgcttctgatgaacaccctaatcatgttggcatcattagggggcttcttttttccatctgtgacggtctcattgccgttgattgggtcaccggcatttcagcccttctactgccagcaacaaattcattcctcggcttgagcttcttgaagttgaagggggcaatgaggttgtgggtgcctgtgctgtccaagtttgtaaacaaaacagctgatgctggtattactgcccttcatatggctgcattaaatgggcactttgattgtgtacaactgctacttgatcttaatgcaaatgtgtcagctgcgacatttcattatggggctggaagcactccattgcattatgctgcttgtggaggcaatttaaaatgctgtgcaagtcggatggctttgaactgcaatggatggcttccacttgatgttgctcggatgtgggggcgtcattggcttgaaccattgttgacacctacttctgatgccacaatatcatcattcccttcttcaaattatttatccttgcctctcatgagtgtgctcaacattgccagagagtgtggactgcaatcaactacaacctcctctaacgaagttgatgtttgtgctgtttgcctggagaggcaatgttcagtggctgcagaaggatgtgggcatgagctttgtgtaagatgtgcactctatctttgctcaacaagcaatgtttcttcggagacgtgtgggcctcctggctctatcccttgtcccctttgtagacatggaattatctcttttgtcaaattaccagatcgaccgactgtttctcatacccctgagattcgaagaaaccgtgtagcttctgttccatcggagatgctttgccctgtcacttgcactccatttccatctgtagcaattcctctgtgtacatgcaacaatggtccttgtccatcatttgaaccccgggaagcagaagcacaaggtggatcgcctctccactcgcatgcttcgatgatggatcaggataaaatggatggtccgaggctggagaaaacaacatgctcaggcatgttttggg

SEQ ID NO: 53632 - DNA, 219 bp, Glycine max
  Peptide Sequence Number=SeqID_170410
atggaggctctaaaaaacaaagaaacaaaatccaacgagagggaggaggcgaatcttaacgcaatggggtgtggaagaaactgtgatggtgacgtggcaccttcctctctatatctatctaactttgtgagacagagaaggataaaacaaaaagaagggttgaaggtggtagctaggaatgtgattgaggtcggtgttaatggtggttttgttatctga

SEQ ID NO: 53633 - DNA, 603 bp, Glycine max
  Peptide Sequence Number=SeqID_170411
atggtagcccatggacgtgaagatgtattgattactgccattggacgaccacaactccctggccatgttcatgttgttggagtcgatgtgccgatcaggaaatactttggaccaacttcagcagagctggatcgattgaaacaaaatattaaggagaagctgacacaaaatatctgggagacaactaatgttgtccttaagccaaatgcagttcagttagtggggcagacccttaacattgtccatgcttggctggcacatcttgtacaaccttttccaaaaaaggataaacatgtaccaaagggacttacgaagcctgttcataggctgaaacatgatgatgattccatataccatatgaaattgatgatcccacagcttttcctcaagcctatgcaggtgttgtgggatgcaactatgtttcgggtgtacaatgataatgtccctttgtacataaagcatgaagatcttggggaaataacacatagtggtcaatgtctgaacatcgttgttatacaattgtggattatgcatatgaatgagttaaatctgcgatcggggaatggctctatgcatggattccttgagtcacagtccatatag

SEQ ID NO: 53634 - DNA, 267 bp, Glycine max
  Peptide Sequence Number=SeqID_170412
atgatgcatccaccaaagaaagaggttgacaggttcaccggtggaagaatgcatgcatcgatggaagaggcctgcatgttcaccacagaaagaggatggtgcattcaccacaagaagaggccgatgcatttatggattgcatttgagtacactgatgtttctgttttagcgattaagtttggaaaattccaagccaaaggactcgacacttggatgactgtggaccgtccaggacaaatctctttagagaggttggctcacacttaa

SEQ ID NO: 53635 - DNA, 180 bp, Glycine max
  Peptide Sequence Number=SeqID_170413
atggtgaaaaagaaactaagtcacgaagtatcaaaagtgatagttgagcttagctcagcagttgggctaagcgtgcatccaccgctaagcgcgacagaagaatctggcagggcatcaatatcaaggccgcgcgctaagcgcgagatcagtgcgctaagtgcagcaggtgccttcagctag

SEQ ID NO: 53636 - DNA, 685 bp, Glycine max
  Peptide Sequence Number=SeqID_170414
ggtgataaggagtggacaacgaagcagcgaaggaaaggcaagtctagggtgaaccaggtcaccttctattttatgcatttcccttatgcttatcttgaggaagaattgcataaggtatttagctattgggggtttgttaaggaagttttcatggtacctaggagaaacaagggagggaagggcaaagcagtgatgcaagacaaagagaaagtggtcatgggagaagaaactagttatgggccaagtagagaagcggtgtcatatgctcaggcaacaaataaagctaaaagtaatgtgacaaggatttggaggaaaaaacaacaaccttatatggttgtagatgattggagggcttgggacccgaatactgaaatctcaaacatggagtggcttatcaagagtttggtggggaagatgcgaaatccacaaaaattgactattgttatggaaagatttatcattcaagggtttagcatgatcaaaatctgtttgttgggtaaagaggggttttcgagggcatttaatgtagaggaggttaaagctgaaaaggtatggggaaaaggtgttactggggtttgcgtagataacgggacaatgcagattcatgattatagggaagaacaacataaaagaggtctctatgataggtggattgggtttgatgtctatgggaggggtgatggag

SEQ ID NO: 53637 - DNA, 429 bp, Glycine max
  Peptide Sequence Number=SeqID_170415
atggagttgatggatactcctatggtgggtaggaaattcatgtggtacagaagtagtgaggttgtgaaaaacagctggacagaatattggtctcggaggattggaggtttgaatgtctcctacaagaaaaatcaagaatcaaatgactcaaggagagatgataacaccaagttttttcattctatcaataattggaaaagaagatctaatgggttgaagggtgttatgaaatatggtagattggtggaggatcccaacattgtcaaggaggaagtcaagtgcttttttgagaagaaattcaaggaaagcgatgatcttaatttgaatcttgatggggttgctttcaattccattgggagggaagataatgagattcgtgttgctcgattttctaaatttgagatcaaacaagctattcatagtgtctag

SEQ ID NO: 53638 - DNA, 450 bp, Glycine max
  Peptide Sequence Number=SeqID_170416
atggtggaggaagcaaagaggaagaagaaatcgatgatggtctttaaggtgaactttgaaaaggcgccctatgatcaggtgagatgggggttcttgtactacatgctaagaagaatgggattttgtgaggtgtggattaattggattaaatgttgtgtggaatctgttactatgttggtattagtgaacaaaagcccaacaaaggagtttaaagggaaaaaagggctacttgcagaagggctaagtggcttctttaagagaggcttcaaggaagaatcttttcaagggagtgaagacagtgaggttcagaagctagcttgggtcaaatggtcatctgtgcgtaagtctagagaggaaggtggtttaggcattagaagcgtggggctatttaataaagctctagtgggtatatggggttggcggtttctgacagagagtgagtatttgtgg

SEQ ID NO: 53639 - DNA, 381 bp, Glycine max
  Peptide Sequence Number=SeqID_170417
agtaggggcataccgagatatagcaacaaagtcacgaccagctttaagaactcaaccaagagtagtaacaagagtaggagggtcgggggagcttgttcaaaaggggatactaataagccacactccaaatatagaaggaaacaattgagatataataggacagtgtatgactctgctttactgaaatataaggtgctagggaaggatgtgcatctaattaaagacaacaaggaggaagcaactaatatttgggatatggctaaatccattagagtgggcaatgcaggtacaaaacagggtgttgtagcaaggattatggaattggaagagagggacaatgatgttgtacatttacgaggaggtgttttagaggaaggataa

SEQ ID NO: 53640 - DNA, 502 bp, Glycine max
  Peptide Sequence Number=SeqID_170418
ggcaaatgttttccaagaaggagggaatgatgagaatcctgaaattggccaaatacaggctaaaggcccaagtggagaagggcgaaggctcaagtggagaagggttcgcatcaaggatgacattctagaggcctcagaggccattccatcatatcctttcattgttgagactagtccaaccattccacaggaggatgctacaacaattacccacagtgcgaaagttgatgtctcgctaagcgagctcaatgcgcttagcgagtgtcatcctctaagcgaggcatcaacgcgcttagtggataggaggaatctggaagggaatctgtcacgcaaacacgtgctcagtgcgtcatcagctcgctcagcgagtcgtttgtcaccttccaggcttagcacgagtttggcgctgagtgaaaattcacttactcgcgctaagcgtgacgtcaaggagcttccttgctatggaaggctaaatcctcagttggggattcttgctgagtaa

SEQ ID NO: 53641 - DNA, 432 bp, Glycine max
  Peptide Sequence Number=SeqID_170419
atgtctatcgatcgagactactttagtctcccttcgtcatccagagacggcaagtctgataacacacagagaccaatatcgtcatttgcttcctttgtcgaagactcaatgtctatcgacagagactactttattctcccttcatcatccaaagacgagaagtccgatgacacgcagagaccaatatggaaagcgagtccgttgacacgcagagaccaatatggtcatctataccctttcatcgaagattcaacatctatcgacagagattactttagtctcacctcgtcatccagagacaatcaagtccgatggcacgtggagacaaatcacggtcatccgcaccctttccgctatccagagacgatcaagtccaatggcacgcgaagacaaatcatggtcatccgtaccctttctgctatcaagagatga

SEQ ID NO: 53642 - DNA, 837 bp, Glycine max
  Peptide Sequence Number=SeqID_170420
aggactacacgtcctcgccttcagaggactacacgtcctcgccatcagagggctacactacacgtccttgccttcagaggactacacgtcctcatcttcagagagacacacgtcctcgcctttaaagggctacgcatcctactcttcagaggactacacgtcgttgccttcagaggactacacgtcctcatcttcagaggactacacgtcctcaccttcagaaaactacacgccctcacctttataggaccacaaagcctcgccttcagagggctacacctacacgccctagccttcagaggactacacgtcctccccttcaaaggactacacgtcctcgccatcagagggctacacgacatcaccttgagaggacaacacgccgtcatcttcagagggctacacgtcctcgcctttagagggctacacgtcctactcttcagaggactacacgtcctcgccttcagaggactacacgtcctcatcttcagaggactacacctacatgccctagccttcagaggactacacgtcctcgccttcagagggctactcgtcctcaccttcagaggactacacgccctcaccttcagaggacgacacgtcctcgtcttcaaagggatacatgtcctcgccttcagaggactacacgccctcagcttcagaggactacacatcctcgccttcagagggcaacacgtcctcacctttagagtactaaacgtcctcgccttcagaggactacacatcctccccttctggagactacacgtattcgccatcagagagctacacgtcctcaccttgagagggctacacgtcctcaccttcagatga

SEQ ID NO: 53643 - DNA, 267 bp, Glycine max
  Peptide Sequence Number=SeqID_170421
atgttgccattgaaggtggcgatacagttgagttgtcattggcattggcgagatagtgctgacatggagagtaggggcacagtggttcagggtggtttcgctaacatggatggcgagtttgttttgagagtatctcaccattgttgctggcgagaaaggtgcctacgtggtgcacttgcatgcaaactgaacgtagcagcgtataagaagcaggcttttccagaaaccttttcagaaagggtttcgcaagtgggagtggtggaataa

SEQ ID NO: 53644 - DNA, 501 bp, Glycine max
  Peptide Sequence Number=SeqID_170422
atggggcatccacaaggtcctgggaccgagtctgggtatgggataaatgcctcagaaggagggtgtttggtgctggaaattgaggaggaagagacaaatctttgttgggagctggtggcagtattgatgcgtttgattgaaggctttacttggagggaggatatgaaggatggatgggtatggaaagtaggtggcgaggagaattatgttgttaaacaaccatctctacctagggaggacacacattttttcagaagcttgtggaaagcattggctccctcaaaaacgttgggttttacggggaagatcatgttggatagggtgctgacatgcaacaacttgctaaggtggaatataaggatcttgactgttattccaaacgaaccttctactcgttggtgcaatcattggggcgggttgtgtgggacgaaaagaaggagaagacggtggggtgtatgggtctcggtgcatggtttggtcgttgtggatgttgtggaatga

SEQ ID NO: 53645 - DNA, 165 bp, Glycine max
  Peptide Sequence Number=SeqID_170423
atgaaagtgatgcaatcctacctcctaagggcattggatacaagactctatgaagattgggccagagatgcaagagaaggccctagggttctcatgagccttagggtagggtaccctagaaatgtaggattttgcagcccttgtattttagggcacctagactag

SEQ ID NO: 53646 - DNA, 204 bp, Glycine max
  Peptide Sequence Number=SeqID_170424
atgacgtttcactcagcgccaatgcacagctcatccttcttccagattcttcctcgtgctcagccgaggagtgttgcgcccagcggttggctcgctaagccagtagattggcttagcgagaggatgaaaatcagcgcttcacaaactttcctaattaacctgaaattgttttatacacaaaagttagttatattcatcgactaa

SEQ ID NO: 53647 - DNA, 308 bp, Glycine max
  Peptide Sequence Number=SeqID_170425
atgtactgactattgtgattggccaaccaaaacaccctggtcgtgtgcgtgctgctggagacgatgtcacgatcaaactatactttggaccggctccaaggacctcccacacgtcttcgtccatggctccgaaagacgtggagcagttgaggcaagaaatcagggaccagctggaggagtcgatcacagaaaaagtgactcgacaagtactcgcactacctcctaagcctgaggatggtcgttcaactactcgtgtcagcacacaggaaaatgttgtcatctggtttggacgatactccacaaagtaa

SEQ ID NO: 53648 - DNA, 636 bp, Glycine max
  Peptide Sequence Number=SeqID_170426
atggtagtaggaaatgcaactatagaaaaacccaggggacaatgggatgaagaggaaaaaagaagggtacaatataccttaaaggccaaaaatataattacttatgcattaggcatggatgaatactttagagtatcaaattgtaggaatgcaaaagaaatgtgggatacattacaagaacacaaaatggaacttatgagactaaaccaacatgaagaaaatgataagaaaaagaaaggaattgcacttaaagcctcatattctcttcaagaagaaagtgacaccttgaatgaaataaaagaagatgatgattttagtttcttcataaagagattcaataggtttctaaggaacaaaggaaatcaaagaagaacaaacttcaattcaaagaaaaaaagagaagattcatcttctgttccaaagtgctatgaatgtaatcatcctgaacatctaaaagttgtttgtcctagtttcaagagaagaatggaaaaatctaacaggaaaatcttcaaagataagaaagcaaagaaagcttacatcacttgtgaagataacaatatgaattcatctggagactcagaaaatgaggtcatgaatctaagtctcattgccaaaaactatgaaagcgaagaagag

SEQ ID NO: 53649 - DNA, 2103 bp, Glycine max
  Peptide Sequence Number=SeqID_170427
atgcgtccaccgtttttgtcagatgccgggagcagatgcgcgtcgttgctcgatcgaaaccaccgtggagacacgctgttaaaaagcgtggcgtggattggcaaacactacaaacgcgagaagagtgaagaggcgctggtcgccggcctgccgaaagcgacgctgctgtcgccgtcgcaggcgatgaccgctctggagaacgctggcattaccggcggcatggttgaacgccgcctgcaggatctgccggagcagctgatgccgatgatactgctgcggcagaacggcggcggctgcattgtgctgtcgcggcgcattcacaccaatgaggagaatcagcgcgagctgcgcttccagctgatcatgccggaggtgagtgataaagcggtggagatgagcctggcggagctcaacgagatttacgccggctttgcggtgatggcgaaaccggcggcggtactggatgagcgcgccagtgaaatgctgccggaggtcaaaggtcactggctgttcagcaccctgtggcgctaccgccgttactaccgcagcgccgccattgccgccgtgctgatcaacgtactggcactctccagcatcttcttcaccatgaacgtctacgatcgcgtggtgccgaaccaggcgtttgttacgctgtggtcgctggcgattggcgtcaccatcgccatgatcttcgaagccattacccgctttgtgcgggcacatctgctggacatggcgggcaaaaaggccgacctggtgctgggcagcatgctgttccgtcaggcgttgtcgatccagatggagcacaagccggcctcatcaggcactttcgccaaccagatccgtgaatacgaatcggtgcgcgattttgttgcctcggcgacgctggcggcgatttcggatctgccgtttatcctgatgttcgtcggcgtgatcttctttatcagcggtccgctggcgattattccgttaatgatgatcccgctgatcatcatcgtcagcgccgcgatccagtggccgctggcgcgcatcatgaaagagaacctgcgcgatgcgtcgctgaaacagggcgtgctgatcgagtcggttgaaggcatggaaacgctgaaagccgtgggcggtgaagcgcatatgcagcgccgctgggagaacttcagcgcgctgcagtcggctaactcaatgaagtcaaaacgctattcgacgctggcaaccggtgtggtgacctttctgcagcagtttcagaccgtgatgctggtggtagccggggtttatctgatcaacgccggcaccttcaccatgggtgcgatgatcgccaccgtgatgctggccagccgcgccaccggcccgctgggtcaggtgattggtctggcggtgcgttatcagcaggccaaagcggcgctgacctcgctgaataagctgatggagatgccggtcgatcgcgacagcagcaaaacttacctgaccgatccgccgctgaccggcgagatctccctcagcaatgtcagcttctcttatccggcaccgccgatgaagcccaatccggaaatcctcaaagacatctctctgaccatcaaggccggtgagcgcgtggcgattcttggccgcatcggtagcggtaaatcgacgctgttacgcgtgatggcgcgtctgtatcagccggtgaaagggcagatctccgctgacggactcgatgttaaccagatcgatccggccgactggcgcaaagcggtgggcttcgtcagccaggatgcgcgcctgttctacggcacgctgcgcgagaacgtgatgattggccggccggatgccaccgcgaatgaactgctgcgcgtgttgaatctgaccggtctcgatcacgtggcggcgcgccatccgagcggcatcaacctgtcggtcggcgagggcggtgaagggctgtcgggcggtcagcgtcagttagtgtcgctggcgcgaaccctgctgacgcggcccaaagtgctgctgatggatgaaccgaccagcgccatggacagcatgaccgaaagccagttcctcgcccatctgcgtcgcgccagcgaaggccacacgctgatcgtcgtgacgcatcgtccgtcaattctggcgctg

SEQ ID NO: 53650 - DNA, 252 bp, Glycine max
  Peptide Sequence Number=SeqID_170428
atgacggaaccccaacagccccagagaccaaagattgaacctttttcactcaaaggagggacacagatccgagatggtgctgttactcatctggggctgcatttggatggagtcagtggaggtgaactgcgtgaggaaataaaaggatgtggggagattcattgcattgtcaagttaaggattggttttgtgggtgtgcttgtccatgtctgtgatcttctctttgtatccttatcatcgctagacgcgtaa

SEQ ID NO: 53651 - DNA, 234 bp, Glycine max
  Peptide Sequence Number=SeqID_170429
atggttgaattggtaaggattcctgctatcaacaacattgaaacaggtttagctcatggcactatggttcttatgccttattgtggggaacaacaaggcaagacgaagtcaacatttaaggaaccatcaatggaaaaaaaggtgattacttcacctaagactcttgttgctacaagtggttatccaaaggagcgtttggtttttgacaaagacagggagaaggatatagcctag

SEQ ID NO: 53652 - DNA, 306 bp, Glycine max
  Peptide Sequence Number=SeqID_170430
atgaatcaacatattgcagcgattccaagctcggaacgacggatcgaaggcatcaaccggcatcggaattgttccgtcaagaaattcgaacttgagtttggctccgagagcgcgtcgcagagacctcgcccaagaatggtagttggaaccatcgaggagtggtgtgaccttgacggaggagggaccgtcgctaggatgaacaaagaacggactagtaggatcagtagagggatccgccggtggcggtggtgctatacgcggtggcatagtggcggaagcaaaaggaatggatcgttaggtcgatga

SEQ ID NO: 53653 - DNA, 309 bp, Glycine max
  Peptide Sequence Number=SeqID_170431
atgtacccgaggctcatacacccccacgatgggattgtgacgcaggatgagttgcagggtggtgctgcttccaacctctctcacgctcacaagggtgacccttgtctcgttttaacggctgatcccaagcctcgtcttcgttggactcaggacttgcatgaacgcttcgttgatgcggtcacgcagcttggtggagctagtaggtgggttgagttgaaattcatcacgcgggagcatgcggtggtggagctgcctgcacttttggatgctttgttgaatgatacaaaaggagggagggatgctttctaa

SEQ ID NO: 53654 - DNA, 213 bp, Glycine max
  Peptide Sequence Number=SeqID_170432
atgtctccaactaatcaaggtggtgaacaagagagttcatgtcaaacgcctgagcaggaagctcctaatgttggggctcttcctcataatgatagacttgggagcaacaccattcgtgtctctgaggcagtaactattgttgttgtggctaaggttgttgctgttaactccttgacaactgtaccaatttgtcaaagtaatattaaacgataa

SEQ ID NO: 53655 - DNA, 867 bp, Glycine max
  Peptide Sequence Number=SeqID_170433
atggagggtatccttgtcactagagatagagagagactaagaaaagttatacgcaaaatcattcaaaagaatttagcggtcaatgaagctacaccaaaagcaatcatgcggactatgaatgtcaagggtttgactctgtttcatttgaagagtcatcttcagctttgcaacaaaagtgaaacctttctttctgcattgcagaaatacaggcttggtaagcaatctgggaaagatgtgggcgaaggatgcaaagatggttcatatcttttagaaagccctggtgctgataacacttctccaaagttgccaactcctgatacaaatgagggttatgaaatcaaggaggcattgagagcacagatggaagtgcaaagtaaattacatttgcaagtggaggcggaaaagcacttgcagattcgccaggatgcagagaggagatacatggcgatgctcgaaagagcttgcaagatgctggctgatcaatttatcagtgctacagttatagacacagacagccaaaagttccaaggaattggaagcaaagcacctagaggtaccttggttgatcctcttggtttttactccttgccatccactgaggtagccggagtgaatgtcccggaagaagaaatactgccaagtctcccaccccaaagggccgattgttcaaccgaaagttgtttaacctcgcatgagagctctggaggattggctttagaaggatctccaggcgagggaaaaaggaggatgctaggcatggactctatggcagcacctttgatctggagtgaagctaagatgagaactcaagccatcaatgtagctcaaggtaatcatcctcaaggaataactaggtatggcatgtag

SEQ ID NO: 53656 - DNA, 222 bp, Glycine max
  Peptide Sequence Number=SeqID_170434
atgacgccacttccggtgaaaatgctcataacttttgctacggttgtccgtttgaggcccactatatatcaaaacgctcagaattcagaggagaatctagataagggaatttggctacggaggttttggatgacgccagatgatgtgaacctgagtaggagtggatcgtttgatacaggctacggaggtttggatgatgccacttccaatgaaggaagataa

SEQ ID NO: 53657 - DNA, 294 bp, Glycine max
  Peptide Sequence Number=SeqID_170435
atgagtgatgatgggactatggaagtaatgacaaaaacaatggtagtggttgccattagggatgaaaatggattaggttgcctttgtcatggcgatagtaatgatgatgacggtagatgtgatgacaatgacaataacaatgataatagtgacgacaataataatagtggtggttgctataacgaaaatgttgatgatggtggtaacactagcgataatgagggtggtaacaatgacgatgatagttgtgacaatgacaatgataatagtggaggtgacaatgatgcatactaa

SEQ ID NO: 53658 - DNA, 1026 bp, Glycine max
  Peptide Sequence Number=SeqID_170436
atgtatcattcaaagaattttcctagtgcaagtttaattggagttaattcattagttcatggtcagcacatagattgtggtggcagcacaatggatcctggcagtggaggaaacagtcttggcaacaactctaatctcgcttcaaaacaacgtttacggtggacacatgaattacatgagcgctttgttgatgctgtggctcaacttggtgggccagatcgtgccacacccaaaggtgtcctcagagttatgggtgtacaaggcttgaccatttaccatgtcaaaagccatttacagaaataccgacttgcaaaatatttacctgactcctcatctgatgaagggaaaaaggctgacaagaaagaaacaggggatatgctttccaatcttgatggttcatctgggatgcagattactgaagcactaaagcttcaaatggaggttcagaagcgactacatgaacaattggaggtgcagagacagctacaattacggatagaggcccagggtaaatacctgaaaaagataatcgaagaacagcagcggctcagtggcgttctttcggagactcctggctctggggttgcagccgttgctccaggggatgcatgccaagaacctgataataagactgacccgtcaacccctgaccctgaaaaggccgccaaagaccgtgctccggcaaaaagtctttcaatagaatctttttcatctcaccttgaaccgatgacaccagattctggctgccatgttggttcccctgctgaaagccctaaaggggagagatcagccaagaagcaacgagtaatcatggatggcgtgtattctaaaccagaaatggtgcttccacatcagatactggagtcaagcatgtcattataccagcaacctaacactgtttttcttggccaagaccaatttgatccttctttgggtatatctaccagaagtggtgaggaattggataagatgacatgtagaaaattggcattggctgtgattgattgtaccaatcatgagacttaa

SEQ ID NO: 53659 - DNA, 546 bp, Glycine max
  Peptide Sequence Number=SeqID_170437
atgattgagcaattcatcaatttcattattcggcctcccagggctgaatatgatccagatcagtacctatgggaaaaggaattctcccttgcaggaagaacataccaaaggcaggatttggaggcaagtatggacatgctttttggatgtagggcagatgccaatgaagctgctgttattcttcttccatcaaatattactgtctttactcttgacttttcggggtcaggcttgtctgatggagaccatgttagccttggttggcatgaaaaagatgatctcaagatggtggtgtcacatttaagaagcaacaaacaagtatctcgtataggactttggggacgatcaatgggtgctgttacaagccttctttatggagctgaagacccttctattgctggaatggtgttggatagtgccttttcaaacttatatgatctgatgatggagcttgctgatgtctataaaattcgacttccaaagttcactgtacactgtctctctttccttcactccctctctgtgtgtgcatatgtaatactttag

SEQ ID NO: 53660 - DNA, 927 bp, Glycine max
  Peptide Sequence Number=SeqID_170438
atggtgtgcggtgctacagttaaccaaagaacgctttcaggaagactccacctttggaggaaatccgatgaaagtgagagggttgcagttgatgcattgattgatatgtgtgattctctttcacctgaggctacaaaacgttgtcatgccaacaacctgcaaccacctgacattacttgttgggatattgatgatggaacttgtgagtggacagatgaggagaaggcagcctttcttcaggctgtatcgtcttttggtaaggattttagaatgattctacggcatgtaggaacaaagtccaaagatcggtgcaagaaaattttcatcaagggtcagaaatcccataggttggatctcatgcgccatagacctgaaaacattggatctctactgaatgaaataaatattggcatgagtacttacactaatgatgcacacattgtggagggagattcagccgctgacaatgataagttaggtacaaaaacaaataatgaccagccttcatctgccgcgaactcgagccatgataaatccaaacctatggaagccaggaatcattcaactaactttaaggaatcagtcattggcaatgataagtcaggcaccaaaacaaacgatgagcagtcttcatctggcacgaacttgagccatgataaatccaaacctgtggaagccaggaatcgatcagctgacttaaatgaatcgaaggaaattaatagagaatttgatcatcaagataaaaccatcatttctaatacaaaaaacggtgagtctaaactggtggacattgatggttgtggagttgtcttgtacaattctgataagtcgagttcagtcaaggacaagagatctacaacaatgtcaaatattgaaattgttttgcataaatttgcccccataaaaaataggtattgctcccaatag

SEQ ID NO: 53661 - DNA, 581 bp, Glycine max
  Peptide Sequence Number=SeqID_170439
atggtagaactccttaggcaaatcaatgatcttgagatgccctttgcttggccattcttgtcaaaaacatccacaactaccttaaccaaagaacgcgttcaggaagactccacctttggaggaaatccgatgaaagctgtatcgtctttcggcgatgattttacgatgatagcacagcatataggaacaaagtccaaagaccagtgcaagaaatttttcatcaagggtcacaaatcccataggttggatctcatccaccacagacttgaaaatattggatctctactaaatgaagtaaatctcagcagcagtactaacactaactatgcccatgtatgggaggcagattcagtcattgacaatgatgagtcaggcacagaaacaaatgatgaccagccttcatcggtcgtgaactcgagctgtgataaatccaaacctatggaagccatgaatctttcagcttactttaaggaatcagttattggcaatgataagtcaggcaccaaaacaaatgatgagcagccttcatctaccatgaactcgagccatgataaatccaaacctgtggaagccaggaatcg

SEQ ID NO: 53662 - DNA, 939 bp, Glycine max
  Peptide Sequence Number=SeqID_170440
atggctgtagaatacatgcggcgggttattgagaagaaggcgaagtttgatatcatggacctgaactgtttgctggttgcaccgaagacattcattcctgttttatttggacatggtaatgatgaccaattcattcagcctcaccactctgatctcatctctgaatcatatgcgggagataaaaatatcataaaatttgatggtgatcacaactcctctcgaccacagttcttttatgattcaatttccattttcttctacaatgtgctccgccctcctcacattcctagagttcgtaagcttgagaaatattttgatttaggggatttgaagattggttctactgtgaatgagagcctattatatgggatactctctagtctacagtctgcaactactgatgctgcaagttcatcttctgctcctcctagcacttcaaattcaatcaaagcatcagttagtgaacttatttcaaaagttgctccagtaaccgccgctgtaggatggctctttccatctgtccaagagtccatgattagagaggaaccaaagcatggcaatgatgaacatggccatgatgagcctgcagatatgaaggatgagaaaaatggcctgactgaagattacttctcatactgtagctcaactagaggaaactggggcagatgttcttctttagtactcagcgatgaagaatcttatccagatttcagggatgatgataatgattctgaggtatttgcaacacccctgggaagtatgagagaaatgtctccagacccaaaagaagagggaaaggatcagaagaagaagaagaaagctgaaagatcctcaaagaagctcaagtctgagagatttgaaaagtgggagtccctcagtcgacggctgcgactttgcattttaaagggatctgcccataggagatcaaagccctcttga

SEQ ID NO: 53663 - DNA, 528 bp, Glycine max
  Peptide Sequence Number=SeqID_170441
atgagggttattatggagatggacgggagtggtatcgatggcgcctcacatattgggaagcgaaatgagttcctcgaaggtttgtgtggcttcgaggaggtggcgactgccaatggggatcttgatgaattcagggtagagcttggtgttcaggaggtgcgtgaccatgttggtgatcttggagacgagataagggtcgagggagtagtgggaggtgagggttttggcggagaggggcttcgctggaacatatgtgttctactgagagggcgtggaaggcggagacagagtagtgagagtgagaaagagggtttggaggaattgagggatggagagggagcaacaaatgaatgcgcctacaaaaaaccgtcatgggtcaaaagcaaaaaagtgccaacaatgtcgttttttgtaaaactgtcgtcattcatctccttttatttacaaatttgtcactgctttttatttttagacggtttccagaaaccgactttaattgcacaccgtaaaatactatttttacagtag

SEQ ID NO: 53664 - DNA, 108 bp, Glycine max
  Peptide Sequence Number=SeqID_170442
atgacaatgcgtggtggtggcacgacaatccacaatggtggcggttggttgcacaatgatggagtgcttgtttgggctaagttcatggaggttgatggtggtgtatga

SEQ ID NO: 53665 - DNA, 1158 bp, Glycine max
  Peptide Sequence Number=SeqID_170443
gactttgtttccattctatgtctgattcagattagtgcaactcttattgcttctatctcctctgacccttgtcagagatcacagagaaaaactaacggcattccattgctggaagatctaatcatctccactggtggcagtgaccagtaccttgctcttttctgtgcagctaacacagtatccaacaaactgcattctggaagtttaagttctaacacttcctcaaaactggccattgagcctgccagtgccagttctgaaactatcaagaagttgaagctgccatcatcagcaagactaggccaaggagaagggaaacaaattgagagtgataagaacaggtccaaaagttggcaccaatttccagaacacattgtgcagtctcttgctcaggagaattcatctggttttgaagataaacatgacttgagctccaagggtgctgcgcgtagtaggagctttcacacattgaaggaatatgatgatatggttaaaaaaatatggttggccgaatccctcacagatcagcaaagtgagtttaatgatgaagaagatgctggttcaggagctaatacaactcatcatactgaggatagggattgtgtcatcaagaagatgcaaccaccatgcttaaacaaaaattattcattggaagaaatagaagaaagaaaagtagtgaaggagaccgacaacttgagtacaacatcagaaatcagcacagtagctacaactccaagtcctaaaagtcacatatctagttcaggtattaagaatgagggagtggttccaagccataaaacaagcacaattgagaagggaattaagagaaaagctgtggcaaagaggctagaatcacttagaatcccaaccggtgtcgaatatccagcaattgctagtcttagagaatggctccctgcaagtggaatatactctcctgaatcctatgtcaccccaaaatttggcagttattctatcatggacattagaaatgcaaatgaatccagtgaggattctgtatttagtccagagttggtgtctgcctttgaacaatgtatgcaaaaacttgaagcagatgaagaaaacattctgaaacaaattgtagagaatgtggaggaagaaagtgaagcaagcagccccaagaaagaacaccatgcatag

SEQ ID NO: 53666 - DNA, 390 bp, Glycine max
  Peptide Sequence Number=SeqID_170444
atgaattggcataatatcataaagtcgtcgcctttgctcaatttgactcagaccttgatgctgcgactcaggcattactcaatagtggtgcaaggcttacagaaactatttcgttgggatattcccattttagttcttgtttctatcgtaggttcgataatagatggacatgtagatatctatatagaagaggcctcgtcgaatgaatccacccaggcacaggcgaggagtcatttgggattcgatggaaatccttttgcctatgtggagggtgttcttaatgaggatagcctcaacatgtggaggggctggtaccctgtcatagagcggttcactagaaagaaagcaaaagatgcggctaagccagcttgctctagttccgtaagataa

SEQ ID NO: 53667 - DNA, 240 bp, Glycine max
  Peptide Sequence Number=SeqID_170445
atggagcttagcaataccataggggccgctctaagacctcttgtcgagtggccttttgctcctacccctgtcgggacagtgcctttcagctcttgtgcctattggggggtagttgcttgtagtttctattctaactttccccatcctgtggcttcaaatggccgattggaagttaggcataaaagaggaagagctggtaggctacccaatagaggtaaagaagcactaacgaggtgctaa

SEQ ID NO: 53668 - DNA, 1083 bp, Glycine max
  Peptide Sequence Number=SeqID_170446
atgactctcattaggggtttgtggcttgtggagctgggcacagatgtcaatctatatgccctggtttttggagaatctgttctgaatgatgcaatggcaatttctttgtacaggacaatgtcatcagtcagagctgatccatctggacaaaatttattcatggtggttgttcgatttttggagacttttgtagggtcaatgtctgcagatttaaaagtcactatttattgtaaaaccttgactaccagaacctgtttaagtatgcaggattggatattgacaaatgaattttatggttccgtccagccttcagaacttggaaagttgtctctttgtccttttcccatatttctcgtatatgcttgccgaaggccttggtctgtctggtattgtgtcaatcctgttcacaggaatagtcatgaaacattatacgtattccaatttatcgcaaagttctcaacgcgatctatgttttcttggtgctcttccttaactcaaccacttcagatattcattggaattgcaagggcaacaaatgttttctcatgtgcttatttggtcaatctggtcagacccactcatcgaaagatacctccaaaacatcagaaggcactttggtatagtggacttagaggagcaatggcttttgcgcttgctctgcaatcaattcatgatcttccagaaggacatggacagaccatctttaccgcaaccactgcaatagttgttttgacggtattgctgattggtggttcaacaggtagcatgctggaagctctagatgttgtaggtggagataatgatagccctttggcttcagttggtaccatcacaaattttgatggaaacaatggttatattgctcctccttacaacgaagaatcatcttcagggaacaaaatcaagatgaagctaaaagaattccacaagactgctgcctcttttactgcattagataaaaactacctgaccccattctttacgagtcaaaatggagatgaagatgatgaagaattgatgaagtggattggtagactaggaagcatggatatgacccagacatggggatataacaaaatttaa

SEQ ID NO: 53669 - DNA, 2331 bp, Glycine max
  Peptide Sequence Number=SeqID_170447
atggacaagtcaagcgctctggagtacatcaaccagatgttccccaacgaggcgtctctctccggcgtggagccgctgatgcagaaaatccagaacgagattcgcaccgtcgatgccggaattctcgccgccgttcgccagcagagcaactcaggaactaaggcgaaggaggatctcgctgctgccacacgtgccgtcgaggaacttatgtataagatccgagagataaaaactaaagctgtgcagagtgaaacaatggttcaagaaatatgccgtgacattaagaaactggactttgccaagaagcatataactaccacaattactgcacttcaccggcttacaatgcttgtctctgctgttgaacaacttcaagtcatggcttcaaaacgtcaatataaagaggcagctgcgcagctggaggcagtgaaccagttatgtagtcactttgaggcctatagggatattccaaagatcgtagaactaagagacaacttaggtactggaaaggagacagaagaaactaatttgctacagcagttgtctgatgcctgcctggttgttgatgcattagagccttctgtaagggaagaattggtaaataatttctgcaatagggagcttacatcgtatgagcaaatttttgaaggagctgaacttgcaaagttggataaaactgaacgaagatatgcatggattaagcgccgaatgagatcaaatgaagaaatttggaaaatctttccttcttcatggcatgtttcttatcgtctctgtatcctattttgcaagaagacaaggaaacaactagaggacattcttggtaatctaaaggaaaagccagatgttgggaccttattattggctttacaaagaactttagagtttgaggatgaattagctgagaaatttgggggaggcactcaaaacagagagattggaaatgagattgaagaaataggtaaagggactaattctagtagtagtgccatggatatccggaagaagtatgaaaaaaagcttgctgcacatcaaggaggtgacagtgaagaaaaagatggaagtaaagatttggcagtgcctggagctgggttcaacttccgtggaattgtttcatcttgctttgaacctcacttaacagtatatgtagaattggaagagaagacactgatggaaagtctggagaaacttgttcaggaagagacatgggatattgaggagggaagtcagagtaatgttttatccagtagcatgcaggttttccaaagagttcttaaagcatatgctacaaagctctttgctagactcccaaaggggggcactggaattgttgctgcagccacaggcatggatggacaaataaagacatctgatagggatgaaagagtgatctgttacattgtaaattcagctgaatattgccacaaaacggctggtgaactggctgaaagtgtttctaaaataattgaccctcaatattcagatggggtggatatgtctgaagtgcaggatgaattctcggccgttataacaaaatcattggtgaccttagtgcatggcctggaaactaaatttgacatggaaatggctgcaatgacacgtgtcccttggggtactcttgagagtgttggtgatcaatcagagtatgttaatgccataaatttgatcctgaccattagcattcctgcacttggaagtcttctttcacctgtctactttcagttctttctggataagcttgcatcatctcttggtccacgcttttattctaacattttcaaatgcaagcaaatatcagaaactggagctcaacagatgctattagatacccaagctgtaaagacgattcttcttgaagttccttcccttggtagacagacatcaggtgctgctagttattccaagtttgtaagccgcgagatgagcaaagccgaggcccttttaaaggttatactttctccagttgattctgtagcagatacttaccgtgcattgctacctgagggtacacccatggaatttcaacgaatcctggagcttaagggtctgaaaaaagctgaccaacaaagcattcttgatgacttcaacaaacatgggcctggaattaagcaaactcagattgcaccttcaattgtgccagcagctgctccagtagctcctgtggtacctagcccctctgctattggactcatagcgtcgcgagaggatgttcttactagggctgctgcacttggacgaggagctgccaccactgggttcaagcggttcctagctctaactgaagccgccaaagacaggaaagatgggcctttcaggaagctctttaatccataa

SEQ ID NO: 53670 - DNA, 588 bp, Glycine max
  Peptide Sequence Number=SeqID_170448
atgatacatgtttgtaaaattggagagaatagaccaatcaaaactttctcagggcatcaggggatatatacaatccgatggagtcctacaggccctggtacaaacagtccctggtacaaacagtcccaatcagcagttagtactagcaagagtaggcatcaagtatttaatccaagttttatgggctggtgggtcaatgcacaaagcttggatgaagattcccgaccgagacatgttttcttccctggcaaaaagagtgctattgatccaaatattctcctccgttatgatgtgttgggaagtagtggtaacaggtcgtcttcaaatttttttttggcaagacgaggtatgttcctaaatttgtctttcaattcgaagataagtcatatattcaattgtgaattggtattgtctgttgcctgggtagagtttgaattcaaagatggaggagaaaaccataaccaagaggcttgggctaaaaaaaaggtcttttacatcggttcttatgacttttctacatcggttttgacgcgtggttgtagacccatgtcgctgaataaacaacatcggtttaaggacccgatgtag

SEQ ID NO: 53671 - DNA, 1500 bp, Glycine max
  Peptide Sequence Number=SeqID_170449
atggtgcaggtccagatcatgccggaacaaaattccgattccgccgctcctccgcctcctcctcctccgccgcacaaccgccggccaagggtccgcgaggtcagctcccggttcatgtccccctccgtgccgcgccgcccgcggtcggagctcgatcccgatgagaattccgaaaccccgttcccaattatttctcagagaaaacaaacacaaacaccacaacaacgttctatgaaaattttcaaagaaaacaacaacaacggacatgaacatgttgcaccgcaccctcacccttcaaagtcatgttctggcagaattggtacaccttgtgtttctaggcctggcactcccacaccctcagtttatgtgtcttcaaggtatagacaaacacaacaacaacaccatcatcaccataacaatcaccatcatcatagatttgttaatggcatggcctctgctgccgagaaattgatgcaagccagtggattgaatcaggctaagtccagtaatgattctggagtgaactgtagtattcagtcactccctgaattgggggagagagagatgttgctgcagtccaatttgtctgtgggtgagaaaattgggagtggcaatggtggtggtggtggtggtggtggggacttgaagtttcaccacccttcgcctttgtcgcggtcggttactttgccttcttccggtggtgagaacaaacctccttcttctgtcgccaagcagcatgggagtggtggaaatcagttgactaagtctggaggggggcttagtttgccgccggtgcctcctcagtgtggaaggccagcagtggatgtgaggaaagggaagaaagggtctagtcaacaggaagatgtgcattctcttagactgttgtataatcgatatttgcaatggagatttgcgaatgcaaaagcgcactccacaatgaaagctcagcaaacagaaatccaggctgcaatcaagaaagcactatattctcaagcaatgagaatatcagaaatgcgtgattctgtgaacaagaaacgcatagagctggagcttttgcagaaatcaaagattctgtcaacaattcttgaacctcaaattccatatctagatgagtggtctacaatgatggaagaatattcagtctctattacggaagtgattcaggctttagtgaatgccacagtgcgacttccagttggtgggaatgttaggcttgatgtaagagagctgggggaggccctgaattcagcatcgaagatgatggaaacaatgatttccaatatacaaagattcatgccaaaggcagaagaaacagacatttccatttcagaattagccagagtagctggtggggaaagagctcttgttggagaatgtggagatttattatcaaagagatacaaatcacagttggaggagtgcagcttaaggggccagctaatccaactgcattcaatttgccacaagaataagaacgaagaacaacaaacaagcaactga

SEQ ID NO: 53672 - DNA, 712 bp, Glycine max
  Peptide Sequence Number=SeqID_170450
ttgcacaggcttggtagacctcttgacattgatgaggtgttcaaggagacaaacattaggaaaaaggacaacacctgggtggataagagatatgagcaaacctataagaaattgcaagaaggctctagtggtgggacacagaccattaacactgaatcaagagttaaattgtgggttgatgttgttggaggcaagtctcagggacttctttatagggctggagacatgtcctcccattataggcttggtgcatacttgattgtggtggaattcatgtcactgcttacatgtcgtatagttggagatcaatgtgaaatgttgaaagaagaaactattgagttttgttcagagtacattgaaaaggtaaaacttgtggggcttcccaagtctcaacatgaggaaagagtgggagaacaagccaaacaggtgtttgtgttcaagatccttgtgatgaaaggtggtaagtggttctacacagaaaaatcattggtgttaatcttgaagatgatgattcaacccttgatacttgttgtcgcaacctacccttcggcgggagggcgacgcggggctcgtgggtgcatcttccaagggaggaaaatgcgcggagttgccaccaacgtttattcgaggaaaacgtcggaaaaaccagaaaggtgtggtctacgaactttaagtgtgaaaggttcgggagttgtatttacgcacggggaag

SEQ ID NO: 53673 - DNA, 486 bp, Glycine max
  Peptide Sequence Number=SeqID_170451
atggttcgaaccttcaacttctcgccatcgatgagcgtgttgaggaagatgcattactccatctcctccatagcacgattctgcctcaacaacgcttggtgcagaacaattggtcgcctcttgatcacgttggatccaacatgtgaaagactcggtttggccaggccattcgtaccaatccaaccgggacctggtggcataattgagtcgtttcgttattggatcgttcatactgggttatgcacattaaatggaaactatggtcagaaccttcaacttctcaccattaacgagcacgttgaggtagatgcatcacttcatctcctccatcgcacggttttgcatcgacaacgcctagagcagaacaaccagctgcctcttgatctcattgggtttgaggtccacctgctctcgttgcagcggcgaaaacgtctacgtgtggcatcgatggacaatgtcgaagcaatagggaaaaggtcattatag

SEQ ID NO: 53674 - DNA, 1650 bp, Glycine max
  Peptide Sequence Number=SeqID_170452
atggacaacgttttctctgttttcccaaacaccaagtaccatcttcacacaacaagatcgtgggacttcataggctttccccagaatgttaatagagcaactacagagagtgacataattgtcggagtacttgacacaggaatttggccggagtctgagagcttcagtgacaggggatttggtcctccaccaagcaaatggaaaggatcatatacaaatggtcatggatcacactgtgcatccacagttgctggaaactcagttaactctgtaagtctatttggcttggcctcagggacatcccgtggaggagttccatctgccagaattgctgtgtacaaaatatgttggaacaaaggttgtcaagtaatcgacatgcttgcagcatttgatgaagctattgatgatggcgttgacatcatttctgcttcactcgagtcacctagtatacagcactttccgtatttcaaatcagtattcgatgtagcaagtttctatgcaatgagaaaaggtatcttaacgtcacaagctgcgggtaattcgggtccgtctctttacaccatgtcatatcatgcaccatggttactttctgtggctgctaccacttttgacagaaagattgttaccaaggtgcagttgggcaatggggttgtttatgagggggtttcgattaacacatttgatcttgagaaaaaattgtatccactgatttacgctggagatgtacctaacattgctggtggacataacagctcaacatccaggtattgcatagaagactctctggatgcagattcagtgaagggaaagattgttttgtgtgaaagaattcatgggactgaaaacgtggggtttttgtctggggcagctggtgttatatttggactgatttaccctcaagatttgcccgaagcatatgccctgcctgagttgctgattactcagtgggatcaaagactcatacattcatacataacttcaatcagcgaagaaataaacgacgggctaatccctttcgtaccttcattctcatcaagaggtccaaatccaataactgtaaatactctaaagcctgatatcactgccccgggagttgaagttatagctgcatggtctccactcaacccactttcaagtgtcaaaggtgacaaaagaactatacagtataatgtaatctctggcacttcaatggcctgtcctcatgttactgcagcagctgtatatataaaatcattttaccccaactggactcctgctatgatcaagtctgcgttgatgaccacagataaagaacttgaagtattcagtcttaatcatagtagttgcaaaggacaagataacaagagagcggtatatgaactaaatctcccatcgtttgctctttttgtaaacggctcagattttactcgtgcttaccctagaacggttacaaatgtgggatcagtaacatctacttataaagccaaagtaattgctccatctttgttaaatattcaagtgaaacccagcactctttccttcacttctatagggcagaaaaagtcattttgcgtcacaattgaagggataactaatgtagaaatagtctctgcttctttgatttgggatgatggcagtcatcaagttagaagtccaattgtagtgtacggg

SEQ ID NO: 53675 - DNA, 340 bp, Glycine max
  Peptide Sequence Number=SeqID_170453
atgacgggagaacgaaatccaactgctaccatatttaagagttatgaaggcaaagattcatttgccccttacattgctccattctcatctagaggtccaaatgtaatcactccagacattcttaagcctgacatagctgctccaggagttgacattctagctgcttggtctccaatttcttctatttctggtgttaatggagatgtgagagtatcaaattacaatattatatctggaacttcaatggcatgccctcatgttactgcagcagccgtctacgtcaaatcatttcatcccaactggtctcctgcaatgattaaatccgcgttaatgacaactg

SEQ ID NO: 53676 - DNA, 141 bp, Glycine max
  Peptide Sequence Number=SeqID_170454
atggcaagaagctatggaatccgaaatggaatcaatgaagatcaacaaagtttcacaagaaaaggattggagcagatgggaagctcaagacctattaagctcgcattgttgccaagggatatcgtcaaaaggaaggtatag

SEQ ID NO: 53677 - DNA, 294 bp, Glycine max
  Peptide Sequence Number=SeqID_170455
atgagttatgcaactgtttgtgtcgaggcaaaccgcgaagaggctatgcttgatagtgagtctactatgggaactgtctttgttgttaagaagtattctaagaaaggaatctgcaagtgtacccactacaatggggataatcgtgtcatggagacatgttttaaactccatggctatccgaattggcatccaaaaggcaaaactacttcaaataccaaggtaaacgctacttccaagagccatatttctactgctgctagatttgtgaccaagtcaagggtagtgagtggataa

SEQ ID NO: 53678 - DNA, 615 bp, Glycine max
  Peptide Sequence Number=SeqID_170456
atgacaatggtcaaagtgatagtaatcgagaaaaacacacttaagagacttagcaatgagtttatctttaccaccaaagacaccaagaggaacaaagtaaaggttttgttgcaagtacaaaatagagtccaaggtttgattgttgaggatgaacgaaggcatgtgactgatcatgtaacatgcagtgagaagtgcatcacccccaacagcgaagagggacattatagtgaaggagaagggtacaagctatttcaactaggtgatgatttttctattctgcaacaccattttgttgtggtgtgtgaccataggaagtttggcggacaacatagtggttatcacactgtagagatgatgaacatcattggagtagagtttattggctttgctccaaacctcataacatgtatcaaatgcttgcttcataggttgaagattgggatcaatagagaaccaaacggcactacacaaagaggtgttcgtttgttgttgatgaactcagtctttatcaagaatgcctgtagccttagtggtcaagtgattgacacgtccttgaccatgaaaccaaagctggacagtggctgcccgggtaatatacttggcaaatctggttga

SEQ ID NO: 53679 - DNA, 384 bp, Glycine max
  Peptide Sequence Number=SeqID_170457
atggacgtgcttgatgagagttcacttgtgcttagtgaaatcagttgttttaagctcgtactatttcctgacaatggtgtcacaccccttgtgatagtcattgacatgctttcactgggtcacgaactattatatgaggacaaaggtaattccaaaaatgtttgttactatgataataattgggcaggattaccatcaggcaaaagatctacctctggctattgtgttcttgttggagctaacttgatttcatgcagaagcaagaagcataatagagttgataggtctagtgctaaagctgaataccatgccatggcaacaactacaagtgaaattacatggctacaacaacttctccaacaactccaattcgaagacaactaa

SEQ ID NO: 53680 - DNA, 120 bp, Glycine max
  Peptide Sequence Number=SeqID_170458
atggcgagtccaatgacgtgcgggggtaccttatggttttactttcgtcatccagagacattcaagcccgatgacgcacaagattcttctctgctagacagggacgatcgagcccgatag

SEQ ID NO: 53681 - DNA, 228 bp, Glycine max
  Peptide Sequence Number=SeqID_170459
atggagaacaatgatggtttgtggtggctaatggtggatatgggtgatggagaaaatcccaacggtcagatcatggaaaagtgttttgtgaagttgcagaccaaatttcgagaagatccaacggttaatgaaggctgggcatcatttttaccgaggcagcttcatgtagctttctctagaagcttcattaagaggcttcctctagaagcttcctcgtggcttctttga

SEQ ID NO: 53682 - DNA, 273 bp, Glycine max
  Peptide Sequence Number=SeqID_170460
atggagtctaccaaaatcttctccacaatggcgtcagagggattgtttcacttgccaacagctattggattcacggttataaaaatagaaaaacaacatattaatcttgtatggaaagaacaaaatagaagaaaatataagttattcgcagaatattccttaaaggttgctttcgttgaggacaaggagcacatggtgttgtctgtactatcgctcgattcctcgcaaatcagagcataccacatagccttatcttccattgtgagacaatga

SEQ ID NO: 53683 - DNA, 330 bp, Glycine max
  Peptide Sequence Number=SeqID_170461
atggagagcttagcttctgcattacatgaagtatctgcagaagctacagaaaccaaagaaaatctactacacatccaacctgaaagtgaaagctatgatgcccagattgaagacttaaagttagtcttaaaagatactaatgaaaaatacaactccatgcttgatgaggctgagtgggagcagagagaggttcaactagtcagctgcataaagaaaaatgaagaagagaagtgtcgcaacctacccttcggcgggagggcgacgcgtgactcgcgggatgcgtgttccacgaaaggaatacgcgcggagtcgccaccaacgtttatttga

SEQ ID NO: 53684 - DNA, 792 bp, Glycine max
  Peptide Sequence Number=SeqID_170462
atgggaacaggtcccaaaacaccgggtagtggtggtggtgctacgcaccagtttccaaaggaacctggccaaggctcttgctctggctatggcataacctttcgatccccaagagaccccagacacaagttctgggaaattactaatgatgcctctctgcgcttgtcttcaaagaggtctgttgatattgtgataagtactccctcacatgcatgttctatgaacaatggggagaagccttactccagagcacaatgccatgataataacaataagaagaagaactatgagagggagagttcttcctcgaagaggcgcattgatgatgtgctaagtactccctctcatgcatgttctatgaacactaggcagaagcttaactctagagaacaatgccatgataataagaagaagaactatgagagggaggattctttgggctggaaaccacttaataaagggaacaaaacttctgaaaggttctattctcaaagcaacaaaaagggtagggacaagaacaagaatatattggaaacgggtttgaaaaatgtgattgaagagacaaggaagaggccaaggctgaattggggtgaaggactcactaagtttgagaaaaagaaaattgagggtgatggtgtaagtgttgttattgctgctactccagcttctggtgcattgaataattccctcacagccggcgtcgttgaaacacacgcgtctttctacatcggttgctcgaccgtcttagaatgtcacggttcaaagatgggtctcatgggatacccatcttag

SEQ ID NO: 53685 - DNA, 1386 bp, Glycine max
  Peptide Sequence Number=SeqID_170463
atggtgctttttactgtccatggactcctctatgttattgcatgggcaatggaaggccaccttgtacaagaattaatacaatggaaagatattggtgttgccaatctcccaggagttatcagccttctagctggtttgttaatgtgggtgacctctcttcccggagtgcggacatggaactttgagttgtttttctacacccaccaattatatgtagtctttgttgtctttttggccttgcatgttggtgactttgttttcactatggctgctgggggaatatttttctttgtgctcgatcgatttctgaggttctgccaatcacgaaggacagttaatgtaatctcatccagatgccttccatgtggcactgtggaattggttctgtcaaaacctcaaagtttgagatacaatgcactaagtttcattttcgttcaagtccgggaactatcatggctgcagtggcatccattcagtgtttcttctagtcctttggatggaaagaatcaccttgctgttctcataaaggttcttggcaaatggacagaaaagttgagacaaaggattactgatgtcgatgcacaaaaagattcatgtgtcataacaacttcagttgaggggccatatgggcatgaagtaccataccacttaatgtatgaaaatcttatattagtggctggtggtattggactctcacccttccttgctatattgagtgacattctccaccgtgttagggaggggaaaccctgtcaaccgagaaatattttacttgtttgggcggaagagggatatagttacaaaccaataaaatcttcattctgtcctatggctagtgattgtggcatgtctgttttggttggtacaggagacaatttttggtctggactatatgtcatctcatctaccgttggctttgtgatattgctggctttgttgtatgtttactacgtaaccccatttcacatagaaacatggtggtacaggggactactatatgtaatctgcatggttgcaagtgttgttatctttggtggttctgtggttgcaatgtggcatatttgggaaaagcaaaattctttgaaggacaagtccaatgatacaaaggttgataagattcatcaaaatggctctttggctaccaaggatcaaagtcaagacagtagtattgcgaagtcaacggtcattcattatggttccaggccaaactttaaagaaatttatgactcgatatcagagaaatggggccttgttgatgtgggtgtcatagtttgtggcccttcaacacttcagacaagtgttgctgaagaaatcaggtcacacagtatgacaagacaacgccatcattccatcttccatttccacagtcacagctttgatctctag

SEQ ID NO: 53686 - DNA, 1332 bp, Glycine max
  Peptide Sequence Number=SeqID_170464
atggaggagtcacaaaagcatctccaaagaaacaaatggttcgacttcgacatggagcttccctcgccattccagttggagcaagcagtgtgcagccacggcctcttcatgatgccgcccaaccactgggacccactctccaaaaccctaattcgcccactccgttcttctccctcctccttcctcgtttcactttcccagcactcccaatccctcgccgttagggttcacgccacccacgccctctctccccaacaacaaaaccacatcacggctcaggtttcgcgaatgctgcgtttctccgaagcggaagagaaggctgtgagggaattcagaagcctgcacgtggttgatcatccaaatagaagcttctctggaagggtgtttcgctctcccacgttgttcgaggacatggtcaaatgcatactcctctgtaattgccagtggccgaggacgttgagcatggctcaggctctttgtgagcttcagttggaactgcaaaatgggtcgccttgtaccattgctgtgtcggggaattcaaaaggtgagagtgagggattcatccccaaaacaccagcttctaaagagaccaggagaaacaaggtttcaacaaagggtatgttttgtaagaagaaattagaattggatggaaatttgcaaattgaccacgtggttgcttcaagttcaaccgcgacaaccttgcttacaacagataatggtgattcggaagagctacgatcacatgattcatgtcatgaattctctaatggaaatgagtattttagtcgtactggaaattttccatccccaagtgagctagcaaaccttgatgagagttttctggcaaagcgatgcggacttgggtatagagcaggttatataatagagctagcgcgagccattgttgaaggcaaaattcaattaggacagcttgaagagctctcgaaagatgcaagcttatccaactataaacagcttgatgatcagctgaagcaaattaggggatatggcccatttactcgtgccaatgttcttatgtgcttgggatattaccatgtcattccaacggattctgaaactgttagacacttaaaacaggttcattccagatatacaacctctaaaacaattgagagagagcttgaagagatttatggaaagtatgagccctatcagttcctagcattctggtctgaggtatgggacttctacgaaacaaggtttgggaagttgaacgaaatgcattcttctgactataaacttataactgcttgtaatatgagaagcactacaaacaagaggaagagaccatcacggaaatgccaatgctag

SEQ ID NO: 53687 - DNA, 1443 bp, Glycine max
  Peptide Sequence Number=SeqID_170465
atggaattacttcattatctagggagtgggaagacatatactatgcaaccattgcctctcaaagcatcccacgatcttttaagattaatgcaccacacataccggaaccaaggtttccaactgtttgttagtttcttcgaaatatatgggggaaaactttttgatcttctcaatgatcgaaaaaaactttgcatgagggaggatgggaaacagcaggtttgcattgttggcttgcaagaatatagagtatctaaagttgagacaatcaaggaatttattgagagaggaaatgccacaagaagtacaggtacaactggagcaaatgaggaatcctctcgatcacatgctatacttcaactttgtattaagagatcagctgatgggactgactcaaagcctgctcgacttgtgggcaaactatcttttatagatctggctggaagtgaacgcggtgcagatactacagataatgacaagcagactaggattgaaggggcagaaataaataaaagcttacttgctctgaaagaatgcattagagctctagataatgaccaagggcatatacctttcagaggaagtaaattgactgaagttctgcgagattcatttgtcggtgattcgcgcactgtaatgatatcatgcatttcacctagctcaggttcatgtgagcatactcttaacacattaagatatgctgacagagttaagagcctgtcaaaagggaacagctctagaagggatcccctttcctcctcaaaccttagagattccactgtgttgcctggctcttcagtcttatctcgtgatgaaaccatggaggatgaaataacttatgtttctagtgacaagaatcgatttggttggcccaaacagctggaaagagaaccctctcctccaaacaatgtagaccgtgttccaagtggtagaatggggggaaatttggcaccatctatgtattctgatccacaaaatggtcaaagaggtagtcaaaatgccagaactgcaaatgaatatgattacctaggactggcatatgaacaagacagaagaagaaaaacaagtaagagggtggataacaaccaattagctgctgtggaggacaataggaagatagaatctcgtgttaaacatgtggatgaatcagattttgaggctaatcattctgatccccatgataatttaaatgccctcctgaaggaagaggaagatcttgtaactgctcaccggagacaggtggaggaaacaataggcattgttagggaggagatgaatttgctcgttgaagctgaccaaccaggaaatcaactggatgattatatttacaagttgaataccattttatcacaaaaggctgcaggaatctttcaattgcagtcacagttggctcaatttcagagacgtttaaatgagtataatgttgtcgtaacttctggtaattga

SEQ ID NO: 53688 - DNA, 2796 bp, Glycine max
  Peptide Sequence Number=SeqID_170466
atgggtgaaagagttatagtattgatactactctttttcactcatttgttgattgtattcacaaagacatcacctcaggattctgctgctctgctggctctagtgaatgaatggcagaacacaccacctaattgggatggtacagatccttgtggtgctggttgggatggaattgagtgtaccaattcacgcattacctccatatcattagcaagcatggatttgtcaggccagcttacttcagatattggatcactatctgaactgctgattttggatctgtcttacaataagaaattaactggaccacttccaaatgacattggaaacttgagaaaactgagaaatttacttgttattaattgtggtttcactggtcctatcccagttacaattggaaatctagaacggcttgtcttcctatctttaaattctaatggtttcactgggccgattccagctgccattggtaatctctcaaatatttattggctagacttagccgaaaatcagcttgaaggacccatccccatatctaatggaactactcctggtcttgatatgatgcaccatacaaagcacttccattttgggaagaataagctttctggaaacattccttctcaactttttagcccagaaatgtctctcatacatgtgctttttgaatccaaccgatttactggcagcattccatctacacttggccttgtcaagactctggaggtggtgcgctttgatgataacgttttaagtggacctgtgcctctgaacatcaacaatcttacaagtgttagggaattagatatgagcaataacagttttgatcaatcagactttccaccgtggttgccaactcttcccgctctgacgacaataatgatggagaatacaaaacttcaaggtcgtattcctgtttctttgttcagcctgcaacagttgcagacagtggtgctgaaaaacaaccagctaaatggcactttagatattggcacctccatcagcaacaacctggatctccttgatttgcagattaatttcattgaagattttgatccacaaattgatgtctctaaagtggagataatacttgtgaataatccaatttgccaagagacaggagttccacaaacttattgctccattacaaaatccaatgactcgtattcaacgccaccagataactgtgtgcctgttccctgcagcttagatcagacattaagccccgagtgcaaatgtgcatacccatatgaaggaactttagttctcagagctccttctttctcagacttggaaaacaagacaatctttgtaactctggagtcttctctgatggagtcttttcaacttcataagaaacctgtggattcaatttctttaagcaatccaaggaagaacatatatcagtaccttgaattgactttaaaaatatttccattaggccaagatcgtttcaatcgaacagggatttctgatataggctttcttctcagcaaccaaacatacaagcctcctccaatgtttggaccttattattttattgctgacgagtatgaaaactatgtggataattcagaaggtcctgtgacatcaaatagaaaatcttcaaatactggcatcatagctggagctggtggtggtggtgctgccctgttggtgttagtactccttgcatgtgtgtacgctatcagccagaagaaaaagaccaaaaaatcaactgggaataacaatccttttgaacaatgggatccgcatgacagcaatagtagcatcccacagttgaaaggagctaggcgcttcagttttgaagagatacagaactgcaccaaaaacttttcacaagtcaataatataggatctggcggttatgggaaggtttatcggggaactcttcccaacggacaactaattgcagtaaagcgagctcaaaaggaatctatgcaaggagggctggagttcaaaactgagattgaacttctatcaagggtccaccataaaaatcttgttagcctggtcggtttctgctttgaccaaggagaacaaatgctgatatatgagtatgttgcaaatggtactttgaaggatactctttcagggaagtctggaattagattggactggattagaaggctaaaaatagcccttggtgctgcgagggggctggattatctgcatgaactagcaaatcctccaatcatacacagggacatcaaatccactaacattttactggatgagcgcttgattgctaaagtatctgattttggtctctccaagcctttgggtgaaggtgcaaaaggttatattaccacacaagtcaaaggaacaatgggctacttggacccagagtattatatgactcaacagttgactgagaaaagtgatgtttatagctttggagtgctattgttggagctgataactgcaagaaggccaatagagcgagggaaatatattgtgaaagtggtaaagggtgctatcgacaagacaaaaggcttctatggtcttgaggaaattcttgatccaaccattgatctggggacagcactgagcggttttgagaagtttgtggacattgcaatgcagtgtgttgaagagtcaagttttgacaggcctacaatgaattatgtggttaaagaaattgaaaacatgttgcagttggctggttcaagcccaattttttcagcatcagcatcagtatccacttcatctagttataataatgcaaccaaaatttccctgcatccttacaacaatgaatactttgattcaagtgtggtacttccacgagcataa

SEQ ID NO: 53689 - DNA, 630 bp, Glycine max
  Peptide Sequence Number=SeqID_170467
atgccgcgatccaattccgctgtgcaccaccaccgtcagagctccgataacttcatgttcgacgctcacggaaggtggttactctcttcgacttacgcgcagacacggcgagagcttattcgtcggcgtgtgtacggaacgaatcgttttatacaggagttcgggactcgatcttcgagcttgaggagaaacgacgatgatcgcgttttagccagtggcttgcttgatctgcattcgttcgataccgagcttttacctgagatgtatggtgttcacaatgaatatttaaccaatcacactgttcggggtcagagttctgatgactacgagtctattctctctggcaacaaacttgtaccaaggtctcggggcttgcctgagagccatcttcttaaaagtgtctcaacagaaaaagagagagcaaagaatgctgccaagatcaaagttgtggttcggaagagaccactaaataagaaagaaatagcaaagaaagaggaagacattatttccatagattcaaattttctcacagtgcatgaaagaaaactcaaggttgacttaacagaatatattgagaaacatgagtttgtttttgatgctgtgctgaatgaagatgtttcaaatgatgaa

SEQ ID NO: 53690 - DNA, 432 bp, Glycine max
  Peptide Sequence Number=SeqID_170468
atgggccgcggtcagcctgcaggtcacgctggcctaaagtctcatttggatgtggactcatatggatgggcccatctatgggctctgtgctattgctcaatctgcggccaaaacgcgaacgcggcttcgtcagtggcgaatctcacattccgagctgccgagtcgaatcgtttgctgagtcacttcaccgagtctgatcttccggcatgttggacagcctcctcggtcgaggattcgccgcgaaatgctattgatatttgtgttatgctttgctttgttttgtgttttgtcgtgtttagcaaatcgttgatcaaattgacgaagaatcggatcgacgtgataaggaggaagaggaaggcgacggagaagtttctgaagaaggacatcgctgatctgctggcgaatggtttggatgaccgtgcttatggaagg

SEQ ID NO: 53691 - DNA, 1326 bp, Glycine max
  Peptide Sequence Number=SeqID_170469
atgggaaatgaagctcatgaccaacaatactcaaaaaaattgcaagcatgtggtcacagccaaaagcacaagttgccgaagtcaattatgctagtcatactcaccaaccttgtcaccatttacatcttcactggtccaatcagttttttgtaccactcttctccgagtcctcgctactcgaactctatctcaaaggaactcaactccaccaaagctcagattgctgccactcactcactcttgtctgaactgcaccatagacttaactcctctaacttacttgtccaggcactgctcattgatctcacgcgccaacaagaaaagcaatccaatggtgctgatcagaatcaaatgagtttgaaggtagggagtgatgacctcagttttgcacttggccctcacaagctcccttttgggtactcaccaaggataggatcagatgagattcacacacctgttggtgcatcatgcatgaggctccatgaagagttaaaccaatatatgtcatatgagattggaggggagtgccctatggatgatgttcttgcacaaaggctcatgctcaaagggtgtgaaccgctccctcgaaggagatgccgccccaagtctcccacaaattatgtggagccgacacctttgcctgagagcctttggactaccccaccagatactagcattgtttgggatgcttatgcttgcaaaagttaccagtgtctcattgacagaaagaataagccaggctcttatgactgcaagaattgctttgatttacaaggtgaagagaagaataagtggatcttcgatgatgggggacttgattttgcaatagaccaagttcttgcaacaaaagcggcggggacgattcgtgttggacttgacattggtggtggaactggaacatttgctgcaaggatgagggaaaggaatgtgatcatcatcacaagcacactgaatttagatggccctttcaacaacctcattgcatcaaggggtttagtgccaatgcatattagtatctctcgaaggtttccattctttgacaacacactggatattgtgcactccatggatgtgttgagtaattggataccagacaccatgcttgagtttgtactatatgatgtatacagggtgttgaggccaggtggtctgttctggctggaccatttcttttgctttgggtcacaactcaacaaaacttacgtgccaatattggatcgaattggattcaatagattgaggtggcatgttgaaaccaaacttaatcgtggggttcacaagaatgtgttgtacatttcagccttaatggagaaaccaatgacttaa

SEQ ID NO: 53692 - DNA, 2846 bp, Glycine max
  Peptide Sequence Number=SeqID_170470
ttttagtcctaaagtctctaagaggttcttggctaagcccaactcccaattgggagggttcagatccttgcaaggactgggaaggcattaagtgcaaaaactcacgtgttatttccatatcattaccagatattggcttgactggccacctttcaggagatattggatcactttctgagttggagattctggatctctcatacaataggggcctcacaggatcacttccacaagaaattggaaacttgaagaagctattaaaattagttctagttggttgtggttttactggtcgtattccagatgaaataggatttctagaacagcttgttttcttatctttaaactccaacaattttgttggaccaattccaccttctattggcaatctgtcaaatcttacttggctagatttagctgacaatcagcttgatggatccatcccagtatctagtggcactacctctggtcttgatatgttgcaaaaaacactgcactttcatcttgggaagaataggctttcaggagaaattcctccaaaactttttagctcgaaaatgactctgatacatgtgattttttacagtaataaactagttggaagcattccagaaacgcttggactagttaagagtctgacgttggtacgctttgaaaataattcattgaatggatatgtgccccagaccctcagcaaccttaccaatgtcacagacctgttgttgtccaacaataagctgcaaggtgccctgccaaaccttactgggatgaactccctaaaatacttggatttgagcaacaatagctttgacaagtcagattttccactgtggctttcaaatctgaagaatttaacaacattacaaatggagagtgtggaccttaacggaaacattccagttaatttatttagccttgcctatttacaaaatgttgtgctaaacaacaacaaccttggtggaaccttggatattggcaccaacaacagaaaacacctgaaacttgttaatttgaagtcaaattcaattcaggacttcgagcaacaaaatgatctcccagagaatatcacgataatacttgagtccaaccccatttgtacagaaacaggagctatggagaggagttactgcaaaaaacacaacatcttagatacagaaccacaaaataaatgtccacctgatagttgcagtcgagatcagattctaagtcccaagtgcatatgtggatatccaattacaggaactttgactttcagagcaccctcatattttgaatggagagacacaacatccctggagaaacatcttttgcaagaatttcaatctcatgatctacctgtggattcagtttctttaatcatttcagatccatttcatagttttgtgtataccatacaaattttcccacgaggccaagatcgtttcgaccgacaagacaaatctacaataagctctattcttggcaacctaagtgctactagtccatatgattttattacaggaaaccaaggtgatggaccgaaggagtcaactaattcatcaagcaaggtcttaattattcgagtagcagttggtggttcttccgttatgcttgttttattagtccttgcaggtgtttatgctttctgccagaagagaagagcagaaagagccatttctcgaagcaatccttttggaaactgggatccaaataaaagcaactgcggcactcctcagttaaaagcagcaaggcagttttcatttaaagaaattaagaaatacacaaacaacttctcacaagacaatgatattggatcagggggttatggaaagtgtgccttgaaggcttctcacgctatactttttttcataatagcgtataagtatgatttagaaacacctggcagaaacacagacgtgctagtttatcggggaactcttcccagtgggcaagtggtagccataaaacgagctcaaagagaatcaaagcagggagggctagaattcaaagctgaaattgaactcctttcaagggtccaccacaagaatctggttagccttgtgggattctgctttgaacgagaagaacaaatgctggtttatgagtttgttccaaatggaactttgaaggatgctctcacaggggaatctggaattgtgttgagctggagtagaagactgaaagtagcccttggtgctgccaggggtttggcttatcttcatgaacatgctgatccccctattatacacagggacatcaaatcaaacaacattttgctgaatgaaaactatactgcaaaagtttctgattttggtctctccaagtctatcttagatgatgaaaaagattacgtctccactcaagttaaaggaacaatgggctacttggatccagattattatactagtcagaagttgactgaaaagagtgatgtctatagttttggagtgctaatactggagctgattactgcaagaaagccaatagaacgagggaaatacattgtgaaagtggtcaggagtacaatagataagacaaaagacttgtatggtcttcacaaaattattgacccggccatctgttcaggatcaacactggagggttttgagaagtttgtggaccttgcaatggagtgtgttgaagattcaggagctgacaggcccgcaatgagtgatgtggttaaagaaattgaagacatgttgcagtctgttggtatgcacctaacatctgaatcagtaacatccacaacatctagtcatagatatcaggaggtaagtatagtgagtttccatctggaccaaccttacagcaatgagtcctttggttcaagtgcagaacatattcaaaaattgaacctagttagttaa

SEQ ID NO: 53693 - DNA, 654 bp, Glycine max
  Peptide Sequence Number=SeqID_170471
atggacaaggttgtggaggaggttgaaaaggtgaagaaggaatgggatgaaacatacaagaaaacgcaagagcacattgaggcaatcgcagactacggcaaatcagcaagagcaaaagaggagaataattctcttgccagattgaatggaatcgctcaggatggcttggctctcctttcttccttcctcttcaccctggatcttctcgctcctcagttgccctctgagccagaggtccaatccactcgtgccttgcttcaatcttccaaaaccctaactcaaaagacaaaagcaggaatgacatccgctgcagagagcatcacggaaagccttcgtcgtactcgtcaattgatggttcaggaggttgaaagaaacacaagcacacttatgactcttggtagggcaccgctcgttgttgatgagaacacgaaatctcctctccacaatgcaacgtcaagatgtcatagacagcgaattggactacttacgttgcaaagaaaggttactgaggccataaaagctggtatggtgggacaggcagagctaaggccccaagctgttgcagatgacgtgaatcttcatcaagtcagaggcaatcgtgttcctaataatgcagaggctcctttagaacaaagaatccatgatgaactatga

SEQ ID NO: 53694 - DNA, 2044 bp, Glycine max
  Peptide Sequence Number=SeqID_170472
tgattctgtggttactgaaaaaacatacgcattcagcatcggtgatggaccatcttcatcatcacaacgtgctggagtgcaatctgcatgggcagggaatacgggccaagtatcaatggccgacattgtcaagatgggtaggccacaggccaggccatccatgcataattcttccatccagagtggtaatcatcagaatgtcttcatgcctccagcagcttcagataacaacttgcattcatcgcaaggttatgcttccaaagtttcagaaacaaatactaatcaaggccatgccattagcgacaatgttccacagaatgatgaatggccttgtattgagaaccaacatgatgttagagtatatgcagatgttgatgcccatgcaaattctgagtgctatgcaaactcgtcaagctttgctgaagctgattggcagcagaaaactcacttggatgaacatggagctgaagatggttccgttgagaatgcagacaatgctgaatctgcttctatatccgctaaaagtacttcagaggataacacaggagctgaagatgatgtttcatcagttgctgcaaacatagagcagctaaatatacagagagatgatcaggggacagcacaagaagatgacaatccttctgtagtaattccaaatcacctacaactccatactccagaatgcatgaatttgagctttggaagttttggatctgcaaaccccctttctggatctgggtcatttacatctaggcctttgaaaagtaacttggaggatacatctggtgcagcggatgcttcaacaattgaaaactcagacactagaaatcctgactattatggggatgagcatcttactactactacctcagatggaaatttagttcaaggaactggtgtgagtgctgggacctatgaacatacttccatttcacaagaggctttaaaacccgaaccccctgaaattgctcaggaaaatcagtattcatttccatcacattctcatggatttaattatgaaaatgcccaacagccggaggtcacatttcctgtttcacagaccagctcacagaatcagaatcttgctcccttctctggtgtaatggcacatacaaattctttgcccagtgctctgttgtcttcaccagttcaaacagcaagagaagatatcccatacttacccttccctgcaacacaatcgatgcctacaaaatatagtgacattgcttcttcaattggtggttccaccataaccatgtcagaggctctaagagctagcggcatttctgcacctcaacctaatgcacaaaccctgtctggtgcaggtgttgccactggacccacacatcctcagcaccttgctatgcatccctactcccaacctagtcttcctctgggacattttgctaacatgattagctatccattcttgcctcagagctatacctatatgccatcagcttttcagcagacttttgctggaaataacacgtatccccaatctctggcagcagtgcttccacagtataaaaataatgtttctgccagcagtttgcctcagtctgctgctattcctcctggatatggctttggcagttcaacaagcattcctggaggaaatttttctttgaatccgcctgctgctcctactgggacaaccattggatatgaggatgttataaactcccagtttaaggacaacaatcatatgatgtcactacagcagaacgagaattctcccatgtgggttcagggccctggctctcgaacaatgtctgcagttcctcccagcaactattataacttgcagggacagaatcaacaacaaccaggtggatttcggcaaaggcatcagcagcagcagcagcagcagcagcagccgcctttacagcattttggaccccttgggtaccctaatttctaccaatctcagactggcatttctctggaacagcagccacaaaatcctcgggaagcatccttgggtggtccgcaaagccaaccatccaagcagtcccaacaaatatggcaaaacagctactaa

SEQ ID NO: 53695 - DNA, 411 bp, Glycine max
  Peptide Sequence Number=SeqID_170473
atggaaacatatatctctgctgagattctccaacaactttctctcctcaactctccatatcacaccctagtcaaaagtaccgtcttggccctcgtaaaaaatgtttggtgtaggtcatgggtccaagaggacctgagggatactatggtcaattggggtgtcatccctaccctagcaatgacccttcttcctgcagctcctgaccttgacgtccagaaaggatgtgcatatacatccttgattggctttcttgcagatgatgataaaccagagcatcggcaactcattgtagatgctggagccttgccttgtcttatagatttgttaaggaggcacaagagcagcaaggtacaaggagcagctgtaatgaccttgagaattcttgcatttaatgatgatgagaataaataa

SEQ ID NO: 53696 - DNA, 1371 bp, Glycine max
  Peptide Sequence Number=SeqID_170474
atgagtgatacagaaggtcaatcacattcctcgggaataacgaagaaactagatagccataaaacttatcatggtagagatcccaataatggaaatgacctttggaaagatggacttatttgtgcttttgaatacattcgaggacaaaacagatcggctaaattgagttcctcctcatcaaagatcacagacggaatgcatggccaacattcaaagatgcatcatgtcccttcggatgataaaaagaagctctcagatccttcatctgtaaatgtctcgagggagagtttgtttggtggctctgatgacgacaaggagagccagacccctaaggctggccaatctaaaaagtatgagggtggtcattgggtaccaattggatgggcaagaatttcagaacttgtccaagcagttcaggttgatgctgagtggtcttctcatcaatttgaatttgagtattctaaagatgattttactgtagcagatttggcagctccctattgggagcatcccactgggcctatatggtggtgccatgcttctgcaggtcaccccacttggctcagcaatgctcaatggctacatcctgctgttagtttagctctgagagacgaaagtagacttataagtgagcggatgaaacatcttttctatgagattgacatcttcatgaatgggaaacacagcatcaagagcttgccacctagcactaggttattccgtaaatctatatttggggcagcagatgagattgaattgaagtttatgaacaggagaaaccatgaagatttgaatcttttcatcctaatcttaaatctagaaattagaaagttatcaacacaggttatcagggttaagtggtcactccatgcaagaaatgagattgtctttgagcttcttcaacatctaaaaggaaatggagcaagaaacctgttagagggaataaaaaagagcacaagagaaatgattgaggagcaagaagctgacagaagccttcgagtaacccataatttagctgtatttggtggcgttggcgttgtcctcaccatcattaccggattatttgggatcaacgttgatgggatacctggggcagaacatactccgtatgcattcggtgttttcacggccatccttgtctttctgggagtagtgctgatcgcagttggcatggtttaccttgggctgaaaaaccctgttgctgagggacaggttgaagttaggaagcttgagctgcaagaattggtgaagatgtttcagcatgaagcagagactcatgctcaagtccggaaaaatatttctcccaaaaacttacctcctactgctggtgatggtttccgcagtgatgcagattatcttgtcatacaatag

SEQ ID NO: 53697 - DNA, 426 bp, Glycine max
  Peptide Sequence Number=SeqID_170475
atgtctagactctgtacagtcgaaccgaaaaataactttggtaaatgcatggaggttgtacgctcgaaactcggcgtctcggtactctcatcgaagcctagattaaatatcacacaactagcaatatcattggcggagtccaacactcaccactccgaccacacgccctcaccttcttcttccgtcgactccccgccagcggcccccgatggcatcgtcatggtgtcgccaccggacacccaggacattttccacacgccgccgaaggtgtccttgctcccctcctccgatgacagcttagaccgttgcgtcgttagtcatgccattaacgtggatgccgagagtcaggtgttcgtcaatttctgcgatggattagagtttgtcgatttggggaaggattcggatttagggttttctgaagtttaa

SEQ ID NO: 53698 - DNA, 354 bp, Glycine max
  Peptide Sequence Number=SeqID_170476
atggcgacgactttggtgagctctgtgggtgggatgcttgcaatgctgaacgagccacatctctcggtgaagcttcacgctctctccaacctcaacaacttggtcgagaccttctggcctcctctggtggattcactcaactatgctgtaagtgcagctaggaataccaagtatgctgaaaaccctcacaaattggcaaatttccttattgtatgcatattccaagggaatccagaaactcaaggactcaaagcaacttcagcgaatatcaacaatgatcagtttggtcacaaatttgaaatttcatgcaaagcaccaatgaaaaaaggtggggaaataaacaaaaacaagtga

SEQ ID NO: 53699 - DNA, 384 bp, Glycine max
  Peptide Sequence Number=SeqID_170477
atgtggataaggaagatgctcaactgggtacttttaaaaagtatttccccagatggggttattttaaaagatattccggcagggggcacttttgcacataaagtgcatgcatggcccaagcaaaccgtcagtgggactggcaggttcgctgttggtgaaggactcgccactgcaaatggcgatatgcacatgcaaggtgaaggactcaccactgggaatggcgacatgcacatgcaaggtgaaggactcaccactttgactggcgagttcccaccacgtaggctcagggctaggcgtcaggccatgcaggacagtgcttcattcttcctgttacgtgatttctcctcttgctattacgtggtttctcctcctcctattacgtag

SEQ ID NO: 53700 - DNA, 2370 bp, Glycine max
  Peptide Sequence Number=SeqID_170478
atggccgaatcactccttttctccgttgcagagtcactgctagggaagcttgcttctcgtgccgttgaaaaagcttctctggccatgggggtgtaccatgatctacaacagatgagagtgactatggcactggtcaaagccttgctgttagatgctgagcaaaagaagcagcagaacaatgcattgagcgagtggctgagacagattaagcgcgtattttcggatgccgaagacatagttgacaactttgagtgtgaagctttgcggaagcatgttgtcaacactcatggtagcgtctcgaggaaggtacgtcgtttgttctcaactagtaatcctcttgtttatcgtttaagaatggcacgtgagataaaaggcatcaagaacaggttagagaaggttgcagctgataggcacatgtttggccttcaaattaatgacatggatactcgtgtcgtgcataggagggaaatgactcattcccatgtaaatgcctcaaatgtcataggaagggaagatgataaaaagaaaataatagagcttttgctgcaagatggtaatgacacgagtccctctgttatttctatcgagggattcggaggcatgggaaagaccacgcttgcaaagttggtgttcaatgacttgatcattgatgaatgtttcccgttgaagatgtgggtgtgtgtctctaatgattttgaacttaggaacgtgcttattaaaatccttaattctactcctaacccgaggaatgaaaacttcaaaaactttgagatggagcaacttcaaaatcgtttgagaaatactcttcatcgtcagaagttcttgcttgtcttggacgacgtatggaacgaaaatcgtgttaaatggaatgagttgaaggatatcatagacataggtgttgaagggagcaaaatcctagtgactactcgtagccacgcaatagctgtcatgatgcgcactaaatcgtctaactattaccgtctagaaggcctttcggaagaacattccttatctctatttctcaaatcggcttttgatgatggagaagagagaaaacatccacaattggtggagattgggaaagaaattctgaaaaaatgtggagggataccgttggcagtaagaacactaggaagttctctagtctcaagggttaatagacaagagtgggagtctctaagagacaatgagatttggaatttaccacaaaatgaacaagacattttgcctgctcttgaattaagttatgatcaactaccttcgtatttaaaacgatgctttgcatgcttctcccttgcccctgaggactttgatatttctagtttttatgttacattactgtgggaggcacttggttttcttccacaaccaaaggaagattttctagacatgggaagtacttgcagatttaaattacatgatttagtgcgtgatcttgcagtgtatgttgcaaaaggtctgagaactataattttccctgtggaagctaccaacgaagctttcttgtatacgttggtgtcgaggtgcaaatacttgagagttttagacttaagttattctaaatacgagagtttgcctcgcagcattggaaagttgaaacacttaagatatcttgatctttcgggtaaccaaaaacttgaggaactccctcattcaatgtacaagctccagaatttgcaaactttagacctcagaggatgcataaagctacatgaattgcccaaaggaataagaaaattaatcagccttcgtcagctgcttgtaaccacaaggcaaccagaatttccagataaagagattgcaaatttgacttctatagaaacattagaactccattcttgcaataatttggagtcattgtttgaagagatacaaatttctactcttagatttttgaatttttctggttgtgggagtctaaagtctttctcgtttcatgccattaaaaatttagagagtttggttatcttcaattgtagtaagttggaattgtcaatgggccttggcaatgaaatccctgcttcaaggttaaagttacttgttcttcaaagtttgtcacaactggtcactttgcctcggtggttgcgaggatctgctagcacattgcattccttgttaattgttggctgtaacaatctcgaagagcttcctgaatggctttctaatttgaattgtctcaaactacttatgattgaacattgtccaaagctgctctcactccctgatagcatgcatcacctcacaaaccttgaacatttagaaattaatgattgccctgaattatgcaaaagatgtcagccaggagttggactagattggcacaaaatatcacatatcaaacaagttatcatcggtgaaccagaagagtag

SEQ ID NO: 53701 - DNA, 1467 bp, Glycine max
  Peptide Sequence Number=SeqID_170479
atgtttggccattgtcattctgaatgttatacaaagctgtcaagcaacaaagaaaatgaagtgatttcaaagtttgttgaagagaatgaggctgaaatgctattgatggctgttcaaaatagtaaggaaccaaaaccagatgtttggtatgtagatacaggctgcagtaatctcatgagtggaatggttggaatcaaagatccttcatggttatggcattttcgttatggccacttgagttttggtgaattaaagactctcaaccagaagaacatggtgacaggacttcctccaattgtagccccttcccaagtgtgtgaggattgtgttgttagcaaacaacattgttctcaatttcctaaaaacaagtcatggagagcaaaagatgctctagagttggaaaaatctaaagcatttattgcattcaagtttcttaaagctcgtgttgaaaatgaggctggaaaaaatatcaagacccttcatacagatcgtggtagtgaatattgctcaaaggtttttgaaaacttttgtgcagagcatggcatacgaagagaactcacaacaacctatacaccgcaacaaaacggtgtatcaaagaggatgaataggaaaattcttaacatggtgaggagcttaatgacacgaggaagggttccaaagaatttttggccagaagccgtaaattggagtgttcatattttgaacagaagtccaacatttgatgttcaaaacatgactcctgaagaaacttggagtgggagaaaactagatgtgaatcacttcaaaaaatttggatgcattgcctttgtccatgttcttgatcagaaaagaaagaaacttgatgataaagctggaaaatgtgtttattgtacaaagaatattgtgaccagcaaggatgttgtttttgatgaagaaaacactagggattggaataggcaacaacctacccaagtatttcttgatgaaaatgacgaaaaaggacaaactttagcctctagtacatttgaaaaaattgctccaatagtcactgaaaattctccaacaaacaatgacaatgaagaagaactatctccccgtattagaaaaaggccagcttggatggatgactttcttgtaactagaattccaaattcaattactcactttgctttgttttcagattgtgatcctacaacttttgaaagtgctgtcaaagaagagaagtggcgaaaaacgatgaatgatgaaattgatgcaattgaaagaaatgatacttgggagttgtgtgatcttcctaaagaacacaaaaccattggtgtaaaatgggtttttaaaacaaagttgaaggaaaatggtgaagttgacaagtacaaggcacgtttggtggcgaagggatacaagcaacaatatgggattgactatacagaagttttttctcaagttgcaagacatgacacgatcagattgatgattgctttagtggcataa

SEQ ID NO: 53702 - DNA, 1011 bp, Glycine max
  Peptide Sequence Number=SeqID_170480
atggcggaggaggggttttggactgagaaggatgtgaagcttactgctgcttggctgcaggatttgttggctgttggctatcagcagccgaggttgatgtcgttggagttgggacgtccgagggcaaatattggtcatggggatcagaaagagtttgttccacaaaagttgccatcggtgcatcttggtgttgaagaaacgggaacagtgaattatgagatttctaatttaatccggtggaggaaaacttttggaaatgttgtgcttatcatgcattgcaatgggccagtggaacgaactgctcttgaatggaggttgctttatgggaggatattcagatctgtagttattttgtccgaaaagaaggatgttgatcttgttgtaggggagggccatttggactatgcatacaggtacctgcccaaaatttttgatcaatttagcagtgcagaaggatttttgttcgttcaggataataccattcttaattactggaacttactacaagcagataaaactaaactttggatcactaataaggtatcggagtcatggtcttctatattaacaaatggtgaggactcagattggttatcacaacaagcaagaatggtacaaaaggttgttagcatgatgccagcccactttcaagtcagttacaaagaaacaagtgacaatgacaagaacctcctaatatgcagttctgagttgttctatgttcctcagcgccttatcagcgattttgttgagcttgttaaccttgtgggggacctagaaatccatcagaaggttgcaattcctatgttctttgtctccctagattctcctcagaattttgaccccgttcttgatagaatgatctacaagcaaaatccccctgcaaattccaccactctttattctgccaaagtccctgctgttcatccattgagtgtatcaagtgagcaagactttataaagcttatcagaataatggcagaaggggatccactcctcatggagttagtttga

SEQ ID NO: 53703 - DNA, 348 bp, Glycine max
  Peptide Sequence Number=SeqID_170481
atggggctagttgagggattgggcatcccaactggaaattctgagccactcttcaacagggggtttatgagtcaatgtgaatggaactcctgcttagaaagcataaccatgggagagccaatagctgcattgcctatgcactctgaccagccaagaaacacacataggaatccattggttagtgcttcagttgttgagaatactgtgagaaggttgatggaaacaaatgaaggtgatgagatgcgagagagagcagttaggcttaaaaacgccatccataggtccatggatgaagatggagtttctcgcatggaaatggattctttcattgctcatatcactaaatag

SEQ ID NO: 53704 - DNA, 153 bp, Glycine max
  Peptide Sequence Number=SeqID_170482
atggcttggaacaacattaggtgtttcaacaccactttcaacaacatgccaatactctttagaccgcaggaaattctccatcaacatgctccaatggtcatagtgatcatcaaagcatggaataacaggctgcacaaagtgctattcagatga

SEQ ID NO: 53705 - DNA, 258 bp, Glycine max
  Peptide Sequence Number=SeqID_170483
atggagtggcgtgtcgaggtgcccgatgtgtctctgacacagacatgtcgatccagcctctattcatcgacatcattgtcacacgatataacctcgctaacatcactactcgaacttgaaccaaacaacatcttcttcgtcacaactcataacctaaacctcattgtcaacaacctcgcactagaccacaccattgttgcatcagaacacgccattagacttgcaccagcattgacaccatcatcgcactcgcactag

SEQ ID NO: 53706 - DNA, 306 bp, Glycine max
  Peptide Sequence Number=SeqID_170484
atgacaagtaaaaggtctatgttccaatccctaagccctatgtctagcggggtggtcactttcggagggaatcaaaaaggtctgataactgatgtagtcaaagcacatagatatgatatgtctaatgaatactgggtcaaagcaatgcaagaagagctagaccagtatcagaagaacgatgtctggaagcttgtagaactcagaacttctaaagaagttcaagatggacaatacaaagtcaatgaagacccctacgcatccaaccattgtacttggattggacaaagtttcaaagcaggtgaatga

SEQ ID NO: 53707 - DNA, 249 bp, Glycine max
  Peptide Sequence Number=SeqID_170485
atgatcaaacaaaaacacttacttcaagaatgcacccttgctaatattgaacttgataagttgaaaaagaaaaactcagatctttggatggaatgccagcattacaaaaagatgccttctgatttgaactataagcatagggaacatatggtctttagggaactacttcttgagattgtaaaactctatgaggagatagaaatcctgagaggtaaacaaggcaaatttgttggtggtcatgaagtgtaa

SEQ ID NO: 53708 - DNA, 507 bp, Glycine max
  Peptide Sequence Number=SeqID_170486
atggctctaatgggcggttttgctagaataaataataatgagattattgttttagtaaatgatgcggaaaaggatagtgacattgatccacaagacgcacagcaaactcttgaaatagcaaaagctaatttgaataaggcggaaggcaagagacaaacaattgaggcaaatctagctcttagacgagctaggacacgagtagaggctatcaataggtggagaggtggactacaatgccatcgtaaggctcatagttgtgttttacgtgctcttgtgtttggtgttgtgtgtcttgtacgaggcattccttatgctccacagagaagaagtggaagcaagaggttcagagagatctcggtttcgtacggttcttataaatcttcgtcttcctcgctcaccgaggacgacgacgacgatgacgacgatggcgattcctcggagaaagacatcaaatcgggcagcgtgtcgtcctctgctgtcacgcgttacgatcagatgaagctcaag

SEQ ID NO: 53709 - DNA, 447 bp, Glycine max
  Peptide Sequence Number=SeqID_170487
atgcaacaagttgagcattctaacatctttgcgtccaaggagtcattgtccaaagcctttgtcgtgaatgatgcttcaaaagaagaatccaatgatgatgactttgatgaagaagatgatgagctatgtctgatcataagaaagataagaaaggtgtgtagaaacaagaacccctccaagttcaatggatcatccaaaagatccttccacaagaaagagaaaaagcacttgaagttggaatgtcctgaccttgaaaacccaaaggataagaacaagaaattcttcaagcccaaaaagaatagtctcatgagcacttgggaggacttagattattactcatctgacgaggatagtgaggaagaagccaacctatgtctgatggctgatgtgtccaccagtaaagcagaatcaacactggacgtgagtttggacaatgaggaatcttag

SEQ ID NO: 53710 - DNA, 453 bp, Glycine max
  Peptide Sequence Number=SeqID_170488
atggcaaggcttgctgaattgaagcttgatgacaaggaaggtatccctcctgaccagcagaggttgatttttgctggtaagcagctggaagatggtcgcactcttgctgattataacatacaaaaggaatcaacacttcacttggtcttgaggctcaggggaggaaccatgattaaagtgaagactctaactggaaaagaaattgaaattgacattgagccaactgatacaatcgaccggatcaaggaacgcgttgaagaaaaagagggaattccacctgtgcagcagagactcatatatgcaggtaaacagcttgctgatgacaaaacagctaaagagtacaacattgagggtggttctgtacttcacttggtgcttgcattgaggggtgagggtaaaggaagattgatgttcgtggaggttttaagtgatttcggaatggaatggtcgtaa

SEQ ID NO: 53711 - DNA, 441 bp, Glycine max
  Peptide Sequence Number=SeqID_170489
attgcgaggaagattcggaccaaggtcgcgtggaccacgtcgtgctccggcgaccggaagccgaacgtcggcgaggcggagaaggtgctgtctccggcttcggtctccggcgaggcctcgtcgtgtttgtcgagcagctcgagcgggatctccagtgagagaagcttgcgctacgctaagagatgcagaggcgcaattgtgagtgtggccggaatcaatcgcgagacggcggcggcggcgaagcgtcgcggcgccggttcgccgcacctgcatcggcgcggcgaagctatactgaagctgctctcttgttgcggtggctcctctgaagtgaagatccgtcaaatgctcggtgacagccctgacactagcaaagctctgcgaatggtggatgctgtgaaaagatcaggctcgggcgggcgttatgatccctatgtttacatg

SEQ ID NO: 53712 - DNA, 336 bp, Glycine max
  Peptide Sequence Number=SeqID_170490
atggttcctactcttgttgacacatttgccttttgctccattggaatgttgagctcaatcaagggtaagagtctcttcatgtctctgtcgatggtcaaagggtgggcgatgagtgtgcctatgacaggaaaatgcaacgaagaagaaacatcatcaaaggtgatggtcatctcttcaactgctttagctcatgtcgtggctgacagatccatacatgtccaattgtgtggtccttataggatcaaagtagtgtcaaatcaattgggtctcctccaaatggcgttccaacgatctagtcagcaaacggtgcctctgccacctcgatgtcatttgtag

SEQ ID NO: 53713 - DNA, 177 bp, Glycine max
  Peptide Sequence Number=SeqID_170491
atgacactattatcaatcaacgtgaggttgccactagcaacattttcaagcagaaagaatttaaccttgagtcattgggtactggtgggtattagtggactgagtgcaaaatttgaagatatatatcaaagagcttttgcctctcgtgttatccctccccatgtgacattgaagtaa

SEQ ID NO: 53714 - DNA, 417 bp, Glycine max
  Peptide Sequence Number=SeqID_170492
atggataaggaaaatccagcatacccaacatgggaatatcaagaccaatcactactagtttggcttcaatcgtctttgtctgaggcgattatgttgaaagttgttggttgtgttcactcacaagctggaaaagttaagagaaagtgttgtagctcttgcactaaatataactcgagagctcaaacaacaaaggcagaggatactgattcaaaatcaacacctcaagttcagcttactcaatgtaacatccttgattttttacttctcgacgactctcacactacaatacttcacactgtgacacttcacttaacagccttgttggtctcggaaaagctatctacggatggttctgacttggggagggttctggccaacgtggagttaagtgaagtttcaccgtgtgaaatgtcgtag

SEQ ID NO: 53715 - DNA, 468 bp, Glycine max
  Peptide Sequence Number=SeqID_170493
atgaggttccaacctcgagctatgagcatgctttccttggcaatggtcaaggttaatggttccatactccttagaggtactcttagccaagatggcctctatgtcttctcaaaccttctacatccttctgttaagtccattgttggaggtgtttttgccgcaattcacatgtcttcattttcaatcttgtcttctaattgtaataatgtcaatactagtaacagactaggtcatcctcgttctgttgtttttgttcccactgaacaaactgcatctcttgtctcaaccaatattgagtctagtcagtttaattcttcactgtccactcctcctcctcaacctcaaaacacacatcccatgcaaactagatcaaagtcagggattgtacaacctcagttacaccctactttgcttctaactactgctaaatctacctctgttaaacatgttctttcttctcctgagtga

SEQ ID NO: 53716 - DNA, 291 bp, Glycine max
  Peptide Sequence Number=SeqID_170494
atgaaatttagccgtatagtggcatctagtttctggtctacgaggtcgcttatgcgtatccacgcttacacttgtcttcacgaaaaccttggagatgaagagatgtcattgtgtttggatgatgagtgttccaacaataaaggtgttgaatctatggacgacttattatcagaagagcaattttatgatgtttttgatgttgttgaaggtggtcttatagatgatatatatgacattcttaatatcaaccttatgacaattagtgatgaagaattaaaaaatcggttataa

SEQ ID NO: 53717 - DNA, 456 bp, Glycine max
  Peptide Sequence Number=SeqID_170495
atggtatctctagaaacctttgaaagttatgtgcaaccaccgagggaaaagcctcgggatcatgctctaggtgactttgaaccataccccatgttcatcgttgagggtccggtgtgtagtggtatgcctcaacccaatgccgcgggggcccctcaacaacgcctgctacaacctctacacttctccgtggggaggttgcctcagaccgtggaaggaagggagaaattggatctcatcgaggagaggctaagggccatcgaagggattggtgattacccgtccgctgacatggcggagttgtgtttggtgcttgaagtcatcatccccccgaagtttaaggtgccatatttcgataagtacaagggggctgcttgccccaagaaccacctaaaaatgtactatcagaagatgggagcgtactctagagacgagaagctcttattgcatttcttctaa

SEQ ID NO: 53718 - DNA, 347 bp, Glycine max
  Peptide Sequence Number=SeqID_170496
ggttacctgcacctttcatcaaccagggggcaaacgagcccgttgacgcgaagagactgacatcgtcttctgcaccttttgccatccagggacagcgagtcaagtggcagagggagataccttacggttattcgcgcctttcgtcaactgaggggaacaagttcgacggtttttactctcgtcgtccagaaacattcaagaacgacgacgcgcgagattcttctctgctgggcaaggacggtcaaatgcaatggcatagggaagtgtcatggttgtccaactttgtctctttcaagacactgaaatttgttgacgcttctgatgccttttcttttctttctgaatga

SEQ ID NO: 53719 - DNA, 813 bp, Glycine max
  Peptide Sequence Number=SeqID_170497
atggcaagcagcgacaatgaattaggaacccaatcggtgggttgcgatgcgaaagatgtagtgaagttttctatcagtgtccccacaacatcgcgcccccacaatggtagatctggatttgggtcgagcgtgccaatgtgcaattgtggtattatggttgagatttgggagtttagtggatcccggtggatgccaatggaaatatcactcttcactctcgagctatattttgctttcttagttcccaacaatatggccaaatccactttctttgtctgccttaacctttcattactcttctctctagtcacagccacttactactcaagtttaaccccaacacttttgggttttcgcgaggagcagttcacccacctccacttcttcttccatgatgtcgtgacaggcccaaagcccagcatggtgtttatcgccgagcccaacgggaaagcgaaggatgcccttccgttcggaaccgttgtggcgatggacgaccctttaaccgtggggcccgaacaggactcgaaacttgtgggcaaggcccaaggaatttacacttcaatatcgcaagaagagatgggactaatgatggtgatgacgatggcattcaccgatggagatttcaacggcagcaccatcagcgtgttggggaggaacatgatcatgagtgaacctgttagggaaatggctattgttggcggcactggggcttttcgttttgcacgtggctacgctcaagccagattttactctgttgatttcaccaaaggagacgctatcgtggaatacgacgtattcgtgaaccattattga

SEQ ID NO: 53720 - DNA, 609 bp, Glycine max
  Peptide Sequence Number=SeqID_170498
atggctaattcaaaaactctctcgtccactttcttcaccttcctaacccttacctttcttttctccttcctagtcactgccaattactaccaaaatatccctccaacatacctaggtttccgtgaggagaagctcacccattttcacttctattttcatgaagttgttacgagccaaaagccttcccttgtcatagccaccgagcccctaaagggtaagtccaattgtccccttccatttgggtccatagtggtgatggaggacccattaacaattgggcccgaacttgactccaaactggtgggaaaggcccaaggattttacatatcttctgcccaaacggagggtttggagttggagttggtcatggggatgaccttggcgttcatagaaggggaatacaatggcagcacactaagtgtgttagggagaaacgccatcttctctcaagttagggaaatgccaattattggtggaacgggtgcttttcgctttgcacgtggctttgttcaagctaggagtgtcaaggttgattaccaaaaaggagatgctaccgtggaatacaacgtatacgtgctccattattcatctcacgaggactttaactag

SEQ ID NO: 53721 - DNA, 957 bp, Glycine max
  Peptide Sequence Number=SeqID_170499
atggacaacaacttacatgggactatttctgatgccctgggaaatttgacttctcttgttgaacttgatttgtcatataatctacttgaaggaaccatttcaacttctttggctaatctctgcaacttaagggagataggtttatcatatctcaaactcaaccaacagggaatcacaacacttgcagttcggagttcacaactttcaggcaatctgatagatcaaattggggcttttaaaaatattgacatgctagatttttccaacaacttaattggtggtgctcttccaagatcatttggaaaactttcatcattaagatatctcaatctgtctattaataaattcagtggaaatccatttgaaagtattggatcactctctaaattgtcatctctgcgtattgatggcaataattttcaaggagttgtcaaggaagatgatcttgcaaatcttacaagcttgaaggagtttcatgcatcagggaacaatttcactttaaaagttggttccaattggcttcctagttttcagcttacctatttggatgtgggatcatggcagttaggtcccagctttccatcgtggattcagtcacaaaaaaaacttaaatatttaggcatgtctaacacagggattattgattctattcctacacagatgtgggaagcacaatctcaggttttgtatttaaaccactctcataatcatatccatggtgagcttgtgactacattaaaaaatccaatatctatcctaactgttgatctaagcacaaatcacttatgtggtaaattaccctatctttcaaatgatgtgtatgggttagacctttcatccaattcattctctgaatccatgcaagattttttatgtaacaatcaggacaagccaatgcaattagaaattctcaatcttgcatcaaataatctgtcaggagaaatacctgattgttga

SEQ ID NO: 53722 - DNA, 315 bp, Glycine max
  Peptide Sequence Number=SeqID_170500
atgggcaatctgaagaagggaaaaatcattgatgatactactagctttgaatgcatttcctgcaactcaagggcaaggtgctatgagtggtatggtgatgagagagttctaccagctgactatttcaatcatttttggcaacatagaggaaacatcaatggcaagaaaaccatcttagcatggggagcagtttgggcatctgtcatttgggcattgtggaagcacagaaatgacattaaattcaatgggggtgagcttgcagtatactttgtagaagggatacttagtggcacattcgtgcatgccaattgttag

SEQ ID NO: 53723 - DNA, 351 bp, Glycine max
  Peptide Sequence Number=SeqID_170501
atggcttcaagattaatacaagattgtttcaacaaacaaagccttgcttcaagattaactcaaagatcaagccttgccttaaaacatagtgctttcaagacatgcaaggctctggaaagagattatttcatgaaaattaagccatttgaaaaacaaacaagtgatagtaacacgacctttgtgattagagatcccatgaaaaagattcatatggttaagaacaagtcacttaaaaaggttcatatggcggaatggagaaggaagaaggatgattggagatgccactacttcaaggagaaaatgagtcaagaagaagctcaccaccataggaagccatggataggagtttga

SEQ ID NO: 53724 - DNA, 648 bp, Glycine max
  Peptide Sequence Number=SeqID_170502
atgggagattttaatgttgtgagaagattggaggagagaatagggaggttgaatggtagtcaacatggtggtagagatattgaagaaatcaatgctttcattgatagcatggaattacttgatgttctattggtaggaagaagtttcacatgggtaagggcggagaaattgaaaatattaaagttagagatcaagaattggagcaaggagaaatttgagggttcaaaggaaaatatgattgtggataacatcaacaacttgggcttgaaagaggaaattgaagggctctccttggaggatagtgattccaatacaaaatactttcacaccatagtaaattggaggaagaggtgtaattttatcaaaggggtgaaggtggatgggaatggggtgaggtttaagactataagcgaggaaaataatagtattcttgtacatgttttctcgaaagaagaaatcaagagcacggtggtaaaagttgacatcgttagggttctcaatgaattatatgctcatggaaaattaccaaagggtactaatgccttattccgtactctcattccaaagaagggcttgagcggcttgatgagggaagtagaggaaaaagagttaatatccaaggtggtcattagtgatggaaatttgaag

SEQ ID NO: 53725 - DNA, 555 bp, Glycine max
  Peptide Sequence Number=SeqID_170503
atgcaatcagaggaactcacactgccttctgaggctaaggttggtccttctgatgctcgtgccagtacaaaagaaagttgtgtcgatccctcggggcaggacccaaaaacgagtgacttagacaaatttgggttgtatgtcgatgacagtcctccctgtctcgttgctcttcgaagagtttatgagggatcgacgattgtccacaatgttcctttgggcaatgatcaactgaaggtcggtgttgaggaagttcgagatgatcatgcttgcgttcctgtactcactcaagaggataagcaagtagctgagggaccaacgaaacatgtgccgtgggatgctaacatgtttggggtgtataatgataacttcccattgtacataaagcatgaagatctttctaaaatagctcacggtggtcaatgtctgagtatctctattatacaattatggattctgcatatgactaagacaattatgcgagcagggaatgtcgatgtgtatggattcctcgagccacaatctatacaaagatttaggaaatcgcaatttgaataa

SEQ ID NO: 53726 - DNA, 972 bp, Glycine max
  Peptide Sequence Number=SeqID_170504
atggctgaatcatcaaagaaacgaaagggatcttcctccacctccactgctactgaccaccgccgccatggaacctccggagacccaccagcaccagcattacgggccaatgcacctctctcgtatccccaccttgttactttttttcttcatcatttcaatgttcctttggttgatgaaccatatgtcaaggttaaaaggtctttctccattgatgtcagtgttgttacttcctttggttatcggaaggatgttgatggtcagtgggttcacaaacaagacttgccaccgcctattcctgatgaatgtaccccatctcctccaccacaaagggatgcttcttcttctctgctgactgaagtcctcacagagctccacgatcttcgagcatttgtgggtgagcattttgatgagatagatactcactttgatgggatgaatactcgtatcactaggctagaagatgatatgagcttcatcagaacctcaaaatcacagagtgcacaaaatgagatgtcatcctcattgagattgggggcaatggcatcatcaacatccttcatgacgagaaggaatgctggtcctatccttgagatcaatcgttgtacaccttacaaacagaaacataacagcaactgtgatggaggaaaacgtgaaggtgagtgttaccttggtggttcggtttctaaggaagagcctacagtagtggagaacaagatctatgttttagataaagagacacaccactttgggatcgttgcattccatgcttgccaaaggcagaagcagaggctgcgcatgaggggggagaagtcaagggaggaagatgacggcgtccccgttggaggccagaacggggccactatcgtcgagcacggcctgaatctccttagctgttggggaaagagggaggagaagcagcatttggcagggtgtgagcgtgagggtgactttgctcacaccgatatctga

SEQ ID NO: 53727 - DNA, 234 bp, Glycine max
  Peptide Sequence Number=SeqID_170505
atggtggctgtgggtgatggagaaagtgcttgggacattagaaatggctttggaagaaagaaaggagaagaaatagcgtttttcctaagctacacgaaagcaaagggtgttacatcacgcaatcactttcaccgccatctgtcgattttgtcgtcattgttcaccagcgttagtgaccatgaagcattgcgtgagcatttgccaaagattgggccctacagaccttgcttatag

SEQ ID NO: 53728 - DNA, 351 bp, Glycine max
  Peptide Sequence Number=SeqID_170506
atgttgtccacctccctgaagagcttacttctcttgccctcctgtcgtgcctctgcattcttgttgtcgtctgccatcccgctcgccatccgccgtacctctatcatccctctgtcatcaccgtggtcagctgcctgggttttttggtggttcgagtttgcttggtttatctgtcgcacatctgggttttttatatgttgcagaaagagctattacgatatacttaaactttctaagggtgcgtcggacgagcagataaagagagcgtataggaagctagcaatgaagtaccatcctgataaaaacccaggcaataaagaggctactaagaaatctcgcagcctcgtttag

SEQ ID NO: 53729 - DNA, 411 bp, Glycine max
  Peptide Sequence Number=SeqID_170507
atggggaactatggctcactcaatgaagtagaatgctctggaagaggggtagtagctgcagttctagcaaatgttggatacaaagttctggtcttggagaaaggaagctattctactaggaacaatgtttcccttctagaaggacctagcatggatcaaatgtacctctccaatggtttggttgctacaaatgacatgtctgtgctaatactagcagcctccacagttggtgatgaagggaacaatcaatgctgttataagtggagagtgtgtagcaatggggatgaaattaggagcgcacacgcaagaaacttacttgttggtggcttacttaacaaggttggaaaagacaatgccaaggctgatattcaactggaaacctgtacgtattcgtcaaggtgcgatctatga

SEQ ID NO: 53730 - DNA, 462 bp, Glycine max
  Peptide Sequence Number=SeqID_170508
atgggttctccacctgcctcccctactcctccttctcctcctcctccttcttcttctccttctcctcctcgtcctcctcctacttcggacgcatcggcctcgacatctgccgtgaagcggacacgcgcaaagcctcacgtctatgatcgttgtggacatcacctacgagaactagaaggaggtccctactgctcagaaggacctgatttgggaggatattcagccgatcaggacggtgtcgaggacactgtctatgacaaatacggcatcagcaaggaaaagtgggcccagttttgccagactcgcagagacccttcttgggaggatgtgcgcatcaaggcacaggccatccagaagcagaatactgtcccccacgttttgtctcgtgggggttatgattatttggagcagaagctcctggctgagaagaccaagaagaagctgcaggaagctgcacagtaa

SEQ ID NO: 53731 - DNA, 465 bp, Glycine max
  Peptide Sequence Number=SeqID_170509
gaagaaccaactgaggatttagctctccataactggaaagcttcctttacaacaaagagaagagaaaaaggaatgattgaagaaatacaagcggtcttcgcacaacaaaatggactctcagtgcgcattaatggatttcggcttagcgcgtactttcctcgctcagcaaatggactcaagcggtacttggcaccctttgttgcacaatacgtgaagttctgtgacatgccggagatcaaaaggaagcattgttacacaatctgtgagattccgatgttcctccagaaggcggttgcttctggaggaagcaacctggctcgcctgggcgagttgggtggcaagctcctcccctattttcctataaatagggggaggagtgaaggagaaaggggttcagccctcctgattttcaaccgttcttcatcgttcatcgttcgttcttcatcgttattcggtcttcaatcg

SEQ ID NO: 53732 - DNA, 336 bp, Glycine max
  Peptide Sequence Number=SeqID_170510
atgccgatctccccctgcgagagtatcgggatcacgcccgcaagacacccagtggacccaaagaagtccaacagggtcttggggtttccagctctgattgcgggcttctgtcagttctacggagtgcccgtcatccctagcaatgtcatcaggcctcctactaaccgagctttcatcaagaagtattgcgcccccaggaaggcagaggacgagacactacaacagcctggggatggccagcaacaggcatcaaatgcatcgccgccacctccagagcccctcagctcatccacaaaaaggttagagtattgcctacgacacatggctgacaaatag

SEQ ID NO: 53733 - DNA, 414 bp, Glycine max
  Peptide Sequence Number=SeqID_170511
atgctgcactccttgctccagagcatccacaaggggaagtccattatcatgcagagccttcaaggcttgggcttgccctccattatgagcatggaggagtttgatgctcaagtggcctatccaggagaccagccctcttcttctagaggagatggagcctctgtagcccacgagcctatgactgaggagcctcgagcattcgctaagcgcgacactcagtggctaagcgcgaggaagaatccagaagaagatgagctgtcaggctcgctgagcgcaccgctccaggtcatcaagcgcactacttcagctcatccgctaagcgagagaagcgcgctaagacaaaattcacttatgcgcgctaagcgattcagatttgcgctaagcgcgcgtgcacaaaccaacccacctatttaa

SEQ ID NO: 53734 - DNA, 3205 bp, Glycine max
  Peptide Sequence Number=SeqID_170512
atgtatttagtggaccctggacaacagataatctccccaagctctgagccggcttgtgggcaaaagaggttatccagtgtcaaaggaatttgtcccatgtcaaaggaggctgcctcatgtttgggtagtagccttgacaagttagtgaggcttgtcaagccccctagcttggacaagtgttgtctgggctgcttttgtcaagttgtccagggtggacatgcatttggttttgcaggccaggccttcctagttggggaccaagcttccccgctcggggatcgtttttggcttcacttcggactcgccatacgaggtcgccgggttgaaaggctcgtggttgaacctttgtattgtatcttcttgatgcttggagcttgtctccttgtcgatggttctccgacttcgacagggatcatggtgtttatgtcatatgtgagtcataaaggagtttcactggtggttgtctggggtgaacaatggcaggcccagagtatactagggagttcctctttccatagacccttatacttgtcgagtctagaagtcttcataagcctcagccttgaattgggtgtcgttgtcggtgacaatggcataagggaggccatatctgcacatgagttgatatcaactagtagatatttgactgctcttggggcctttggtagtggtcctaatatgttcattccccacatggaaaagggacaaggggagctcatattgtggagattgttaggagggggtgtcagccctgagtgttggctagtagtagtcagcgtgcaccactttggtggcaagggagcatcccctggtgtgaagaccacagatcccttcatgaagttctctcatgacgtagtatgcttgttggttattcagtcatttgagcaaggttctggcgtcgagcttcgttctcatttggtggaaatatcccttgaattaggaaattcttgtaggggtgtctatggtgggagtttggagcgtctcctagatgatagtcttgaggtgctcaatatttttggtgctgactatcttagagagcaggtctgctctggtgttgttctccctggtgacattgtcaaggccttcgaggatgattcctgctctgttccccttcacgttggacgtaccaccaacgtagaggctccactagtttggggtgatttagttgtttccagcaaactctgccataaagttttcatgaattgtgtcttcatggggccacagggttcgtactggagatcgaaatctaaaagttctacggaccaaggcaccatcctccttgctagttcaggctttcccaaaacctgtttgatgggcgtcatggagtacgcatttagtgaagtagatgggaagacgggtggtgtggcaatggtgttcttgaaagccaggaaggcttgctcccaggtctcgtcccaaaggaatgactcagttttcctaagcagtttgttgaacaacttcaccttttcgcctattgatgatagacagaggatatgcatccttgggacacgtcctgttcagatcagtatagtcggtgcacattctccatttgttgttggcctttttgaccatgacaacattggcgaaccaggtggaatacttgacttttcggatgaagttggctttaaggagcttgacatcaactatgcgtctgtgctcatgtctggtgaggtccctgttgagctacgtgcactacccgactgtcagggctcaaactggagaccctttgtccatgctgatgacttcagtggtaccattcgctgtggggtgagacttgataggctccctggtcacaaacttcacacatcggcattgagggtgcctttgacaggaggggggatcgacaaaataaaggactctgacactcaagtcgcatatgaccatcgtgtagaggggtttgatggaactagggctgttcttagccttgtagataattcccgacttattgataatagtcgggagcttagagataatcacgttagcgatgcaccgatgctcatgatgagagaggtccttattgagctgcatgcactactccagtttgggtccaagttccaactagacaagctcttcgatggatttcaagcctttgttggaggtgtcgtctcgcggatctatgtcaaattctctgcctatgttggattggctctctgcatagcattggcgtgcttgcttttggtcatccttaacgattacaatctcccctctcttggagagcatgccctaattgaaggtggccatcaagtccatgtagcctttgatctcgactctttcgcctgcaaagtcgaggagtggaattgcgtgatggtggacaatatcgggaccctggacaccatgaaattcactatgatgatggagaaaaccactgtcttcttggttgacggggttgatacccttgaagtccctgtggtcgctcacgccattgtggatgtggtctttgtctgcttcggtcttctgctcttctcttatttgcttcctggttcctatgctactcctcttgatgtccttcgagtctcggtcattacttggttgcgtctgacctcaacctcagaggtttcatctagtgtagccggatgggtacctccagagaggctagcgcttgtctggcttgtgcctcttgtccaacttgtgcaagtcggccttggtgtttgtttcgtgcttgttgtgcttctttcgtctatgcttttgggtgcctttttgcatagactgcctatgaacttgccagggcgtaaggcgaggagcatggaatgcaatgctaccttgggattgagaattcggatctggatgactggccatgcgatgagacctgatggtggcatactgagcactgaatcgtttgatgagggtgtcgaaactgtctatgacctgggtgggagtccaccataccaggaaggcatccagatgctcatctggatcggttgtcccatcgtaccatttgaggttgaatggcttccaccccaaggggacttaggtcgtctgcaatgttgtccgtgcatcaagagtgtgattccccttaggtgcgttcaggcaagtctgatgccagacctagtgctaatcatggatagatgtgagaggattgatgaaaggccatgggtggggtcccaaacttcacacgccagcattgagggtgcctttgacaggaggggggacatgcaaaacgaaggacttcgatgcttaagtgagaatgtgtataaggagattaaagcaa

SEQ ID NO: 53735 - DNA, 358 bp, Glycine max
  Peptide Sequence Number=SeqID_170513
accccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtggtgtccgggaagtcggcaaatggatccgtaacctcgggaaaggattggctctgagggctgggcacgggggtcccagtcccgaagctcgtcggct

SEQ ID NO: 53736 - DNA, 156 bp, Glycine max
  Peptide Sequence Number=SeqID_170514
atggttaagatcctagaatcagtcgcagatgtggtttcagagtctcaagcggtcatcataacacgaaggaaaggaacaaaagagcagcaaaggagaaaggtttggggtgcccaagaaaggactccctccattgaaaacgctgttgagagtgtttga

SEQ ID NO: 53737 - DNA, 117 bp, Glycine max
  Peptide Sequence Number=SeqID_170515
atgggctctcaacctaatgttctgatccagaaagtcactgctatgatgaatagggtaggtgcagtgcaaggattgagttattttgattcttggtcatggggatcaagcattgcttaa

SEQ ID NO: 53738 - DNA, 114 bp, Glycine max
  Peptide Sequence Number=SeqID_170516
atgtttgatgaaagacattatctttcaattggagcaaatatggtagctgcttcaggtgttggagctgcagctgtcgttgctacaaatccgctttgggttgtgaagactagatag

SEQ ID NO: 53739 - DNA, 321 bp, Glycine max
  Peptide Sequence Number=SeqID_170517
atgacagctttgtcaactagatcaaacttgaggaaaagaaatattaggcttaacaacatggacttctcgtccattatgccatcaccaagaagaaacgttagaacacttagttttcttgtgcctgatagcatcaatttgggacatttggttattgcggaacaagtttggtttattaaccaagaggtggatgtagaatctttacgaaactcaattacggtacgtgcttggttttggatatcatgcaaagcaaagctaaatcatctctctttttatgattggagcacaaatctcttggagtgcttaaaccgatctgccaaataa

SEQ ID NO: 53740 - DNA, 441 bp, Glycine max
  Peptide Sequence Number=SeqID_170518
atggagagagagagcgaaaaggcgaaaccgcacttgatcttcgcgtacggcacgttgaagcgaggctttccgaaccactatctgatggaggagttgaggagcaaagacgacgccgttttgcttggcagctacgtgacgaacgagccttatccgctgggcgaggtctatgccgtgtcggaggaggcggtggttgtgctggacgagttcgaaggcgtgagcgcggggtattacgagcggttagcggtgacggcggcggaggaggagggaggggggaaggtggaggcggaggcgtattggggacacaggagattcggtgaagtgttgtggaagatgaagggggaagttgggttgagggagtatggggagaaagaagcaagagagtatgtgaggaaggaggacagaagcggtggcagaaacactattcttgaccttgttccttaa

SEQ ID NO: 53741 - DNA, 590 bp, Glycine max
  Peptide Sequence Number=SeqID_170519
atgcctatgacacgtttgaccggtgatgagagaagagcagtgcgagaattgtctgttgcacacccgctctctatgtatggctggtctctcacatttttcatcatgaaagtagacccgtctgtcccctgcatggtcatcgcacgtgtgctgagaaaaggaaagcaaattggaaggaactcttggcaggcatgggatgcggtgcaaagaaaggataatgagcttaaaggaagcagcaacgtgggaaagaggctcaagtgggaatggggccgaatccagttcttaagggctttatggggaagcaacaacgaactcaagcttcaaagggccaaaaggaatgagtcaagggtggaaagtatgatattagaggacaagttgatggcttgttgtcataccctaatttcgtccggggaccatctgtttggtgggatgcgaccttcgtttgaccgcttcgagtatttccgtgaagaaaatccaagccgaggtgcttccgcaatgcttccgagacgtttccgtgagcgaatccgtgaaggttttccgttgttcttcaccgttcttcatccgttcttcgttcattcttcgttcttcaacgg

SEQ ID NO: 53742 - DNA, 2115 bp, Glycine max
  Peptide Sequence Number=SeqID_170520
atggcatcggaagcaatgctaaagctgaagaccaatctctggaagcaaggcatttttaaggttgacaatgtacaatacaaatgggcaggcttgagcggaaactttctgagcaaaatatgggtgctcctcctagctatgaagaagctgttggtgaatctcgcagccctagatgcggaaacttcagcaccatctgctcctagagactcctctcctcatgtaaatgataatcctagtcaaatctctgctcctacgggatcttttcctgtaaacaataatccaaccgaagcaactactgctgcatctggagcccaggaaactgagacgactgatgacttttttgacccacgtggtccttcatcagctgctcctgccgccccagccaccactaacagcgttgaaatggacttgctcggttccctctcagactcattctcttcaaatgcattatctcttgtaccagctgcatcagcaactgctgcccctgatgcaaattctggatcaacagcttcctttgcagcagcaccatctgggtccaataattttgatcagtcttttgaagatccatttggtgactcgccattcaaggcttttacttccactgaaactgctccatctcaaccccagacatatcagagtattgagccttcccaatcaaatggtcttaatgcagaaacaaactctaactatgggtttggggattcattttctgttgtaccatactctgctcctgtttcctctgacgctcaacctttctctgcaaactctcagtttccgtctcaagatatgtcatcttcacagccagaaacagatattcttgcagacattcttcctcctgcaccattacctgagatgcattcacagcaaaacatttcagcacctgcttttgaccatccttcttcaccttcctttccagcttcatctggtcaaatggcttcacaaccattttctgaaccaacgggccaattcccccagcaaggtttctcagctgcaaccagtcaacccgcacaaacctttccagttcctacagatcaattttctcaacaacacttttctgctcctaatggccaaccaggacaagtacaatcatccttttcatctccctccagtcaatatgcacaacaacccttttcatcccacgctggtcaacctggcttgcatgcattttcatcgcctactggccaacatatgcagtcaccttttgcttctcaaggtggccaacctgcacaatcaggtagtatgtatggtggattgcactcccagggtggatctccaaccatgtctcctcaatcccaaaatggatataatgggcatatgaatagtggaaactttggatcaatggcagcttttccatcacacatggctccccaagctccaacaggacagctgtcacagggcaccaactttccccatcatggaggatctattgctcacactgctccgcatttgtcttctcactctccaactcatcagccatcacagtttaacagccagagctttactggacaacaagggaatgccaccccccatagctcaccaattaccaatcaatcacttgcttcacaatcaaattctttagtttctcaaccatccaaggacaagtttgagacaaaatcaacagtttgggcagatacactaagcaggggattggttaatttgaatatatctggacctaaaacaaatccattagcagatattggggttgactttgaagccattaataggagggaaaagagaatggagaagcccactaccacggctgtaacatcaactgtaactatgggtaaagctatgggatcgggttcaggtatgggtcggtctggtgctggttctctcaggcctcctccaaacccaatgatgggttctggcatgggcatgggcatgggcatgggcatgggcaatggtcctagtgttggtatgggtatgggaggctatggaggcatgaatacatctatgggtatgggaatgggggggatggggggaatgggtatgggacaaggataccataaccagatgcaacccccaactagattgcctcctggctccaacataccaggtagttatggtcaacagccatatggtagttatggtcaacagccatatggcggctaccgatga

SEQ ID NO: 53743 - DNA, 282 bp, Glycine max
  Peptide Sequence Number=SeqID_170521
atggagattgtgaagaagcatgattctggagggctggtttggaagagaatcaagctcaccaccacccgaaaagccaatgctaagaagcgtcttcttcgggtttggcagaatgaagctgtcctcaaagcctgttctgccactcccaacgaacctcaacctacaccagtggctacaccagtgtggaggcttgaacagatgttgaattgttgtgtattgaaagagagaccaccacaagtgaaggtgaagagaccaccacaagggaaggtgaaggtggaggagtga

SEQ ID NO: 53744 - DNA, 2121 bp, Glycine max
  Peptide Sequence Number=SeqID_170522
atgctgcttgactgctggtcaattccgtccgtcatgcttcttacatggcttttcttgaaaacaaaatatagattcaaaaagattaccggtgtagttgtttgcgttgctggccttgtcttggttgtgttttctgacgttcattcaggtgaccgtgcaggtggaagcaatcctcgtaaaggggaccttcttgttattgctggtgctaccttgtatgcaatcagtaatgtcagtgaggaatttcttgtgaaaaatgctgatagagttgagcttatggcaatgttaggtctctctggtggcattatcagtgccattcaaataagcatacttgagcgcaatgaacttaaatctattcattggtcggcagaggcggcgcttccttttgttggatttgcagtggccatgtttatgttttactctttagtccctgttctacttaagatcaatggttctaccatgctaaatttgtctctgttgacctcagacatgtgggctgtcttaattcgcatttttgcttaccatgagaaggttgattggatgtactttgtgtcatttggtgccgttaccattgggctcataatctattcaggaggggacatagatgaggatcagcaccctccaaatgctgccatcgttgatcttggccctgcagtcaaacaagatgaggaagccaattcaggaaatcatagcaaaggaactgcggctggaagctcaaaaacatgggggatagggatagggatagggatggagaaagtgaaggtgcttcggcgactcctcgagacaccaggggttcaccaggggccagcctgtttcgacgctctgggtgcgaagctcatagaatccgctggcttcccctactgcatcaccagtggcttctccatcgccgcttccaggttggctctgcccgacaccggcttcatctcctacggcgaaatgctggagcagggccaactcatcacccaagccgtttccattcccgtcattggcgacgccgacaacggctacggcaatgccatgaacctcaagcgaaccgtcaagggtttcattgccgccggtttcgcaggaatcattctggaagaccagattgcgccgaaagcgtgtgggcacacgcgcgggaggaaagtgataccgagagaggagggcgttatgaagattagagccgccgtggatgcgagaagagagagtgggtctgacattgtgattgtggcgcgcacggatgctcggcaagctgtgtccttggaggaagcgttgacgaggtgcaaggcttatggggatgctggggccgatgttcttttcatagacgcactcgcttcggttcaagaaatgaaagctctctgtcaactttctccccatcttcccaaactcgcaaatatgcttgaaggaggaggcaaaacgcctatacttagtcctcaagaacttgaagacgttggttataaacttgctatttatccaatttccttgattggggtttgcatacgagcaatgcaggatgcactcactgctattaaaggaggcgctgttcctcctccgggaagcatgccatcttttgaagaaatcaaggacatcgtaggatgcatgtttgtggatgccgatgtagacggagtgaatgaggttgaaggtgattttttcgcacacggcggagaggcagagggtggtggcctcttccgatatgaatcagctgccaatatgcttgaaggaggtggcaagacaccgatacttaatcctatggagcttgaagagattggttggggtttctatacgagcaatgcaggtggccgtattcctcctccaggaagcatgtcatcttttgaaaaaattaaggatatcttaggtttcaatgcttactatgaagaagagaagcgctatgctacaagcaccaatcaacagctttccaatagagagagcaatagcctatacagtatacaacggagagatcaagttgataaagagcagacaagtcaaagtttcaaagatccaattgtggaagtaataacacctgatgatgtgtacaataaatatggtgcagatagttcaaggaaccctttttctggtatctggtctcgaactctcagagtaaaaataactggcagagatggatttgagaaactcgatcttaggattccg

SEQ ID NO: 53745 - DNA, 1608 bp, Glycine max
  Peptide Sequence Number=SeqID_170523
atgttccgcaaagagcgtcattgccctcaaagcaccactgaaaggttgaggtgcctcattccaatcccacctgggtaccaaaccccgtttccttggcctaagagtaaggacactgcttggttcagtaacgtgccttttcccaagcttgtggagtataagaagtcacagaattgggttaggttggaaggtgaccactttgtgttccctggaggtggcacttcgtttcctgaaggggtcaaggcttatgttaatgctctaaaacgtcttcttccggtgcctttggaatctggggacgtcagaacagtgcttgatgttggttgtggggttgcaagctttggagcttctctgatggactatggtatcttgacaatgtcactggcgcctagtgatgaacatcaatctcaagtacagtttgccctagaaagaggactcccagcaatattaggtgtactaagcattcacaggctaacattcccttcaagatcatttgatatggttcattgctctagatgccttgtcccatggactgattatgatgggctatacctgagagagattgaccggattttacgtcctggaggattttgggtactgtctgggccacccataaattggagggtaaactacaaagcgtgggaaacagagcctcatgagttaaaaaaggagcaaaataccttagaagaccttgcaatgcaactgtgctgggaaaaagttgctgagagagaccagattgctgtctggcaaaaacacatagatcatatcagctgcatgcaaaagttgaagactaggagatcccccaagttctgtaactcatctgagtctgaccctgatgctggatgtccaatagaaagacttagaacaatactggagaaagttattaagaagggtctcatggtgaataatatttatgatgatttggtctttaagacactagaagatggaaatctgtatattgctaaggtttctcttttcctgaatccattcaagaactttgaatttactactgttttgctaaggtataccaaaatgactgcatgcatttttcctcttccagacgtgaaagatgtacatgaagtatctggtggtgttcttgagaaatggcctatgaggttggaaactgttccaccaagggtcagaaatgaaaatgatgatggcttcactctcaaaacatatattgaagataatcagacatggaaaaggagagtgtccaattatggggtccttcttaaatccctctcttctggaaaatatcgaaatgttatggatatgaatgctggctttggtggatttgccgctgcaatagtgaaatatcctgtttgggttatgaatgttgttccctttgatgtaaaaagcaacaatcttggcattatctacgaacgaggccttataggaacttacatggattggtgtgatattactgatattcttctggagatgcatcgcattcttcgtcccaaaggagctgttatcgttagagatcacggagatgtaattcttaaagtaaaagaaataactgatagaataagatggaaaggaattgtagtggctggtgaccaggatggaccttttcatccagaaatgattatggttataaacaatgacgactaa

SEQ ID NO: 53746 - DNA, 129 bp, Glycine max
  Peptide Sequence Number=SeqID_170524
atggagggtcatcgtgagaaattgaagatgaaccctgttatcagtgatgtggttataaggagaatagttatggtggaagtgagtatgaagatgccaatatggatgttcaagctaactacatgggcatag

SEQ ID NO: 53747 - DNA, 650 bp, Glycine max
  Peptide Sequence Number=SeqID_170525
atgtcccatactaatggattcgggtccacaacgatgggttcaaatgtacgagatcttgtagcacttaccaacgaggccctatcgattagtattatacaaaaaaaatccatcatagacactaatataattagatctgttcttcatagacaaacttgggatttccgatctcagagatttctctatgaaaaatatgaatcggagtttgaagaaggggggggagtcctcgacccacaacagatagaggaggattttttcaatcacatcgtttgggctcctagaatatggagcccttggggctttctattttattgtattgaaaggcccaatgaattgggatttccctattgggccaggtcatttcgggacaagcggatcatttatgatgaagaggatgagcttcaagagaatgattcagagttcttgcagggtggaaccatgcagtaccagacacgagatagatcttccaaagaacagggcttttttcgaataagccaattcatttgggaccccgcggatccactctttttcctattcaaagatcagccttttgtctctgtgttttcacatcgacaattctttacagatgaagagatgtcaagggaacttcttacttcccaaacagatcttcctacatctatatataaacactg

SEQ ID NO: 53748 - DNA, 861 bp, Glycine max
  Peptide Sequence Number=SeqID_170526
atgaatcctaattttaggatgaccgacccctttaatccagtccatataatgtccttttcgggagctagaggaaatgcgtctcaagtacaccaattagtggatactgctgtacgaacatcagatgctggatatcttacacgcagacttgttgaagtggttcaacacattgttgtacgtcgaacggattgtggtaccattcaaggaatttcggtgaatacccagaatggaatgatgccggaaagaatatggatacaaacattaattggtcgtgtattagcagacgatatatacagaggttcacgatgcattgccgttagaaatcaagatattggaattggacttatcaatcgatttaaaacccttcaaacccaaccaatatctatccgaactccctttacctgtaggaatacatcttggatctgtcgattgtgttatggccaaagtcctactcatggtcacttggtggaattaggagaagctgtaggtattattgcgggccaatccattggagaaccgggcactcaactaacattaagaacttttcatactggcggagtcttcactggaggtactgcagaacaggtgcgagcaccttataatggaaaaattcaattcaatgaagatttggttcatcctacacgtacacgtcatgggcatcctgcttttctatgttatatagatttgtatgttactattgaaagtggtgatattatacataatgtgactattccaccaaaaagttttctattagttcaaaacaatcaatatgtaaaatcagaacaagtaattgccgagattcgcgcaggaacatacacttttaatttaaaagaaaaagttcgaaaacatgtctattctgactag

SEQ ID NO: 53749 - DNA, 388 bp, Glycine max
  Peptide Sequence Number=SeqID_170527
atgattatgaggggccaagacatttatagtagccaatatgaggctactacttcaccttcctctagtgaaagtgaagaagcaaaaggggaagaatctagcaaagaactctaccccgaagaaaaaggacaaccattaatggaggagtgtaaagaggtaagtgtctcctccaagaggttagctaagaaggaaagtcattttgcaataaagacaaacattaaagaaacttcccctcttagacaacctccatattttctcctttgtcaaaagacacttgttagcactgccacccctcttaggcttgaggttattcctcaagtaaaggagttgttggatgagtgttttgttcgtaagagcttaaatctttgtgctttgttggtgcccaaaatag

SEQ ID NO: 53750 - DNA, 375 bp, Glycine max
  Peptide Sequence Number=SeqID_170528
atgcgtggtttgaacctaactgaacgtttcaagagcattgaggttcatgctctcaattcttcttcatcagaaacaaatcgtggcaatagcagcaaagcctcagtggctgctgccaccaaacctcacaactaccttgacagaaacaaaaccatgttaccgtcatggtcaaaaaccaaatccagaactaccaacaacaactcaacctcatcagtagcagaccttgcccctagtgttgtctgcgtggttgagttaatgatgactgccagtgtcaaaaatagccaaatcaggaaacctgccttcctagtgtgtgtttgtcagataaggaaagtgatgttttgttctgtgttggaagtgaaaaaatcagttgggacataa

SEQ ID NO: 53751 - DNA, 582 bp, Glycine max
  Peptide Sequence Number=SeqID_170529
gtcttccggaagtgcgcgtcttccggaattcttccggatgaaccacttcttccggaaagttcccggaagaggttttccgggagtcttccggaagaagtgttcttccggaagacgtttggttacttccggaagaacacttcttccagaaactttccggaaaaggttcttccggaacttccggaagaacccctaacgggtcttccggaagactccgtcgtcagccttttgcgccattttttccggcgtcctctcgtcttctcccctctcgtcttctaccctaaggttactatcctaaggttccattgctatgctaacaatgctgcatattacaagcaaagggtagggagggagactaacctgttcgcggagaagaagaagaaaaccttgccttgggcgcgcctcgcggagaagaaggaagttcacgaagaagataagaagaaccaggttcacggaagaggaagagaagacgaagctgttcgaacaaacagtgtcttccgggagcatttccctttgggagattacaacttggtatgttttgggcctcaagcgaacttacaggcttcccctaaggactcagcatag

SEQ ID NO: 53752 - DNA, 846 bp, Glycine max
  Peptide Sequence Number=SeqID_170530
atgattattgttgcttggaatggatctggggatcccagtgcaatatttaatggtgatgtgttcaagaaggcattgagtgtgtttataacagcagcaatattgaagtttgggcaaggtagattctatatcagaacatgtgcagtgctgcagtttgaggaattgattttatgtgttagccaaacaggcactgtgactttgaaatggtccatcgttctctctattcattatgtgttgtcttctgttctagatgtgatcctaagttggaaagcacaacagagtatgtcgctgtatgttaagttaagatacattctaaaagttgtttcagctgcagcatgggtgattgttctctcagttacttatgcgtatacttgggataatcctcctgggtttgctcaaaccattaaaagttggtttggaagtggtggttcaagttctccttcattgtttattctggctgttgttgtttacctgtcaccaaatatgcttgctgcgatattctttctgatcccttttattcgtcgtcatctcgaaaggtcgaactataggattgtaatgctaatgatgtggtggtcacagataaaacctctggtgggacctacgaaagctataatgagtgtaaaaatcacaatcttccagtggcatgaattctttcctcatggtactaggaacaatattggtgttgtaattgcactttgggctccaattattctggtatactttatggatacccaaatttggtatgccatattctcaacattatttggtggtgtttatggggcctttcgtcggcttggggaggtggtggaaaatgctattttgttatacttcacgttcttgtgcctttga

SEQ ID NO: 53753 - DNA, 408 bp, Glycine max
  Peptide Sequence Number=SeqID_170531
atggcttttgaattgtatggtatgcttgcgggtaatgtcagtccgatgacaggagagaatgtgaagccagcgtatggaggtgaagaggaggcttttttaaggaaagtggtcactcctatctataacgtgattgctaaggaagctgcacgtagcaaaaagggaaggtcaaagcattcacaatggagaaactatgacgatttaaatgaatatttctggtctgctgattgttttcgagtaggttggccaatgcgtgctgatgctgatttcttttgcctcccagccgaaaagctggtttttgataaatcaaatccttacccttgcatagaggctgtttccggattcgaacccatgaccaacaagtcaccaaggcacaactttaccgctgcaccagggctcgccctcctttga

SEQ ID NO: 53754 - DNA, 1386 bp, Glycine max
  Peptide Sequence Number=SeqID_170532
atacggacactgggaatgctaaggtctcgttttcaatcattgcctggtgccttcaatgccagtttgattccggaagaaacaaatgagccaaagaaaaaaggattaaaagccactttatcccgcagatttcctgagatctcatctaacaaagggaaggaggctgcaaggtttgcacagttgtggaaccaaataattactagtttcagggatgaagatcttattgatgatagggaaatgaaccttttgcttgtaccttattgggctgatactcagttggaccttatacaatggcccccctttcttcttgctagcaagattccaattgcactggatatggcgaaggacagcaatggaaaggaccgagagctgaagaaaagaattgcggctgataactacatgtcttgtgctgtccgtgagtgctatgcttcatttaagagcattattaagcacttggttcaaggggaacgagagataccggttatagagtacatgttcaatgaagtggataaacatatagaatcagataaactgattagtgaattcaaaatgagtgcacttcctatcctctatggacagtttgttgagttaatccaatatttgttgacaaatgatccgaaagatagggaccgagttgttcttctattccaggacatgctggaggttgtgacaagagatataatgatggaggatcaggatcaaatattcagtttggtagattcaagccatggtggtactggacatgaggggatgcttcaccttgagcctgagccacatcaccaactttttgcatctgaaggagctatcaagtttccaattgaaccacttacagcagcttggacagagaagattaaacgacttcacttgctgcttacgacaaaagaatctgccatggatgtaccatccaacttggaagcaaggagacgtatttctttcttctcaaattcgttgtttatggacatgcctatggcaccaaaagttcgcaacatgctttcattctcaattttattttctagtattgaagtgtgtggtttgggtctaattcaaccccagaagctagctcataggctaagggttttgacaccatactatacagaagaagttctattctccttgaatgatttggattcacagaatgaggatggggtttcaatactgttctacttgcaaaagatttttccagatgagtggaacaattttcttgaacgagtgaattctactgaggaggatattaaagggagtgaatctgatgagttagtagaagaacttcgtctttgggcatcatataaggggcaaacattgaccagaactggttatttctctttcactccaccccccccaaaaaaaattaaaaaatatgcacacatgatttcaagtgctaactgttaa

SEQ ID NO: 53755 - DNA, 3156 bp, Glycine max
  Peptide Sequence Number=SeqID_170533
atggcttcatctttagaggagcttcttgcaaaggaggggttcaaaggaatcagaagagtgacaaggtctagatcctccttccactatggcgcttcaagtgagcctcttcactctttggatgggagattttctgtatcaagtgaaagaattcgaactcagagaacaaagtctgatgcctcacgatatcagatttcaagtggacagttaaaaactgacaacgatactgctatgaaccggaggtcaagggataatctttttttgagagacaaaatggatcaacggttgaagaactcttctatcgatacagattcaggcagaggagttgataccaattcatcagaatacatgccaaggaatgagattactgaggtgactgagcaagaagctaacatagtcaaagataattgttcaacagaagtttcttcgaaaagaggcaaagagaagaatttcaatgaacttgtggaggaggaaaatcctgtcaaggatgcaaaggcacgcagcagaagttccagtatacatatgcttggacactctagtgaaactagaaacaatataaaaccccagaaggactcatacactagatcaaatagcagcaggaataaagatagcaatcatgctattcaagctgcttctagtcttgctcttgatgaagttgctgtccaagcagtagtttcaattctaaatggctatataaagagttttccaaaagatgcggatttccggtcaacattgcgtcacaaatgtttctcctccttgaattttattgaactggaagaagagaacattacggggaccaaagtcataagaagtcttgagcaagcaatcgaggccattgaacaaactgctgaggagcctatatctaccatgtatctgaaaagaaccatgatgcagcttagcattattacaggtttgagtttaaatgatttgaagtacgagtgtacgtgtgggattccaaattttaagttgtcagcctgtgctcatctttacctcagtgtggtatacatgatgcagaaaaaaaataaggtgtcagcgaagcatctcttgcaagtgttttgtgattcaccttttcaggcacggacagtattgttgcctgaactgtgggagcatctattttcttcacaattttctcatttgaaggcatggtacagcaagcaggcagaatttctagtagatgcaccaagcaaaacaagaaagctaaaacttcttcaaaaagtgtataatgaacatttggattctggaactcatatatttgctgtatactacaaagattggctcactgaaggagtagaatctccgccaactccttcaattggcattccatcagcttctgtaatgggcagtcaagagggaagttcacttggttattcttttgagtctgctagctccattgacccactctcaccacagccaatggtcagcaagaaactgtatgattctatgtttggtagcttgagcaaacccagagtttaccaagtcaaagatattaaggatgatgataacatagacaactgcatgaaagactcttatggttcaactattgttagacagacattaacatatgagtctgaaactgttaaatttacagatcaagatattgaaaatttctctcaaggtgtagcaattgatacaatcaagcctcagaaaggaaattcaatgacagcttcagaagaatggcagaaaaggaatctcagcaatgacattaataactctttctctatggaaactaatttaaacagccacagtattgatgctctatcacatgaaaaagcgagtgaacctgttcttataaagccaaataagacatgttcttctcttgaaggaccatattttccaagtattcctcatgaatttatttgtcctcttactggaaatctctttgaggaaccagtcaccctagagactggtcagacctttgaaagagaagccatcaaagcatggtttgaaaagggaaatagaacatgcccagtaacaggaaatactttggaatgtgtgaccatgccatttaccaaccttattttgaagcgtttgattgatacttggaagtcagaactttttgattaccttattgatcttccttctcaaacagtggagaatccggaggagcttaagttgaaaaagagggatgaggctgctgttttcaagaggtttgaacagggaaatgtggaagaaaaatcacatgtgatgtcactcttgctaaactgtattcaagtggactctggttgcatatatcagatagcaacaagtgttaacaaaaaatgtcttcttgagcttcttcacagtaagaaggctaccccgacaacaaatgcaatactattccttactgaaattttatcaatgaagagggaaaacagtttgctgcaatctgaaatgttagatgttggttgggacattaactggggaaatgggcatcgggttgagcctcaaaagtttagcatatacagagaggtggctgtgaatgctattgcagaggcacttgatgccagcttaaatgatgagaagggcagagaaaagtgttgcagagcactagtaatcttgtgtagccatttttcttctactggaaagataccaaccaagactagcatcttaaaacaagcaggttataataatgatagcttagaagttaaacctcctggccatgaagaagagggtcaacggttatatgtagccatttcatcggaaggtgaagaaaaaaggggtgaagagttgctaaagaagttgttagagtcattgattggtgatggagaaagcccgtttttgaagaacatatctagatgtttagattctaagcacttagatttggtgagagcgtgtctaataactgtgacatggttgagctcctcactgtctatgctatttagtgctggattgcatcttcccgccttcttatccatcatctctcagttgaaaggaatcctggaaaatggagaacttgagctcaagactcttgcttctctgtctttgcttaatttcagtaaaatatcaggttcaccatcttctgcacttctgttttttgatgctaaaaatcttgccatttttgagtgcaaaacgcttttgaagactatggcagaagatattggtccccttcttcatgaacttgatgatgtaacatggactgcaaaacagcttcatgccattgtgtcgagggagaatctgtag

SEQ ID NO: 53756 - DNA, 1779 bp, Glycine max
  Peptide Sequence Number=SeqID_170534
atggaaccaggaatttgcaattctgtcaactccgtaaatgttgaagcaaccgagaaaaaggtgacaggaggaaatggaagctacacagagcagtcagacacaagctataagaagattaaaggaggttggaaaactgcaattatcttgttagcgaatcaagcactggctacactagctttctttggagttggagtgaacttggttctgtttctgacccgagtccttcgccaagacagtgctgaggctgctaacaatgtcagcaagtggaccggaactgtttacatattttcactcattggagccttcctcagtgattcttactggggacgatatttaacctgcgcaatctttcagttcatttttgttgtgggcttggggatgttgtcattgtcgtcttggcggtttttgatcaaaccggttggttgcggcaatgaagaaactacatgcttggaaccatcatcagtgggtgttggcattttctacttgtccatatatctagtggcatttggatatggagggcaccaacccaccttagcaacctttggtgcagatcaatttgacgagaagaacgaaaaacaaaagaacgcgagagaagctttcttctcttatttttactttgccctcaatgttggatctctgttctccaacactatattagtatactacgaggattcaggaatgtggacaatgggtttcttggtgtccttggcctcagctgttattgccttagtttcatacttagcaggatatcgaaaatatagatatgtaaagggatatgggaatccggtgataagggtagttcaggtgtttgtggccactgttagaaagtggaaggttggtccagccaaggaacaccaactttatgaggttgatggtccagaatctgccataaaagggagtagaaagattcatcacagcaatgattttagattcatggacaaggcagcaacaataacggagaaagatgcagttaatctcaagaatcactggcggctatgtactgtaactcaagttgaggaagccaaatgcgtactgagaatgctaccagtttggctatgtactataatttattcagttgtgtttacgcaaatggcttctctttttgtcgagcaaggggatgtgatgaacaacaagataggaaattttcacttgccagcagccagcatgtcagtgtttgatatctgcagtgtccttttatgcactggaatttatcgccaaatccttgttcctctagcaggaagatttagtggcaatcctaggggactaactgagcttcaaagaatgggagttggcctaattattggaatgttagctattcttgcagctggtgccacagagtttgaaaggctcaaacacattacacccggggaaaaggctagttctttgagtatattttggcaaatcccacagtatgttctagttggtgcttcagaagttttcatgtatgtgggtcaactggagttctttaatgggcaagccccagatggcataaaaagctttgggagctcactttgcatggcttcaatttctcttggaaactatgtgagtagcttgctggtgtacatggtgatgggaatcactgcaagaggcgagaatccgggatggattcccaataacttgaatgtggggcacatggataggtttttcttcctcgttgcagtgctaactgctcttgattttgtactctacttattatgtgctcgctggtacaagagcatcaaccttggagatggtgacatgggaagccaagaggacgaggaagtgatcagtaaagtttga

SEQ ID NO: 53757 - DNA, 1041 bp, Glycine max
  Peptide Sequence Number=SeqID_170535
ctcgtcgagccagcggccgacgctatcgaaggtggtgcggcgggagatgtcgtagacaatgagggcgccgacagcgccgcggtagtaggcggaggtgacggcgcggaatcgctcttggccggcggtgtcccaaatctgagccttgacttccttggagtcgatttccaagcactgagtctggaactcgacacctatggtggccttggagtgcatgttgaactcgttccgggcgtagcgggagagaaggttggatttgcccaccgcagagtctccgattatgacgatcttgaagaggtagaggcgcaattcaacaaggagctgacatgtggcattgagttgttgtgccaacagctatgcgtaatgggttgctacagttgcagtgacacaaccacttttggtcagcatagagtaggcacagggtgcagggcgcagatgctgcatagggcacactggcgtaagtacccacgtgaggatgttgcgccaacccccctgcgcaatactccttactcctttgtctctttcttcgcttataaattgaaaaatacatgttgttccctcacgcataacacccccccccccttccagcaacttccttcttcctctgtatttgatatgacaagttcatcatcatcctcatccagttttgatgtggtatgtggaccacgtgaaaatgatgtgttgtggatgcaaaagcaacatgtgtcccaacatatttggaacgaggatgcagatagaaaattaagaatgaggcgagcgattccaacttatcagggtatagaacaaccaccgacagaaattattcctctattacaacaatctggattatacacaacaataaaattgcgtagaatcaaaatcaatggaggaattgtaaatgtctttgttgaaaggtggaggccagagacacacacctttcatttgacgtgtggggaggccaccatcacactacaagatgtgtctgtgttgctaggtcttcctgtggatgacaatcctttaattggcagcacaaatattgatgagattgatatgtgtgaacaataa

SEQ ID NO: 53758 - DNA, 189 bp, Glycine max
  Peptide Sequence Number=SeqID_170536
atgacttgcgaaacaaagagtggaacgagcaacaatttgaaggttgtacattcaggaactaaagaattcaaaatagctagtaataagagggatttgtttttgggattttctgagcaccaagagcggctacgcaagaagcttgcacttgaggagggaaggatatttgcagctaatgaacaactttcttaa

SEQ ID NO: 53759 - DNA, 397 bp, Glycine max
  Peptide Sequence Number=SeqID_170537
atgacgtttcgtgtgttgctgttactggtggtgttgttgtttgtgattggcgcgggcgccgacgatgccaaacgcgacgacgacagggctcccaagtcggaatcctgcaataaccccttccaattggtgaaggtggagagctgggtggacggtgaggaagggcatgtccacaatggcgtcagtgccagatttgggtctgtgttgccggacaaacctgacaagagtgtcagaactcccgcaatattcgctaatcccatagactgctgttccaattcaacttcaaagttatctggctcagttgctctctgtgtccgtgggggctgtgacttcactgttaaagcttattttgctcaatctggagctgctactgccatcttggtcattaacgactcacaag

SEQ ID NO: 53760 - DNA, 436 bp, Glycine max
  Peptide Sequence Number=SeqID_170538
atgagagaaaaggaaagaaagcctcaagaggctaacattaacctccgatacttccatgggaaggacaacatagaggctaacttagattgggaaataagggtagagcaaaaaattaaaagaaagtctactttaaaatcttatggctctcactcttatccaaagaaagaccaaggtctaggcatcttaggggctgcaccttctaagcctaaagatgataaggcgaagacaatagaaaagcaaccccctaaggctagtatgcaagagaagactatctctataaagtgctttaaatgtcttggaagaggacacattacttctcaatgccccagcaagaaaaccatgattttgaggggcccagacatttatagtagccaagatgaggctactacttcaccttcttctagtgaacgtgaagacgcaaaatgggacgaatcta

SEQ ID NO: 53761 - DNA, 240 bp, Glycine max
  Peptide Sequence Number=SeqID_170539
atggcaaagggcgcagaattcgtctatgcgcgtttatcactcattgagcgtgcggataaccgcatgtcatcgggcccaccgcctctggatgacaaaaggtgcagaagacgacatagcaaaaaggtgtggacggataaccacttgggtatctccgcatgtcacatgacccaaggtcaatatgacagagattgtggggcggccaacaaaagcgaggctcttgctccaacgtatcctcaatga

SEQ ID NO: 53762 - DNA, 117 bp, Glycine max
  Peptide Sequence Number=SeqID_170540
atggggagagttaacctagggttgaatgtgagaatggtagtgatgacttgtgggaaagcttgggctgagcaaatgaggaaaacgagtgaccaaagtgaaagcaagagccatttctag

SEQ ID NO: 53763 - DNA, 1251 bp, Glycine max
  Peptide Sequence Number=SeqID_170541
atggtttgctccaatagcagtgaagcaaatatttcaattccagtagtcatgatagcaaagtcagcaggacaatctctcaacaagtctttcacatctggaagcaaagtggaaattttgttatatgctccgcctcggccacttgtggacttctcagttgcatttttgtggttgatgtctgttggaactattgtatgtgcttcactatggtccgatctgactaccccagagaagtctgatgaacgctataacaaattgtgccccaaggaatcttctaatgctgaaacagaaaaagatgatttggacaaggaaattgttaacattgattcaaagggtgctgtcatatttgtcatagcagcgtctacctttcttgtgctattgttcttcttcatgtcaacttggtttgtctgggtgctgattgtacttttctgcattggtggtattgagggtatgcacaattgtattgtaagcctcactttaaggtacaaccgatgtctctttgttttctggcctgagaatgtgctcggtgttctttctgcatgccacagaaaatgccaaaattgtggtcagaagacagtgagcttacctctatttggggagatttctattttctccctggcagtattgttattctgtgtggcatttgcaattttctgggctgctactcgacaggaatcatattcatggactggccaagatatccttggcatctgtttgatgataacagtcttgcagttggctcgattacctaatattaaggttgcaactgtactcctttgttgtgcttttgtctatgacattttttgggtattcatatctccagtgattttccatgagagtgttatgattgcagttgctcgaggtgacaaggctggtggggaagcaattcctatgcttttgagatttcctcgtctttttgatccctggggaggttatgacatgattggatttggagatattctgtttcctggtttgcttatttcctttgctcatagattcgacaaagataatggaaggggagcatcaaatggatattttctttggttggtagttggctatggcatcggcctcgttttgacatatttgggactatacctgatgaacggaaatggacaacctgcacttctctaccttgttccatgtacactaggtgtcacagtcatactgggatgtataagaggtgagttggagagcctttggaattatggcacagactcatcgttgtccacagagccccctggctctgaagtttaa

SEQ ID NO: 53764 - DNA, 251 bp, Glycine max
  Peptide Sequence Number=SeqID_170542
gtattattaggcaccgaatccctatgataggtggtatgatgaatgtgttgagtcgtgcaaccctcttttgtaaaatcacccatgcatccaacatcttaatgattcacacacatagggactcattagatcaaggggttctcacgggccctaagagatggaatgatgcaatactacccccccaagggcattggctagaagactccaagaagattgggtcggagatgcaagagaagatcatagggttctcatga

SEQ ID NO: 53765 - DNA, 519 bp, Glycine max
  Peptide Sequence Number=SeqID_170543
atggatgatgttgatgagatgaagagtactaagaagggaaaagggaataagaaaggtggtgggctgataaccaaaacatgggagcgatgcaagtccataggaagaagccgcaaggaggcaagttctaattccctcaatactaatactaataccatgagaagcaaatcatggccaaaccgtaaccgggcggaaaacaagaacaagaacaaaaacagtactatcgtggcccccgaaggttgcttctcggtgtatgttggaccccaaatgcaaaggtttgtcatcaaaaccgagtacgcaaaccaccccttgttcaagatgttgctcgaagaagctgaatctgagtatggttacaacagccaaggccctttggcccttccctgccacgttgatgtcttctacaaggtcttgatggaaatggattctgatgaaactcatggcagctgtgcctgtgttaagcgttctccctctgcttatcaacttcttcgcacttcccctatgctttcaataaaccacttctga

SEQ ID NO: 53766 - DNA, 444 bp, Glycine max
  Peptide Sequence Number=SeqID_170544
atggatatggagggtgtagcagacaagttacggtcgagaagtaatagtaatggaggttccaaaagggactgcctcctcccggcgtccaaattgctgctcaaaacatttactttccgtgaacttgccgctgcaactaaaaacttcaggccagagtccttagtaggggaaggtggtttcggaagggtctacaaaggcaggcttgaaaccactgctcggggattgaaatgcttaacctttcacaccactaaactaaagtgctgtcaactctctttttcaatcaaaaggttctcatgctcagtcttctacatcaccctaaccttgtcaatctcattggatactgtgccgatggggatcaacgcctccttgtttatgaatttatatgcctttgggacccttggaagatcaccttcatgttatgcttcttccaatgctttgcctatctaa

SEQ ID NO: 53767 - DNA, 246 bp, Glycine max
  Peptide Sequence Number=SeqID_170545
atgtatattgttgtggtaaaacaggggcaggatcaccttgggctaccttctgaggtagagacaaaacgtgagcggcagaaaccaatcaaggtagggtacttaaggacggatgcaagtagggatggggtcatgaccgaccgatcgttgccccttctctgcgcgagacaagcagagaatgtcgctgcgaggcagccccgtatcctttgtattttgcagctttcttttactatttgtaagaataagtaa

SEQ ID NO: 53768 - DNA, 933 bp, Glycine max
  Peptide Sequence Number=SeqID_170546
atgacgaaagcaagaatctcccaagtttataccgtatcatatggtattgaatattgtggaaaaaacggtgatcccaccttcccgtacctacttgtggttgcccaaagtcagaagaaactagagaacatggcaatcagccacagtactttggcatttgccttcggcatgctaggtaacgtcatttcgttcttggtattcttggctccaataacaacattttaccgaatattcaagaagaaatcgactgagggctttcagtcactgccttacctggtggcattgtttagttccatgctttggttgtactatgctttactaaaaaaagacgccatgcttctcttaaccattaactcattcggatgtgtcatagaggtcatctacatcatcttgtacatcacctatgcgacaagggatgctaggaacttaactttaaagctatttttcgcaatgaatgtgggcgcctttgctctgatcctcttagtcacacattttgctgtgcatggttcccttcgtgtccaagtccttggatggatatgtgtttccctttcgattagcgtctttgcagcaccactaagcattgtggcacaagttgttcggacaaagagtgttgagtttatgcctttcaatttgtcattcaccctcacattgagtgccataatgtggtttggttatggtctctttctcaaggacatatgcattgctcttccaaatgtacttggttttgcactgggattacttcaaatgctgctttatgccatttaccggaatggaaacaagaaggttgataaaattatggaaaagaaggcaccgctagagccactgaaaaccgttgttatagaaactggtctggaggaaaagcagcaaggaaagaagagcaaagaaaacagtgaggagaaggagaaaagtgatgaacctaacgattgtgcagtctaa

SEQ ID NO: 53769 - DNA, 786 bp, Glycine max
  Peptide Sequence Number=SeqID_170547
atgcacgtacgtgcatgtaatttgatttcattcttggtattcttggctccagtgccaacattttaccggatatacaagaagaaatcgacggaaagttttcagtcactgccttatttggtggcattattcagttcaatgctttggttgtactatgcgatgctcaaaagagatgctgttcttctcattaccattaactcattcggatgtgttatagagatcatctacatcgtcttgtacatcacctatgcaaccagggatgctaggaacttaactattaagctattttcggcgatgaacatgagttcctttgctttgatactcttagtcacacactttgcggtgcatggtccccttcgtgtccaagtcctcggatggatttgcgtttcgatttcagttagtgtctttgcagctccactaagcattgtggcacaagtagttcgcacaaagagtgtagagtttatgcctttcaatttgtcattcaccctcacattgagtgccataatgtggtttggttatggcctctttctcaaggacatatgcattgctctcccaaacgtgcttggttttgtgctggggttacttcaaatgctgctctacacaatttacagaaaaggaaataagaagacaaaaacaaacgaaaagagtccagtagagccactgaaaagcattgctgtagtgaacccgttgggaactggagaagtgtttcctgtggaggaagatgaacaagctgcaaaaaagagccaaggagatggagatgataaaaagggccaagactgcctagtctaa

SEQ ID NO: 53770 - DNA, 174 bp, Glycine max
  Peptide Sequence Number=SeqID_170548
atgaaagcaccaagttgctatgacccaggggtcatagctagaattcgaggttctagctcctccaagaaaaaaaggcggaaggtgcctctaacggtcgaagattttggaagattctgtgctgacaaggctgttgctgacaggattgcttactcattttgccacgtaatccctcag

SEQ ID NO: 53771 - DNA, 429 bp, Glycine max
  Peptide Sequence Number=SeqID_170549
atgaaaatagctgttggggctgcaaaaggattagaataccttcatgataaagaaaatcctcctgtcatctatagagacttcaagtcatctaacatattacttgatgaaggataccacccaaaactttctgactttggtcttgcgaagcttggtcctgttggtgacaaatcacatgtttctacccgcgtcaagggaacttatggttactgtgctcctgagcattggacagctgactgtgaagctcttgccgtggcatcattgtgcattcaagaatcagctgcaacgcgtcctctgattggagatgtggtgacagccctctcttatctggccaaccaggcatatgatgaaggtggaagaatattgaaaaatgaagggacttggaaggatccgagaaagatgactccccatgagaaactgagatctaggtag

SEQ ID NO: 53772 - DNA, 3585 bp, Glycine max
  Peptide Sequence Number=SeqID_170550
atggcggaatccacccgttccaagtccttcgatcggctcgaggaagcgattgccaaactcgccactaggcatcttcacgtttccgacaagcttgagaaccttatcaatcgcgtcacggcccttgagtcccaccctccttctccttcctccgcctcaactaacccttctcaccacggccaaacaccttcaccccacatactcaaacttgatgtacctaggtttgatggctcagatccctttggctgggtattcaagatctcgcaattctttgaataccatggcattcctgattctgagcgactcacggtagcctcgttttatatggagggccctgccctcgcgtggtttcaatggatggcacgcaaccaccaacttccttcgtggtccggctttcttcaagcgattgaagctcgctttgctctctctccgtatgaggatccaactggtcagctcttcaaattggttcagaaaggcacggtccgcgaatatctggcccagttcgagtctttggccaatcgcatcaccggcttgtcaccgtcctcacttctgagctgtttcatatcagggctcgaacctgatatcaggcgcgaggtccaagcccttcagcccctcactctgactcacgcggccgggctagctcgtttgcaggaagaaaagttctctgattcccgacgaagcttccgcagtagaccctcctttcctccctatcctgcaactccacctcccctttcggtggtccctccctccccattacccttgcttccctccccgcccaaaccccctcccttacccgtcaggcgtctcagtccagaggagcttgccaaccgccgtgaacgcggattgtgcttctattgtgatgagaagtacaaccgcagtcaccgctgcgcctcacgcttcttcctcttggttgcaaacgaagaccctgaggatgacctacttaaccctaatatcagcccgcccctttcccctaaaccgacccggcccgacaactcaaataacccaactcactcccaacccgatctaccccaggcccagataagccttcatgcactctcgggccacacggcccctgagaccttgcgcatgaccggccggatttccacacagtccgtcgtgatcttgattgacggcggcagcacacataattttgtgcaagcacgcctcgtcaagacatttggattaactccccagtctaccccgactctacgcgttcttgttggtaacggtaatgaagtggtttgttctcaagtttgtctcgcagttactatccaccttcaaggtcactccttcaccgtcgacctacatgtattaccactatgcggagctgatatcgtcttgggtgtccaatggttaaaatcattgcgtcctgttctcacttattacaatgatttaaccatgaagttcctccatcaagggcaacttatagagctgaagggaaccacagacatgcaccccctcgccgtctctccaccgcaattaagacgtatgcttcaaactcagagtgtgagtgaattctttcacattcgcgtctgcccctccacttcaccatcaccgacaactcaccctgcaattacctccattcttgaacaattcggccctctttttcaacccccaaccacactaccaccatcacgatcaactaaccactctattcacctccttcccaattcccctcccgttaacacacgcccttaccgttaccctcatttccagaaacaggaaattgagtctcaggtctctgcgatgctccgcaatggaattatccggccaagtacgagtcctttctcgtctcccgtcctccttgtcaagaaacgcgatggatcatggcgcttttgtgtcgattatcgcgcgttaaatgccctcacggtcaaggaccgttttcccattccgactgtcgacgagcttttagatgaattgggcgaagctcgttggttttcaaagttagatctccttcagggctatcatcaaatactaatggcgccggaggatatcaacaagacagccttcagaacacatcacgggcattatgaatttctcgtgatgccgtttggcttgtgtagcgctcctgcttcctttcaagccactatgaatcagaccttggggctcttcgtcctgaagttatcaaagtgttcctttgccactcagcaagtggaatacttgggccacttggtatcggagaaaggggttgaaccagttccggcgaaggtaaccgccgtacaacaatggcctactcctcgtacaacgcgcgccttacgcgggttcctgggattatcaggattctaccgccgcttcattaagggatacgcatcattagctactcccttaaccgctttgttagtcaaagaccaattccattggaatgaggaagccgacagagcattttcacaattaaaacttgctctgtgtcaagctccggttctgggtttaccagattttaattcttcctttgtcgttgaaacagatgcttcgggaattggtatgggggccattctttcacagaaccatcatccccttgcctttttcagtaagccattttgctcgaaattactccgcgcttccacttacgtccgcgagctcgccgcaattactgtcgcggttaagaaatggaggcagtatcttttggggcatcattttgttattcttacggatcaccggagcttaaaagagctcatgtctcaagctgtgcaaacccctgaacaacaaatttatttggctcgtttgatgggctttgattatacgattcaataccgcgccggcaaagccaatttaggggcagatgctctttcacgactaccaccacctactcagggagaattttatgtgctgaccatacccaattgccttttcttgcaggaactccgagcagcacttgctgctaatccagactttctgtctcgaagacaactgctgcaggatgatcctcaaccggattgggtgttgcgcggggattttattgtgcatcaagggcgcatctggcttcctccaaaattcccattaattccggcgatattaacagagcttcattccacccctactggaggacacatgggtgttatgaagactcttgctagggtccgtgagaattttgtatggacttccatgaagcaggacgttcaccactttgtgaccacttgtctcacctgtcagcagattaagtctgataatcgtcgaccgtcgggactcctgtgtcctttaccagttccggcaaagccttgggaggatctctccctagactttatcgttggtcttcccttacaccggggacactctgttattctagtcattgtcgaccgtttctccaaaggtctccacctgggatctctgccacaacaccacacggcggccggagttgccaagctgtttatggtaatatcaggaaagcttcatggaatgcccaagagccttgtatctgatcgggaccctctatttttaagtcacttctggcaggaattgtttaaattaagtggaactaagctctgtatgagctcagcttatcacccccagtccgatggtcagactgaggccatgaataaagtggtggagcagtatttaagagctttcgtacatcagaacccttcttcttga

SEQ ID NO: 53773 - DNA, 226 bp, Glycine max
  Peptide Sequence Number=SeqID_170551
atggagaaagctccaaggattgacccgctctacaaccctaattcatcgtcattggggctattctctcgaaagaagagtgtgatagaagcatatccgtttcagcctagggatcagcctatcaaacaaacaaaaatagttggaatggtgtatccagcagacggtctttcatcagtaagcgatgtgctagtctttgttggtgaatacctatctggtgttcaagtctccg

SEQ ID NO: 53774 - DNA, 138 bp, Glycine max
  Peptide Sequence Number=SeqID_170552
atggggctccgaaaaaggtggggtgggatatcgccagtcgagaacgaccttgaatggcaatctgaagggaagagacaccaaaaatgggttttcctttgtcggcagtcgcttaccttgctgaaaatttatctggtctga

SEQ ID NO: 53775 - DNA, 705 bp, Glycine max
  Peptide Sequence Number=SeqID_170553
atggccaaaacaaaactaaccttattaataatctccttcttcaccactttttctgttgtttgtctctcctcccccgcggattttttcctctatggcgggtgcacgcagcagcgttacacctcgaactcgccctacgagtctaacctgaactcgctcctgacctcgctggtgaactcggccacctactcttcctacaacaacctcaccgtggtggggtccagccagagcgacgccgtctacggcctctaccagtgccgcggcgacctcgccatgcctgactgcgccgcctgcgtctcccgtgccgtctcccgcgccgggcagctctgcccagcaacgtgcggcggcgcggtccagctggacggctgcttcatcaagtacgacaatgtcacattcctgggtgtggaggacaagaccgtcgtgctgaagcggtgtgggccctcggtgggattcgggccggtcgggtcgggtgagagggatgcgggtgtggcgcagtgttgtggggatttgagtttcgccgagtgtcaggattgtgtgggggatgcgatccgacggctgaggagtgagtgtgctgctgcggattatggggatgtgttcttggggaagtgttacgctagattctccaccaatggtgcacatgcttacaattacaacaaggcccatggtaagccttcacttcttaaactactaacaataaccttaaaatag

SEQ ID NO: 53776 - DNA, 585 bp, Glycine max
  Peptide Sequence Number=SeqID_170554
atgaccctaatcgttatgggcgtggttgctacatatagtcgcaatatgcttcctcatattcaacttagacactggcggaaagggtctcagtggtttgaactaaattgtgctctagccgcctacggggcattacgagagaaaaagctcgtcgtgggtcaagaccagagagctacaggtacaccaggggcaacagagcactcaggcggggtcggggcaagggcagcacgtcacggaagttctcagcttaatcttaccagcgctatatcttgggtgcgcgatatgtcgggtaatccccaaacccgtacccgatcaactcggatattccccgtcaaaatcgggacgggtttgggcagataccctcaggtacgggtttcattgtcatgtctagttgagcttgcttggtggagttgggaaaagtttgacattcttccactgcgggaagccaacatcgacaggcaggactataagggagcactttggaaggaggatttagcaaaagaggagacagtggcagctaaggtaacagcgacaatgatagcgaaggggaggaaaggaaagttccaaagagtgtccaagatggtggtg

SEQ ID NO: 53777 - DNA, 348 bp, Glycine max
  Peptide Sequence Number=SeqID_170555
atggacgaagccgaagaagggtatggtgaaagcaacaatgagtgtttattgggcgaggaagaagatcatgattacaatgacctttacaatgacgtcaatttcaatgaagggtttattcaattgttgcgcaagaacgacaattcagggtttatgctgcagttatttggttcaagattcctaaatttcaagattttgggggttgcttttattgaggaagcatttgtgtattcacaagataaaatttatgattttgagatgaagctaatggatattgacagtgagcaccttgggattccagaggcgtatcatgccatatcattgttaagatgccatcctctgagttgttag

SEQ ID NO: 53778 - DNA, 222 bp, Glycine max
  Peptide Sequence Number=SeqID_170556
atgggtatatcaggcttagaggagcactcaaatcgggcgacccccaaggcctatactctgaagagtctgtcagggtctctccctcctgattcaggtccaacccctaaattttttttgcatgcaaacactgctaatgaattatacaatacccacgacctcacactcgtgttttacacacgtttaacacaattgcgctacaatttaacactggttcctgaatag

SEQ ID NO: 53779 - DNA, 966 bp, Glycine max
  Peptide Sequence Number=SeqID_170557
atgcgcgagctgaaatacatcactgagaatcgcctgagcagcagcgtcaacgggctggatatgctcaacggcatgccgggcggcaaaagcacgctgccgcagtttacgccgctgtttaccgacggtgactgcacgtcaatgagcaacacctggcgtaactcgctcgattccctgagctatttcattaactactggaaaagcaattttgcctcagcctatgaactcaatcgggtgttctttatcggcggcgaaaatcagtgcctggcagacttcaccatcggtaacaataatccggtcgatcgcgaacgcagcctgaaggcgctgcgcgaaaacgtgctgcactaccgcagcggcaacgaggaagagcggcgtaatccgatgtactggattaccaacagcagccagccaggcatcggcaacttctacatggtggtgccggtttacgtcgccaacaaactgcaggcgctgctcggcgtggaacagaacattcgcctggatgaatttattcagcccggcgggctgccgctggtggccaccatcaccgatgaaaactatcgcccgctgatcagctcacgacgcggcggacccggttattcgctggacgatctgccggataacagcacctggtttggttatcttgacggctatcgtcagctggtgctgaaaaagccgctgccgccgtccagcctcaatgtggtgtggtcgctgtcgaccgatgtgctaatggatcagctcaagctgatgctgatcaacgcgttgctgctcaatatcctcagcgcgctgattctgtttaccctggcgtgggtgtttgaacgccgcatgttcctgccggcggaagacaacgcccaccggctggaggagcacgagcagttcaaccgcaagattgtcgcgtcagcgccggtcggcatctgtattttgcgtaccagcgatggcaccaacatcctcagtaatgaaattggcgcataa

SEQ ID NO: 53780 - DNA, 516 bp, Glycine max
  Peptide Sequence Number=SeqID_170558
atgcttcaaagtatccatcaaggtcagattctattgctgcagagtctacaggtggtagctcctccaggatccatcttatcagtggagcagttcttagagagggtagcctggcctggggcccaaccttcgcttgatagggaaggtgaaggtaccacagcccaagtaccccaacaggtacaggatgcttcctccgagaccaccattccaaagccattcactcttcatcttgaggtaggggaagaacaggcgagaccagagattgctactactcctgagagatcccttgagggcacatcagagcttcttactccaatggcagacctctcctcaccacagcctacagttgacccttccactcctttacttgacatactagaggaccagaccgcaccagtcttggcactgaacacctctcctccaactactccagtacttcatctgacagatgaggagtgtatcgacacgcctcgtcgctatgatatcaccatcctaaaccgcgacaaattctatttttaa

SEQ ID NO: 53781 - DNA, 507 bp, Glycine max
  Peptide Sequence Number=SeqID_170559
gatgtgcaaaaaaaggcacaggccatccagaagcaaaacactgccccctacgtgttgtctcgtgggggttatgaatatttagaacaaaagctcatggctgcccagtccggaagcactgagggcgtcattgaccctccatctctcatcagacgccacgtgaagtggaagctagcccgcaccaagaaaactgggcagatgacatctgaggcagcaaaggaaatagctgagaagattggatcgttcgtcccccatagacgccaggatgtcctaactattgccattgggcgactagagcaccatggctgtgtccgtgctgctggagccagtgtcaccataaagcaatacttcggatcggctccacgaacatcctacagttcttcctccatgcctcctgaagacctacagcagctgacccaacaaatcagggaccagctggaggagttgatcacaaaaaaagtgactcgacagctgatggcatccttcaaccagatgcagtcccagttctaa

SEQ ID NO: 53782 - DNA, 288 bp, Glycine max
  Peptide Sequence Number=SeqID_170560
atggtcgaaagaaaaaatccctatttgacaaggcttcttactatacctatgaattccattggacccaaaaatgatacattggaagaatcatctgagtcttccaatatcaataggttgattgttccgctcctgtatcttccaaaaggaaaaaagatctctgagagctatttcctggatccgaaagagagtactcgggttctcccaataactaaaaagtatatcatgcctgaatctaactggggttcgcggtggtggaggaactggatagggaaaaaagagcgattctag

SEQ ID NO: 53783 - DNA, 180 bp, Glycine max
  Peptide Sequence Number=SeqID_170561
atggagaacgagcaatttttgattaaacagatttggatgtcaaactcaggagcacagggtcatacaatgctcaatagaatgccccagaactcctccatgacaagcacatgttgcattcgagtcgtatcctcagaaaaatggaggttgaggaaccttggctggggttatggatatcattga

SEQ ID NO: 53784 - DNA, 288 bp, Glycine max
  Peptide Sequence Number=SeqID_170562
atggcttctaggaaaagaaaggcaccatctacacccacccaagttagatttgacagatcaagattcacttcccaagaggcttgggaaagatacacaaacattattgtgcctaggaagcttctgccagagaggaacgtagtggtatacttgtcgcaacgtgcccttttgcgggcgagcgaaggcgaggctcacgggtgcgctttccaaaggaggaaagatgcgcggagttgccaccaacgtttatttgtggaaaacgtcgggaaaaccgaaggaaaccggtccaaatga

SEQ ID NO: 53785 - DNA, 573 bp, Glycine max
  Peptide Sequence Number=SeqID_170563
atgaacacgctaagcgcacctgcttcgcttagcctgttcatcacaactgttaaaattttggatttccagatgaacacgctaagtggaccatgtcgcgctaagcgcgctaagcatgccctgtgcgctaagcctgagtgtcattttcgtgaggttgagctaagcgcgccatgctgcgctaagctccgactctcttcggctaagcgccagtctgctatggcatctaagaaaaggaaggcaccttctacacctgcccaggccagatacgacagatccagattcacatctcaagaagcttgggagagatatacagatattgtggtgcccaagaaactactatcggagaggaatgcggtagtttattacactgaatttgacgagttcaaggaggaactcgacagaagacactgggatgagaagtttacactcctaaggcctaatcctcaggagttggctgctaagctctatatcccagggaggggattcgagctaaatgctgatgggcagccattgaagatactgaggaagaacatgaccaccttcagacatggagtgttctttcctatgttgaattag

SEQ ID NO: 53786 - DNA, 534 bp, Glycine max
  Peptide Sequence Number=SeqID_170564
atgacatctaggaaaaggaaaagaaccgcttccagacctcaagctcagtatgataccaggagatttcaatccttggaagcctggaatcggtacacaaataacattctgaaccggaggatccttctggaaaggaatgttaagatttatcataccgaatttgacgagtttaaggcagagttggagaggcgtaacttacacaaacgtctcgccaatctccaagatggaagcatagatgtagctatggtgaaggagttttatgctaacttatacagctcggaagaccagagccctaagcaagtgagggtaagaggacattcaattaagattgatgctgacagcctgaacaccttcttagagaccccaatagttttggaggagggtgagacactgcctacctattcaagatttacgaggatgaggattgatcctcaagagtttgctgcccatctctgcatccctggtaggggttttgttctgaatgcagaggaccacccttggaagcttctaaggaaagatctcaccactcttgcatag

SEQ ID NO: 53787 - DNA, 262 bp, Glycine max
  Peptide Sequence Number=SeqID_170565
atggacaaagcgaaagaaatatggcacgatctgaaatcccgatactcgcaaggtgatctctttcgaatctctgatcttcaacaagaagcatcatcaatgaaacaagagaacgtgtgctacaaaaagtacgatcttccttccaattatgatgggagaagcaaaggaagcagtatcaaaagtggaaatacatgcactcattgtgggaaaaatggacatactgttgatgtatgctatagaaagcatggattcccccaggatacag

SEQ ID NO: 53788 - DNA, 159 bp, Glycine max
  Peptide Sequence Number=SeqID_170566
atgcagaaagggatcaataatcgtggaggtgatgatggtcatggaggcctcaaaggcccaagtggagatggcgaaatggatagatatatcagtgatggttgtcatttatattgtcacatgggtgatcctattatgggattaatcatcaatttgatttaa

SEQ ID NO: 53789 - DNA, 470 bp, Glycine max
  Peptide Sequence Number=SeqID_170567
atgagtgggaagggcggtggcaaggcgctgtcggcgacgattccagcgtcgtcgcggaagatggttcagagcttgaaggagattgtctccaatttccccgaccatgagatctacgccacgctcaaagactgtaacatggaccctaacgaagctgttagtcgtctcctctcacaagatccttttcatgaggtgaagagcaagcgagaaaagaaaaaagagattaaggacccaacagaatccaggtctcgtgggagtgggacaaacaacacatccagtcgtggcggtggtagggctggcacagatcgtaatggtggacgtggtggtgccaaccaattcggcagcagtgatgatggtctgcaggggaagcctgtatacaagaaggaaaaaggggcccccacttatggagggtctacatcctctgcacctagtgtgctgggaaacaatgcgaacatgagaccggcatcctacag

SEQ ID NO: 53790 - DNA, 414 bp, Glycine max
  Peptide Sequence Number=SeqID_170568
atggaagttggtggaacctggatgagacaagaagaaatcataaagattctatctggtagcaggatttatgtgttgtttgcattcaatggaggagggaagctggttcaaaaatcaacaacaacattatattcagcagatgggatcgcgtcaagtggagtgtgggaatggcagcttgagtggaggagaatgctaatggagggagagatggatttggcagcaaatttcatggaggatattgaggggatggtagttcaagtccagcatcaagatagttggtcgtgggagggggatctggcaggggagtacacagcgggaagtgcatatcgggcacttaatcagtttataattgaagatgatgagagggctttctctatcctttggaaactaaaattcccagcaaggtgtctcatgtag

SEQ ID NO: 53791 - DNA, 813 bp, Glycine max
  Peptide Sequence Number=SeqID_170569
atggtaaatggagggtctcacaaaagtttcattcaacagaggggtattaggccgggagaccctttatctccctatctattcatcctttgtgctaaagctctctttgctttactgaataaagttgtggcttcaggggatttgcatggcattaaagtttctagatcagctcctatgatttcccatttattttttgtagatgatagtatcatattttcgagggccaccaaagaggaagttactcatatctctgtcattctaaaagattatgaaacagcttttggacagaggataaattttgacaagtcagaacttccttgtagccaaaatgtgtctagtaccaaacaagatgagctaatacaattgatgggggttaaggcggtggaaaatcaggagaaaggggatgtagaacaaagaagtattcactggatgagtaggaagaggttgacaaggcacaagaatgaagatgatgttggtggaagattacaaccactgaagttcaccacgaatggcatctacacggtaaattttggttaccatgttgcacgaatgaagtacaattccatagagtcttctttgaggaagccaaggaacgaatggaggaaaatatgggagggggaagcactacccaaatacgcaggagaaaaggagtgggggggggggggggggagagcgagaaggggttttcgctttttggttgcaaactgtagagcgaagagcgttcgagtagtgagcgaaagaggttttctttcttctttccggttgttgtcgcggcggaaccctagctactccggtggtgcgagaaagggtgtgtga

SEQ ID NO: 53792 - DNA, 600 bp, Glycine max
  Peptide Sequence Number=SeqID_170570
atggggcagaagtctctgatctacgcgttcgtgtcgcggggaacagtgattctcgcggagtacaccgaattcagcggaaacttcaactccatcgccttccagtgccttcagaagctccctgccaccaacaacaagttcacctacaattgcgacgcacacaccttcaattacctcgtcgacaatggctacacatattgtgttgttgcagatgaatcaattggaagacagttacccatggcttttctagagcgtgtcaaagatgaatttgtgtcaaaatatggtggtggaaaggctgccacagctcctgcaaacagccttaacaaggaatttgggccaaagttgagggaacatatgcagtactgtgttgatcatcctgaagagataagcaaacttgcaaaggtgaaagctcaggtttctgaagttaagggtgtcatgatggagaatattgaaaaggctgagccaagctacaataaaagaaggtttactagaacccatataactgagtgttgtcacgtcattacaagaaaacagataacaggcactgttttgatagagaatgaagtggttgatgatgttaggaggaaagaaaatgctgtctag

SEQ ID NO: 53793 - DNA, 390 bp, Glycine max
  Peptide Sequence Number=SeqID_170571
atggctgtttcgagatttgaacctgtgaccaaactggtcacaaaaggcaactttagcattgcgttagggctccaatctcaatctcatgtccaaagcatgagaatgaaaatgtttaatatgtctaaagttctggacaggggtgacaagatagaacttctggtggacaagactgagaaccttcataaccaggacttctggaaccagaatccgtcgaaaaatgtggctgcaaaacatgaagataaagctgattgtattgggaatattgatagcacttatcctgataatagtcctatctgtgtgtcgtgggttcaactgtggaaaatagcaccattctccgaggccttttatcatgttatttcaaccttgagattatcggagaaaagatactaa

SEQ ID NO: 53794 - DNA, 417 bp, Glycine max
  Peptide Sequence Number=SeqID_170572
cgactcaaccgcatcgggatccgaaccaacccgaggcccattctcgacctctccttctccatcaccgttaaagtccacaatagagacttcttctccctcacctatgacaccctcgccgtctccgtcggctaccgcggccgccagctcggcttcgtcaccggcggcggcggcggccgcatcagggcgcgtggctcctcctacgtcgacgccacgctcaccattgacggatttgaggttatctacgacgcgttctacctgctcgaagatatcgctaagggcgtcattccattcgatactgacacccgagttgaagggaaattagggcttttcttcttcactgttcctttgaagacgtgttcacaaattcactcgctggcacaaacactgtctttggttaaggagaagagtaaatactaa

SEQ ID NO: 53795 - DNA, 183 bp, Glycine max
  Peptide Sequence Number=SeqID_170573
atgtttgaagccagaaaatggtggaaaaatttaacaaatgaaaaggaagctgagaaaatcttagaaaaaaatttcaacgaaacaaagagtgagtttgaacacgcgtcaccgggtttcgactcggttggcgactcgttgactactcagatcattatcaaagtgtttatcttttcaaaaacataa

SEQ ID NO: 53796 - DNA, 486 bp, Glycine max
  Peptide Sequence Number=SeqID_170574
atgtgtcacccaggagttccttttgtgaaccgagagggcttgatggtgcatagaagatggcttgtgtcaccactggcaaggcatgcaccgaggcaggttcatgatggtggtggctctggagagagtggttcggtgaagcactgcgtgtgctcgccgtcgcagcatccgggttcgttccggtgccggttgcatcatggcgatatcgaatggaatgacgcccttagcgatatcttcgagcaggtagaacgcgtcgtagataacctcaaatccgtcaatggtgagcgtggcgtcgacgtaggaggagccacgcgccctgatgcggccgccgccgccgccggtgacgaagccgagctggcggccgcggtagccgacggagacggcgagggtgtcataggtgagggagaagaagtctctattgtggactttaacggtgatggagaaggagaggtcgagaatgggcctcgggttggttcggatcccgatgcg

SEQ ID NO: 53797 - DNA, 522 bp, Glycine max
  Peptide Sequence Number=SeqID_170575
atgcacaccgctcaactgatttctgatgccatctattgtttgcagggatcgcccccgcaagacacccaatggacccgaagaagtccaacagggtcttggggtttccagctctggttgcaggcctctattagtcctacagggtgcccgttccccccagcaagggatcgtgcccgcaagacacccaatggacccgaagaagtccaacagggtcttggggtttccagctctggttacgggcctctgttagtcctacagggtgcccgttccccccagcaagggatcgcgcccgtaagacacccagtggacccgaagaagtccaacaggatcttggggtttccaactctgattactggcctctatcagttccacagagtgcccgtcacccccaacaaggtcattaggcccccattaaccgggctttcatcaagaagtactgcgcccctaggcaggcgcagggcaagacaccacagtagcctggggatggctggcagcgggcaacagacgcaccgccgccacctctaa

SEQ ID NO: 53798 - DNA, 870 bp, Glycine max
  Peptide Sequence Number=SeqID_170576
atggttggtttcacacctttttcgtcaagaggtgagacatgcttgcccgctagaaggccaccactcatgcacagagaaaaagaggcaagttgggaccgactcttagcaagcaaagaaggagcgtctgtcaattggttcccccgatggaaagaaggaagaactgggattcttatttcgtgtggaggatttccaaatgttcccttgatggggacaaggggttgcattaattacaatcccatcctcgccataagacaactgggctaccctatgagaggggcaccattagaggaagacctcacacctattattgcacgaggtttcaatagcaccaacgtggaggcacttcagaaggttcacaaggcatgggagatggtgcaaaagaaggacaagaaactcagaggcagtagcaacgggcccatcggcgactaccataggtggttaaaagcctacacgcaaggtttggattggctcccgaatttgagaaccactaagggggtggaagttgaagctccggaggagggcgaagaggagaatgccgaactgagagacgtaaatatagccaccaccgaggccttggaacaagagaccaaaagggcccgtagggaagaacatggccggaacaaattccgaggggctctgtggggcagtaacagcgagcttaagcttcggaaagaggaaagtaaccaatcacgagtagacagtttgatcttgaaggatgaattaaggatttgcctaaggtccaagagaagcttgtctcagcggttatgcgagaccgagaccaacatgttagccatcctcacgaacccttctttagtggacgtagtggtggaagagacttccttactccaccctactcttcctccaccatga

SEQ ID NO: 53799 - DNA, 711 bp, Glycine max
  Peptide Sequence Number=SeqID_170577
atgcagaagaggtcccaaactgaaccggttgatgtagaaatgggagatcgattagaggacatgattcatgatcttggacaagagtcttttcagcaagcacatgcccctatgcatgatacattggaaaatgattcgaagaagcccttgtatccggggtgcaagaagtcattgacactgttgtcaatggtgttaagtctggatatgcttcaagaggaaaacacgttgccaaaaagttactgtgaggtgaaaaagattttgtgtccgatgggtataaagtatcaaaaaattcatgcatgccctaatgattgcatactgtacagacatgactatgaagaaatgcataaatgccccaggtgtggggcatcatggtacaaagtgaacgatgatgacgagtgtagcagtgtcgaaagcacaaagaaagacccccaacaaaggtgttgtggtatcttccgatcattccaagatgcaaaagaccttacatggcatgcagatgcgagaaactacgatggaatgatttatcatccgactgattcctcccagtggaagaagattaagcctttttatccagatttcggcaaaaaggcaagaaatcttaggcttgaacttgccactgatggaatgaattgcgacgacaatttaagcactcaacacatttcgtggccaattttgctagtaattgacaacttgcctccttggttgtgcatgaagtga

SEQ ID NO: 53800 - DNA, 180 bp, Glycine max
  Peptide Sequence Number=SeqID_170578
atggcgctaataaatggaatggatgcaaaagtatcaaagagagacccacctgccatgcgaaggtatcctatcaatagttccaacagaagcaggaaagtagccaatgagaacctctggtttctagcgaagagagaaggcatggtgcaaaatcttcttgacattttcttacaagaaatttga

SEQ ID NO: 53801 - DNA, 279 bp, Glycine max
  Peptide Sequence Number=SeqID_170579
atgatcaacatcatctcgataccatcgactcgttcgccttggttgatgaaaggtgccgataaccgtaaggtattccccgcatgtcaccggactcgctgtctctggatgacaaaaggtgcagaagacgacgttagtctctgcgcgtcgacgtgctcgcttgcccctgatttaagaaagatgatgacgttagtctctgcatactacctgactttgagtctgacggatagcgaaagagtgtttatacggataaccacttgggtatctccgcctgccacctaa

SEQ ID NO: 53802 - DNA, 795 bp, Glycine max
  Peptide Sequence Number=SeqID_170580
atggagaagatggatgtggacataataataagggggacccctaaggcaaatggtcactttggggcaattgcagcttgcctaggcgagctgaaacttagtgttgaagcaataaggtcacctaggcgagctggtttcttcaccatgaagccatttggtggcccaagcaagccagaggaagctctaacagattctaggtggatccaggaaatgaaaacaaaaatgaaagcattggagaaaaatgctacttgggaacttgtaaccttaccgaatggaaataatacagttggttgtagatgggtgtttactgtcaaacataaagctgatggaagtgtggagagatataaagcaaggctagttgcaaagggttacattcaatcctttgaggttgattaccaagaaacctttgcactagttgcaaagctcaatacaatgagggtgttattatcactagcagcaaatcaagattggccacttcttcaatttgatgtaaaaaatgattttttacatggagatttaatggaagaagtttatatggatcctcctcccgatataccaaagtactcaaatattcctttggtgtgtaatcttaaaaaggccctatacggattgaaacaatcaccaagagcttggtttggaagatttacaaagtctatgaagtttttcgattacacacaaagcaattctgatcgcaccttgtttctcaagcataatcaaggtaaagtcactgcattgataatatatgttgatgatatgattatgactggaaatgatcctgatgaaattttaagcttatag

SEQ ID NO: 53803 - DNA, 617 bp, Glycine max
  Peptide Sequence Number=SeqID_170581
atggctgataatgctgttatcaataacacaacttttgccaacctgttgaatccctattatactcatcccaatgagaatcctggtgttgctatcgttgctcaggttctcaacggtgccaatcatcactcatggtcacgtgctatgctccttgccctgaaaaccaagaagaaggtccagtttattgatggttctttgcctcgtcctactcttaatgatcccaatttcactatttgggatcattgtaataccttggtgaaagaggtggctacagatacttcatctacaacttttacaccagagcaacataaggctctcctttctttattgcaacaaacttcacaagcctcttcctctcacaccactaatcagctgattagttctaataagaatgacaattcaggtatattttgtgccactcttcatgcttcaagttccaacataaactcttgggttcttgatagtggagctactgatcatgacccctcctcattgaggatgattgaagcagctgaattgagagctgggctatacatcttgtcttcctcaacaactaagttttcctatacttgtaacatcaatactattccttccactaaatgcaatgtttggcataatag

SEQ ID NO: 53804 - DNA, 150 bp, Glycine max
  Peptide Sequence Number=SeqID_170582
atggtgtctccgacagcgaatgtcgcaacctctccatcgttatgttcctctacgaatcaatgttgggattcgtcgaatggatcatcagaaaagtcgcatttcacttttggaatgatcgaagctacagtggcgaggaatgaggaaaattag

SEQ ID NO: 53805 - DNA, 267 bp, Glycine max
  Peptide Sequence Number=SeqID_170583
atggataaagttgatatctttgtccctcatcctctcacaaacgcatgtttgcttattcaactttcaccggaatgtgggtgtaagccattggtctgtttgctcaagcaacctgcgctcctgagtgttgacttccaagaccgttcaatcagagattactcatcttgcacgcgggaatcctctactacaagagacccacagtctcttaatcccttttcagaaataagaagaagagaagaagaggtctctcgtaaaagaggtagattgtaa

SEQ ID NO: 53806 - DNA, 2385 bp, Glycine max
  Peptide Sequence Number=SeqID_170584
atgggcgatcttcatgtgaacggcgtcgttttcggggaggatcgcccctgcgcgtcctcgccgccgtcgccgccgcttccgccttggaatcccgatccatcctccgtcgcggccgacgcctgggcggcggccgagagaaacaccgctgagattctccgccgcatacggcccacgctcgccgccgaccgcaggcgcagggaggtcgtcgattacgtacagagactcatccgtgaattgattttgaatgattctggcgtgcttgttcggtgtttaggtttttgttttgttatggttttgatgactgtgaaggtttttccatatgggtcagttccgttaaaaacatatcttccagacggagatattgatttgactgcactcagctgtgaaaacattgaggatggcctggtatctgatgttcgtgctgttcttcatggagaggaaatcaatgaagctgctgaatatgaagtaaaggatgttcgtttcattgatgcagaggttaagcttgttaaatgcattgtacaggatattgttgtagacatctctttcaatcagttaggaggactcagtacattatgttttcttgagaaggttgatcgacttgttgccaaggatcatctcttcaaacgtagtattatccttattaaagcttggtgctactacgagagccgtgtactgggtgcccatcatggtctgatttcaacatatgctttggaaacactggttctgtatattttccatcagtttcatgtatccttagatggtcctctagcagttctctacagatttttggactacttcagcaaatttgattgggacaattattgtgttagtttgaagggaccagtcagtaaaacttctctgcctaatatagtagctgaggtgcctgaaaatggagggaatacattactgactgaagaattcattagaagctgtgtggagtcattctcagtaccatcaaggggggctgatttaaatttgcgtgcatttccccagaaacatcttaacatcattgatcctttgaaagaaaacaacaatcttggccgcagtgtcaataaaggcattgcttttaagtatggtgcccgtaaacttggctggattcttaggttaccagaagacagaatagctgaggagcttattaggttctttgcaaacactctggaaaggcatggaagcactcaggggaatgtagacaagtcatttttgagcttatctacagcttccggaaaggataggaaacctggaaatcaacataattttgaaagcagagatgaaagagaaagatatgtagtacaagatgcaggggagttctttgactcctctagggatggaaatgcagttacaagttttaaacttggtgaagattctaaggatattgcaacatctggggtcttggatcgcacaagcactaatggttggtcttattgttcaaatgagcaatttgaaaataatatttctgatagtgaacctgccctaaattctgttatcaatgatgagaaagagaagcaagttatggcaggcaattcacccagatcacataccgatgaaaagcatatggcagtctccgaagcttcaaagtcattgttggaccttactggggattatgacagtcacattgggaacttacaatatggtcatatgtgtaatggttatcctgtctctctcgttgtgcctagtcctcctaggtctccgaagtttccaaataggaatccatgggaaactgttcatcaatgtgtaccgattaatcacagtattcgttctcaggcaaactcaaattgtgtaatgggacaacaagtttacgtcataaatcatcctactctgccaatgacttcttttggttcagaagagaagagaaaagtacgaggaacaggcgcatacttcccgaatatgacttcccgtccttacagggacaataggccaataccaggaaggggaaggggtcaagcaccaggtactcatggacatctgcagagacacagccgtaacaatggctttgccctagctccacaagagacaaatttgtctgtggatggaacttttgaacatgctctagaaggatattctggttttggtagtaccaaaaccagatcatctgaaacctatttccctcaaccttctacatggggatcacattatgctaatggtttccttcattcatctgagaaacctgaatctggacctgcaagccctcagcttcgagtagtgccaagaaatgaaatgagcaattacccagagtcaggcatttctactcctagggacactgtgcctaacactgaggaggtgacagaggagaagtctgattcattgtcagcagttgattccaaaaggattgaagagcaagcttatcgtttgaagaatgatgatgactttcctccactttcccattga

SEQ ID NO: 53807 - DNA, 318 bp, Glycine max
  Peptide Sequence Number=SeqID_170585
atgcatgcacaaggtttgcaaagtggattttgttcattgacttccttatttgggcactacgaatttgttggcttagtggggagacccagcaacgaaaatgtggagaattacatgcccggcactcttaattgtgaggaaggagctcaggagtgccacgattcgtctgagatatatcagaagattgtgacagacccatctatcacagttgacacaattatcgtcacagctcttaatttgcaccagccgggaatcgaacccgggtctgtaccgtggcagggtactattctaccactagaccactggtgctttgttgcctaa

SEQ ID NO: 53808 - DNA, 596 bp, Glycine max
  Peptide Sequence Number=SeqID_170586
gtgtctcaagagtgtcctctacggcacggactggggctccgtggatctaagtgtggggaggatggtggcaacaaggacaatgacgtagatgatggtgacaacgagatgatgactctcgaggacttcctcgctaaggccaatgtcgtcaatgacgccagccataaccatgaccataaccacgacctcgactatgacaatgattccaagggagtcctcaactttgattttgagggcaacctcaatgccaccccatcctcatccttcaccaccacccatttcgggcccctcgtctcgcacaactcctctgtagtcacctatgtcgtgtctaacagaggccctgtcacccctgccttgtctgtagaggaccccgtgggcagtgacaacgttctcgagcagcgtagcttccgggttacacgtgcgggtttctgcattagtacgacaaggcaaggatgttggtatgtcgtttcttcaggctctgtggagaataccaagaacatgatggaagtggagactcaaagagattcctctgctgatggagtttgcaacaagcaggaggaagagaaagcaattacggggttattggatggaagtgaaga

SEQ ID NO: 53809 - DNA, 158 bp, Glycine max
  Peptide Sequence Number=SeqID_170587
atgggtttgaacccggcatacgaagtggaggtgaagcgtgtgtcgcagatattagtggcgttcgttaacgacattgaggaagtgttcgatgcgatgggacttgaaaatggtctcttggggaatgatttgataaacggaaagtgggaagtggagaagag

SEQ ID NO: 53810 - DNA, 696 bp, Glycine max
  Peptide Sequence Number=SeqID_170588
atgaaatttcaaagattacccggacctgtcggccaaggctatagactcgttgaatacatcagtgtagcgcgcgtgcggcccagaacatctaagggcatcacagacctgctgaggtctcgttcgttaacggaattaaccagacaaatcgctccaccaactaagaacggccatgcaccaccacccatagaatcaagaaagagctctcagtctgtcaatccttactatgtctggacctgttgttcgtctttcataatccaagatttcacctctgactatgaaatacgatggcccccgactgtccctgttaatcattactccgatcccgaaggccaacacaataggatcagaatcctgtggtgttatcccatgctaatcaccggaggcacgacccggccagttaaggacaggagcgcatcgccggcagaagggacgagccgaccggtgcacaccggaggcggaccgatcgacccaacccaagctggaattaccgcggctgctggcaccagacttgccctccaatggatcctcgttaagggatttagattgtactcattccaattaccagactcaatgagcccggtattgttatttattgtcactacctccccgtgtcaggattgggtaatttgcgcgcctgctgccttccttggatgtggtagccgtttctcaggctccctctccggaatcgaaccctaa

SEQ ID NO: 53811 - DNA, 270 bp, Glycine max
  Peptide Sequence Number=SeqID_170589
atggatatgtcagagtttccaagtgccagagagaagaagaggattgtagcctccattttactatcaacatgcgagactaatttctctatgccaaaacattatttctcaaataccaaccattggaatgttccaaaatgggtgcctaaggtggtgtccaaatttcatgacgatccaacgattgacgagtttgggatcatagttttactggaacaggttttgggtctctatgggaaaaaagctatgatgcgaagggaatttcttccaccatag

SEQ ID NO: 53812 - DNA, 1419 bp, Glycine max
  Peptide Sequence Number=SeqID_170590
atgaaccttcccccagggccatggaagttacctatcattggaagcatacaccacatgattggctttctaccccatcaccgtttgagagagctagccctaaaacatggccctctcatgcacctaaaacttggtgaggtaccagccattgtggtttcttctccagaagttgccaaagaagtgatgaaaacctatgattccatctttgctcaaagaccccatcaagttggtgcagacatcatgtgctatggttccactgatattgccactgcaccattaggaggctattggaagcagcttagaagaatatgctcacaagagcttcttagcaacaaacgtgtgaggtcatatcaatcaataagagaagaagaagtgctgaatttgatgagacttgttgatgccaacactagatcttgtgtgaaccttagtgagaaagtgtcttgcatgacaagtgccatcactgctagggcaactttcggtgaaaaatgcaaggaccaagaagatttcatttcccttgtcaagaaacttctgaaacttgtcgaacgtttatttgtttttgacattttcccttctcacaagtggcttcatgtgatcagtggggagatatctaaactggaggagttgcagagagaatatgatatgatcattggaaacatcattagaaaggcagaaaaaaagactggtgaagtagaagtggatagtctcctctctgttcttctaaatattaaaaatcatgatgtccttgaatatcctttgacaatcgacaacatcaaagctgtaatgttgaacatgtttggtgctggaactgatacatcatcagcagttatagaatggaccatgtcagagatgctgaaaaaccctagagtaatgaccaaagctcaagaagaagttagaagagtatttggtagcaaaggatacaccaacgaagcagcacttgaagacctaaagtttctgaaagcagtaatcaaagaaacacttagattgcaccctcctttccctcttcttcttccaagagaatgtagagaaacttgtgaggtcaaagggtacacaatacctgctgggaccaaagtgatagtgaatgcatgggctattgcaagagaccctaagtattggtctgaagcagaaaagttttatccagagagattcatggattctccaattgattataaaggttccaatcatgaactcataccctttggtgctggaaggagaatatgtcctggcatttcttttggtgtatctagtgttgaactttgtcttgcacagctactttactattttaattgggaactgccaaatggaaacaaggaaaacgacttggaaatgactgaagctttgggggcctcttcaagaaggaaaacggatctggtcttagttcccatttcttacaatcatgttcctgtttcatatataagaccttaa

SEQ ID NO: 53813 - DNA, 1854 bp, Glycine max
  Peptide Sequence Number=SeqID_170591
atgaagacagtgtacaaagcaatcgatgaggtgcttggaattgaggtagcatggaaccaggtcagactcaacgaggcgcttcgcacgccggacgatttgcagcggctttactcagaggttcatctcctcagtaccctcaagcatcagtccatcataagattctacacttcttggattgatattgataacagggccttcaactttatcacagaattgttcacatctgggtcactgagagaatacaggaagaattataaacgtgtcaacatacaagctataaagaattgggcttgccaaatcttgcaaggtcttgtttatctacattgccatgatccaccagtgatccatagggacctcaaatgtgataacatatttgtcaatggtcatcttggacaagtaaaaattggtgatctgggactggctgcaattcttcgcggttcccaattagcacatagtgttataggcactcctgagttcatggcaccagaattgtatgaggaagaatacaatgaacttgctgatgtatattcatttggcatgtgtgttctggaaatgctcacatctgaatatccatatagtgaatgttctaatccagcacaaatctacaagaaagtgacatcgggaaaactaccaatggcttttttccggattgaagacatggaagcacaaagatttattggaagatgcttggtacctgcagaaaagagaccatcagcaaaagaattgttgcttgacccttttcttgtgtctgatgatccatcatcaacaaagaaatttgcaattcagaaaccatttttgaatgtcaatgagatggagaaactgcaattaagtgatgatcttcctaggactggaatgaaagtgatagggaagctgaaccctgaagatgacactatctttctcaaagtgcaaatttctgataaggatggttctgctagaaatgtattttttccctttgacatattatctgacacacctattgatgttgcaaccgagatggtgaaagagttggagattgcagattgggagccttttgagattgcaaatatgattgacagagagatatctgctctgctacctcacagaaggcaaagtagttgttcagatgccttccacacattcaattatctggatgatgattgtgatgatgatgaacctcatcatcatttccgctcgttctcttctagttcatcgttccaagaatcaatgtcagatttagtcagcaaagctgaggaaatatcaagtggatattattggctccatgatgatttgcatgatgataccagttcacgatgctcttcacaagggacatattccaacttgaattactattctctggatgatcatcatcaagagtacaacgtgccatctttgagaaaagataaacttcccatcacaaagagtcacaacaagggcaaaaaggtttcctcaggcgaagacttgagcaatttcaaccaatataaactcatggtaggatcacaggttcctctcactagtaaaagcaagatgatgatgaacaatcatcatagattaacaaggaacaggtcattgattgatataaggagccaactattgcaccgttcactggttgaagaggtgaacaaaagaaggttattcaagacagttggtgctgtggagaatattggatttcaggcaccttgtgatgtttccacaaaaaggtcacagcatattatggagtgtgctgaacaaaaaatgattttaggcgatggagaacttttcccaagatgctggaccaacaagctctactatttctgtagatgcatggaaatgaaaggagatgcagctggtcgacaagctaggattaagattcactatgccagtggtttgttttactag

SEQ ID NO: 53814 - DNA, 259 bp, Glycine max
  Peptide Sequence Number=SeqID_170592
ttacaaaggggagggagagaaagtggtgcacggtgtgattggatgggagaataagcagatactatttaacaaggaaagtgacagggtattagcaggggatttgtggcagataagagaaagcactaaggcacggaacttgaagaatctgtggaccctctttgatgtaatcattggtgggaaacagaggaagaagatgcaaaaaaacagagtgaggagatgcaggggaggtaacaattacaggggagaaatgaagttgtga

SEQ ID NO: 53815 - DNA, 180 bp, Glycine max
  Peptide Sequence Number=SeqID_170593
atggataaaggtaaaggtgccaaggcattagcgacctctttgcaaaacctcgatttgaatcctccatccaacatcaagtccaagtcttccattacaatcgcccaccctcaattccccgagatggggtgttatgtttatgtttggtttttggtaaagctttcacctttcagtgccccatga

SEQ ID NO: 53816 - DNA, 390 bp, Glycine max
  Peptide Sequence Number=SeqID_170594
atggtgattaaaagcacaagcaccacctctcacacaaaaataagaaagtacaacatgaggcttaacccgaaaaaatgcatatttgagaagcataaaggaataaatttgaaggacgaatgcaaagtccactttgaaaaactgaaagagttcaacccttcaccacccatcctcactagacctcaactagtatgcaccaagggggttaatgaaagttcaatgcctagtagacttttttgccaaattgacaaccgctatagaaatggcagctactatgttattgagggtggtggagacctatacaagagaggcttcacgactcctctattgaagggcctaactagggatcaggtcaagtacatgatgaacgagatgcatagaggaattttctaa

SEQ ID NO: 53817 - DNA, 551 bp, Glycine max
  Peptide Sequence Number=SeqID_170595
gattattgcctaagaagacaaagcctctgagtttagtcagcctttgtgttggagttcttggaagacatttggaggatattattgcagatttgagtgaaattgctatcaacttgccagctgatataaagataacagtggcagctattgctagaagaagaaaattgctgaatgatgatgtcctgatcgcattagctgatacttcctgggaaatctttgatgtctccggctcagatgtctctgattttggcttaataaaagcagctgaagtatgtagattcattaaagctctagatataagagctatgatttgctctgagaatggctcaatatggctatctgttagcaacctctatcttaactaccaccatgggatcattgtgacattgctctatccctcaaaatcttcacctatgaaagcgataggggccaagtttcaagtggggtattctcatcctaacgttgtgcttctattgcctcatgagtcctactgtgttctcgacttctatcttgttctctttcatggtcctgatcacatgttatgtctttcatga

SEQ ID NO: 53818 - DNA, 315 bp, Glycine max
  Peptide Sequence Number=SeqID_170596
atggagtttctcaataatcaagtataccaatggagcgttgcacctttcaacattatagggaacactcgacacatgattgcattgtcattcatggacagattaattcatttgtgtgatgaatgtgttgacatgttattctgggtccgagagtctatcgtaatgatggatggtcaacatcttccatccaggtgggagttaagcctccataatcttgtcagtgaaaggatgaagctaagtgtcaatatttgttgctctttggactggttgtgtgacaaaggggttccttcacatcacattgcatcagtcacgtcttag

SEQ ID NO: 53819 - DNA, 480 bp, Glycine max
  Peptide Sequence Number=SeqID_170597
atgattagaggcttacatgtgagggaggtgtgggaggatgatctgaagaaggttaaggaagaggtagcaaaattatttttgaatagattcttagagggtgaggatggaggaattagtctagatggtgtttattttaatctcatatgtcatgagaacaatttattgttatcttcaaaatttgaagaattggaattgaaagaggcaatatgggattgtagggtatccaaaagtctaggatcagacggattcaacttcaacttcatcaagaagttttggagtgttttgaaagttgatactatgagaagcacaaatgtgtcccttatctctctcatcccaaaggtggaggaacctcaaggtttacgtgaatatatacctatttccttgaagttgttgtatgatcctggagattgtggaggttgtggcaccgcaagcttgcggcaaaactgctgcatagaggtggtagtgatgcaacgctcttga

SEQ ID NO: 53820 - DNA, 126 bp, Glycine max
  Peptide Sequence Number=SeqID_170598
atgtgcagtgggaagggaattggtacaagagaaaaaacaatatggctggtaggagctgttctggaagggacaaagagagagtcaactgctggcattatattcgaagtttccctgatcgccatttag

SEQ ID NO: 53821 - DNA, 1584 bp, Glycine max
  Peptide Sequence Number=SeqID_170599
atggggaatgaaaccagaaaactctcagatgagtatgaagtttcagaagtcctaggaagaggtggattttctgttgtcagaaaaggcaccaaaaaatcaagcagtgacaccaaaacacatgtagccatcaaaaccctgagaagggtaggcactgcctcaaactccaacaacccttctggatttccaagaccaaagggtggagagaagaagagcacagcagctatgatgggattccccacatggagacaagtctcagtctcagatgccttgctcacaaatgagattcttgtgatgaggagaatagtggaaaatgtttcaccacaccctaatgtgattgacctctatgatgtgtatgaggactcaaatggggtgcaccttgtgttggagctgtgttctggtggagaactgtttgataggattgtggcacaagataggtactcagagactgaagctgcaggtgtggttcgccagatagcttcaggattagaggctattcatagagctaacattgtccacagagatttgaagcctgagaattgccttttcttggatgtgaggagggactctcctcttaagatcatggactttgggttgagttctgttgaggaattcactgacccagttgttggtttgtttggatccattgattacgtttcaccagaggctctttctcaagggaagataactaccaagagtgacatgtggtctctgggggtgattctatatatcttgctctcagggtatccacctttcattgctcaaaataatcgccagaaacaacaaatgataatgaatgggaatttcagtttctatgagaagacatggaagggcattacccgttcagcgaagcaactgatttcagatcttttgattgttgatcctagtagaagacctagtgctcaagatcttctgagtcatccatgggtggtaggtgacaaggccaaagatgatgcaatggaccctgagattgtctcaagattgcagagcttcaacgctaggcgcaaactgcgtgcagttgcaattgcaagtatttggagcaccacaatcttcctcagaaccaaaaaactgaaatccttggtgggaacacatgatctcacagaagaggaaattgaaaatctcaggatgagttttaagaagatatgtgtgagtggggacaatgccactctatctgagtttgaggaggtgctgaaagcaatgaacatgccatcactgatccctctagcaccgcgaatatttgacttatttgacgacaaccgagatggaacagttgacatgagagagatactatgtggtttttccagcttcaaaaactccaaaggggatgatgctctccgtttgtgcttccagatgtatgacacagatcgatccgggtgcatcaccaaggaagaagtagcatccatgctcagagctttgccagaagactgtctcccaactgacatcactgaacctggcaaattggatgagatatttgacctaatggatgccaacagtgatggaaaagttacctttgatgaattcaaagctgctatgcagagagatagctctctccaagacgtagttctctcttctcttcgcccacaatag

SEQ ID NO: 53822 - DNA, 498 bp, Glycine max
  Peptide Sequence Number=SeqID_170600
atgaggtttgctgcacatcttcatctttgtcacagctctggtgttgcccatgtcatcctctccgtcacagctcctccattcacagttcacaacatccgactctcacgcctccgcgtcttcctctctgttgcaaactctccgcatcgagctcctatgtcattcttgctaccactcgcggctagtctcattgccacttcgttgtcagtgtcgagtgaaatcaagcactactcaaaattggtggaatggtttgaatggctacttttgtactatttcttcattgaaaagagtgatgtgtctctcaaggactccaccttgttcggttttttattgtcaaaacctatcaaagctaacttcagctctttggcattgaggtgcaaggcaaagggtcactttggggtagttgctgctcgcccaagcgagctaaaacttagtgctgaagcaatgagctcacccaggcaagctggagctcgcccaggcaagttggcatcttcaccatga

SEQ ID NO: 53823 - DNA, 468 bp, Glycine max
  Peptide Sequence Number=SeqID_170601
atggttctggtgatgggtcccctccttgggaggattgcatcacagtatctctacacctatcttgaccatcaagccatagcggccaagctgtgcatgctagaaagggccaaggtgggtccgaacaacagccactcaggatgcaccaccaccaccaatcatccctcctctagccacctaatcttccgccagctagccctcctcttcccagccggagcaactaattcagatgatgcaaaacctccaccacgacaagtgcctcatcatccagaacctccattagctttccatccaactctcccttcagcatccactaatgacgccagaggacttcctacaataggttccttggccaggagtccagccttattttgtcggggggaggggggtgacacctctcccgtgagtaatgatgataccgcaaacacaggagctgatgaagattatgtggcagacatcattattgcttag

SEQ ID NO: 53824 - DNA, 1938 bp, Glycine max
  Peptide Sequence Number=SeqID_170602
atgaagcttgcttctacaatatttaagaagctggagatcaccattccctttggagagaccttacagcagatgcctctgtatacaaagtttttgaaggacttgctcacgaaaggcaaatacatcaacaatgagagcatcgtgaaattcaaagacccaggaagtgtaaccatctcatgctatattggggatgtgtcagtgggtagagctcttattgatctgggggcaagcatcaacctaatgcccccatctatgtgctggagaatcaggaatttgagaattgcttctactaggatgacgcttcagctagtagacaactctattactagaccatatggtgtagttgaagacgtccttgttaaggaaggaatagtgttaggccacaagatctccgctcgggggatagaggtggacaaagcaaaaattgatgtcattgaaaagctacctccactagtcaatgtgaaaggcatcaggagtttctttggacatgcaggattctatcagcgaatcataaaggacttctccaaaattactagacccttgagcaacttgctgaataaagatgcaatgcttaagcttgatgaagaattaaagaatttgagctcatgtgcgacaccaatgctatgtagttggtgcagttcttgggcaataccgagacaaggagatgctggtcatagtctacggattagagaagttcagatcatatttggtggggtccagagtggttatctttatgatcatgcaacaatcaaataccttctcacaaaagtagattcaaagccaaggctaatcagatgggtccttctgattcaagagtatgatatagtgatcaaagataagaagggctccgagaatgttggggttaaccacctttctaggttagcaaatgaagaaataactcaagaggagcaggaaatccgggatgaatttcctgatgaatcccttttacatgtgaatgagagaccttggtttgcaaacatggccaactacagagctgcagtggggataggacaactgttaaggtgctacaagttggattcatctagccttttatcttcaaggatgctcatgatcatgtgtttcattgtgatcaatgccagagaacaagggacatttctcggaggaatgagatgccattgcaacacatcatggaaacataaggtagcttcaccttctcatcctcagagaaatggccaggcagaagcctacaggactgctttcaagacttccactggactatcaccctttcagatggtctatgggaaagtctatcacttgccagagatgagactcaatgtctatgagttttccaaaatttataagcagaagataaaggtgtaccatgatcgaaagctgataaagaataactttcatcctaggcaacaagtattgttatttaattcccaacttaagctcttccctggtaagctcaagtctaaatggtcaggtccattcataatcaaagaagtgaagccttatggggcagtggagctagtaaatcctgcctcaagtgaacttgagagaagctggattgtcaatgatgacctcgaggaagcaccgaacaggatccagtcagctgcattggagggattcctcccgctttgcttccgagacagcttgggcatcagtggcacaaaagacttacccgccctacctgagaagcagattgatgtagtgttggtaaaggagttctattccaacatctatgatccggacgatggttctccgaagcagtgccaagagcgggggtggaccatcagattcaatgctcagatgttgaatgatttcttagggacccctgtcatcctcccggagctagagcagttgactacatactcccaatataatgtagctccatgtagagcttgtaggccttggatcttcttcatcaatggaatccttttcttcttgaagatcaatggcagtggaatggagaagtag

SEQ ID NO: 53825 - DNA, 369 bp, Glycine max
  Peptide Sequence Number=SeqID_170603
atgccgttcaagccattagaaacaggcaaatgtgaatttcttgtgaagttgaaagaagaagcaagctatgaaggtagcgcaaagttggttttgtcgagtgagtttaaggagtacaacgatggtttgatagatcatcgtagttgtattggtagtacaaagatgcttcctctcagtcacacgtgcataaccttcttcactgcttcttccattcatcgttgtccaacttctggattccctcaaagtttgttctcagtcgaaagggtgtcgtttgctgttttctgcaaccgagttaagcttaatgggaatgcatgggtctcgttaagattcaaaggctcaaattggaagccttatttgtctaacaacaattaa

SEQ ID NO: 53826 - DNA, 357 bp, Glycine max
  Peptide Sequence Number=SeqID_170604
atgaccactcttacacagatatggatgacgttgctacttagcaacattctgcctagcgaccacaatgccgatcatgacataggtaagtatgcatgtggctcaactgaagtatcagttggtctgtcccgtcatgacatagggatcgcgcccacaagacacccagtggacctggaggagcccaacaaggtcctagggtttctagctctgattacgggcctttgtcaattctatggagtgttcgtcgcccccaacaaggtcatcagaccccctactaaccgagctttcatcaagaagtattgtgcccccaggcaagcacagggcgaaacaccacaacaaccaggggatgatcggcaatag

SEQ ID NO: 53827 - DNA, 228 bp, Glycine max
  Peptide Sequence Number=SeqID_170605
atgaagcttacctcgacaccaacagtgacagtggcagcgagattggccgcaagtggtagtgagaacgaagagtcacgacgtggagagtttgtgacagagaggaacacatacgcggaggtgcgacacttgaatgttatgaaacgtgaatggaggagttgcgacaaagaggatgacgtgggcgacaccaaagctacggcagagacaaagatacacaatagacatgagtga

SEQ ID NO: 53828 - DNA, 237 bp, Glycine max
  Peptide Sequence Number=SeqID_170606
atgtctaacctgtcattaaaactgaaaatacttaagttagaacttggtgatgacctactcaagcatttagttatgatatcacttcctgcacaccttgggcaattcaaaagaaatgatgcaatcctccctagcaagggaccagtcactagagccatgagcaagaggctccaagaggattgggctagagctgctgaagaagaccctagggttctcatgaacctcagggtagatttctga

SEQ ID NO: 53829 - DNA, 402 bp, Glycine max
  Peptide Sequence Number=SeqID_170607
atgaatatcaactatgattacaaagttgtaaaaatagcttacatggttgtatcagtttatccaaaggatctaaccctatcaaagctgaagagttatgccaaaagcttgcaaagttggggaagccccttagctagtggaagatggtacggtacctttgggatgaggctcacccaagaatactggagaccaagaattcttattgagattgctacaacagtgagtaccttgatagctctggatgagtccactaggtcaaggaactttggccattttgctagattgttggttgacatcgacctctcggagataagaggatcgattagggatatattgtgcacaatagctcatgatttagattttgtcatcttattgtgcaaacaagttgtttgtccaaatgcctaa

SEQ ID NO: 53830 - DNA, 1479 bp, Glycine max
  Peptide Sequence Number=SeqID_170608
atgggtgtagctgatgttcacaaaactgccttcagaactcatgggggccactttgaatacttggtgatgccctttgggcttaccaatgctcctgccacatttcaagggttgatgaattcagtttttcaacattacttgagaaggttcttacttgttttctttgatgatatactcatctacagcaaaagtatggaggaccacctttctcatcttcatcatgttcttcttactatgagaactcacagtttgtatgctaagaaatccaaatgctactttggtgttgacaaggtggaatatttgggccattttataactaaagaaggattttccactaatccatctaaaattgtagcagtacaagattggaccctaccacaaaacttgaagcaattgaggagttgcttgggtgttgcaggttattacaaaaggtttgtaagtcgatatggtgcaattgcaaaacccttgactgatatgttgaaaaaggacaattttagttggtcttctgcagcaaaagaagcatttcaggaattaaagcaaaggttagtagcaacaccagttttggccttaccagacttttctaaggaatttgtagtggaggcggatgcttctggcctgggcttaggtagagatgctaccttgcaagagatgaaaaatgtggtttattggagaggcatgtccaaggctgtcatgttttttgtgtatcaatgtgccacttgccagaggattaaatataacactgctgcatctccaggactgcttcaacccttacctattcctgagcatgtatggcagaacatcaccatggacttcattgaaggtctccctctttcttttggtaaacaagtcatttttgtagtggtagataggcttagtaaggcagctcatttcatggccttatcacctccttatactgttgctaatgtggcccaatgtttccttgatcatgtctttaaattgcatggttttcctgacacaattaccaatgataaagatcctatttttgttagccacttttggaaggaatttatgtccttgcaagggattcaagtacaactttctatagcctatcacccacaaactgatggtaaatcagaagtggtgaatagattccttgaaacatatctcaggtgcatgagtagtgactctctagcacagtggtccaagtggttgcctcttgctgaatggtggtacaattccacttaccacagtactattaaagcaagtccctatgagattgtgtatggccaagatcctcttgtttatttaccttatctcctgggtgaatctaagattgctttggttgataggagtttgcagaaacgtgaggaaatgttaaagttactcaaattccacatgaagaggtcccaagacaaaatgaagcaacttgcagataagggaaaatatgataggagttttcatattggtgacttggtttatgtaaaattacatgcttatcgccaagttttagtgcaagcctga

SEQ ID NO: 53831 - DNA, 384 bp, Glycine max
  Peptide Sequence Number=SeqID_170609
atggggacaaatgctcgagtctggacggaggatgtccttagagtgttgagtaaatttcaccggaattgtgttcttcctaaaggcactaatgcaacttttgttgtgcttattcctaagaatgacaacccacatggtcttaaggaacaccatcctgttactctagtgggatgtttatataagattattgccaaggtgttatctaataggttgcgtagggtgctgcataaggtggtggatgaatcccaatcggctttcttaagtgggcagaacatgttggacaacgtggttgtggcgaatgagatgattcaagatgcaaagaagagacctagcccttgtgttatctttgtagttgacttcgacaaggcatacaactcgttaagatag

SEQ ID NO: 53832 - DNA, 522 bp, Glycine max
  Peptide Sequence Number=SeqID_170610
atgtggaggtctttcataaggcgcacattgttggccaaatggctgtggtggtttttgaaggagaaggatgccttgtgggtagaagtcattaaagctagagtcggcccaagcgtagatatgctgcataccctggggaggatgttggttggttttaggaggacatatggctcaaaaatgaagctctcaaggataaattttcaacaagttatactttgtttctcagcaatagaatttctcaataagtgggatgtggtgttgggagggggaggagtggaagtggatgttcgaatggagtgtatcttctatggaatagatattgtgactactgactacttaggagagttgaatggaatcgtgtataaggatgttcccagagatataaataatgtggtggagcttatccaaggaagatcgtggcacatgttccaaggcaatgcaaagtcaaaagatccccttggtctcattttgggattggtcctctacgttgagggtggtgatcaccagcccaataattgggggtag

SEQ ID NO: 53833 - DNA, 315 bp, Glycine max
  Peptide Sequence Number=SeqID_170611
atggttgattttgccaagatacaaccacatggacaaatagaccagtattcaataggctataggcccattagtgaggtttatagttggaaaggaaagagagtgaagggaacaaaaaatgaaacaaaggatgaaggctcaggagtgtatgagaggaggagggaacatattccacaagggaaatttgtgggaatgaggagaaaaagagataacagaattggcatggtcaataggctatcaatatttgtgagaactcactcccttgatttgctcatcaacaattacttacactggactttagagaagcacaatccttag

SEQ ID NO: 53834 - DNA, 702 bp, Glycine max
  Peptide Sequence Number=SeqID_170612
atgagacatctttatgaattttatgtcaatggagttttacctagaagttgcaattcttctttcatcacccttattccagtggtggaggatatgcaagaacttgatgagtttaggtctacatcattaattggatgcatatacaagattgtggccaaaattctatcaagtagaagcaataaagtgttggagtggatcatagatagaagaccaatggctttcattagggtaaggaatatgcttgatgggggtgttgggtggattaagagttgcttggaatctaactccatctctattcttgttaacaggagccctttgaatgaatttcaaccaaagagaggattgagacaaggtgatccgcctgttccatttcttttcctaattgttgtagaaagacttagtagcttgatcaagcaagtggtggaaaggaatatgtttgagagctataagagattggtgaaaatccaaggaaacaatagggatagattcctagacaaggtgaagaagaagctatcaagatggaagggcaaatgtctaccatttggtgggagaatttgtcttatcaaatcaatacttacctctttgcctatctacatgttatctttctttaaaatgcctttgaaagtggtgaaggcatttaggaaattacaaaaagagtttttatggggaggatttgaggagatgaagaaaataccatgggtctaa

SEQ ID NO: 53835 - DNA, 561 bp, Glycine max
  Peptide Sequence Number=SeqID_170613
atggcggggaaagagatggttggcgttggcatggcagccattgggctctcaatgaaagcaccaaatgttaggcctgtttcctccttctacaattccttcttcctatcaaaatacctagggtgggaatttttgggtgttgagagggcagtgaatcggggtttagtacgtggcttgatttggacaaggtgggcaaagtgtgtggagataacaatcctagaagatggttcgacaacaactgcaaaatggaggattggggtagggaaaggtatcaagatatggggagatggaaaactgatagatgggtttgggatctcaaatggcagcgacaatggttccaatgggaaacaaagagtgtgggggcttctgagggatgatcttgagagagtgagattcgtgagaggggcactagataaaagagtgtggaacctaaaaaatgagggggaaggaggtcgcgacgaagttcctgaagggagaagggggactcgaggagaagtggaaagaggaggaggccacaactgtagtggaggggaaggaggcagtgacgaagggataaatgaatag

SEQ ID NO: 53836 - DNA, 252 bp, Glycine max
  Peptide Sequence Number=SeqID_170614
atggatgaagatcagtggatatatgacaacataatgtctgaagaagttaatatgaatgaagaaaatagagagcaacctggtgtgtttgaaaatattgattgttctaatgccttcaatacttataaggtatttgctacccatgatgatgttttgtattgggttcgctttattgcatatgatattagttttggggaggtgattatgaggtcagacacatatactggaaatagaggaaggacctcatatgtttaa

SEQ ID NO: 53837 - DNA, 729 bp, Glycine max
  Peptide Sequence Number=SeqID_170615
atgggtgaagtagatgaggtgcaagagcggataaaggcggacatagaggccctgaaagggaaaatgaccacaatgatggaggccatgatgagcatgaataatggaggccaggaaggcaaagagttgggaagtacggatggcccccattttgtgcgagttcaaaacgagcatgccttcccgccatatggcttgcctcctaactatacaccacccaatgtggtgcaccctctcgatgagaatgccaataactccactcctatactcattgagagccaacaaactcaagctgatcatgcacatgtctctcaacctatgagggaggcacatgaaataccccaccactatctagccgactcaagcctcacctccgatacgccactatggggcaagatcaaggccattgaaggaggcgaagattatgcctttgctaacatagaagatttgtgcctagtacccgacgtggtcattcctccgaagttcaaggtgccgaacttcgataagtacaaggggactacttgccccaagaattacttgaaggtggtgggttacacacctttaagctttgctgatttcgttttcgtcggcgaaaggatcgaagtgcgtctgagaagaggcaaatttgattatcctgcattggtgaatgaggaagctgcggcaaatgaagagaatgagaaggaggaaggaatccatgttgtgattgctgttcctacatggctaaatttctcgtaa

SEQ ID NO: 53838 - DNA, 120 bp, Glycine max
  Peptide Sequence Number=SeqID_170616
atggtgcttgggagcaatatcttggactggaacacgatgacagtgctccaaaaatgtcctatgcagtcaaccagctttgtgctagctgaactccatattatccacgaccatggttcataa

SEQ ID NO: 53839 - DNA, 513 bp, Glycine max
  Peptide Sequence Number=SeqID_170617
atgaagatgaaagcaaacaaaacaagaaatgaattgaaagcctcggattcgaacacttaccagttgaagatcgaagaacggcgaagaacgatgaaaaatcttcacgaaatcacccatggaaacgtctcagaagcgttacagaggcacctcggcttggattttcttcatgaaaacatgggtcaggcaccctttggaacaaccctcctctaccaatttctagaaaaaaggggtggagtttgccacccaggtggcttcctcaggaagcttcctgaggcacccccctttttactaagttcatcccttttttttcgtaatttacgaaagcatatcggagtgaaatatacttatttaggtttacgggtgtcataccctaatttcgtccggggactattgtttgatggcatgcaacctttggttgaccgcttcgaggtacttggcaccctttgttgcacaatacgtgaagttccgagacatgccgaaagtcaaaaggaagcattgttacgcaatccatga

SEQ ID NO: 53840 - DNA, 231 bp, Glycine max
  Peptide Sequence Number=SeqID_170618
atggaagccaaatccaagcagttcaaagagcttgatgaaatagcctaccctaatctaaattctatgcgtgttcctctagaaaaggtgaaaacaaaaggtgctcaaaagaaacagatgaccaaacatcaaagatcaacaaagcgtgatccgtcttactgggagtatgtggatgcattacattatgtgcaaaatagcaattcttcaatgaaacaacctacatcatcatcttaa

SEQ ID NO: 53841 - DNA, 213 bp, Glycine max
  Peptide Sequence Number=SeqID_170619
atggtaagtaattccaatgcaagtgcttcaggtcaattgtttaacctacaaaaatcagaagtggcttatagcaagaatgtggagaaagttataaagggtttagtgacttctactttggggtttagagatgagcatgtcaacgaggcaaaccggtggcgggtttggttctccccatcctcgtttccagaaaaagacgggctgagttcgagtcgg

SEQ ID NO: 53842 - DNA, 232 bp, Glycine max
  Peptide Sequence Number=SeqID_170620
tgctttgaaaggacttgatgatactccacaacctaaatccaaggctgctgctaggtggattgttgttaagtgtaatagacaaaaaagaagtactgagtgcggctattacgtcatgcactggatgtccacgataatcttaggaattttcaggaataattggaaaatgtattttaatgatgttagaccattggaagcagagagattcaaggcgcttcgcatccagtgggcatag

SEQ ID NO: 53843 - DNA, 225 bp, Glycine max
  Peptide Sequence Number=SeqID_170621
atgacggggatgcacgatggaatggaaaaatgcatgttgatcacaacagatgggaggaatggactcacggcacagcacaggggggaaggagacgtcaatggtgtttggtgtcgcggcacaacacggaggggaaggaggtgtaaatggagtggggagggatggaagcaacagccatctgaaggagtgagaattgtgatttgggccttagttttgtggggctcttaa

SEQ ID NO: 53844 - DNA, 906 bp, Glycine max
  Peptide Sequence Number=SeqID_170622
atgtctcctccaagtccattcggcctctgggccagcttgacgagctcgcccgggcaacccaggcatttctatttctcgaaaaagatatcataccataccataccataccatgcaagttttagggatatgcaagacatgagggactgctatgacaccttgctttccgccgccgcagcaaccgccagcagtgcttatgaattctccgagtccttgcgggacatgggctcttgtcttcttcagaagactgctttaaatgatcacggagatgaaactggaaaacttctcctcatgcttggcaaaatccagttcaaactccacaaactcattgatcattatcgttctcatatattccagacaattaccattccctcagagtctctcttgaatgaacttcgaattgtcgaggagatgaagcggcaatgtgacgagaaaagagacttgtatgactatatggtaacaagatatagagaaggaggcaggtctaaaggtggcaaaggggagactttttcattgcagcagttgcaaactgctcatgatgaatatgacgaagaggctacattgtttgttttccgattgaaatctctgaagcaaggacaatcgcgtagtcttctaacacaggcagcacgccaccatgctgctcagttatgtttcttcaagaaagcagtcaagtcccttgagacagtagaaccacatgttaaatcagtaactgaacagcaacacattgattaccacttcagtggtcttgaagaggaggatggggatgaaggtgattatggagatgatgttggtggtggttatgatgagaatgatgatggggagctgagttttgactatggacaaatcgaacaagaccaagatgtttctacatcacgaaactcaatggaggtgactaccttaagaaactag

SEQ ID NO: 53845 - DNA, 1116 bp, Glycine max
  Peptide Sequence Number=SeqID_170623
atgagcattagagttgtggacaaagatgttttgcagtcttgtgcacagaaactttgcatccttgtttgcttaaatgtgactatctgctctatgcacttggatcaggtggaacttacacttcctagagattctacagctgaagctgctaaggaaaacttagacaaccttgtaaggaatttgttttccttcaaggttagggcagggagccaatctgccccactttttgctgataataaaccagatgcaagtgaaaaactgagacaaatgcgcccatctttatcacggaagttcagttcatatgtgctacccacaccagttgatgctaagagttcaacctcttcagggtcaaataatccaaagccttccaaaatgcaggcaaatttaaatgaacctacaaagaacttgtggcattcatccccattggaacaaaagaaacaagaaaaagatataggagatgagttttctggttcaattgtcagaagtgcacagtcagtactcaaggaaagtaatagcaatactgcctccatgagattgccgcctcctttaatagatagtcttttatcctcaaaccgtgattacatttctgcttactctaaaaagattaaaagacatgccttttctggcccattgacaagtaatcctgggcctaccaagcctgtctccatagaaagtgttcaactgttctctggacctcttttgccggctccaatccctcagcctccgtcatcatctccaaaagcatctcctagtgcttctcctactcttatgacttcacccaaaataagtgagcttcatgaacttcctaggcctccaaccagtttcccctccaattcaaggcttttaggtttagtgggtcattctggtccattggtgtctagaggtcaaaaggtgactgcaaataatttggttgcatcaagtgcagcatctccactgccaatgccacctcaggccatggctcgtagtttctccataccttctagtggcgcaagagtggcagcattacatatgccaagaacactagaatcctctcatagatcatctatatctgagaatattgcttctcctcctctgatgccaatatcattatctagtagtcggccatcattagatggctga

SEQ ID NO: 53846 - DNA, 338 bp, Glycine max
  Peptide Sequence Number=SeqID_170624
atgtgcagggaagttatccaacttcagcttttagatttaggtgttgaggtcagcccagttttgccacctggcgatcaaggaagttcacaactttcaagggcaagccagctatcatcaaaggatgcatttctttcaaaagctgaagccaaaactatttttgagatcaatggcatttctgaggatattgtttgtgttatggtgggaactattagcaaaatagtcatggataatcattcatggtgttatctagcttgcgttcaatgtcatggaaaaattgacatccaaacaggaccattcacatgcggatgtgacaaagataatgatcagcctgttctaag

SEQ ID NO: 53847 - DNA, 453 bp, Glycine max
  Peptide Sequence Number=SeqID_170625
atgtttatcaccattcaatgggaaacacttgcttccaatcttgaagatttttcaaaagtagctgaaaattttgcaatcagcaagtctactgtggaagttgttgttagcatgaaacttcaagatgatgctattcctgctcttgaaaagcttcagaagatatggacatcctttagtttagtcactccaaacctttctattcgagaggctatggtcacaaatattttactagggaagaatgataacgtggaaggtgtttgtacattctttggaatgaaattctatgctccgtctgttattctcaccacagggacttttatgagtggtaaaatttgggtcggtagaacttctatgcctgcaggaagagttggcgagtctgcttcacttggattaacaaaaaacttacaacgacttggttttgaaactgatcggttgaaaaatggaacccctgcctga

SEQ ID NO: 53848 - DNA, 195 bp, Glycine max
  Peptide Sequence Number=SeqID_170626
atgaagatggacttccctatgggggctgcacttcatgcatcattggccactagttatcttgcaaattatcagcaggacatagccagggtatggtacaacttgaagaagctgacctatgaggataggaaggctaagttcatttcacgcgtggcggctctcaactctactatcgataacgatgaagatgatgagtga

SEQ ID NO: 53849 - DNA, 269 bp, Glycine max
  Peptide Sequence Number=SeqID_170627
atggcatctcctcacgcgcgcagatccgcctgctggacaacaccttcatgcggttggtgttcagcttcaccgccgtgcctttcgtcggcatcccgttcgccatctggatttatttgctgggggatgaactcggcccaaccattgcctggatcatggtttacctgctatgcgccgtggcgatcagaatatggcatcggcgctaccaatgcgaggccaaagaaaatgatgaagacgccgtgctgcgccgctggctgccgcgcattaataag

SEQ ID NO: 53850 - DNA, 294 bp, Glycine max
  Peptide Sequence Number=SeqID_170628
atggatggtcatcaacgaccaacgcataatcctgccccaaaggattctcctttcgccttcacagttcagataggcggaaaccgccaaaatgctgggcctgggctcatcggacgaaattaccgtgaccaatgtcaatggcgcaccgccggatgcgctgggcgggcaaaaactttcttatcgcgccaccacggaaaaaggccgcattttcgattgctcgtcgctgatgatgccgggaattttaggttcgtcgccgtcgctgagcgcgccgacctgtacgccggtggtcacgcataa

SEQ ID NO: 53851 - DNA, 123 bp, Glycine max
  Peptide Sequence Number=SeqID_170629
atgacgacgatggcggacatggcggacatggcggtaacaatctttagtggtcgcgaggcttgtgctcatagatacaaaagatggattccactcatatctccttcaaaagatggaaatatgtga

SEQ ID NO: 53852 - DNA, 516 bp, Glycine max
  Peptide Sequence Number=SeqID_170630
atgctcggtagttatttgtcaaaaagaaatcacaagggtttggtgttgggggccaacaatacgacctgcgtctgtgtaattgtaggtgccaaacatatggttgccgagatgaatgtccgtgaattttccatctctaagaatgaccgtacttcaaattccaattccaaatttcttaccttgcccaccattttgactcttggccgtgtcgccgctgtacctcttcttgttgccaccttctacatggatggttggcgaggaacagttgttactacaagtatcttcactgctgcagcagttacagattggcttgatggttatattgctcgtaagatgaaaatgaaatctacatttggtgcctttttagatccagtagctgacaagcttatggtttctgccacattggtcttattatgtactagaccgttggaagttgctgtgtttcgacaagtaccatggctattgattataccttcaatcaccataattggcagagagctgcaaaccaggttctactaa

SEQ ID NO: 53853 - DNA, 231 bp, Glycine max
  Peptide Sequence Number=SeqID_170631
atgcctgatctttcattccaagttagggatttggttgagtcaagatgctttcaaggtggttgtcgtggtgcatggtttagatgcaagttgtctacagctgatatgacagctgtcaaaagttgtactaacaaaagaaaagtaaacccatcagagaaggtatactctattaccccgcaagctcatgaggggttggctgaaagattttcaagcattctgagcctttctctatag

SEQ ID NO: 53854 - DNA, 309 bp, Glycine max
  Peptide Sequence Number=SeqID_170632
atgggttccaaggttttgcttgttctagttatgttcatggccactatacttctgatttccgctgcacccaatgaataccagaattttgacaaaaaagatgggaagcctgctccaaatggggaatatgatagcaaatggggttacggtggttggggtggtccttggtatcgcggctggggtggcccttattatggcggtggatggggcggtccgtggcacggtggtggctggggttggcacggtggctggggtggttggcgtcctaatgaacatgttgaggctgggattaatggcaaccttaacaactaa

SEQ ID NO: 53855 - DNA, 558 bp, Glycine max
  Peptide Sequence Number=SeqID_170633
atggaagccgtggataccttactctccgatcgagagtgtggtttcattgccttgaggaagaaattgcataaggctcaagaaattatgaagctgacagcagacaagaagcgtagagaggtgcagttccatgtcggtgatatggttatgattgggcctgttgcgtataagctgaaactccctgaagatgcacgtatccaccccgtatttcactgctccatgctcaagccattccactcacctgtcttagctaatacttctcccacccttgcattaccttcgctgattgttaacaacgagcctgtgatctctccgacggccattgtgggcacccgttatacctctaattctgaaacacctaagttacaggtgctggtacaatgggaaggtttgcttcccgaagataccacttgggaagattgggagcaacatcaagataactgccaccttaagggcaaggtgattcttgaaggcccaggggatgataggaatcgtgaagatgcatcagctaggccgaagaggaagagcagtgctcgttcatacctgaaggactacatataa

SEQ ID NO: 53856 - DNA, 180 bp, Glycine max
  Peptide Sequence Number=SeqID_170634
atggtggaagcatcaatggcggagaccaacaacgtggctatcaagttcatcgagaaggaggatctcacaatcgttgagagcttcgcaattgagggcgtgaatgccttgcgacaatcagatcgaagtcacaacctcataacgacgacaaatgaagaagagaaacctcacgatctaatctag

SEQ ID NO: 53857 - DNA, 261 bp, Glycine max
  Peptide Sequence Number=SeqID_170635
atggcgatagatggcttcaattttcagaataccttacaccgacatccacccatggttcatgataatgcatttgttgaaccacctcctgcagctgctaatgtagatatgtctcgacatgcaatggacgcttgccaacagataacaaaaagtttggaaaacatgatcaacatgagaatgattactattggaactgaagcatacactctgaccaagcactgcctgagattggccaggggtgtcactgagcaatggaatgtttat

SEQ ID NO: 53858 - DNA, 156 bp, Glycine max
  Peptide Sequence Number=SeqID_170636
atgtatgacaatttgaatgatgcgtcaaagagttcgacaaaacatcttggaggatatatcactatgttaccgcgttggatctacgagcatttccttaaaattgcttccattgttgctgatgaagattatcatgagaggaaaccacgtgcttgttga

SEQ ID NO: 53859 - DNA, 561 bp, Glycine max
  Peptide Sequence Number=SeqID_170637
atgacagtgccggtgctagccactcctaatttcagtcagccatttattttggaaactgacacctccgacatcgccatgggcacaacggcctccatatatgtccgtgagttgcacgccatcaccgtcgctatgcgcaaatggcggcactgcctactgggtaaccatttcactatactgacagaccacaggagtcttaaagaccttatgtcacaaatcattctaatattggagcaacaacactacctgtccaagctcttgggatatgactactcaatccagtatagaccaggttcaggcaacgttgcggtcaaatatgaaaatcgaaaatcgaccggtcttctgcaacctttacccattccgactactatttgggaagatcttgcccttgatttcatcatagatctgcccttgtcgcatggattcttagctatccttgtcgtaaatgaaaaattcgctaagcgcgccctctctagtgctttacctgccaagtattctgctcacaaggttgccctgctatttctcgacaccgtctgcaagctgcacggattccttcatgtctga

SEQ ID NO: 53860 - DNA, 867 bp, Glycine max
  Peptide Sequence Number=SeqID_170638
atggttatagtcgagaaccccaccattacccaccatgacttgaagtgggtcaatggaggaggtgggaaggtgcaaaaagcttgtgattcatggttggacgaaattatgggtactcccaccgtctacgaggatagtcacctgggaaatcgtcgggtggattgtcacaggcaaatgaggctccagttcttcgtctgggataaggaggatggttcgtcgagagaaggagggagggcaggatgtgggagccacgagcagattgatggcgatcctgtagcttatcctcctataattttgctagcgccaccacttgtggtaatgacaggggttgtaatgcttgtacctcgcaacggagtcgttgcgcgacatccattggtactagcaaagggctgggccctccatgtaaaacgaggacaccgtgaggcgttcgttgttcgatatgcattggtacttgaagaactaggtggtttcggtgtagggggtgaaggtggtgaaggaggaacgaagagggcaacaagacgttcaacgaggaagtcaattttgctgctcatttattgggcctgggaaagggaggtgtggctttggacaagggagttctggccttgggtaagtcgattgactgcctcctcaaggcgttccgtggttgctaaacgagtattgtggtctagcatgacgagaatggcagagcaaggtaaaggcgcaaggaataaggatgaagcgaagtcgaacggtagaaattcattgctgaatgcgcatctccacaagtcgttcaatgtgtccaagtactccttgttgaggattgtgagtccattgtttcctgcagttgagaagctcctgtcgttgttcaaggattcttgtaaggaactgtaa

SEQ ID NO: 53861 - DNA, 471 bp, Glycine max
  Peptide Sequence Number=SeqID_170639
atggcgctgactttttccgggtctggagcttcgccggcagctgaaacaatgtatcccaggacattgaaaacttcctccaagtgggataggtgcagtgtgagggaagtgttgtacacaagaatatcgttgaagaacactgcgacaaacttgcgtaagaatggtttcagcaactcgttcatggaggcttggaaggtggcaggcatacttctgaaagtgtgggtacctatatggatggacgttgactgggttgatctgtggaaggagggtagagcttcgaggggaagggatgaaggttcattgggttgggccggatcagataaccaggcaaggtggagcatggtggttatactctgtgtttgcgctagccttttgagttggtgggttgatgccatggttggaagtaacgacacatcaactcaaaggtgcacttgctggcccaaatatgagaacaccattgttctggttgtgtaa

SEQ ID NO: 53862 - DNA, 411 bp, Glycine max
  Peptide Sequence Number=SeqID_170640
atgaagaagcttgtagacacacaccgttgggatgtttcgtattctacgggtgactgggtcttcgtccatctacgcccttaccgtcaggtgtctgttcgaccatcctatacaaagctttctaaacgcttttatggtccatttctaatcctggagcgtatcggaccaatggcgtatcagcttcaacttctggcttcatccaaaattcaccccattttccatgtttcattattgaaaccatatcatggcaacccaccatccacatttggacagccatccagtggtagaaccactctcaatattggactggaagatagatacatccagtatccctcccacttaaaaggtcttagtgtaatggctcgggctggctccagaagacaccacttgggaggattgggattccctacgtga

SEQ ID NO: 53863 - DNA, 696 bp, Glycine max
  Peptide Sequence Number=SeqID_170641
atggatttatccaattttggaacaggtcgattttctgcacacaaaaatatcccaaacacaagagatacttcagagtctgaccctttcgttttggggatccaaacagaatggcaactgcaacaaatgattcgttatggtcatcgaaatgttgttgcagcagactctacgtttggcgcaaagagacttaaatatcccttgttcacactacttgtttttgattcaagacaacatgcacttcctgtggcatgggtcattacacgtagctttgcaaagcctgatgtgtctaagtggttgaaagctttaatcgatcaaactcgtagtgttgagcctggatggaaactcaatggatttttaattgatgacgctatagctgaaattgatcttttgagaaatatggctttcaacaatgagaaactttccactagcaagccaggaagcttctggatcattagaagcctatcatgtaacctttgcaagcatgttgtcaaagtaaacgtgatttatgaaaatcttaaaggttatcaacaatccatgtctttccggtcttttgaagaggttttgatggatctatggaaaaagccagtagatgattcttttgcattgaaaggcagaacctacatcggcaaaccatcaagtttgcctcttcctcatggtagtagtaacacaaaaagtgttggtgtgcataagaagaactag

SEQ ID NO: 53864 - DNA, 678 bp, Glycine max
  Peptide Sequence Number=SeqID_170642
atggactggtctctttgcacaaagagagatgatctatgggaaaaaaatggctctaatctatggaagggtgtgtgcagtagctggaggaattttcaagaaaaccttggcttgaatattggtgatggtactaaagtggaattttgggatgataggtggggtcctggaagtgatgaatcttgtcagagatttgatgttgatactgagaacttggatcggattttccgaaggtgtcctatttctagagctatatggtatatgcttttgcctcaaactatgcattcagaattcttggtccaggatttcaatttatggatgctcagttatttgaagaatggcgagagtgtaaatggtaggcagtggtaccacatttttgctcttgctgtggacaatatatggcagtgtagaaacaaacttatttttgagatctaccaggttcaacccactgttatcgtttctcagatatggagacaagtggatgctattttggatagtattcagtatattgattccttacattcgatctctttgagtgttaaggagagtactattaattcaagtatgaagaaggtggctgttggaggtgtttttcgtgactcaaatggccaggtgatttttgcatatgctttaaggggaggctcttattgtgaaggcatatgctgggagaaggaaatcaagtga

SEQ ID NO: 53865 - DNA, 528 bp, Glycine max
  Peptide Sequence Number=SeqID_170643
atggtgttcgagagtgcttctcgatcgacttccatggctgattcgtacattgggagcttgataagcttgacctctaagagtgagatcaaatacgaagggagcgacgagtcaatgatggcgaaggcggcgatgatgggtggggtcctgtctggaaaaagcactgttgttggtgctcagctcgtgtccctcactgtcgctctcgcggtctccctcactatcaatctcatagtctcactcgttgtcactctcacgcttgttgtcgttgttgtacttgactttggcgttaatgatgagcgcgaacaaaaggacaccgcacaaaaggtaataacttttgcagactcgctgatactatccatctctcaaacatgggatcggaaggaagcaagttttatcaatgaagatagaattcaaacatttgcttttggtacaaggattcctacttcttgtcaggatggtggtttccctggctttactgctcaactatccttagtgatccatggctttctgatggctacactttggttatag

SEQ ID NO: 53866 - DNA, 267 bp, Glycine max
  Peptide Sequence Number=SeqID_170644
atggattcggaggatttccaatccattctggagagtgtcgacgtttgggccttcatggacgccgccatcgcagtggcctccgtcaaccacgctgacgagttgaagcgccgaagagacagaatcgtggagttggtgacgccaaggaattcagattttgcaaacttggatgctcaccaaatggctggaattgccgatcctgatgatggcatatttaaaagtgtacctgttgatgaggtcttgaagcataaaaattcttcaacaatgtga

SEQ ID NO: 53867 - DNA, 378 bp, Glycine max
  Peptide Sequence Number=SeqID_170645
atgtctaatccttggaggtttacagtagggaactggttatgtgactcagatctggttagtcctactagaattgaacgggttctagccgaaaaagaccttctggctgactcatattcagacctagagacttctatccttgatgaaaaagaatttctcctattgaaggttatctctacctttccggagttatcttgcttgatatgctctatggttggagcgggtcggggaatagacggtgttgccttatccataacccatctttcgggaagagttacctcatcccattttatttttctcgggagagaaacgttagcctttgtcatatcagtgataaacaaggctgctgggattgatccgtctttcatgtcaaggccatga

SEQ ID NO: 53868 - DNA, 272 bp, Glycine max
  Peptide Sequence Number=SeqID_170646
gttatacgaaccggctctccacgcaatcgagagaatgttgctgctgtcttgtggtcactatgcatcggagatccactgcaattaaaactagcgaaagaacatggtgcagaagcagcactacaggagttgtcagaaaatggaactgatagagctaagataaaagctggaagcatattagaactcttgcagcgaatggaagggggacctgctatcaagtcagcagcaacaacagaaccaggtagtcaaaacggaaagaaattggaaggtgggag

SEQ ID NO: 53869 - DNA, 228 bp, Glycine max
  Peptide Sequence Number=SeqID_170647
tatttggaggaagaactgtccaccaatgtgatgaattgtaattctctagacgagaaagctcaagcactgtgtaaagatgctgatgatctacttgctgcaagcagtggagtagaggatgagggtaaagttgctgaagtaaagcagaatatactcaactcaacctggtccactgacctaagaagccagcttcgtaagattaagaataccattcttggcctgtctgattaa

SEQ ID NO: 53870 - DNA, 480 bp, Glycine max
  Peptide Sequence Number=SeqID_170648
atggctagccaaggggtcattcaagtgtcaataagccttgtcaccttgaagcctatgccttatcttcttgtcaagtggcacaactatttgactaaggggaagaaggttctgggggatgtggaggagctcagttggcaggttgttagaacgtatataagagtgcaaggggaaaactcaaccaccaaggacaacaatgacagagagacagatgtagaaagtgatgttgcaagaagagagtttgatttaattgaggaaacggtattggttgtgaagaaggaatcacggccaaaactgcttatccaagtcagcaagaacagatcagaggccaataaagcaaaaattccaggaattccgttgtcagagaggccacaagcagaatctgaatccactgaagcagaagtgaaaggtaaactgatatggattgattccaagcaacagacaactcgaggcaaggttatcaaattgagactcaatttgtga

SEQ ID NO: 53871 - DNA, 907 bp, Glycine max
  Peptide Sequence Number=SeqID_170649
atgggtacttcttatttagctaaaaaccaagatgatgacatcaaatctctatggaattatgttacaaagataaaacgtgcaagaggtagtggccatgaaattaaatgcaatctatgtggactgaattttactgggtgttacactagagtaagggcacacttgttaaaggtgagaagaaaaggagttagagtttgtgaaaacgtaactccatcaagacttattgagtttaaaaatattgacaatgaggctactgcactaagagtacagaagtcaaaggcaaaatctatctcttcccgtccatttctaatgaaaaccaagagaaaaacattagtgttgatccaagaaaaaagaaagagatctagagagactcttgattatgaaattgcaaaggatgaagttcatcctactatagttcaaaatgaccctcctatcattgaaagatgtgagggcgatgatatcaaactagaatcagtatccactagcgaacttcaatctgtagacttttcttccagcattacaggttctgattcagatgatcccttcgatcaagttgataaaaaattctctgtatgtggcaaggaaaccatgtcatctggggcatgttctggagatgcgtctctaaaatctattagagatgccataggtgccttggagctgttaatgattagggacttatctgaagtctcttctgatcctgtcatgcagtctcaacttagtcacttcttggatctattgactacaagtagccatccaaaggtgacagtagagttaggcactctttttgtgttcaagagaatggcctttgcttcattccaagaattccaagctactgttgagtctgtgaacaaactgaagaactttgagaagcaaaaggccagaattcagaaggagacttcagcaggaaaaa

SEQ ID NO: 53872 - DNA, 265 bp, Glycine max
  Peptide Sequence Number=SeqID_170650
atggtggtctcgaatgagagcctgagctactctttcggtctatccaacggtttcgcgaagaagcccatgctctcaatgacggtggtggagtcgagagacttcctcatcccgctctctgaatccatcgcgttccacagactccctttcttcgagaccatcgcggtcatcaccaaggccaagggagctaacctcttttgctggaaccaccgccgtggattcctctgcttagccaggcagaagcacatttgcatctttcgacacgacg

SEQ ID NO: 53873 - DNA, 618 bp, Glycine max
  Peptide Sequence Number=SeqID_170651
atggatcaaaaccagcatggtcaaccaacacaagaagcagttggcaagaaccaatatcaatctaatcctatgatggcacctaccaatcctcctagtgagactattggtccttatgtcacatcatccttccctagagagaaacaacatgctccccaagacatttaccaggaacaactcaacaacttttgggcaaaacagtgccaggaaattgaggagaccactgatttaaggactcacagcttgccttatgctaggattaagaagatcatgaaggctgatagggatgtgaggatggtgtcagctgaggctcccgtgttgtttgccaaggcctgtgaaatgtttattatggagctcacaatgaaggcttgggccaatgctgaggatcacagaaggaggatacttcagaagagtgacattgcatctgcaatctcaaagactgatgtgtttgattttcttgaggatattgtccccagggatgtaggcataccaagatcaagcattgctcaaaattttgatctaagtatgccaccacatcagaatgtcacatacccaccatattatgttccagcaatggtcacgggaagacccattcctgatcaaaatcatcatgggccgtaa

SEQ ID NO: 53874 - DNA, 876 bp, Glycine max
  Peptide Sequence Number=SeqID_170652
atgctggccattgggggacatggcactagtatccgcacaagctctacttgcacggctttgctcagagaacttgcggtctttctctgtctttggtgtttcagaattctgggttttgaggaatttgttgggtgcaaaaataaggatatgggcacaacagttgaggatgaacaggacttgtcacttgggagacttaatgaatataaaaaagaaaagaccgtgggttatgttcaccgaagtttgcatgggactcaggtggaacagtcgactaatattagcaatagcacattggaaggtctagagcaggccattctcaagttaaaaatagaaaggaaaactggaatttcagaagaatcagaaatcactgaacgaggtgttctttcaacagaaatgatagagaagggttcagcagaagtggacaggcttgccaaactaaaagcaagcagaatgaaagaacttgtttttaagaagaggtcagagttagaggaaatatgtagattgactcatattgaaccagatccaagtactgtggctgagaaagctagtgcattaatagattctggactggtggatccttctgagctattagccaaaatcgaagaacagataattaaggcaaaagatgaagttttgagtagaaaagaagtaacagataggattgataagtgggttgctgcatgtgaagaggagaattggcttgacaaatataatcaagataacaaccgttacagtgctgggcaatgcgctcacattaatcttaaacgtgcagaacatgctagaataactataggcaaaattccagcattttttaagaaggtatatgcaggtgtcaatgccatgcaacaaaaagaggaagataagagagacgacaaagggtaa

SEQ ID NO: 53875 - DNA, 189 bp, Glycine max
  Peptide Sequence Number=SeqID_170653
atgcctgatcttccattccaagttggagatttggctgagtcaagatgctttgaaaaggtggttatcgtggtgcatggtttagatgcaagtgatcgcaagaggtatggtggggaaaacagtacttattctttctttttaacacaacagattctgattgttcagacttcagtgactattcccttgcattga

SEQ ID NO: 53876 - DNA, 312 bp, Glycine max
  Peptide Sequence Number=SeqID_170654
atgaccataatttgtctctgcgtgccatcaaactcgatcgtctctggatggcgaaaaggtgtgtggatgaccataatttgtctccgcatgtcatcgggctcgccgcctctggatgacaaatggtacagaatgaccataatttgtctctgcgtgccatcggactcgatcgtctctagatggcaaaaaggtgtgcggatgaccataatttgtctccgcatgtcatcgggctcgccgcctctggatgacaaaaggtgcagaatgaccataatttgtctctgcgtgccatcggactcgatcgtctctggatggtga

SEQ ID NO: 53877 - DNA, 505 bp, Glycine max
  Peptide Sequence Number=SeqID_170655
atgacaacagggggtggcaagattagcgctttaataacagcaacttaccgtcttaaagaggttaagacctgcctcaacgttagaattcagcccaatcccgtagctttaattattttgcggcatcaggtgaaggagaaaattcctatcgcatcgccgccgtttaaaccgttacgtcgtatccgtccggcgctgctgctggccggttcaccggcggcgctggcagataatggcgcgactgcaacaggaccggaacaaactctgaatctcagcaaccagacgttacaggcgacgggtaaagatcattacgggttgctggttgagagcggcgctaaggccagcgccacggatgtaacggtattaactgatggcgctgatggctacggtgtattctccacgctcgcttcttctgatattcagatgacacgctgcagcgtgcaaaccacgggcgatggcggctacggcgtggtcgccagcctgaccggcgcatttaaacttgatggcaccc

SEQ ID NO: 53878 - DNA, 624 bp, Glycine max
  Peptide Sequence Number=SeqID_170656
atggctaactttgttattgttgatgatcatcccattgtgcgcgtggcgataagactggtgctggaaaatgccgggcatcgtgtttcagcagaggctgttgatggcgacaatatatttagcctgatcaaagagaatggcgccgatgcggcaattattgatatagatctgcccggcattgatggtattgaagcggtcaggaatcttcgcaccgcgggctcattaattccggtgattgtgatgagcgggaaaaacgcggaattttacgcctataagagtaaaaaagcaggtgccaatggttttatcagtaaaaagaacaatctgaacgacctggcacaagccgttgacgcggtgctttccggctatggttttttcccgctgcgcctgagtcaccaggcggagggcgatcaactggtgcaggacagcgacaaattgctgctgctgtcgcatcgcgaatatgaagtgctgcgctacctcggtgaaggcaccgagattgtcaaaattgccaaccgcatgaagctcagcaataaaacggtcagtacctataaagccagactgatggaaaagttatcgctgaaaaatcaaaaggatttactcgatttcacccgccggaaccagattaactga

SEQ ID NO: 53879 - DNA, 501 bp, Glycine max
  Peptide Sequence Number=SeqID_170657
atgtcaaatcatagttctgtttcatctgtgcatccttcagctgggctaaattcatcacttccatcatcttctggtattggtcttagcaataacttaacatcatctggtccattggcagcccctgccagggatagtagatatggagtttcacgaactccacctttatcagttgacgaacagaagagaatacaacaatataatcagatgatatctagcagaaacatgccgcaatctaccatgtctgttcctggatctctttcaggaagtgatcttggtggtgtgcgaatgttgcctggtggaaatggtatgggcatgttgggttctggaggcatgccttcttctagtatggtggggattccaagccctgtaaatatgcatgctggagttggtgctggacaaggaaactcaatgctgagacctcgggagactgcaaaggttggaagttacatggaagttattaaaacttccatcaacggttggaagttacatggaagttactaa

SEQ ID NO: 53880 - DNA, 309 bp, Glycine max
  Peptide Sequence Number=SeqID_170658
atgaggactacggcaagggcaagtaggatccacgcagcaacgtcatggaacgtcgtcgcgaccatggtggtctctcccacgcacatggtgaagagcttgagcttcgctaggatgcgcgcgagcacagggaatgcggtgatggaaagggagactcccatgaagatgaggaactgtgggaattcggctttgtcgacgccatccacgattttgcaaaggatgacggcgacgtcaatgccgcatatgaaaggaagagagatctcgacggcggtgatgcaaaatgcttttcgaccgctctggggaatggagtag

SEQ ID NO: 53881 - DNA, 306 bp, Glycine max
  Peptide Sequence Number=SeqID_170659
atgattcgttgtggacaaaagatcatcatatttctcatcaataatggaggttatacaattgaagttgagattcatgatggtccatacaatgtgataaagaattgggactacactcactttgtggacactatccataatgggcaaggcaaatgttggactgccaagaacttgaaaaccaactacgaaggagttgattacaaaacacaactctctcccaaaataatgccaacgtcatcacgtcggctcgacgactcctcaccagaatcttactccctgcaccctgctgctttcattctgctcccatga

SEQ ID NO: 53882 - DNA, 411 bp, Glycine max
  Peptide Sequence Number=SeqID_170660
atggccgatttcttaactgcattggctataaaagtgatgaccagcaccacaactgtggataattaccagcgtgtctatgtcccactaggcattcctctgaggcccaaaattgaatgtgttgaacaggaactgctaagcggagatactgttgtaatagctgaaaccggagactcatggttcaactgtcagaagctccatctgcctgagaattgcggtgatgaggacatgttcaagagcaagggcaaggatccacttgatggacttggaggacctatgacaagggctagagcaaggaaagccaaggaatctcttcaacaagtgttgtccatactatttgaatacaagcccaagtttcaaggagaaaagtccaaggttgtgagttgtatcatggcccaaatggaggaggactaa

SEQ ID NO: 53883 - DNA, 270 bp, Glycine max
  Peptide Sequence Number=SeqID_170661
atgaagaagatccaaggcctacaagctccaatggagctacatcaatttatatctgatgaggttactatgtcacttggatggggaaatatgaatgatggaagccaaggtttctttaaccaaccctcgcttttatgtggagccgaacctaatgatactggtatggggaatgataatgatgaaaatatgggtggtggtgacactgatatgcattcgcaaccagctatcctgacttttctagtttttaaagactacgacgatttcttaaattag

SEQ ID NO: 53884 - DNA, 384 bp, Glycine max
  Peptide Sequence Number=SeqID_170662
atggaaactgcaaaagggaccaccgaaagaacaccaagcaaccggaagaaacaaagcagaagaaagcgaaaggcagtaaaaagaagcaaagaaagcgaaagcgcagtagaaagaattaagttccggaagaaggttcttccggaaacttccggaagaaggttcttccggaaactttcggatgacgttcttccggacgtagtttgtgggtacttccggaattcacaaattcttcttccggaagaagtttttttccggaaacttttcggaaaagctttttccgaaaagtttacagaaatacttcttccggaagaagaattattgaagggcaattttgccacttcactgtttgctgggtgccccagcaataatgctgggtgcacgtag

SEQ ID NO: 53885 - DNA, 882 bp, Glycine max
  Peptide Sequence Number=SeqID_170663
atgaaggcgcaccgcataatcgagagagtccagagggagcagaggacgctgttcggagtgaaaatgccgaaaacggttattgcagtcacgccgacgcacgtgcgcacgttccagaagcttcacttgagcggcgtcatgcactcgctcatgctcgcgccgtacgaagtcgtttggatcgtcgtggaggccggacaagtcaccaataagaccgcttccattatagccaagtcaggactcagaaccatccacgttggcttcaatcaccgaatgccgatttcatggaacgatagacacaaattggaggctcgaatgcgccttcatgctttaaggattgtgagaaaagagaggctggatggaattgtgatgtttgcggatgatagcaatatgcatagcatggagctgtttgatgagattcaaagtgtgaagtggataggggcagtttcggtagggattcttgtccattcaggtggtgcagatgaatcttcgaccctacagggtgaggaggaggccccgccaatgccagtgcaaggtcctgcttgtaatgcgaccaataatttggttgggtggcatacctttaataagttgcgatatgctggcaaaagtgcagtttacatagatgatctggcacctgtgctgcccagaaagcttgagtgggctgggtttgtgttgaattccaggttgctttggaaggatcttgatgataagccggactggattaaggatcttaaagagttagatgggattgatgaggatatagagagtccactgtctctgctcagggagacttatgtggttgaaccacttggtagttgtggacaccaggttttgctttggtggctgcgggttgaagctcgcacagacagcaaattccctgcccagtga

SEQ ID NO: 53886 - DNA, 1275 bp, Glycine max
  Peptide Sequence Number=SeqID_170664
atgtcggcttccacggtgtccatcacggcagcaaacccgggggcgcgtcggagaccggtgatcgccaccgagaagaaaacagccaccaacctcgaactcctcgccaacgatgtcgccgtctccccggccgtcgcaacttccggagacggcgccaccgggcgcgacctcagccaccactcggtccgcggcgaggcgctcctcgaccggacgccccgtgatttggctccggcgaagaaggtcgccggcgggaactcgtcgtcggtcccgccgcggcgtgcgcggaagctctccgcgaaggccgagaagccgcggtggctcacgttggtgagcattttcgggaagaatatggtgctcttggtggtgctggcggggctggtccagttgatctggcggatgtcgttgaaatccggcgatggcatggctggcgggtatgtcgggttttcggaattcgagggccggatttcggatgtggaggggctgttgaagaagacagccaagatgattcaggttcaagttgatgtggtggataagaagattgaggatgaggttagagggttaaggagggaactaaatgagaaaattgaagagaaaggggaaattttggaaaatgggttgaagaaaatggaggcaaagaatgaggaattggagaggtatttgagtgagttgaagggggaggattggttatcaaaagaggagtttgagaagtttgttgatgaagtgaggagtgtgaaggggagtgggtatgagggtggtgggttggatgagataagggagtttgcaagaggggtgattgtgaaagagattgagaagcatgctgctgatgggcttgggagagtggattatgctcttgccagtagcggtggcgcagtggtgaagcattcggaggtgtttgatttggtgaggggcaattggttcttgaagtctgctagaaatggtgtccaccccaacgcggagaagatgttgaaaccgagctttggtgagcctgggcagtgtttccccttgaaggatagtagagggtttgtgcagattaggctccgcactgccatcattcctgaggctgtcaccttggaacatgtagcgaagagtgttgcatatgatagatcaagtgctcctaaagactgcagggtctctggttggctgcaggagcataatgctgattctgcaattaatactgaaaagatgcatcttctggcagaatttacatatgaccttgagaagagcaatgctcaaacattcaacgtgttgaattcagcagcttctggtgtcatcaacacg

SEQ ID NO: 53887 - DNA, 327 bp, Glycine max
  Peptide Sequence Number=SeqID_170665
atgtgcaaatggcggaagcacctgggcgaatgggaaaacgcgagagaagtaacaccaccacctcaaccaggatatctaaagtgcaacatagatgcggatcaaaattgcataggcattggcttgtgtattacaaatgaatggagtcagtgtgtcaaagcaaattcttcattgcatcaaggatgtatggactatgtggaagctgaaacgtgggccttgcttcatgccctttcatggatcaagttccagaaccttagcaacaatgtctttgaaatagatgttcaaactgtgatggatggtataaatacaaaagcagtaggaaagtcttga

SEQ ID NO: 53888 - DNA, 327 bp, Glycine max
  Peptide Sequence Number=SeqID_170666
atggagattactatcagagatggagtcacggaatccttgaatcagccaggaggctacatgttggtgatgtggctaggtttggacatgttggtgatgtggtattcctattggtgtttgggcgtgagggattggggtattaagaggtggttcgagctagggttggggtctggggttagtttcgggtttaggggggtattagggtttgagggagaactcgccattgttgagcctctaggttctgcacgaagctctggaccccattttcgagtcccttcatccgcaaccatggttaataacttcttacaaacatccgcaaaagctggttga

SEQ ID NO: 53889 - DNA, 422 bp, Glycine max
  Peptide Sequence Number=SeqID_170667
atggggaatggacttggtacatttctcattgccaaaagtcaaatcaagttccttcttgtcattgtggattacttcaccaagtggattgaagccgagcccctggcaaaaatcataacccaaaaggtgcaaaagttcacatggaagagcatcatttgtagttatggcttaccccaagccatcataaccgacaaaggaaggcaattcattgaaaaaggctatgaggagttcctcaagcaactcagaatcaactctctgacatccttagtagagcatcctcaaaccaatgggcaagcaaaaatcgctaatgacttggtgtggagactaagaggagatgcccgaaaggacaactcagaaggcaaactcgtgttcgattgggaaggcccatttcgtgttgtagaatctttgcagaacgacgcctacag

SEQ ID NO: 53890 - DNA, 459 bp, Glycine max
  Peptide Sequence Number=SeqID_170668
atgcatttggtcatagaggctattaatagtttgaagaatgttgattccactgctttacttcagtttcttcacccaattcttaacatgctacttcatcttattggcaatggtggagaaacacttcaggttgctgcgtttcgggccatggttaatattgtaaccagggtgcagcaggaatcagttgatgatgctgaaaggaatcatttcctagtcaactatgttgattgtgcctttgatgattttggtggtcgtcaaccgcctgtatatcctggactgtccactgtttggggaagcttggcacgaagtaagggcttcaactccaagttctcaagtttccagatattgtttttatgcaccaagcacttaatattatttggttatagaggttactgtcagtttataacagctgtcactgaagatttagattgtagtcataaccaagagaaagaagagatttga

SEQ ID NO: 53891 - DNA, 267 bp, Glycine max
  Peptide Sequence Number=SeqID_170669
atgacaaagggcatagagatctacgcatgtgactggaggaacaagtcgaagagacaatgtctagaaaagccatcgatcatcaattcggtagtgccatcgaacttcgtgacattgttgatttgtgccactgagaggcactgcaacacgatcgaagtcgtaaggcgtggctcttcctctaccattggtcatctttgtttgaagaggaaattggggattctgcaaagaacattgtttgggttccattctcgaccactgtttgttccataa

SEQ ID NO: 53892 - DNA, 264 bp, Glycine max
  Peptide Sequence Number=SeqID_170670
atggcgatactagaagcaattcactgggggcttgagatgaatattaatgttcaagtctgcaacattgagactggctatcaaaggcagaggaagaagaggtcatcaggcagaggaggcccaaccgttggtgtagaagtcgaggtcaatgcatcagagggatccgccatggatggtgttggatgtggtggggtagcatttgttgttgttgtcgagatccaccatggtgaatggtggatgaaggctgagggtgaaaaagggttggag

SEQ ID NO: 53893 - DNA, 150 bp, Glycine max
  Peptide Sequence Number=SeqID_170671
atggaacctcacacttcacatgtttcagcaacaaccattctaaaaatccactttctgattcatcctttgacaatcgaggctcagaaccttctatgtcttctagtgaagcaattcaaaatttcagagtttttgcagcaacatggaatgtag

SEQ ID NO: 53894 - DNA, 420 bp, Glycine max
  Peptide Sequence Number=SeqID_170672
atgggtgctggttcagctgcttttcattcaatcaaattacgagattttactgcacaatctaatgcttatgctattatgctgattcaaattgggtttttcttctttgttttacttgttgcttctcttgccctctatgttttggtgcttggggttaacagagtgctagtgcagctgctgctggtagcaacccaggtgatgctagtaagcacccaatccataacgaattacatttttaagaagaatttgactgaggaagcatgtcaagaaattggttctttttttctacaatgccatgccataccattcaatgtgacaagacgtgatgaattctatgacatcttggaattggttgcaagacatggcagtgatggcacaggatttaagccaccatcctatcctgagattagagtcaaatattag

SEQ ID NO: 53895 - DNA, 1207 bp, Glycine max
  Peptide Sequence Number=SeqID_170673
atgtcatcttctttcattatgagttcttcatcttctcttgtttcccttgatctctcctcaaatctgttgaaatcatcaactatattttactggctcattaactccaccaccaatcttcataaccttttgctttataataacacgttagaaggtcccattccagatggatttgggaaactaatgaactctcttgaagttcttcacctcaccggtaacaaactgcaaggggaaattccatctttctttggtaacatgtgcacattgcaggggttacacctctcaaataacaagttgaacggggaaatttctagcttcttccaaaattcttcatggtgcaacagacacatatttaagaggttgtatttatcttataaccggttgactggaaagttacctaaaagcattggattgctatctgagttggaggttcttaccttggttgggaattctttggagggtgacgtcactgaatcccatctttctaatttttccaaattaaaaaggttgtacctatcagagaactcgttgtctctgaaattggtcccgagttgggttcctccattccaattaaaatacttgagaatcagatcttgcaagttaggccccacctttcctagttggctcaagactcaaagttctttgtacgagcttgatatttctgataacgggattaatgactctgtaccagactggttttggaataacttgcaatatatgacagatttaaatatgtctttcaattacctcattggtgcaattcctgatatatcattgaagcttcctaatagaccgtctataattctgaattcaaatcagtttgagggtaaaattccgtcatttttactgcaagctcccacgctgatgctctctgaaaataatttttcagatttgtttccattcttatgtgaccaaagcacagctgcaaatttggccactttagatgtatcacacaatcaaataaaggggcaactcccagattgttggaaatcagtaaagcaattagtgtttcttgacttaagcagcaataaattgtcagggaagattcctatgtccatgggcgcccttgttaacatggaagccttggttttacgaaacaatggcttaatgggtgagttgccttcttctttgaagaattgcagcagtttaattatgctggacctgagtaaaaatatgttgtcgggtccaataccatcatggattggagaaa

SEQ ID NO: 53896 - DNA, 1147 bp, Glycine max
  Peptide Sequence Number=SeqID_170674
ctttcaggaaattgtccctttaaatgctggaaatgtgctggtattagaggataatgagcctgctgcaaaatggcttgctttaatcaaccaatcactcaatggttcttcagatttggcttctaagggactaaaactgactgcatcttttggaggcccattgttctcgcaaaagccttctttgaagaagattaagaaaactttcaagaaactaaatggaaagaggctaaaaagttgtaactgtgttcttgaaatggaaaggaaggctgctaaggatttctgttttcgctgccaagaatcaaacttcaattcagatgattcttccacagaagaggaggatgagaatttcacaattcctgttgcattggcaactagtcagatgaaatacagtcttgttgcatgtaagcaaatggttggaatttttgtaagtgtctggatgaggagggaacttgttcagtatgtaggccatttgagaatatgctgtactagccgcgggatcatgggttgccttgggaacaaggggtgtatatcagtgagcatgtcattttatcagacaagtttttgctttatctgtagtcatttggcatctggagagaaagagggtgacgagcttcgtagaaaccttgatgtcatagagattctgaagaacactcaattcccaaggatttgcaagacaccacatagtaggatgcctgacaaaattttagatcacgaaatttctttgagccatgatgatgcaaaaaggcttgtggaaaagagggactggccagctctttttaacaaggatcagcttaaaatggaaagggaagcaggtcgtgtattcaaggggtggaaagagggaaagatctactttgcacctacttataaatatgccttcaactcagacacttactatgttgaaggtgtaaaagtttcaaagaacaaaaggagaactccagcttggtgcgatagaatcttgtggcatggaaggggaatacaacaacttttgtacgtccgtagagaatttaagttctctgaccatcgacctgtttgtgcaacatttaatgtagaagttgaggttatgttcaggggacagaagaagaaagtttcaacttgcaactttcagaacattgatgatcttgtatccacaagaagtccatatttttcttga

SEQ ID NO: 53897 - DNA, 234 bp, Glycine max
  Peptide Sequence Number=SeqID_170675
atggttgaatgggtgatctccaagccaatactagtgtggtgttgtggtgagcagatgttgaaagctcaagggatggctgaaaagaaaagttcatcaagggttggtggtggttcgatggtgtttgggcgagtggatctagtgaaagggaggttggtggtttggatgagcaaaactgctaaaagggacaacgaagatgtttgggttgtgaagagacgtaaagaacaacctacatga

SEQ ID NO: 53898 - DNA, 327 bp, Glycine max
  Peptide Sequence Number=SeqID_170676
atgcgccttgctggggcaaggcaaacgaagggtgatgaagttaatgatgatgacatacctagtacttcgggaaggcagtttacggaaggtgtagatggtgacttgctgccttcagatgttccaaagcatattggtcaatctccccttcctgcttatgagcctgcatttgattgggaaaatgagaggacattgatatttggacaaaggataccggaaactcctctatcgcatggaatgaagatctctgtaaaagttcagtctttacaatttcaagcaggattggctggtgagtgttatgtggttgatattggtgggataatgtggtag

SEQ ID NO: 53899 - DNA, 435 bp, Glycine max
  Peptide Sequence Number=SeqID_170677
atgctgggctatgatgatgacgatatcgatgtgttctttgactcagtggatagtttgtcagctcaagattctgttttaggcaaagaagggtttgattctgaaaggtgtggttatgacgaaatttgggtgaaggagcctgttagtgtgaaggagaggagggaacgttttctgcagggtttgggtttagctgatgctgcttccaaggtttgttcacaagagaaaatgagctttgatgattcgtccatcagcttgggattggagaggatcagggagtgcagtggggcaatctcaaatgcttgcattttgcatactgatccagtagtatctgagaagttgattctctcaggaggcaaagcagcttctgaagaaaaagtctatttggatgaagtgaaagggtgttcccaagatgaagcagatgcaaactttcaagggaaa

SEQ ID NO: 53900 - DNA, 435 bp, Glycine max
  Peptide Sequence Number=SeqID_170678
atggtagaatcatctaagaagtgcaaaggtttaacttcaaccagcatcgctgcaggccaacgctgtcacgacacttctggtgactctaccgcaccacccaatccctccatttcttccccatgctccttaaatctattttcctctgacgatcaacgtcaaagctactgctattgcctcctttggttatcggaaggatatggatggccaatgggtgtaaaacaagaccttcaatctattgttcctgatgaacatacaccctcaccaccgccacaaatggattcctcctcttcactgttgcatgatgttcttagtgaaatacgggatcttcgggcctttgtaggtgatcattttgaggttatggattctcatataatgcgtcttaaggatgacatgagcttcattcgtcgatgctttgatcctccggcatatccatag

SEQ ID NO: 53901 - DNA, 822 bp, Glycine max
  Peptide Sequence Number=SeqID_170679
atgcctatcccacaaatttactatgttgggaggggaggagaagctttcctcagacttttgaaaggtcttcctaagtcaggaagtcagatgtctggttcatttacatcaagtggaaaaaatataatctcagttggagaggactcccatgtatatatttggaactttgatgacatgggaaatgcttcttcgaaacagacgaaatctgaacgctcctgtgagtactttttctctaaaggtgttactgttgcaataccttggtcaggaatgaaagcagatcaaagggactctagtggtaattattcccaccgttcttcagaaatgccaacccaacagctagaggttgcccctgagactagagatcacgaacttttttctcttggtaattggttcaccactgatggctcgtgtcgaggttctatgacttggcctgaggagaaacttcctagctgggatttacctatagcagaagaagaccagcagttatctcacaaagataattgccatgacagaagtgtatcagaaacatggggactatcaattgtggcagctggttgtgatggaactatcaagacattccacaactttggattgcccccacgatgccttccatgtatgagaactttagccacttatccattaaggctttgcttgctaaaggtggaaaatttacaacggtgttttatggccttagaatccaatataagtggctcaaaatgtgggaagacggaatttgaagctcatggtatcttggccattgcctctgcttatatgatgataattgctaaatccatgttgaatctcaaggctcttgacatgttctag

SEQ ID NO: 53902 - DNA, 234 bp, Glycine max
  Peptide Sequence Number=SeqID_170680
atgagtgagtgggtagattcaaaagatattctgaaactcaagtcaataagaattttaccaaagatactagcagaagttggagatgggttagattctctaagacagggcttaaggcttcttgaggacaatgataactttcctctcgatgaatgtataatctacagcgtacgtatttatcttaaacatctgcattcgaacattgacttcaatcaacgcgcaacgcatgtagattga

SEQ ID NO: 53903 - DNA, 837 bp, Glycine max
  Peptide Sequence Number=SeqID_170681
atggaagaaccatcgaaaaagcggaaaggcacttcgagtcggagtcaacggcattccggggcacaggaaacctcaatgccttcctccattccctctggatcattgttctcatcaaaggaacaacgtatacgcgaaggtgtaccatttgaaggtgcactgattgacgattggaagtttgatttctctatacatgatgaccgccgattggtttgtaccaatcaagcggatatgaccggaagacttcttgccggttcattggcttttgaaagccgcatcctccattaccttattgttcgcatcttgcttcctagatcttcaaaccttgcccaggtttctgaagaagatctcattgtcatgtgggcctttcataaaggtttacaaattgattgggcacaccttgttagatatcgcatgcataaggcattgcgattgaatgcccctttgccttatcttcatcttgttacccttttccttcaacacttcaacatccctcttgattctgaagcttatgttccaatcaagagatcattccttataggcgcttcagtcatagcattctttggttatataaaggagcatgatggatcttgggtgaagaagggtgctagaaatgttggtgaagaaggacatgaacgagaagattcatcttttctttcgaagaatatggacaggtttgatggtcttcaaacctttgttggtgagaggtttgacactttggaattgcaagtggatatgcacttcaatgaaatggagtcaagaatcacaaaggttgaagaagatgtgtcttacattcgttcaagctttgatcttccaccactgccgccaccatcatcttag

SEQ ID NO: 53904 - DNA, 291 bp, Glycine max
  Peptide Sequence Number=SeqID_170682
atggataacaatcaagaggagataaattacatagggttagagagggatgtggattgtttggttgtgagggggaggaagaggaagagtctgagtcgctcgtcgtggcgtggaactcagtcgctgcaacgggatgatgattgtagccaaatgcaaagccacgtggaccggccatgccggcgcataggacagcgtcgtagtacaaaaaagggtttgccgcagcaccgcgccggtaaagtgctggaaggggaatcgagcggatgcgagtgcggcgagggcaaggttgaggtctag

SEQ ID NO: 53905 - DNA, 322 bp, Glycine max
  Peptide Sequence Number=SeqID_170683
ggagccagtagaagatgattttggtggattcaagggttcatcagcttcgactagacctttgtctctgtggaccgctgactcctcggcagaaagtcatttaaccagatcacgtaggcgtgagggcaccagggaaagtgcgtggctagtgcaacaacttgcggcaacgacaagggttgcagagcttggacctcgcgatgaagttcaaagggaaaggggtggtgttagtgttgggggtgatgttagggaaggcagagtgggtgccttattgatggaagcttgcttgtggggcttctatggaggctggatctttgagcttcaatga

SEQ ID NO: 53906 - DNA, 423 bp, Glycine max
  Peptide Sequence Number=SeqID_170684
atggaagaaagaatagaagagagaatgggaaagaaaaagtacaaaatgaaaaataaaaggattgcttacaaattgaaaaggtatggcaaccaagtaaaaaaaaggctaagtcatgaagtgcaaaaagtgacagttgagcttagctcagtaattgggctatgcgcgcatccacagctaagcgcagcttcagcgcgaaggagaatctggcagagcattagcatcaaggccgtgtcttcagccaggctcagtgcacgactggcgctaagctcgaatccacttacctgcgctaagcgtgagggtggcgctaagcacaacatcgtgaattcagagcctattcaaagcctgtcttgtgcagaattagggtacacacttttacagacttttagacagattgtaggaagaagaaaaggcacagattcctga

SEQ ID NO: 53907 - DNA, 477 bp, Glycine max
  Peptide Sequence Number=SeqID_170685
ggtggacccttgggtactagtaccctcaccttcagagggctacacgccctcgccatcagaggactacacgtcctcgcctttagagggttgcacgccctcgccttcagaggactacacgtcctcgtctttagaggactacacatcctcgccgtcagaggactacatgaccacacccttagagaactacacgtccccgccgtcaaatggctgcacgcccttgccttcaaagggctacacgccctcaccttcagaggactacatgtccttgccatcagaggactacacgtcctcgccttcagaggattgcacatccttgcctttagagggatgcacgccctcgccttcagagggttgcacgccctagccttcagaggactgcacatcctcgccttcagagggctgcacgtcctctccttcagagggttgtgctgtgtgaagatctacagagaccagagcttgaagcggaagtcgttctga

SEQ ID NO: 53908 - DNA, 624 bp, Glycine max
  Peptide Sequence Number=SeqID_170686
atgaacattggacctccatttggaggaggtccaattgatttgtcattgatccgatcttacagggaccagtatgttggtcatgtatggattcgacagtcgcgaccaaagatgaagctggtcatccacgatggccaagtgttaccactccttactgagtcgacggtgaaggcttatgtgttgcggtcggggttatcaaccctagttacgatgtggtaccctgccacaaacaagggctttgtgaatacccatgtggagaggtgccaccaagagatctcgtccttccacttgcctgttggaaatataaccatcactttagattatgcatactcattgatcatgtcccctccacctttagtagaggtcgtgaagattttgttcatgactcaccttggcattaatttagaggaagaggctatagcaacaaccaccataggtgccaggggagtcgctgcactggcatacctatatggccatctctcttatgtgagccagtacaccagcaagcaagttggaggttacatgatgttagtaatgctagcagatggaagccaacatgagacaccagacaagctcatccgaccagggagaagctggatgaaactccaaatggatgttgtcgtctga

SEQ ID NO: 53909 - DNA, 390 bp, Glycine max
  Peptide Sequence Number=SeqID_170687
atggtcgattctctgttattctttttaaatgtaaatgggccgatactacaggagatagaggtcgtgccaaaggtgaagcattttagaaatccacaaaaatcagcacctcaaccacaatgtcatggacctctatcacaagctccaacacattctgttccagcaatgaatcctgaaatttcttccccaccaagtgattccacacaagctcctgaagtcccaactggtaatgtccctctttctcatgtatcaacatctgaagttccacaagaagatgaaacaactagacgtcatgttgggcgtgagtctacacaatgttggactgttgaggcaataggtatacaagtattgtattttatttttatttttgtaattaccctatacttcatatga

SEQ ID NO: 53910 - DNA, 615 bp, Glycine max
  Peptide Sequence Number=SeqID_170688
atggtggaaattcaactattgttatgggaatgtaacaatgagaaagatgttcaacagatgagagggacttattgctttgattatgagatccactatcattcaagcaagatgaacgtggtcgcggatgccttgcccaggattctagaacccaccttgagctccctgttgctattgtcagtcccatgtttggtgtttttaggagaactcaaacaacatctggtgaatgacctaacttttctcaagttgcgccaagctatatccaatgaccctgcgacatattccgactactttatcgcccaggatttgattctaaaatggggtcgtatttggttaacaccaggatcacacttcatcctaactctgctcatggagtatcattcgtcgccaacgggtgggcacatgggagtcgccaagactctggcacgccgtagcgagaacttcacttggcatgggatccgaaaggatgtggaactctttatcacaacttctattgactgccaacacacgaagtatgaaacccagaaagcagttggtttactttgtcccgtactggttcctttcttgccatgggaggacctctccctcgactttatcattggcctgtcggcgtattga

SEQ ID NO: 53911 - DNA, 909 bp, Glycine max
  Peptide Sequence Number=SeqID_170689
atgaataaggaagccaaggcacaacttgaggtagccaaagctagatatacagcatatgtttcagatttaatagttgtgaaagaggagctggaagcattgcacaacgaatatgcttccttagtgactgatatagatgtagctattatgaaagctgaagaggttgttactacatcaaaggaagtagagaagtctgttgaagatttaattgttgaactaattgctgcaaaagagtcattggagactacacatgatgcgcatttggaagaagaggaacaaataataggaatagtcatggcaagagatcaagattctctcaattgggagaaggaacttaaattggcagaagaagagctccagagactcaaccagcgaatttcatctgcaaaggaactcaaatctaaactggaaacagcctctgctttgctgattgatttgaaagctgaattaactgcttatatgaaatcaaagttaaagcaacaaagaggcccagaagaaccagagataaagacacacactaacatacgagaagtagtggcatcagctggaaaggaacttgaggaagtaaatcttaacatagagaaagcaactgctgagattaatatcttgaaggtagttgctacatcattaaaattggaacttgaacaacaaaaaacaactcttgcctccattaggcaaagagaaggaatggcctctgttgctgtggcatctttggaagctgaattggaaaagaccagatcaaaaataggtttagttcagatgaaggagaaagaagctaaagagaaaatgaccaagcttcccaagaaactacaactaacagttgaagagactaatcaaggaaaaagcatagctacagaaagtaaaggcagaagcagagcaagccaaggctggagtaagtaccttggaaagtag

SEQ ID NO: 53912 - DNA, 176 bp, Glycine max
  Peptide Sequence Number=SeqID_170690
atgatctcctgcggaagggaagaagagggcatagaagttaccgagcctgaggcatttttgtggcatgacaacgagacccgaacccgtggggtccgccccgaactcgccccgattttgacgggaaaacccgagttgaccggggtcggggtcaggttttccccgatagccaaagtcag

SEQ ID NO: 53913 - DNA, 435 bp, Glycine max
  Peptide Sequence Number=SeqID_170691
atgatgtcgttctcctcgatccatcaccatctttctctcttcattctctctcccttcaatccccaccgtcgtcatcgctccactccctcgtcgactcatacatctctagcgcccactcctccccgttgccagagaagctcccacctaattccttgccagactctggctagtggttacgattctatccgtgagtctgtagattcgcactggccgcgagtagatctagcatggtctgttgcggcgattgatcatggtggtggaagatcaagtaccatattatcaagctatggtggtggcgcgtcgattttgattttatcagtctcgatttttggcatagagtttttggagaattggagagtcgattttgttggagcgtgtcatgttctaaagggtgaagctgtagttgacgaaggcgatgaggaggaggaggcgtag

SEQ ID NO: 53914 - DNA, 246 bp, Glycine max
  Peptide Sequence Number=SeqID_170692
atggcaggatatctcattgatgactcaactgttcaggggcatgcagatacatatccaaacccaccctcacttctgcaaattggtaaaacccaaactcactcagtcaaagcatacttcatcaaaattagggcattggatatgagtagccatggattagacgaaacatacctaggtaaggtggcgaaggagaagaggaagagagttctgatgatgctcgagcttagacgaaacaatgctcagatgtga

SEQ ID NO: 53915 - DNA, 543 bp, Glycine max
  Peptide Sequence Number=SeqID_170693
atgaaatgcaagatagaagatccaatcctcaacatctacagagaagacaaagcacaacagaacattgaatggacaaaattcaagccccaaagaaaaactaaacttcctcaccaacactacaacatgcaacgattctttttcttcaacattaccaaccacattgagcatatcctaacatacttaagaacccagaattgcaaacacgacaaagatctatttttcaccctgccagcagttaaaatgctcccgtggaaatcgatcaccgcaattgagaacagagaaaaaacatcatcttcacaatcaccaaagatccaacgaaaaggaacaatacccagatttaaaaaaaaaaacactcattttcccaaagctcaattcttttcacgaaaaaattacaaaaacaggaggaaatctcgccaagattcaaaatgccgcactgtaacttcaaagaaaaacaaggggggaaagagagtaaaacttacaaaatggaaggaaacccaaaacaaagaagatgaaaaagagagagttttgagacaacaatggtag

SEQ ID NO: 53916 - DNA, 2319 bp, Glycine max
  Peptide Sequence Number=SeqID_170694
atggagactttgcaccgtgacccaggtggaggaattgaaaatcttgatctgcgtgtttccaatttgggccaccaggatcatttttgctgcagtctatgcccagatgtcaacattgtttatggagcaaggaacaatgatgaacacatgcattggataattgttccaatcataaggaagttcacaggcaaggaaaggggcctctcaatgctgcaaagaatgggaattggccttttcatttcagttctgtgcatgttatcagctgctgttgtggagattatgcatctgcagctcgcaaaagagcttgaccttgttgataagcatgttgccgtgccccttagtgtactttggcaaatccctctgtatttctttttaggggcagcagaagtattcacatttgtggggcagcttgagttcttgtatgaccaatctccaaatactatgaagactttaggtactgcaatgacacttctgaacttttcattgggaaattacttgagttctttcattcttactatggtaacttcaccacacaaggtggaaagcctgaaccaaaagaggtttctcaccagagacatgagttctattgaaggtgctacacagcttctggaagaggctctccttcaggatgatgaagagagtaaacagtacacaagagatggctcagttgactacagaggcaggcccgctattaagaaggatactggcaattggagggcttgtccttttatcctaggcaatgagtgttgtgaacgtttggccttctttggaattgcaacaaatcttgttacctatcttaccaccaagctgcatgaaggaaacgtttctgccgcaagaaacgttagcatctggcttggcacttcttatctcacacctctcattggagctgttctaggagatggttactggggtcgatactggacaattgctgttttctctgtggggatgtgtaccctgacactttctgcatctttaccagcattgaagcctgctgaatgcttgggttctgtatgcccttcagctactcctgcacaatatgctgtgttctactttggtctatacgtgattgcacttgggatcggtggtataaagtcatgtgtgccatcttttggggcaggtcaatttgatgatactgatccaaaggaaagggttaagaaggggtcgtttttcaattggtattacttttctatcaatctaggtgccattgtatcgagcagcatagttgtgtggattcaagacaatgcaggatggggtcttggatttggcattcctactttgttcatggtattatctgtgataagcttctttataggcacacctctctacaggtttcaaaaaccagggggaagtcctgttacaagaatgtgccaggttttgtgcgcgtctgtccggaagtggaatttggttgtccctgaggatagtagtcttttgtatgagatgtcagacaagagatctgcaattaaagggagtcgcaaactgctgcatagtgatgatctaaggtgtcttgatagagcagctacagtgtccgattatgagagtaaaagtggtgactattctaatccatggagactttgccccgtaacacaggtggaagaattgaagatcttgatccgcatgtttccaatgtgggctactggggctgttttttctgctgtttatacccaaatgtcaacattgtttgtggagcaaggaacagtgatgaacacaaacattggttcctttgaaatacccccagcttccctcgcaacttgtgatgtcctaagtgtggttttgtgggctcctgtctatgacaggataattgttcccattacaaggaaattcaccggcaatgaaaggggaatttcagtgttgcaaagagtaagcattggctacttcatttcagtcctgtccatgttagcagctgttgttgtggagattatgcgtctgcggcttgcaagagaccttgatcttgttgatgaacctgttgctgtaccactcagtatactttggcaaatccctcagtacttcttattgggggcagcagaagtattcgcattcgtgggactgcttgagttcttctatgatcaatctccagatactatgaagactttaggtacagcactgtcacctttgtattttgcgttgggaaattacttgagctctttcattcttactatggtgacttacttcaccacacaaggtggaaagcttggctggattcctgataatttgaacaagggtcatctcgattattttttcttgcttttagctggacttagcttcttaaatatgttggtatacattgttgctgccaaaaggtacaagcagacgaagacttcttaa

SEQ ID NO: 53917 - DNA, 2007 bp, Glycine max
  Peptide Sequence Number=SeqID_170695
atggcttcgtacaccccaaagaatatcctcattactggggcggctggatttattgcgtctcatgttgccaaccggcttgtccggagctaccctgactacaaaattgttgtgcttgacaaacttgattattgttctagtctgaagaacctccttccttcaaaatcatctcctaacttcaaatttgtgaagggggatattggtagtgctgatcttgtcaactaccttctcatcaccgaatccattgacactataatgcatttcgctgcccaaacccatgttgacaactcgtttggtaatagctttgagttcaccaagaacaacatatacggaactcatgtcctattagaagcctgcaaggttactggccagatcagaaggttcattcatgtgagcactgatgaggtctatggagagacggaagaggatgctgttgttggaaaccatgaggcctctcaacttcttcccactaacccgtactctgctacaaaagctggggctgaaatgcttgtcatggcttatggtaggtcatatgggctacctgttattacaactcgtggaaacaatgtttatgggcccaatcagtttcctgagaagttaattccaaagttcatcctcctggctatgcagggaaagaatcttccaattcatggggatggttcaaatgtgaggagttatttatattgtgaagatgttgctgaggcttttgaagttgtcctgcacaagggtgaggttggccatgtttacaatatcgggacaaagaaggaaaggagagttgtcgatgtagccaaagatatatgcagacttttctcaatggacccagaaacttgtataaaatttgtagagaacagaccatttaacgaccagagatactttcttgatgatcaaaagctgaaggacttgggttggtctgagaggaccacttgggaagaaggcttgaagaaaaccatggattggtatatcaataaccctgattggtggggtgatgttactggggcattgcttcctcatcctaggatgctgatgatgcctggtgggttggagaggcatttcgagggatctgaagagggaaaacctgcatcttttggctcaagtaataccaggatagtggttccatcatccaagaacaccagctctcaacagaaacatccttttatgttcttgatctatggtagaacagggtggattgggggtttgctggggaaattgtgtgaaaagcaaggaattccgtatgaatatggaaagggtcgcctagaggaccgctcctcactcttggctgatcttcagaatgtgaagcctacacatgtttttaatgctgcaggagtgaccggcagacccaatgttgattggtgtgaatcccataaaacagaaaccatccgcaccaatgttgctggtaccttaacaatggctgatgtctgcagagagcatgggatcttgatgataaattatgctactgggtgcatattcgagtacaatgcaacacatcccgagggctctggcattggttttaaggaggaagacaagcccaatttcattggctctttctattccaaaactaaagctatggttgaggagctcttgagagactatgacaatgtatgcacactcagggttcgcatgccaatttcgtcagacctgagcaacccgcgcaacttcataacaaagatttctcgttataacaaagtggtcaacattccaaacagtatgactattttggatgaacttctgcctatctcaattgagatggcaaagaggaacttgaagggaatctggaacttcacaaatccaggggttgtgagccacaatgagatccttgagatgtacagggattacattgacccaaacttcaagtggtctaacttcacccttgaagagcaagcaaaggtgattgttgctcctcgaagcaacaatgagatggacgcatcaaaattgaagacagaattcccagaattgctttccatcaaggaatcactcatcaaatatgtctttgagccaaacaagaaaacataa

SEQ ID NO: 53918 - DNA, 1665 bp, Glycine max
  Peptide Sequence Number=SeqID_170696
atggcttcttcctctctcttctacctttctctctccctcatcctaaccctcacctccgccgcgcgccacaaaccccacccctcaccggccaagccaccagccaagcccgccgtgaccaccgccacctcgccggcaattcaacaagcctgcgccgcgacgcgcttcccgcagcaatgcgaagcctctctctcccaatcccagaacctccctccgaacccgaacccgacccctctccagctcctccagtccgccatcgcgctctcctccgacaacctcgccaccgcacagacgatggtcaagtcactccacgacgcctccgccgacagccgcaaccgcaccgtcgccgccgccacctgcatcgagatattagccaactcccattaccgcatttccctcgccagcgacgcgctcccacgaggcaggaccaaggacgcgcgtgcttggctcggcgccgccctcgcctaccagtacgactgctggaacagcctcaaatatgccaacgacaccgaaatggtcggcaaaaccatgttgttcatcgataacctcgaaactctctccagcaacgcactcagcatggcgttttccttcgacgccttcggaaacgacaccgcttcgtggaagcccccagtaacggagcgcgacgggttctgggaggctgtgggctcgggtggccccgcgtccgcgggaggggtaccgccgaatttgacgcccgacgttacggtgtgtaacaatggaggagacgggtgttataagacggtgcaggaggccgtaaacgccgcgccagcgaacggaacaaagaggtttgtgatatacataaaagaaggggtttacgaggagaccgttaggattccattagaaaagaggaatgtggtgttcttgggcgacggcattggcaaaaccgtcatcaccggtaacggcaacgtgggacaacaagggatgacaacttacaactctgccactgtcgcggttcttggcgatggattcatggcaaaggaactgacggtcgaaaacacagcaggtcctgatgctcaccaagcagtggcattcagattagacagtgatctttctgtgattgagaattgcgaattcttgggcaatcaagacactctctatgctcactcactgcgccagttttacaagtcatgccgcattgagggcagcgtggacttcatctttggaaacgctgcagcagttttccaagactgccaaatcctagttcgtcccaggcaagtgaagccagagaagggtgagaacaatgccatcacagcacacggcagaacagaccctgcagaacccacaggctttgttttccaaaactgtttgattaatggcactgaggaatatatagcattgtacctcagcaagcctcaagtgcacaagaactatttgggtaggccttggaaggagtattctagaacggttttcattaattcgatcttggaggctcttgtcacaccacagggttggatgccatggagcggtgactttgctctcaagacactttactatggggagtttgagaacaagggtactggctctgatttgtctcagagggtgccatggagtagcaagatccctgctgaacacgtattgacgtattcggtgcagaatttcattcaaggaaatgattggattccatcatctgttggtagcccatcctcgtaa

SEQ ID NO: 53919 - DNA, 804 bp, Glycine max
  Peptide Sequence Number=SeqID_170697
atggagttaagaatagaatcaattcattgtgtcaaatttatatcatgcaggccaaattttgtgaacaggtggatatggggtggtttagatcgtggttatatatcgaatgtagatattaactggggtgatatattgcaaattactgcgaaactgacagggaaaaaagagtttcaagaggttggccttctaaacttcaacaataatgaactagaccattgggaacagcttattcctaatgtcacacatgttgttctggagctggagtatgctgcaaaaaatgtgacatgggaatccctatacccggaatggattgatgaggaagaagaaaccgaagtcctggtttgtccttctcttccaaagaacttgtgggacatgaagggaatgtttttgggagaaaaactccaccttccaccaggatcttgtgaacttgcatttcctttgaggggcaaagagctgagttacgtgggaaatgttcgtagagaagcatatgcaacaattctccattccgctcacgtttatgtttgtggagctattgctgctgcacaaagcatccacatgtccggttcaactcgagacctagttatacttgttgatgagacaataagtgagtaccacagaagtggtttagaagcagtagggtggaaattcaggacaattcaaaggatcagaaaaagtgtcaagtttccttatgtggttaaaagtgatgctgctcatgaaaggtggcggaaggtgcatgatgcaatgcctgagcttttgcaacagttttgcatgttgaagtcaaagcagaaggcacaattggaatga

SEQ ID NO: 53920 - DNA, 1745 bp, Glycine max
  Peptide Sequence Number=SeqID_170698
atggcttctccttcactactgaatgatgcgaacgctctgctctattcggcgaagagttttaccgctgcgatgctcgcatactatattgcattatcaattggcctagagcggccttcctgggcaattatcaccgtatatattgtttcccaaacctccgtcggagcatcgctaagcagaagtttgtatcgtctggtgggaacggtaattggcgctggcatgacggtattaattgtacccacgttcgtgaattcacccgtattttgcagcgtgatactggcaggctggattacattctgcctctatctgtccttgctggaacgtacgccccgggcctatggttttgtccttgctggttacactgcgagtctgattggcttccctgctgtatccgatcctggcgcgatttttgacatcgctatcactcgggtacaggaaatcatgatcggtatcttctgcgcggcacttattcatcgctatgtattgcccgcgcgcatctcaggtcagttcaacagtaaattatcgcagacgctgctcgcggcgcgacagcgtatcgcagagactttaacaggcaaacccgatcctgtttcctcgccgctgcatatggcactggcattgcagttcctgcagggcatcagccatcatatcccttatgattttgcgttctctgtaccggtccggcaagcgagaaaaaggcttcatgacaggcttgcgcgattagtcattgttaactgtgagttacgtgaccgtttagcgctgatagcgaagatacctttcgatgtgcaaattttaatggatgatgttgaggtctggctggcctgcaaagatgaaggaaaatttaaaagcgagggggaagcgctcaaaaaacgcagtgaaaaattactgcagcgctatgtcgtacatgagttgacgtttgtagaagcactgcatgtaagttttatgcgctacctgacagaggccattgtcctcgtgcagcagtgctatcgtctttcggatgccattcatcacgcgaatcagatgcctgcgcactcagaaatgaataacgtgaaagggtatgtattccaccgcgatcctcttactgctgcccgcaccgcattgggcgctttcaccatcattttgagcggctgcatggtgtggattttctcggcatggcctgatggcggtacggcagtatctatccttggcgtttgttgcacactgtttggcagcttcgatacgcctgccccgcatattgtgaaatacatcattggttccctctggggagttgtgataagcctgatctacagcttcgttctcctaccgcaagtcagtgattttatcgtgctggtagtggttctagctccggtatatctgcttgccggatcgctccaggcacggccgcccactacttttatggcgatggggatcacactgacgctgcctattttgtgcgagctgggtgctcattacagcggggattttgccgtggcggtgaatacctctatcgcattattttctgcaactggctttgcggtattcagcatgggctttctgcagactgtgcaggcagatgcggcaataaaacgcctgcttaaattatgccagcgcgatattaaccgcagcgtgaaaggtgtgttgaatactgatgaaactctctggatcaacctgatgatcgatcgggctgcgttgatactgccgcgtttgccgcgcagcggacagtcatcagaacaggcattgaatcatcttttgcacaccctgcgtataggcct

SEQ ID NO: 53921 - DNA, 807 bp, Glycine max
  Peptide Sequence Number=SeqID_170699
atgttgcccccactcgccaatacgctgttcgatccggataccacctcctgccccgcagtcgcgcgtcatttggattttgtcgattacgcggccgaagtgcctgtgcatacgcaccgcaaagggcaattgattattgccctctatggagcggtcatttgtcgcgccgaaaatgatatctggatcgtgccgcctgattgtgccgtctggatccctgggggagtgccgcacagcgcaaaagctacttggaatgcgcatctcaactatctttttatcgagcctggagccgccgagctgccggagcgatgctgcactctggccatttctggtctgatcaaagaactcattgcccgtttaacccacgagggcgtcggatacccaccagaaagccatctagccagactgaccagagtaacacttgatgaattagccaccatgcctcagcagaaactgagcctccctgtgtcgtcgcatcctaaaatccgcgccatggccgatgctctggtcagtcaacctgatgaccgaagcacattcaaaacatgggcaaaaagactggcgcttagcgagcgttctctcgcgcgtttaatgctgcgcgaaaccgggttgacgttcggacgctggcgtcagcaactgcaactgataattgctctccgggaactggccagcggcgtttcggttcagaatgttgcagctaatctggggtatgaatcggttaatgcgtttatcaccatgttcaaaaaaaccatgggcagtacaccagcacactattttgccgaacggaaaacaagcgcacacttaaccgataattag

SEQ ID NO: 53922 - DNA, 2073 bp, Glycine max
  Peptide Sequence Number=SeqID_170700
atgtctaccccaccaatgccctttctattcctctttttgttctccctcattgtaccattactcttagctcaagctccatcaccatctcctacacattctcctcctcctccttctccatcaccatctccaaaacatacccctcctcctcctccttctactaccacaccaccctctccaaaacatgtacctcctcctcctccttcttctccatcaccatctccaaaacatgctcctcctcctcctcattcttctccactaccatctccaaaacatgctccttcttcaccaccaccatctcaagcacatgcccctcctcttccttcttctcaatcaccacctccaacacattcccctcctccttcttctccatcaccaccatctccaacacatgcccctcctccttctccaacaccacctccagcacgtgccccttcaccccctccacctccaccaccctcttcaccctcttcagcatgcaagtccacactataccctaaactatgccgctccattgtctcctccatccgctcctctccttccgacccctacaacctcggcaaattctccatcaaacaaagcctcaaacaagccaaaaaactcgtcttagtcttcaaagacttcctcacaaaatacaaatcatcctcttccctcaacgccgcggaaatcgcggcactcgaggactgcagcgagctcaaccagctcaatgtcaactacttggagtcggtttcggaggagctcaagtcggccgactcctcgaacgacactgagctggtagagaagattgagacatatctcagcgctgtggccactaaccactacacttgctatgatgggttggttgtgatcaagagcaacattgccaatgctattgctgtgcctctcaagaatgttacacaattgtacagtgtgtcacttggtttggtcacgcaagctctgaagaaaaacctcaagacgcataagacccgcaaacatggtcttcccaccaaggactacaaggtcaggcagccactcaaaaaactcattaagcttcttcacacaaagtacagttgcacagcatcatccaattgtagtactagaagtgaaaggattcttaaagaaagcgagaaccaaggagttcttctaaaagagtttgcgattgttagccttgatggcacagaaaacttcacctccattggagatgctattgccgctgcacccgacaatttaagggcagaagatggctattttctgatctatgtcagagaaggaaactatgaggaatatgtcactgttcccattcaaaagaagaatatcttgcttattggtgatggcatcaacaagacttgcatcacaggaaatcatagtgtcgtagatggttggaccacttacaattcttcaacctttgctgtctctggagaaagatttgtagcagtggatgttacattcagaaacacagcaggccctcagaagcaccaagcagtggccttgaggaacaatgcagacctctccaccttctaccgttgcagctttgaaggataccaagacactctctatgttcactctctcaggcaattctacagggaatgtgacatttacggcactgtggatttcatttttggcaatgctgctgtggtgttccagagctgcaacatctatgccagaaaaccaatgccaaaccagaagaatgcagtcacagcacaagggagaactgacccaaatcaaaacactggaatttcaattcaaaattgcaagattgatgctgcacctgatttggctgaagacttgaagtcaactaactcatacttgggcaggccatggaaagtgtattcaaggactgtgttcatgcagtcatatattggagaactaattcaatctgctggatggttagagtggaatggcactgatgggttaaacaccctcttttatggtgagttcaagaactttggacctggctctgataccagcaagagggtgcaatggagtggttacaatctgttgagtgctactcaagcgaggaacttcactgtgcataattttacattggggtatacatggcttccagacacagatataccctattctgaaggactttag

SEQ ID NO: 53923 - DNA, 567 bp, Glycine max
  Peptide Sequence Number=SeqID_170701
gggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacgatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggatagtagacagggacagtgggaatctc

SEQ ID NO: 53924 - DNA, 978 bp, Glycine max
  Peptide Sequence Number=SeqID_170702
atggctacgctgaataaagcgcttacgcggcctgccgccattatgggtattcctctggtgccgttcgttctcgtcagcggggccatcgtcctgctggcggtctatgtcagctattacctggcggttctgctcattcctgcctgggcggaaatgaaaaataaaacccgaaaggacattcattatttcagtctgctctggctggcatttaaaacccgtggacggcttttcaccaacacccattttggcgcgaatgccctgctggcaaaccagtacgataacgttgatatctcggagtttattcagaaaatgaaattaagcgagcgtattacgctggataaatatattccgtattcctcccatattcacctctacgtcatcagaaatcgtcaccgtgatttggttgccacctgggagctgggcggcacggtctttgaatgtgaagacgaacatcacctgaccctgatggctacgcacctgaataacgttattcgttcgtatgagggtctgccggtaacattctatattcaccggcttcgtgaaaaataccatgatgcttttgaagcctgttcgggtattcccttttccgatgacgtgacccggcggtattaccagccggtaaaagaaaaaccgttctggcggcaccgactgtttttcaccgtctgctacgcgccgttctctcagattgagaagaaaaccatgaaagcgcagtcgtacggtaaacgccaggcagcactggatgacgcgctcaaaatcatgctggaataccgcgaagcactggaatcttcattatcccgctatatggcaacgccgctggggatatatgaagaaaacgggcgggtgtattcctcacaactggcgttcttccatcgtctgcttaccggccagtggcagaaagtggccgtaacgcgctcaccattttatgaaacgctcagtacgccagacgtctttttcaccaccgacaccggtgaatgccagacg

SEQ ID NO: 53925 - DNA, 411 bp, Glycine max
  Peptide Sequence Number=SeqID_170703
atgctccgaatctccgtacccctccaagaatcgccgccctcgaccacggaagagctcacgcttctcctgactcctagaacatactaccatcaactgcgcaacgtggcaatcgagagaagaatagcgaggctaggagaagtcgaaggccagcaaatcagaaacactaatcttacttcaaatcgtttagtttcagaaccttccgaacctgcttctgcctctgcggtgaaatcgtcgaaatcagttggagtgaaactccgaacgccattcgttagcaaaacggaagaatataatatttggaaaagacaactagcagaggggattggaatagtgagcattgaggaatgtgtgaaatctattaaaagcaagaaagagtgggacttgggaggaggctcccttgaagtgctagcctag

SEQ ID NO: 53926 - DNA, 558 bp, Glycine max
  Peptide Sequence Number=SeqID_170704
atgactggatatctgctagcaggatcaattattgaaccaagagcatcgacaacaggcatggtcaacaatgaggtttctacatgtcttgagtatgttgactatagaagattactgcatttacttgtttctaggcttggaactttcattggtatatgtgcattgagtggtgattttggagttgcaaatgcttatgttcaaggtggaatggtgggagacctctcctacatgaaactggaattcattcaatctttccttgctggtgtagcagcatccgatgcattaacctctgctttgaggttaattacaaaaacaacatttgagaattctaaggacgttctctgcaaaggagcgattattttccctaaaataccaattgtgaagtactaccattcaaaggcagcatcagaaggatctaaaactgtttcagctgaccttgcaactcgtggcatccggacattacctggagcaataatgcttttcacctttttttttcattccaataagtcccaaaactttcattgttcaagattcaacttggaattcatttatgaagtttga

SEQ ID NO: 53927 - DNA, 279 bp, Glycine max
  Peptide Sequence Number=SeqID_170705
atgaagaaagtggatgaagagactggcaaatactatggtagaaaggccgtgtcatttgtcttgaagagacaaccttgggctttatttgttttcacttttgtactttccagtgaaggacttggggaggcctatgatggaaatattgtatttgcaagtgacttggaaacttttggtggtgggcataatgacccaatcagtgtggctttgggaggtatgctccctttttacatcaatattatgatggttgatgaaaggttttatgttcctcctggtagttga

SEQ ID NO: 53928 - DNA, 231 bp, Glycine max
  Peptide Sequence Number=SeqID_170706
atggaaaattcccaaaagggagggcaaaatggtcatttggtgactttttcaggcccctggctcatccaggctagcctctggcttgcctgggccactagaaagcttaaggctaaagtaactggctcgcctgggcaagctgaggtcacctgggcaagcaaggttacttctggagaaagcaaccaactcgccttggtgagctgctgtgcaacctccacccctcatatgctctaa

SEQ ID NO: 53929 - DNA, 237 bp, Glycine max
  Peptide Sequence Number=SeqID_170707
atggacttaggagcaacccatcacatcaccaatcatcttgataacctccacctcacacaaacatatcatggcaatgatcacctctttgttggtgatggatatgctctccccatcacttacaatggatctgaagacaagggtttcaatactcaaagggccgcaaagggatggccattaccacatgccccatccaaccaatgcaccaacaacatacatcacgacctcactacctcataa

SEQ ID NO: 53930 - DNA, 750 bp, Glycine max
  Peptide Sequence Number=SeqID_170708
atggcttgtttgatgtctcgaacgggaagggagatgcagagatacaacagtagtggtggccgccaagttgtgggtggcactcgagctttctcaatggctgcactttcggataaacttgctttctgtttggtgtctgcctgtctggtgacagttgcacccaagcttttccaatggtgcataccttacagatataaagaagataatgatggcaatgtgagcaatgaattggaggtgcttgtggttagttcacaaaagggtcaagcattaatgttcccaaagggagggtgggaactcgatgaatctgtagaagaagcagcttccagggagtccctcgaagaagcaggagttacaggaatagttcagcatgaattgggccaatggagcttcattagtaaaagacttggaacatactatgaagggcacatgtttcctttgcttgtcaaagaacaacttgacttgtggcctgagaaagatctaaggagaagaatatgggcacaacacggtgggaggcgcaacatgcaacaaagaggtgggatacatagagaggggtggcgcatgagtcgaggaggaggaagtgaccttcttgcgggtgtttggccgaggtcaaggaagcgcagtggggtcgaggaattagagatgtgcaatggagtgagggtaagggaaggagacgcacggcagagtgagggtttgaaagggaagactttgaagtctaaagtctcaactctcaactcaaatattcaatctgtttaa

SEQ ID NO: 53931 - DNA, 594 bp, Glycine max
  Peptide Sequence Number=SeqID_170709
atgaccactaccgcgttctatttgatcacggtctacgcgccaacctttggcaaaaacgtgctgttattaagcgcctcggatagcctgctggtcacgctattggtggctatctccaatttcatctggctgcctatcggcggcatgctttccgataagtttggtcgtaaacccgtactggtcagcatgacgctgctggctattttcaccagttggcctgcgttatcgctgctggcccgcatgccggacttcgccatgatgttgtccgtgctgctgtggctctcctttatttacggcatctacaacggcgcgatgatccccgcgctgacggaaattatgcccaggtcggtcagggtcgctggtttttccctggcttacagcctggctaccgctctgtttggcggttttacgccggcgatgtccaccgcgttaattaaagtcaccggggataaggcggcgcccggctactggatgagttttgcggcaatctgcgcgctactggcgacgcttggtattcacctgcggctatgcgcatgttgccgtcgcgcaggagatcacggtgatgatttccggcggcttctctgcggcgttggataa

SEQ ID NO: 53932 - DNA, 456 bp, Glycine max
  Peptide Sequence Number=SeqID_170710
atgaaaaaaaacattctgaccggcatgattgccgcgactctgggcctgttcaacaccgctaacgctgaagggatggatcctgccgcattgaaaaacgtctatgacatcacgcgcaataccgccgggttgatgtcctactgtgtcgataaaggtttcctgaaagccgacagcatcgacaacgccaagaaaatggtggcctacgtggcggctattcccggcggcgtcgacacccgcgacggcgacaagcgcgaagcgatgggccgagaaggcaatgtgctgaacgacgacggcaaagtggtcgcgttggaaaaagaagcgccgcaggggctgcaggcatgtaagtcttcttcacgcgcccttacagggccgatgggatccgtcgccacaccggcggatccgcttccaggatcgcattcacgcctcgttttacctcccgagtacccgcatccggtttga

SEQ ID NO: 53933 - DNA, 816 bp, Glycine max
  Peptide Sequence Number=SeqID_170711
atgctgggctcttgctttggtaagctcgacctaggggacagcttcgcaggaacagaaaaggaagctgctaacactaaagaggtaacctgctataacaccctacaggatgatcgaaggcagaggaatcacatagagggatattattcgaatggtggagcaaaagtagctgttgaccagacctttatcggggaagaagagggacacgtcacgcaatctctctctccttcaatatcggggcagatccaacaaggacttgggccaggctgcattacgggcccaatttcgactcaaggagggtgtaataaggaagacatcctccctgtagagcttttgggggtgcaagttgtgcagattcaaaaagagggtgggccaagtaataatttaggcccaactttgaaaactgaggggtgttataaggaggaatccctacctgtaacccaacccctaaaagagaatccagacaagtattctaaagtttattttagacaaaaaaactctctctttaaggcccgactctcgcagattgaggaaaatcatcctcagcttcaagatggtgagaaggttccagaagatcaacttgtcaatcaggataaggccaaaaatcagagttatgtggaatcagaaaggaggttaaaaagcataattgaatgtagtgatgaggtgttggaagaggctcaacatttatggcatcttggagaaaacttaggcatggagacagctacagataacctagacttccttcacagttatgcttctatggagtgtagagacagaaaagaagctacggagttggggaataggaaacctcttaaatga

SEQ ID NO: 53934 - DNA, 261 bp, Glycine max
  Peptide Sequence Number=SeqID_170712
atgaaatttcaagtagagaggaaagagggaaagtactgcaatctggatgagagggtgacagacagggtcttgtatgatatattaattcaagcaggacgagtggtagacttgcacattcctaaagataaggaatcagagaaaccaaaaggttttgcctttgcagaatatgaaactgaagagattgcagactatgctgtccggcttttttcaggcctcataacactgtacaacagaacacttaagtttgcggtgcgttcttga

SEQ ID NO: 53935 - DNA, 222 bp, Glycine max
  Peptide Sequence Number=SeqID_170713
atggcatcatcaaaatatcaaagtcaaagtctttgcttctacgatctccctctttttgatgatgacaattcaattcctgaaatcaagatacaagcaatgttgatgcaatcctaccccgcaagggcattggatagaaaactccaagtagattgggccagagatgcaagagaaggccctagggttcttatgagccttagggtagatttcgggcccatgggctaa

SEQ ID NO: 53936 - DNA, 300 bp, Glycine max
  Peptide Sequence Number=SeqID_170714
atggcttgccgacaggataagagcaaggaatatgttgtcagtgaatcaagcatagtcttggagatagatctcagtgttccgatggttgacaagttctacctgaacaataggtggtacaatatcgaatatgaggccctacacctgctttgtgctttcgatggctgttatggtcatacggctagagcttctccaaacaatagtgaagatgagaaaatggcaagtgtggagaaggaggttgtgatggctccaataatgatagtgttcggggtcaaagttagggttgatgaaaatatcccataa

SEQ ID NO: 53937 - DNA, 174 bp, Glycine max
  Peptide Sequence Number=SeqID_170715
atgggggatgtagccgaagcggaggatagaggtggcatggagggtgtgccggttttgacgaaaaagacaatgaggaggttgagggtgattgttgtggagtggttgtgggatcaatgtgtttttcaatttgagaaaggaagggtggaggctccaattctcatcgacacaccatag

SEQ ID NO: 53938 - DNA, 333 bp, Glycine max
  Peptide Sequence Number=SeqID_170716
atggaccgttgttgttgcatgccccgactcctccttcgtcgaggtcctcaaactcttttgctttcaaatgtgctacctttgcaggctctctatacccatgtggttgtcgtgtcgctcaatgagaatggtgaagccgaagctttgagcaaagtggatgatcgaaaaatatctgaactcaagcatgaatggtggattgtttggatttggaaaaataaggagagaaagtcagttggaaatatcctttcaaggtggccggtagtgatcaaagagaagaagaatgagaagggaagaaagaagagaataaacaacaaaactaacaaattaatccattga

SEQ ID NO: 53939 - DNA, 1410 bp, Glycine max
  Peptide Sequence Number=SeqID_170717
atgacgacgctctccaccctgtcactgcccgccgcatatctggcgcaactgccgggcgtctatacgctgcgtccccgactggtagccgtcagcagccagaattttgccgatatggcctgcctgcataacttccatccccacatacgcagcggcaatccaaaaagggaagccatcgccatcctcacatcgcccgtcggtggcgggtattacctgaaccttcacgacagccaggccgggcgggatgacaccggtgagaaaacgccagggaatacggcaattatcgggaaaaccggctccggcaaaaccctgctgatgacggtcgtgcaacaactgatgcagaagtaccgcaacccggcgacattcgcgccttctgccaccctcaaacggctgaccacggtgtatttcgataaggaccgggcggcggagatggcgatccgccaggcgggcgggcgttatttccgcatccgtaccggcgagcccaccggattcaacccgtttgcgctggagccaacccgccggaacatcagtttcatcaaacggctggtgcgcatgctgtgccgccgtaacggtaagccgctcgatccacgcgatgaggaacggatcagtgccgccgttgacaccatcatgctggactatccgccggagtaccgccggttcgggatcacccggctgctggaagtgctgccggagccgccgaccacagacgcccgcaccaacgggctgcgtattcgcctgaaacagtgggcgcaggggggcgagttcggctgggtgtttgataacgaggctgatactttcaccatcagcgatgtcgataactttggtatcgacggcaccgaatttctggatgatgacgatatacgcggccccgtgaccttttacctgctgtatcgcgtgaccagcctgctggacggtcgccgcctggtgatgtttatggatgagttctggcgctggctgtccgatgtcgaattttcccgtttctcgctcaatatgctgaaagttatccgcaagctgaacggcatattcgtccccgcaacacagtcaccggatgaaatcgtcagacatcccatcgccccggcgattattgaacagtgcggcacccagattttcctcgccaacccgaaggccagtcatgcggattacgtggaaaaaatgaaagtgccggacagcgtttatgacacggtcaggaatctggatccgggcgagcattacatggtcatcctgaaaacaccgttgcgggccggggaaacccgcccgtttgtggcgatggcaaaaatggatctgtccgggctgggtaaactcacccggctcctcagcggcagtgaggacaacctgaaaatattcgatgccatttatcaggacggcatgcgacctgatgaatggaaagaaaccttccttgagcgggcaatctga

SEQ ID NO: 53940 - DNA, 474 bp, Glycine max
  Peptide Sequence Number=SeqID_170718
atggcgattgagaataccactgacgttgaaaaaaggataaacaacacactcagcgatatatcagacttatctgaccgtatatcgaatgcgcaggactcgaaagagtctcaggatctggctaacgccatcgcggcgaaaagcgtacagttaaatgcgctgacgaatcagtgggagatgtctgtcagacaggctgaacagcgaacgacattgctggaacagcaaagacagaaagcctttgaacagcagcagctaacggctcctgaaaccaaatccgaagcctggtataagcagcatcctgacgaaacttatgtggtttatacgcaatgcctgaaggatggtgaggcaagcgataactgcgaatttgcccaccgggcagcacttatgtttgcacaggaaggccagcccggggttaaggagaaattcgaggcgatatttcagcaggaagctgaaaaacgaaatgcagtgacacagtaa

SEQ ID NO: 53941 - DNA, 1032 bp, Glycine max
  Peptide Sequence Number=SeqID_170719
atgtccggtggcatttttgttggtatggacaaaaacatcatggatggactgaatgccgtactggaaggtcaatcttccacttacggcacgatgatcagcgtcatcatcgtcagctcttttaccctgtttatactgtttcgcggttatcagacgctggctggcaaactccggaccccggttgaagatgtcgcctgggatgtgggccgcatgttgctgatcaccacctttgcgttaaatcttgatggctggctggatatggcggtagcggctatccagggactcaaagacggtatcagcggcgatgataacgtctgggcgctgctcgataccgtctgggaaaaggcacaggcgctggggcaaaagttatttaatatggacacctcaacttacgtcaaactgaatggtggccttgccgaagtcctggtatggggcggctctattgtcctgctaatggcagccacctttgtcaatctgctcgccgaaatcaccatcctgttaatgacgaccaccgcgccgctctttattttctgcctgctgtacggttttcttaagccgatgttcgataactggctgagaacaattttcgcggcaatgttaacgatcatgttttctgccttatccatccgtatcgccattaattacctgcataagatactggatgctgcaacaaaaacatccgctgaaaccaatatggtaacactggcggcgcagtgcctgctggccgggattgcggcgggtgtggtggtctggttctccgcgaagctcgccagcgcactcagcggggccgccgtacaggcagtgctgcagggtgccgccatgagtggcctgagcggactggcgaacaaatccgccgacctcgccgggccgggggtaaagggcggagcccgcctggctgcgaaaggcggcatggccgccgccgcggcggccggcaggctcgccggcgcaggcgcgggtaaaaccgtgagcgcctggcagaaacgcgccgccgccatcgaaagcatgaaacgcctgaaccggcagcgtcaccgttaa

SEQ ID NO: 53942 - DNA, 891 bp, Glycine max
  Peptide Sequence Number=SeqID_170720
atgatgctgaaatacattctgctcctcacgggtttactggtgtcatgtgtggcatggagctccgcgacaccgcgcggcagcgcgtatgacagccggatgcagaacgtcacgtacaacagccagaacgccacggtcgtcagtacccgccccggctacgtcaccatgctggtgtttgacgatgatgaaaccgttatcgatgcgcaggcgggttttcccagaggctggaccgtgacgaaaagcgataaccgggtgggcgtcagcccgaacccgattacccagccggtcacggatgccagcggcaacaccgtcagccaggtgtttctgccgacggcaaaagactggaaaaccaatctgttcgtggtgacctcgaagcgcgattacagcctggagctgaacgtgctggataaagactcgcccgttcaggcatttgttatccgctaccgctatcccgatgagcagaggaaaaagtcagccgctgccagcgccacccgtcagcaacgacagcaggaaacactggaccgcaagcggatagcggcggcattcgggaaggctaccactccgcgcaactggcgctatacaaaacgggtggcagcaggctcagccttcatcgccccggactttacctgggatgacggtcgtttcgcgtatatcggtttttcccccacgaagaccctgccttccgttttccgggtggttaacggccaggagcaggcggtcacgcccggaacggttaaacggggcagttacaccgtggtggtggttccggcatcgacgcagctggttctgcgttacggcacctcggtggtgggggtcgaaaacgacggatccgggcgtatcccgctgaccaacagtgacactgtttcaccctccgttacgctggaggcaaaatga

SEQ ID NO: 53943 - DNA, 226 bp, Glycine max
  Peptide Sequence Number=SeqID_170721
atggcatatcaggagtcggagcagaaaacgccgcccggccagccggaagtgacccgtttccgtaagacgtccggtcgccgcacgctgatcgtcagcctgctgagtctggtcctggtcatcgcgctggcatccggtggcgatcgtcttctcagcgccctgaaaaggggtgatgagaaagaatctgacaccgcgccgccgccttcctccggggcggtgcagcaggagc

SEQ ID NO: 53944 - DNA, 1934 bp, Glycine max
  Peptide Sequence Number=SeqID_170722
cttatcgataccgtccaccaccctcctccggggcggtgcagcaggagcgtaagaatctgggcatggacagtaacccgtttggcctgttcgggccagggaggcagaaaagcgcagacccggcccgtcagaccgtcactaccggaccagccctgccagcggaaccgcccgccctgaacaaggctgcagcgcttgcagacgggctgaacagcagcacaacggctggcggcaatgcctacacgtcccgtagcgaaccgcgcaacagcgcgggaacgtcggacagcctgtctgcctccacggcgtacacatcctgtcagtcggtactggtcagtggcgaagatggacgcctgcgctgctcggatacgacagcaccggcaggcagcaataacaacgacaatccgggcgttgcccgcgtcaccggtgtcaggcggctgggccttgatcccgatctctatatcccggtggatcactatattccgtgttcgatgatgcggcgcttcgtgtccgatgttggcggtcatatctcctgcctgatcggtgaaaatgtctggagcgccagtaaccatgtgaaactgatcccggcaggaacggtcgcccgtggtgtctaccgcaccggcgcactgcacatgggcgcagccggatgtttgtggctgtggacggagctgcgcacgccagagcccggcagcctgcaaatcccgctcaccgatacgcaggccaccggcccgctcggtgaggcggggatcgcgggctggatcgacagccatttctgggagcgtttcggcaacgccctgatgctgagtaccgtgcaggacgtggcggcagcggcatcagaggccgcgccgggtaaagaccgcaataccgactataccgaaaacacccgtgccgccacggcggaaatggcgaaaacgacgctggaaaacagcatcagtatcccgcccacgatgtacctgaaccagggcgatgtgatcggcatcatgaccgtcgaagggctgaccgaaatcgcgattaaccgaccgggggaactgcacaccaaaataaagggggcatggcagcgggatgaatccccggtcacgctgcgtcagtgtcatgcttttgccagagcgctggcgtcctggcaggacgataatattgacgatacgtcaccgatactgtcggccactctcgaatccggcgaacgtattcagacgattattcccccggcctgtgagcgtaatacggtatccattacgctgcgcaagccttcgtttgagcagaaaacacatcagtcatggattgatgcaggattttatcagcgtgtggctggtcaggagaaaacggaaagccaggatgatgcactggttcagttatatcaaagcgggaacatcccccgttttatggaaaaggcggtggaatacggcaaaacgatttttattgtgggtgaaaccggctccggcaaaaccacctatatgaaaacgctgctgcattatattccgctgcatctccggttgataacgattgaggataatcctgaaatccgttttcatcaccacgccaattatgttcatcttttttacccggcggatgccggggacaacgccattgtcacgcccggcagactgatccgtgctaattatcgcatgaaccctgaccggatattgctggcggaaattcgcgggcgagaggcatgggacgcgctgaaaattattggttccgggcatgagggattaatcacctccctgcatgcgggcagcccggaagaatgtattgaagggatcattgaccgctgctatgaaaaccccgactgccggaatattccttttgatgtgctgttacgcaaggtactaaaaagcattgatgtcatcgtcagcattgatatacacggcgatattcgccggatgcatgatatttattttaagccagttcatttaaatggcatgaaagagacattcagaaaataa

SEQ ID NO: 53945 - DNA, 342 bp, Glycine max
  Peptide Sequence Number=SeqID_170723
atgaaggtcagcgcgccattcactatcggcgacagtgaaacggccagcttattcaaaatcacgatgcctccttcgtcagctgtggccgctgtacggccatgtgcaggaaagcatgcttccctgcacgacacggcgtgcgccagtacatgcgggctggacgcccttattgcctgtcgcatgggggtaatgtcgcagctgcacgccgcgccaaaacccccaatatcaacagcggcacaccgtcgcccgctacgcgcgaccaccccctttaagacggtcgctttcgcctttttcttccctttgcttgttcctcgcagcgggaataaaagggaagctgacctttaa

SEQ ID NO: 53946 - DNA, 1368 bp, Glycine max
  Peptide Sequence Number=SeqID_170724
atggggccggtacttatctggattttccagtggctttatcggggcctggtcatcggcagcgtcccagtgctaacctggccggtgcttatttcctttactattgccggtattattttccatattctgctgcgcagagtattaacccccgaactggataaaataaagaaacgccttgtcagaaaaaccacgcttgaacgggaattacgtactgatgtccgtacggtgaaatccctgctgccggaaacgctgcattatgacccgctggattatatcgacctgaacaaagggttatttatcggcatggaccgcgatattcagccgatgtacctgccggtaaaggactggcaaaaacaacacgcggatattatcggcaccactggcgccggtaagggcgttgccaccgggatattactttatcaaagtattttggctggtgaaggcgtatttgttatggaccccaaggatgatgaatgggccccccacctttaccgtaaagcctgcgaggatgcagggaaaccctttgccttaattgacctgcgaaaaccccaataccaattaaacctgattgaagcgatcaccgccgatgaactggaagagctttttgttgccggtttcagtctggcagagaaaggtcaggagtcggacttttatcgcattgatgaccggaaagcggcccggatagccgcgcagtttgtcacccgtaatactgccgcaaccattcgggatgtgtataacggagactacgttcagggtattgccgataaaataaaagccttttttgggaaaattgaagagctggccctgctcaatgccatcaatgcgccgacaggattttcgctcaataagatatttaaggaaggtggttgctgttatgtgattggctcaatgcgcaacagcaaaatcattaccgctcagcgcatgctgctggttcgcctgtatcagctagcggaaaagcgcgagcgagtgaaaaaagtgccccgccccattgctatttatctttccgaactgaaataccatttatccaggacagcgctggaaggtttgggcgcggcacgggataaaggcgtgcatattattatggaccaccagtcgattgccgatttaaaagactgcccggcagatttgaaaggtgacgccgttgtcggcgccgtcgttgagaacgccaaattcaaactggtttatcgcgttatggacccggataccgctgaatgggtagccaggatgtcaggcactatattagtcgatgatgaggtccgcaaagcgaaaaccgatgccgtgctgacagagactatcgacagtgaacgcaccatcagacaggccgagcgtttctttaccgacagcaatatgatcctgaacctacccgatttt

SEQ ID NO: 53947 - DNA, 952 bp, Glycine max
  Peptide Sequence Number=SeqID_170725
cgtgatcactcgtatgaggaacgcactgcacgggacgatgaattcaactctgccgggaggatggcgtccttgctgcaggctgcaaggcactatgctgatgaacatcacaacggagcgggggttgccgtaacgccagttgatggggtattcattctgcgcgagaccgcgcctaccgcattgcaattcgctatcactaaaccgttgatcgcaatggtgctgcaaggcagtaaacgcgtgaccatgggcagcgatcgttttgattttggtgcgggtgaatccttgctgatcaccatggacgtgccaaccgtgagtcaggttatcagcgccagtgccgacaccccttattattctctggtcgtggaactggatgcggcggtgattagtgaactgatggcaaatatggtcgggctggaggcggcaacggatttgcccgtaagcattgatcagatcgaagaagatgtggcagaagccgctttgcgcctgctgaacatgctcagcagaccgcgcgcgctcgccgtgctgggcagccagttggtgcgggagttacattactggctattgtcaggacgacacggcagcgcgctgcgcgccctcggcagcactgacagccatgcgcggcggattgcgcgggcagtcgcgatcattcgggctaattatgcgcaaccgctgcgcatgaaaaccctcgctgacgccgccggtatgagcctctcggtatttcatacgcatttccgccatatcaccacgctcaccccgctgcaattccagaaacaactgcgcctgcttgaagcgcggagactgatgctgacggaaggaacggcgatcggtattgcggctaatgcggtaggatatgagagcgtgacgcagtttacccgtgaatattcacgactgtttggttcaccgccagcccggaatattcgggaaacccgcgcactcgagcgttcagccctgtccg

SEQ ID NO: 53948 - DNA, 504 bp, Glycine max
  Peptide Sequence Number=SeqID_170726
atgagagtttttagggtttctctcctagtgggagttttaggtttttgctttcttatatgggttagggagaaacgagtgaaggatgaccttgcaccaaggatcatgagtattctaagttggaattgtcatgagataggtcattggagagcaattcttgttcttaaagacgatgcaaaaattggaaaccttttttttttgcgaacccctatgcaaagattgatggagtatgaaaccaaattggttttgatggagtgtttggtgttgatagagaaggaatgggaggtggaatttggagaaatccttttgaatgagaaatggtgtttgatgggttattacggctactcaaagaggcctagaagaagggaaacatggacacttattagaagtctaacagaggatatgtcccttccttggtgtatcgacgcacataacattgatacagtgtctaacatcaagatcggaccggtatggaagatcaaagaatatcgacctcttcatccatag

SEQ ID NO: 53949 - DNA, 312 bp, Glycine max
  Peptide Sequence Number=SeqID_170727
atggatcaaacttggatgaatgcaagttgcatgagctttgtgtatgaggaaggtgttgaacagttcttggaattcgtttatgatagaagtcaatcggatgaggagggaaaatatttttgcccttatgatgtagaaatgggagatcgcttagaggatatgattcgtaatctaggacaagagtattttcagcaagtacatgctcctatgtatggtacattggaaaatgattccaaaaaagcctttgtatctgaggtgcaagaagtcattgacactattgtcaatggtgttaagtctggtcaatgtcaaggctag

SEQ ID NO: 53950 - DNA, 162 bp, Glycine max
  Peptide Sequence Number=SeqID_170728
atggagatttacatcgtcttctgcgcagactacctctgtcaagcactaacccgtgagactaacgtcgtcttctgcaccctttgtcaaccagaggcaagtgagcccactgacacatggagatttacatcgtcttctacgcagactacctctatcaagcactaa

SEQ ID NO: 53951 - DNA, 483 bp, Glycine max
  Peptide Sequence Number=SeqID_170729
atgcgagagtggaactcgatgggcatgcagcgacacaatgagcaacacggtggtggcacagtggacacacagcgccacaaggagttgagtgatagtgagagagcgcaatttcttgacgtggtgagggcaagttggcaaggtcataggagcttgcaacttgtggacaagaacaagaactattttaagaaggttgatgtcttcagaagtggaaaaagagtcaaatttaaggaggacatccaagggtgcaggagagagatggagaatgttcgtattcgagatgaccgagatacaggggttagatatatcaagctccaaaagataatggaaaccttcatgatccaaggggacattttttggcttcagaaggccaagatgttttggtatcgtgagagggacaagaatactagttactttgatgctaccgtgttagtaaggaaaatgaggaatagagtcaaatgtctattgtgtgaagatggagtatag

SEQ ID NO: 53952 - DNA, 210 bp, Glycine max
  Peptide Sequence Number=SeqID_170730
atggttgaaaaaagaaggaataaaaaggaatggatttggtggaaggatttatgcgctgcatgtggggcaatagaggaaggtaggtggtttaacaatgctgtgaggtggaaattgaggagcgataaaaagaaagttctgggaagatggttgggtcagaggaggggtttgggaatggagtttcagatggagaaggaacgtgttgaaaagtga

SEQ ID NO: 53953 - DNA, 645 bp, Glycine max
  Peptide Sequence Number=SeqID_170731
atgagagctcaacccgttacatgccttagatgtctatttctaggtgtaagagagagctcaacccatcacattcgtccatgctctgttgtgagggatattaacaaaatcattgagaggtatcgccaatgtcgttacagcaagtcgcagactgacgattcattggaacacgattcacagagttcataccatgaattcttgaaattaagagcgaaatatgaatcacttgagctgacacaaaggcattttcaaggagaagaacttgagccacttagctttaaagatttgcagagccttgagaaacaactagacataacgctcgcactaactcgacagcatcaaacgaagaaactcttggcacgagcagatgaattacgcgaaaaggaaaaaattactacctgtaaggttcacaagttggaggatcttaacaaacaattagagtccaaggaaaaagatgaattctcaagcttcatccttgacaataacaattacattcaagtgcatgctacacaaggtgatcaatttgagtctgggacaacactaaacacatgtaggtttcaacgccaagattcaaaggaaaaagcaattgataccaagacagacggtagtcaaagcagtcacaacaaaaacaaaggatggctattgtga

SEQ ID NO: 53954 - DNA, 486 bp, Glycine max
  Peptide Sequence Number=SeqID_170732
atggttatgatggatagctgggtgcttgagatcatcatttatattagtgctggtcaatgggtctcccacctcagagtcctccccacaatgaaatctcagacaggggaacccattggcaacattcctgttcattattgtagtagaaggcttaaaagctttgattcgagaagctcagaagaagaagatgtttgggggttaattcgttggaaggaagaagatgagtgggtaaataatgtcgctgattttctaaattatcgcttgttatctatgccctttacctacttggggattcccattggagctaacctaaggcaaagcgagacatggggaaccatcattgcaaaggtcccaaagaaagtggtgggtaggttggaaaagttgcaatggtggttcttatggggaggggaagatgaccaaaacaaaatatcatgggtcaattgggaggatatctacacatctagggagaaaggaggattggggatttga

SEQ ID NO: 53955 - DNA, 261 bp, Glycine max
  Peptide Sequence Number=SeqID_170733
atgggcctgaaatctactctaaggctcatgagaaccctagggtcttctcttgtatctttggcccaattttcttggagtcttctatccaatgcccttgggggggtaggattgcatcaccaacacccttgttggactttccttaccaaccttgtgttggactttccttgccagccacctgttggactttcaacatctcttcaccacagtgccataattgttcttggcttggagatcatctgctcaaccgtaacacccacttga

SEQ ID NO: 53956 - DNA, 351 bp, Glycine max
  Peptide Sequence Number=SeqID_170734
atggccttgcatgcgtgccatgtggacacgttgttgaagattcctatcatatggtatggattgctggacatttgctcggtaccccctgggtcacctattgagcacttctgccaaatttctcacaggctacaaggacatgtcctaaactcttggtggaaagctggttggtgcgttattatctggaacatttggtataacagaaataagatattgtctggaggaggagaaggccaagatccatcttctcatgggcgagggtatagggatccatctctctttattccttggcctggtgcttctaagctcgtggagcttctagctttctttctgtgcaattcttttgcaccctag

SEQ ID NO: 53957 - DNA, 491 bp, Glycine max
  Peptide Sequence Number=SeqID_170735
gtattccgattggagctaatccaaggaggttggagacatgggagccaatcatatccaagtttgataggaagcttgcattttggaagcacaaacacttgtcatttgctgggaggatttgcttaattaacttggggaaggagaaaatatcttgggtggggtggaaaaatatttgtagtccaaaggatgatggaggagcattatgggagagggtgctagattctaaatgcgctaattggcaaggtatgtgtgagaataaggagagtggtgagagacactctaaatccatttggtggagagacataaaacaagtggaggtagaggtgatgggtggtttgaggatatatatgatggagtggaaaattggagatggtacacctactaggttttggaagcataggtggttagggagatgccaagatggatggatagtagatgggaatgagacttttggtggaggagatagtggtttgaatgggaaaaggaattggtag

SEQ ID NO: 53958 - DNA, 249 bp, Glycine max
  Peptide Sequence Number=SeqID_170736
atgaagaaaggagaagattcctccttagccccaaaatgcaatgaatgcgatcaacctgagcacttgagattcgattgtcttgtccctaaaagaagaattgaaaaatccgacaagagaaacttcaaagaaaaggaagaaaagaaagcatacatcacttgggaagataatggcttggattcttcaagtgattcagaaaatgaaatcataaatctggatctcatggcgaaagactatgaaagcggagaagag

SEQ ID NO: 53959 - DNA, 579 bp, Glycine max
  Peptide Sequence Number=SeqID_170737
atggcactttcctgtgtttatcgcactggtcagagattcggtgtcggtcatttaattgatgtgctcatgggcaaagtcacgccgcaagtagagcgctttggtcatgaaaaagtcagcaccttcggcatcggcaaaaccctcaatcaagcacaatggagcggcgtctatcgccaattgattgcggccggattattagaaactgatttatcaggttacggtggtttacaccttaccgaagccgcacggccagtgctcaaaggtgagcaagaagtctggctacgccgcgatgccgaacccgaaaaacgtatgagcaaagccgagcgtagtgcccgcgctaaagaagcctttgaaggtgcgagtgacgacccactctggcaagcacttaaagccaaacggctggaactggcaagagagcagggcgtgccaccgtatgtgatttttcacgatagcaccttgctggaaattcacaatcgcaaaccgcagaccttggatgaaatggggcagatcagcggaatagggcaggcgaaattgcagaagtatggggatgcgtttttgcagactatagaggaaactatttga

SEQ ID NO: 53960 - DNA, 482 bp, Glycine max
  Peptide Sequence Number=SeqID_170738
atgaccgacaccgaatctctgaccagtgcgataaacacaggaaagtgccatttgcgcgacttgggtggcttgccaggtttcgaccggatgcaggcagttatcgcattgctcgcaggcgccgggatggctttcgccaaagtagcgcaaaatggtttggtggcggcaggcggtggattcgcagtagccgagcaaggcatcaagcttcaggcgttccagccgtttgcgttcttcggaggcttcgccgctatcgagcatttgccgcatggagacgacatcgcccatgccgtagaccatccaggcatttgcggccaaaccatcacgcccagcgcggccggtttcctggtaatagccttccatactttttggcaggtccaaatgtgcgacaaaacgcacgttgggtttatcaatgcccatgccaaacgcaatcgtcgccaccatgatgatgccttcttcacgcaggaagcggcgctggtgatgttcgc

SEQ ID NO: 53961 - DNA, 140 bp, Glycine max
  Peptide Sequence Number=SeqID_170739
atggctgcgaaggttatgttcggcgcactcgatgacgtttttgccaacaccaaggtcaagccaaaggacattaagatcgcccttgtgaattgcagcttgttcgatcccaccccttccctcactgctatgattgtcaacgg

SEQ ID NO: 53962 - DNA, 306 bp, Glycine max
  Peptide Sequence Number=SeqID_170740
atgccgttcgttaggatatccgactcaactgcatcacgattcaaaccaaccctagacccattctcgacctttccttctccctcaccatcaaggtccacaatagagacttcttctcccttgcctatgactccctcaccaactgctgccgcatcaggaccgcaactccctcactggtgtcattctgttcaatattggagaggatgcaaggcaggcttgatggaatcaacaatagtgacagcaacaagggcgatgaaaggggttaagcgagcaaatgatgtagtggagtttgaggaagttagggtttag

SEQ ID NO: 53963 - DNA, 132 bp, Glycine max
  Peptide Sequence Number=SeqID_170741
gtagatggtagcatgatgggtagccctcctagggcagggtttggaggactttgtagggttcaccatggaagctttcttgtgggcttatatggtcatgttggagggcaagagatcttatatgctgagatttaa

SEQ ID NO: 53964 - DNA, 189 bp, Glycine max
  Peptide Sequence Number=SeqID_170742
atgaccccttcacagcaatatcatgacccaattccaacacctaatgccccgctgacgaagaaaaagcggggaggcatcggggcagaagaaatcctgatcgccaagcacgaagatgggatcgaccatgtggcacatcctcacgacatcatggacaccaaaatgaatgatttgcatgtcttcgtttattaa

SEQ ID NO: 53965 - DNA, 375 bp, Glycine max
  Peptide Sequence Number=SeqID_170743
atgtctcttgtcactctctttgggaaacttctagaacatgaaatggaacttatgagaatccatcaacatgaagagaatgacaaaaagaataaaggaattacactcaaagcctcatcatcttctattcatgaggaaaataacaaagaagacctgaatgaaaataacttagaagaagatgatgatttcagactctttgtgaagaaattcaataaatttatgagaaacaaaggaaatcaaaagagatcaaacttcaatccaaagaagaaaggagaagattcctccttagccccaaaatgttatgaatgcgatcaacctgggcacttgagatttgattgtcctgtctttaaaagaagaatgaaaaatccaacaagaaaa

SEQ ID NO: 53966 - DNA, 1551 bp, Glycine max
  Peptide Sequence Number=SeqID_170744
atgatgcagttgaggaaaacggacacgttgcttcgttccgttggaacgtatcttgccgtcgttcgccacttttccgcttcggcggaggcaagagtaggctccgccgccgccagttccagcggcggtggagacacgctggggcggaggcttctgagccttgtgtacccgaaacgcagtgccgtcgtcgccatcaacaagtggaaggaagagggtcacgagccccctcgcaaataccagctcaatcgcattgttcgagagcttcgcaaggacaagcgttacaaacacgcactcgaggtatgtgaatggatgaccttacagaaggatatgaagctggtgcaaggtgactatgctgtccacttggacttgataactaaagttcgtggtttgaatagtgcagaaaaattctttgaggatcttcctgatagaatgaggggcaaacaaacctgctctgcacttctccatgcctatgtccaaaataatttggttgacaaagctgaggccctcatgttgaaaatgtcagaatgtgacttattgataaatcctcttccttataaccacatgatatctctctatatctcaaatgggaagctagaaaaggttcctaaaattattcaggaactaaagatgaacacttccccagatattgtcactttcaatttatggttagctgcttgtgcctcacagaatgatgttgaaactgcagaaagagttctgcttgagttaaagaaggcaaaaatagatccggactgggtaacatacagtacattgaccaatttatacataaaaaatgctagccttgaaaaagctggagctactgttaaagaaatggagaacagaacctcgaggaaaactcgagttgcatattcctctcttcttagcttgcatacaaacatggggaacaaagatgacgttaatcgaatatgggagaaaatgaaggcctcctttcgcaaaatgaatgataatgagtatatttgcatgatatcctcactgttgaaacttggagactttgctggagctgaggatctttatagggagtgggagtctgtttccggtaccaatgatgtcagagtttcaaacatacttcttggttcatacattaaccaagaccagatggaaatggctgaagatttttgtaatcagatagtgcaaaagggtgtcattccttgttacactacatgggagctatttacatggggttatttgaaaaggaaggatgtggaaaaatttctggattattttagtaaagctatttctagtgtgacaaaatggagtccggatcaaaggttagtacaagaagcattcaaaatcattgaggaacaagctcacactaaaggagcagaacagttgttggttatccttaggaatgctggccacgtcaatactaatatatataatctatttcttaaaacttatgcaactgctggtaaaatgcctatgattgtcgcagagaggatgagaaaggataatgttaagttggatgaagagactcgtagactattggatctaacgagtaaaatgtgtgtgagcgatgtttcaaggattttatcctaa

SEQ ID NO: 53967 - DNA, 504 bp, Glycine max
  Peptide Sequence Number=SeqID_170745
gatgatggagaaattgaaggggatgtgaatcatcgcattcaagcaggatggatgaaatggagaaaaacatcgggggtgttatgtgatgcaaaggtaccgatcaagctaaagggaaagttttatcggactgcggtaagaccggcgattttgtacggaacagaatgttgggcggtcaagagccaacatgagactaaagtaggtgtagtggagatgtggatgtgtggtaagactcgacaggataaaattagaaatggagctattagagagagggttagagtagcgcctattgtagagaagatggtgaaaaatagacttaggtggtttgggcatgtagagagaagaccagtagactctgtagtgaggagagtagaccagatggagagaaggcaaacaattcgaggcagaggaagacccaaaaagactataagagaggttatcaagaaagatctcgaacttaatgatttggatagaagtatggggctgaaaacgcattaccttaactga

SEQ ID NO: 53968 - DNA, 1669 bp, Glycine max
  Peptide Sequence Number=SeqID_170746
gttgcctggaaaggcatatgcgaggaggcagcatctatggctcacgggtgcaaatgaggtggacagcaaaacattttcacgagctattctagccaagactgtggtgtgcattcctttattggacggtgtggttgagtttggcacaatggataaggtaaccaaccagccctcacttgactacctcgtaatgttacgtagcaacgttcaagaagacctcagcttcatccaacacgtggagaccttcttcatagaccacctcaaccctttgccaccgaagcctgccttgtcggagcactcaacctcaaaccccgcctcctcctctgaacacatccccgccgtcatgtataccgtcgtggatccacttgccgccaatcccaacctaaatgatgacatggatgaggatattgaggaggaagaggaggaggaagaggaagatgaggagccggaatctggttccgaagacaaagccggatacggcatcgctcgccaaactccgacaccagccatggcggcagagcccagcgagctgatacaactagagatgccggaggacatccggcttgggtctccaaacgatgggtcaaacaacttagactcagattttcacttgctggcggtgagtcagggtgttaacacagcggggcaggctgagtcaactcggaggtggggcctgagtcaaaaccccatgcaagttcaactaccgacttcagcccttcatccattggaagacttgacacaagaggacactcactactctcaaacagtgtccaacatcctccaaaaccagttcacacggtggccagcctcaccctcctccgttggatacgtctcatactccacgcaatcagcattcgcaaaatggagcagccgcgccagccaccaccacttccacccggcggcggcggcggcggcggacggcaccagccagtgcatcctcaagtacatcctcttcacggtcccgtacctccacgccaagaaccccggcgagagttctccccaaaccaccgccgcggacaccaaactccgcggcaagggagcgccgcaggaggagctcagcgccaaccacgtgctggccgagcgccgccgccgcgagaagctgaacgagaggttcataatcctgcggtcgctggtccccttcgtgaccaaaatggacaaggcgtcgatattgggagacaccatcgagtacgtgaagcagttgcggcggaagatccaggagctcgaggcgcgtaaccgccagatgacggaggcggaacaacgttccaagctcccagagatagcagttcagagaacaagtagcagttcgagcaaggagcaacagaggagtggggtgacaatgacggagaagaggaaggtgaggatcgtggaaggggtggtggcgaaggcgaaggcggtggaggctgaggccaccacgtcggtgcaagtttcgatcatagaaagcgacgcactgttggagatcgagtgtcgtcacaaagaagggttgcttctggacgtgatgcagatgctgagggaggtgaggatagaagttataggggtgcagtcgtcgcttaacaatggggtgttcgtggcggagttgagggctaaggtgaaggaacatgcaaacggcaagaaggtcagcattgtggaagtgaagagggcacttaaccaaattataccccatgctgttgactaa

SEQ ID NO: 53969 - DNA, 648 bp, Glycine max
  Peptide Sequence Number=SeqID_170747
atggctgctattcatgttcatgatgatggtgaagttggttttgaagaaggaatgctatggttaccctctcatgttctgaacgaggcatgcggcactaaggtatgtttgaggaaccgccaccaaaagttccaaaaccatcagcaaatgcatcagcagcgtcatcataaatcacctggagaaccaaaatcacaggaccgatgcacgtgctcagtctggtatggaatttggaggtttcgagagtactcaaaatctggctcaagatcttcgtatcaaaggccaaaacttgccaatggtggacctggaatgcgagctattttcttaggatccacgcatagatcatgtggcactggcgtgttcttaccccaaagagcaggcacaaacttccaaccaagcaagaggccagcttgtgctcctatcctagttccagctggagttattcaagctctaaatcttaatgtgcgtgcattaggtctgcagatttcacccccgcaagttcagagttatgacccaagatgcagggaagtatacaataataattcagaagaaaagaaaagtgatcagaaagattcgtccaagcaatgtcgttttatatctcagaatcaatgttctactccagagatatttctcccaaaggaatggacttactag

SEQ ID NO: 53970 - DNA, 1338 bp, Glycine max
  Peptide Sequence Number=SeqID_170748
atggtgggcccctccagcgccagcggccgtagggaagttagaatcgccgtcgtgggcgacggagccaccggaaaatccacactcatagccgcaatggcatcggagtctttccccaagtccgttccgcccgtgcttccccccactcgcttgccccgcaatctcttccccgattccgttcctcttaccctcatcgacacaccttccagcttggcaaaacaaggcacacgcaatgaagaattgaagctagctgatacagtggttttaacctatgcttgtgatgaaccggtgagctttgagcgtgtgactacttactggctccctgaattgcacaagttggaggtgaaggcacctgtgattgtggtcggttgcaagcttgacctgcgggatgaaaaccagctagtgagcttagagagtctcaccactcacataatgaaacagtttactgaagttgtcacctgtgttgaatgctctgcagctacactttatcaggtcccacaagttttttattttgcccaaaaagcagtactgcatccagtagatccattgtttgattatgaaagacatgctttaacagatcgatgtgtgagggcgttaagaagaatatttgttctttgtgatcatgacatggatggtgccctcaatgatgaagaactcaatgagtttcaggttagatgcttcaatgcaccattgcaacaatttgaagtagcaaatatcaaaacaattgtagagcagaaagtacctgaaggagtcaactctattggtcttacctttccaggctttatttatgtccataatttgtttctaaagaaagggagaacagagacattatgggctgttctaagaaagtttgaatatgataatgatttaaaactccgggatgatttccttcctgttccatccaagcaggcttctgatcagagtgtggagctgacaagtgaagccgtagagtttctgaatggtatctttcgattgttagatacagataaagatcgatacctacgacctgctgaagttgataagctatttgatattgctccggaaagatgcggaagcggaattggtgaaaacacggagcttgatttaatgaaattttggatgaaactacccttgtttttaaggatgagtttacacacagcagtcgcttccacctttctttcatatccatcctttctcatcgtgacctatctccataagtgttgctcttcaaatgaggtttatggagtgtgggatcttcatgaaaggatccaaatcttcgtgcaaatcttccagcacctcatggaggcactccaccctgccattctcgatcgtgcaaggtttggatttggcgtggcgaggtag

SEQ ID NO: 53971 - DNA, 1014 bp, Glycine max
  Peptide Sequence Number=SeqID_170749
atgacctctatgattaacactatcaccccttgtgccaacttcatcactggaagcattaacaatggtttaactccatcagctacgtgctgtgattcatttctgtctttgataaccactagcgtggattgtgcttgccttctagtatcagctaatgttccattgcaaatacccgttaacagagttcttgccctcttccttccacaggcatgcaacgtgggtcaaatgcctgcactgtgcaaagcctctgcttctcctttaccggctccaggcccagctctacttggatcaaatgaccaaactcctccgcctattgctttttctcctttaagcccacaagtttctaacaccattttcgaagttgaagctccgaaatctgagattctgcaaccagcattggcaccagcatcagtagaatctacaccaatgaagcagaagcacccacgaaaagttcaggaattagacaatgcagaaacatcctgtatgggttggaaagcagctgagaaactcattaggcgctggaaaattctaagaggggataatgttatgataacaaggggcaaagataagggtgagaccgggattataaagcgtgtcatttgctctcaaaatcgtgtcattgtagagggtaaaaatctggtaaagaagcatatcaagcaagggcaaggtcataaagggggaatctttacagtggaagacccactgcatgcctccaatgtgcaagttcttaacccagtgacaggccttgcaaggttggagttaaaatatcttgaagatggtactaaagtcagtgtccagaggaataggagcatcagggttcatagtccctcgtcccaagatcttaaagataagaactaccccaagacctacagtccagccaatagagaattgagaaaaggtgagagacagaaaatgaacttgaattatgagaaagttggtcctaaagatactcctatgaatcttgtgctagagaagacttacgatgctaaaacaggacggggcatgcctgaactttaa

SEQ ID NO: 53972 - DNA, 363 bp, Glycine max
  Peptide Sequence Number=SeqID_170750
atggctgcgccactaggcactagccttcaaagcatgttgcaggctgcggtgcaatctgttcagtggacttatagtctcttctggcaactttgtccacaacaagggattctggtttggggtgatggttactacaatggagcaattaaaacacggaagacggtgcaaccaatggaggtgagtgctgaagaggcttctctccaaagaagccagcaacttagagaactctatgaatcactgtccgccggagagacaaacccgccttgtcgccggccttgtgccgccttgtcgcctgaggacttaacagaatccgaatggttctatttgatgtgtgtctcattctcctttccacctggtgttgggtaa

SEQ ID NO: 53973 - DNA, 417 bp, Glycine max
  Peptide Sequence Number=SeqID_170751
atggagtggcgcgccttaggggcgatagagatggatttttacgcgtctaaagcgcttttccccagcgcggaacagccgctctcgctgctggagctctcgctcacgccgcaggtgattatgcaccctgattctgatgagcccgtggcgcgccgcctgcaaatttcggggcataccattttcaccaacgaactggagatgctgcgcgccctgctcgaacagggctgcggctggggattcttgccgacgcacatgcatgcggaacagtggaaaaacgtcaacacgctgcgcaccgaagtgggcagccaggggatcagccaaaccatggtgaccatctggaagccgggcaatgaccggcgggcgctgattgatgagacgttggggttgttgccggggttgtggcggggagctgaggggtga

SEQ ID NO: 53974 - DNA, 153 bp, Glycine max
  Peptide Sequence Number=SeqID_170752
atggcgcgcctggcagatgcccagatcggcctggccgtttgccagcaggctttcagcttcgtcgcgcgaggcgttaatcaggctcagccgtgtgttgcgttgggccatggtggcaatcagtgcctgcagcagcgcgcggggcgtgaagggatc

SEQ ID NO: 53975 - DNA, 687 bp, Glycine max
  Peptide Sequence Number=SeqID_170753
atgcagtctgattgctttctgctacttcatagccaagctggaagagccagacagcaaagcttgattgaaagcctgattgcgaaacccatcaagaatgcagatggaacaaacaactatcgctacaagcagctttttatatccacccacaacctagatttcttgaagtatctaaagaaaatatcacttcctaatgagaagaatcacggtggatgccaacatttcatcgtggagagaaacggaggggcaagtcagatttccctgatgccttcgtatctgcgagattacatcacagaattcaactacctgtttcatcagatctacaagtgccgtaatcaaggtggagcgaatgaatctcatgagccattttatggatttggtaacaacctccgtaagttccttgaggcatttttattctttaagttcccgcaccaagatgacaagaatgatgcctttgagcggatcaagaaattctttggcgaagaggatccgactgcaatagctcttgtgaatagacttaataacgagttttcacatctcgaatcgattcctgatcgtggatttaaacctgttgagattccagaaatttccaaggtggcaaactacgtgttggacaagatttatacggcagatccgcatcaatacaatgcgttattgaagagcatcggtgaaccacccaggacacattag

SEQ ID NO: 53976 - DNA, 813 bp, Glycine max
  Peptide Sequence Number=SeqID_170754
atgctgctgagaaacagatcaagagctgtgacgaagccaagtttgatgggtgatcacagctcctcccagccatgtccaaatcagagttacaaaagaaccatcattccttctctattttcaccaaaattccgagacttcactgccaagtgtctctcagctggagctgaggctttgagaagtcccacatcgattcttgacaccagagccttatcatccccatttgggagtcctttgtcacatgaagcagcagcctcagaaaacacaacctcttgggactccaaatgcattggccttgctcttgttggtgcactcaaagatgaaacttttcctcagaattcaactaaaccaagtagtggaacggttctgtttggaactaagcatagagtaaaaatcccacctttgcctctgtcactgccaccaccttcatttgaatccaaaacatgtgcttctgctgctgctgctgattgtgctgccaaaaccaaggattctccattatctgttgcaactggtgttctgagtttgagtgagatggagctttctgaggagtacacgtgtgtgatagcacatggacctaatccaagaacaacacacatattcgacaattgtattgtggaaagctactgttccctgccaaatacacccaattctccttcactcaatttccttagcttctgtcacacttgcaagaagcatcttgagcagactaaggacatttttatttacagaggagagaaagctttctgcagcaaagaatgtcgccaccaagagatggtgctagatggagcaagaaattcagaatttgacagatactaa

SEQ ID NO: 53977 - DNA, 1122 bp, Glycine max
  Peptide Sequence Number=SeqID_170755
atgtctggactgattgaaggacttcctgacgctgttgcaatcaggtgccttgcatgggttcccttctacctccacccaaagttagagcttgtctctcgtgcttggcgagcagttgttcgtggccctgaactatttaaagctcgacaggagcttggttcatcggaggatctgttgtgtgtctgtgcttttgagccagagaacttatggcagctgtatgaccctcagcgagacctctggataactcttcctgttctaccctcaagaatcaggcacctttcacattttggtgccgtctccactgctggaaagttgtttgtgattggtggtggaagtgatgctgttgatcctttgacgggtgaccaagatggttgttttgcaacaaatgaagtctggtcgtatgacccagtagtacggcagtggtccccccgtgcggcaatgctcgtcccccgttctatgtttgcatgctgtgttatgaatggaaaaatagttgtggctgggggcttcactagctgcagaaagtcaatatctcaagcagaaatatatgatcccgagaaagatgtttggattccaatgcctgatcttcatcgcacccataactcagcctgttcgggagtggtgattggaggaaaggtgcatgtcctgcacaaggatatgtcaacagtgcaagttttagacaatgcaggtcagtggacggtagaggaatatgggtggctccatggtcaaatggcagttatcagggatgccctttatgtgataagccatggattaatcatcaagcaagacaaaaaaatgaggaaggtagttggttcagcttctgaatttcgaaggagaattggatttgcaatgattggtttaggtgatgaattatatgtgattggaggtgtcattggccctgacaggtggaattgggacatcaagccactgtctgatgttgatgttcttacacttgcgagcgagagaccgacgtggcgccaggcagctccaatgacaaggagacgaagaattaggttgttcaatggcttctttgagttgttgtatggttataatggctggggcgcgaggagagttgaaaaagatgcattaaagtcccacgttggagaaatacaaggttcgaaaaggtag

SEQ ID NO: 53978 - DNA, 840 bp, Glycine max
  Peptide Sequence Number=SeqID_170756
atgagccaggaacagctcaagaaacctcaaggggagcaggaccccatcaaatacggcgacgttttcaaagtctccgacgaactcgctttcaaacccatcgcgccaagagacgcagctctcatgcaagccacggagaaccaagcattgggccaaactcaaaaaggaggtcccgcctcggtgatgcaatccgccgcaaccgaaaacctccgcgccggcgtcgtgggccgccaagacatctccgacgtggcgaggaacgaaggcgtgagcgtgaccgaaaccaaagtgggctgccaccgcgtcatcacggagttcgtgggaagacacgtggtggggcagttcgtggagcccgacgtccccatgaacaccccaggcaccgcgctggagcgtgacgccataaccatcggcgaggctctcgaggcatcggcgatagccggagcaagcgacaagccggtggatgaaagcgacgccgccgcgatacaagctgcggagatgagagcgacaggaaagaacgagacagagcctggcgggctgggcgccagggcccagtcagcagccacgcggaatactcgtactgtgtcccactctcacaagacaaccttgtctgatgtcttaacggatgcgaaggagaagctaccagcggataaggcggtgacgcgagaagatgcggagggagtgattggagctgagcttaggaacaaattggacatgagaaccacccctggtggggtcgctgcatccatggctgcagcagccacacttaatcaaaacagctacgatttcttcctttcatctcttttgattatttcaacgaaaacaatgcaaatcctgctgacgttttaa

SEQ ID NO: 53979 - DNA, 775 bp, Glycine max
  Peptide Sequence Number=SeqID_170757
atggagaccctttttgttgttgagcagcataataagaaccaatactacaacaggtccaagtcacagggtcatgctcgatttggggggtcaccttcaaggggctttagggatatcaattgcagaacttttgagtctgggagaactggtatattgccaacacctttgaaatcgcatcatggttctcccaaaacaccacctaactctgataacaaaatggttgggaaagtaaaagttactcctaagagcaccccaattcccatcaatggtaaagcttatagaaaagaagagagtgaagatgtccctaatggtgggggtcttttgctttctgaattgtgggctggacctacctactcaaactcaccacctcccagttccttgccaattcccaagttttccgtctggccgaagaggaccgtgtctcttgatctccctggttcctcctcccctgagattgaaatgcaccctgtggctaagtctgcgccctcttcccctagcagggagcttttggatttgccttttacaagggatttctttgatgataatgctgattctgctgcgactaagacccttcttagttggtttatgttgcctttggttgtggtgttgcccttgacaatctgggctgtgatggtgggtcaacaatctccagattttggaatttggatcaagcttttagctgtggagagggtaactgggtgtatactagaggaatctattgaaagcaggctttgctatggattgtacaacttgatggaagcttcgatgaaaatgtttg

SEQ ID NO: 53980 - DNA, 475 bp, Glycine max
  Peptide Sequence Number=SeqID_170758
gctctcacacgcaaagcaccgaagagagcgtcggaaacgaacaagacgtcgacattgtggacgttggcgtctctaagttccattcccctaattatactacatcgtcgttcgcctccgatcacaaccatcgccggagcttcacgccggcaaaacctctgccgttcaagataacggatgagatgatcggcatgaccgttccgagaaaggctccatctgcaaaaaggtttcatgaaagttggatttccgcaagcagcggtggggaggagctgaattttcggcaacgatcgaattcccccggaggacagagtgttgaaccggcctcaccttcttcttcgaatgtttctctgaggaagaagatgaaagagattaaacctgtttctaagacatcaaaatcgtcttcgtcagacctcgagattgagatagctgagcttctgtatggtttgaagacttcgaagagccacgagtcttctaaaaa

SEQ ID NO: 53981 - DNA, 279 bp, Glycine max
  Peptide Sequence Number=SeqID_170759
atgcgtctaccggggaaggagagtctgctgatgaaatctcccataaccataaatgagattttggatgttagcatttcgtttctaaatgaccatttagaggaaacactgggttcgacaaaaatagaagaaatccactcaaagtgtatcaatcttgcacagggtaaggtttatggtgagtcaggattttggctcaaggcttgtagaatggctagacatgatacatgtcagggtttggtttggttcaaggataaaaagggatgccccacattatttccatga

SEQ ID NO: 53982 - DNA, 361 bp, Glycine max
  Peptide Sequence Number=SeqID_170760
ttggaaagatgtaccagacacgctaaaggagctagtatggaatgacattttggccaagttggatatccccgaagccttacatgcaaagaaaaaggtgatgtacactgtggccactagatggaggcagtttaaatcatccctcaccagtaaatttgtttatagtaattttgaggactcgttggaagaacaaatgacaaatggtgagtttgtcccacagggtcgtgaagacatacttaacacggccatagggagaacatatcatagaggtcatgttcgtgcagccgggtctggggtgacaattagtcaatactatgggaggacatcacgtgcctcaagtacctcatccatatcattcacctaa

SEQ ID NO: 53983 - DNA, 660 bp, Glycine max
  Peptide Sequence Number=SeqID_170761
atggcaagcacaagaaatctgaagcacctcaacctgaacctgaacctgaacatgtgttgttcaaattcagctactcatgaatgcgaatctcctccattgagccccataactagttcctcaaatcacaataacactactcaatgtccttctccttcttcaattatgataaagaacttcaactctatctatgaccctaccttaacctctcatgaccactctttcagctctaccttcttcgagcccgaacccgctgacttcgccaccgccttcgcctcccaacgcttcttcttctcctccccgggcctctccaattccctagttgaatacaacaacaccaacaaaagtactactcgacacccagcattgttgagagaacatggtgagaagatgaaggaggaggaggaggaggaggagaagaagaagaaggtgttgttcaaggggagcgtggcggtggcgacgtactcgccggatccttacgtggatttccggcggtcgatgcaggagatggtggaggcgcggccggagctgatggacgtgaagtccaattggaatgttcttcacgagcttcttctatgctatcttgcgctgaatccaaagagcacacacaagttcattcttggagccttcgctgatcttctcgttagcctcatgtcattctag

SEQ ID NO: 53984 - DNA, 345 bp, Glycine max
  Peptide Sequence Number=SeqID_170762
atgaaacggaagcgtgggaggcctcccaagatggatttgaaagaggaagatcaattagatgatcagtttccacgtaagcgtggaggagtcaacgaggctcatcgcgtgttccaaattggcgatgagaaacccccagaagagcctgtgttgggtagctatggcctgggaatttcacgtttgggtaatgcgctggttggcagagcaatccatgcccaaattgtgaagcatgatgttggagaagctgatcaagtggtgaacaacgtgtttttggggttgtatgtggaaattgggtgtttcgatgaggtcttaaaggtgttcgaggcaatgcctcaacgaaatgtttaa

SEQ ID NO: 53985 - DNA, 3543 bp, Glycine max
  Peptide Sequence Number=SeqID_170763
atggatagaaccagagaatccagaagatcatccatgaccacctccaccaacggatttcccaaacgcagacatcgaactattgctctcagagactcttccgaggaaggagctgtggaattgagagaaggtacgagtaagagaggaaggaatcgagatagagatagggattcggcgaacaggagtaagaggaggataggctctcactcgcaaagcaccgaagagagcgtcggaaacgagcaagatgacgacgttttagacgttggtgtttctaagatccgttctcttaataatacgacgacatcgttcgcctccgatcaaatccatcgccggagcttcacgtcagcgaaaccgccgccgttcaagataacggaggagatgatcggcgtgagcgttccgaggaaggctcgttcagcctctgcgaaaaggtcttacgaaagttggatttccgcaagcagcggcggggaggagctgaatttccggcagcgatcgaattcccccggaggacagagtgttgaaccgacctcaccttcttcttcgaatgtttctctcaggaagaagatgaaagagatagaacctgtttctaagacatccaaatcgtcttcatcagacatcgagattgagatagctgagcttttgtacggcttgaagacttcgaagaaccacgagtcttctataaagcttgaagcaagcgtcagtccctctgatgatgctgagaagaagaaaatggaagacaacaacaattcttccaccctgttttcaaataattcaactgaagagttaagcaggattcagattgagcaacctgctgatgtggattatcatgttggtccatcaatagaggcaccaaaagagaacattggggatgcttcagcagatggaagatcggtttcccctactagggaatcgccatcatgctccgagttggatactgagaaaccatattcagcttcaaacagagtagtggctttccagcaggctcctcctcccatggggctgtccccagaaggggatgacttgtcaaggggtgatttcatattagaaactaaagctttggcactggatgtggaaatgaagaaggaaaatagtgtcaaggtggaaagaccagttaagaaggagaaaattccagaggaaattgaagaggctaaaatggtcacatttatggagaagttggatgtgctaaaacatgatttggagaagaaaaacaatgtccatgacataaagacaaacaataaattagaagagcaggataggaataaggaactagctagtatatcatcaaatcccaaagaagagaaaaccgcaaataatgtgactttgctaaggtcgataactatgattggcagatacaagccgcacttgcagccagttgcaaagacggacaaaaccacaggatcattgacactaaagcatgcaaattttgtcctatctcaacggaaaccaaagagatgtgcaacccattattacattgcttgtaacatcttacaccagcagtttacaaagatgaacccgtctttgccagcagctattggctctggttctctgtgtagcacaaagcccaacaatgtcaactgtgtgccctctgcagaaagtatggccattgggaagcaatctcaaaaacacttgccaattgtaaaccaaaatgcttcacaagagaaagggtgggccgtgaccagcaatcctagtcttactgctgccaaatgttctaataattccaacccaatggattcagctcatagggtgcagcttgtgctccagcaaggtccaaatcctgggccaactggtaatctagtgcatggtcctgctttcctctatcctccaggccagcatcaagcgtcagttacagcaactactaatcaggcaggagctgtgaattcccctaacagcacttcctcatataataaattccatagttcagttggcggatctcctggtacctcctcaactttgccagttgttgctcctggaataagctttagctacccaaatttttcagccaatggttcttctccgtatatgacaatagttcacaataatgggtattcattccctttttcaacttctcttggagcaaccacggcaatcagaggtccgagccctccacaagcaacacatgtacttagtgggcctttctactcttctcaaatgttccatccacaacagcaccctcagtcacaagcactggttcaaccaagttatcttaatgctagcacatcaagtagttcatcatctcataaacagtcaccaggtgcacaagttaatggcagtaatattttgacctctacaactatggagcagcagtcacaaaagcgacagacttcactgtctcatctttgcaagcatgagactgagatgggtggagggaatgcaccttctgttgctaatcgaacatcttactcacagaagaatgtgcatggccagaactgtacaattccagtgcagccagtgaacttttcttttaagccatctgcaacatcggatattgttggcaatggtggaagttttggtgacaaacaacaaaagcaacaggctttaaagggaggagtagagaatataccatctcaagcatttgccatatcatttgctgcatataatgggaccagtgttccttcaaaccttaacttctcatccatggcacagaatcctgtgatacttcaaagcctgcctgatatggcatggcaaggatatcaagctgcaagcacacctcagactactcagcaaaagacttattcaattactgaagcaaagagtggaggaaattcttcacaccaagatgatgaaaagaaaatctctcgtgctcagtcttccagcaatgggccaaccacccttgtttttgataattcatcaaagaatcttaactttatgctatctactgcgaatggaaactggtctaatcacaccattgcttcaactgcaataacaagtgtgccactctctagtaatgctttaagttctcaacaaccaccacatttgcttcagcttccaaagcagcatgctatgcaacagcagcaagctgctatggcaactcgatataaagcaccacctgccaacaacactccagctgcaaaatttggaaacaatgcccccgttttctcacaaactccttctcaatgcaagagttctaaccaagcttctcacactaaggcctcgagtagaactgcagattctcatattcatcactcatctgtcataacatctaatgctccaaccctcaaaagtttttcccaggaacaagggagagttttgccaggtcatatgcaaatttcttttgggggaaattacataacgcccctgccaccccaagggcaaccactactcaataacaaccatcctttatgcgcaacagctcaaggaactccatacagtgggggcaatgcgaagtcaaattcagaaggaagtaaagttagttcgtcggtgaacgcttcacaactgcaacaaactgaaaattctgctgggagtggccaaaaatcttctccagtttgtgggagaaatgtcccgtcaatattaagttcatgccccagccacctatcagagctaaagtattag

SEQ ID NO: 53986 - DNA, 792 bp, Glycine max
  Peptide Sequence Number=SeqID_170764
atggagaaaaacataaaacttgtgaagcaaacagaaaaagaagatgaaacacacaagagtgtcgttgagagtggcggcgagaatgagcttgccattgggggagaatttggcgaaggagacagcaggggccttatcttcgatgagggtcttcaagagattgccggtttcggtgtcccaaatcttgcaggagccgtcgtggctggcggagatgatgaggtttccgtcgcggttgtagtggacggaggtgacgggcatggtgtggccctttatggtgtggacgcatttcccggtcttcacatcccaaaccttgatggtctcgtcgaaggaaccggacacgatgtagctcgattgggggttgaagttgacgcagaaaacggcgtcgtcgtggccgcggaggatcttgatgcagccgccgccgacggtggcgtcccagatgcggagggtgcggtcgtcggaggcggagcagatgtagtgggagccgaggctaggagggttccatcgttcgagaacttcacgcacgacaccgcgttttcatggtcgcccgccacacctccgccatctgcctttgacaacgatagccacaccactaccataggtgaaggcaccacaatcactattgttgaagccacttcacagttgaaggcaagtgttttattcacaattgagctttacttcaatgaccttggtggcggcatcgatgaaaaaggagaggtggagagagctaccatagacccaagtgatggaggggcaacaccatggtggagacaagtaaagtgggaatataaaaaataa

SEQ ID NO: 53987 - DNA, 903 bp, Glycine max
  Peptide Sequence Number=SeqID_170765
atgagggagtttccttcttgttttggagaaaatggtgttcaggttgctgactcatcctcatcaagcaccacaagagcagcacaaaatgtggtcacgtgtgtctatcagtgcaaattaagaggccattcaagcttgattacagtctcgtggacaaaaactctgattggtcaaggcttgagtgtggaaattgatgacttgggaaagcattgcctctgcaaggttgagataaagccatggctcttctcaaagagaaaagggtcaaagaatttggaggtccaatctggtaaagttgacatcttttgggatttgagtagtgccaagtttggttcagggcctgagccaatggaggggttctacttagcggttgtgttcaacaaggagacggtgttgctcctaggggatctaaaaaaagaggcatgcaagaagattgagagtgattgtgcttgcttttctcactctggtgctattttcattgcaaagagagagcacatttttgggaagaagttttatggtgcaaaggctcagttttgtgacaaggggcaggtgcatgatgtcacaattgagtgtgacacgttaggactcaacgatccttctcttgtgattcgaattgatagcaagacagtgatgaaggtgaagcgtctcaagtggaagttcagagggaatcacaccattttggtggatggtgttcctgttgaagtgttttgggatgtgcatagttggctctttgggaatgctatgggcaataatgcagtgttcatgttccaaacatgcatttcaaatgacaaaatgtgggaagggcaatctgtttctgatccctcatgggcttcttctcagcagtttagggattcccaattgcaaggccttgggttctctctcattttgtatgcttggaaacatgagtag

SEQ ID NO: 53988 - DNA, 795 bp, Glycine max
  Peptide Sequence Number=SeqID_170766
atggcggaggtgtggcgggctgcttttatgaatgaggtgtcgaaagtgagtgagttccggtggatggcgacgagcgcgacaagaagcggcggcgttacccaaaccttgggcttcaagccgtaccgtcacctgaaaactctaaccgaccatgaaaacgcggtgtcgtgcgtgaagttctcgaacgatggaaccctcctagcctcggcctccctggacaaaaccctaatcatatggtcctccgccaccctcaccctctgccaccgcctcgtgggccactccgagggcatctccgacctagcctggtcctccgactcccactacatctgctccgcctccgacgaccgcaccctccgcatctgggacgccaccgtcggcggcggctgcatcaagatcctccgcggccacgacgacgccgttttctgcgtcaacttcaacccccaatcgagctacatcgtgtccggttccttcgacgagaccatcaaggtttgggatgtgaagaccgggaaatgcgtccacaccataaagggccacaccatgcccgtcacctccgtccactacaaccgcgacggaaacctcatcatctccgccagccacgacggctcctgcaagatttgggacaccgaaaccggcaatctcttgaagaccctcatcgaagataaggcccctgctgtctccttcgccaaattctcccccaatggcaagctcattctcgccgccactctcaacgacactcttgtgtgtttcatcttctttttctgtttgcttcacaagtcttgctatttacatttgaaatga

SEQ ID NO: 53989 - DNA, 318 bp, Glycine max
  Peptide Sequence Number=SeqID_170767
atggttgtgggtcatgatgtttgcacccatagccactttagcggtgcccttgcactcctaccaatgaaaacagttccctacaacgcgatccacaaaggcatgttcgacgttcttgaagcggctaaattcatttggttcctgctcgtaatgagggaattagaggggttgcgtcaattgtcaagcaaaggtcacttgttagggatagctggagaaagaggtgatggtggttgttgttggtgttttcattggtgtcgatctcggttgggaagtcttagtgggggaaggggaggtgaggttagtgaaaagatcagcttataa

SEQ ID NO: 53990 - DNA, 972 bp, Glycine max
  Peptide Sequence Number=SeqID_170768
atggttatggccttgtggagtggcattgcaaattggcaaagaaaaaaaaaagagtggagaaaattgttatccacaacacaacatcatcaacgttacacaagtctctctgatggcaacctcgacctctttctctccgacagcctctgtccgctccatcatcttccaaaagcaaaaccctcccaaagcccttcttcttctctcccagcagcgctccttcgcctcttccgcaagctatgcaactctcaagctccctcgcagacccctcctttccaagggagaacgccacttgtgagggctgctactatcgaagaaattgaagccgaaaaagcagcaatcgagaaagatgctaaaagcaggatggataggactattgataatgtccgtacaaatttcagttccataaggacagggagagcaaacccagccatgcttgacaaaattgaggtggaatactatggaagtccagttagcttgaagagcattgctcaaattagcactcctgatgccagttctcttttggtacagccatatgacaaatcaagcttgaaggctatagagaaaaccatagttagctctgatcttggtatgactccaaataatgatggagaatcgatacaattgagaatcccacagttgacatctgataggaggaaggaactatcgaagatagtggctaaacaagctgaagaagggaaggtggctttgaggaatataaggagagatgcattaaaagcttatgataaacttgagaaggagaaaaagctctcggaagataatgtgaaggatttgtcaagtgatttgcagaagctgacagatgagtatatgaagaaagttgacaccatcttcaaacagaaagaaaagcttatgacggatggtaaattaatgaggtacttagacacggattacatgcccaaggcaagaccacatgctctcccttttactatgtccaccacattagttaatatgttctag

SEQ ID NO: 53991 - DNA, 104 bp, Glycine max
  Peptide Sequence Number=SeqID_170769
atggactcaacgcttatttctcccgactccggcaagggggttgcttctcttcatcgcgctcgtcgtgcggcatggggaagctttgctggcgccgtcgtcgactg

SEQ ID NO: 53992 - DNA, 1287 bp, Glycine max
  Peptide Sequence Number=SeqID_170770
atggtgggtgatatgcgtctaatttttgcagttttattttatgttttggttttacccaatgctttcgcagaaaaactgcctgcgccaacaggcaaacccgttttaaccatttcaggaaagattaccaatacaaacgaaggtgataccgccgtatttgacattgccgcgctagaaaaattgggcaatgagacagtgatcaccactactccgtggtattcagggaaagtgcgctttgatggtatttcacttagcaaacttatggacttagtgggcgcgcaaggtaagacggcgaaggtgatggcccttaacgattatactactgaggtaccagtggaggattttcataaattcccggtgatcctggcgctgaagatgaatggtgaatatatgcgcattcgtgataaagggccgctttttattgtttatccctacgatagtagcgcggagttacagaaccaaatctattattcccgctcggcatggcagatggtctccgaatacatgcgtctcgaggctcgtttaagcgccctggcgctgaacgtgaaggggaccgaccgcgatgaggtacgcctgcgcctggaaataatgatgagccagatcgagctgctgcaacagggcgatcttggtcagttcatcagaaaaagcgagcagcggcaggcaacggtgaccagtctgattcagatcctcgatcaactcgatcggcaactggacaccatgacgcctgagcagatggtgattctgctgcataccatgagtaagttagatggtccgatgacctcactggcctccatgaccctggcgcaggactttgatgtcgtcaatcttacgcacgataagattcagcatctctattacatctattcggtgatttcaatcttgctgattacgatgtgtatcactcttgggctattgatgcttcggcaaaataacaacttgcgccgcgctcatgtgcgtatgaaattgctcgcgaatgatttgcagctgtcgaaagagaaactgcaggtacagaaccgccggttgcaatatgatgcttatcacgattcgttaacaggcatgcctaatcgcctttctttctggcagaggctacaggaagtagtcaatcatgtgaaaccttataatggttgcgcagtggttatgttgttcgacctggataattttaacgatgttaacgataccctggggcatgatgctggtgacaaactgctgcaggagctcgccagccgactgtcgttcttccgtaaaacatcagagacgctgtaccggcttggcggcgacgaatttgccctg

SEQ ID NO: 53993 - DNA, 228 bp, Glycine max
  Peptide Sequence Number=SeqID_170771
atggactctattgcacaagtcatagggtgcattagagaaggaaacacgtaccaagaagattgggagaagaagtatgagagctatgtcttgaaggatttatataggaacaacttcaaagaagctattggaaagaagaaggttcggtacaatttgatgtgcgacatggcaatgaaagtggacatcaagaggaacatgacagttactccagtggatgaggaagatatctaa

SEQ ID NO: 53994 - DNA, 300 bp, Glycine max
  Peptide Sequence Number=SeqID_170772
atggctaaagttgaggaaggagaaatatttctagatactgaggaggaagttaacaacttaattgaggctataaggaaagagaagggattattgcattatactaggattgttctggatcctctaacaatgaagattactaaggcttcctgcgactgcgagggttatactttcaggcacaattgctggcacatcaagactttagagcagatgattaaggaggacagggagttaagggaaaggatagagaaggcaaggcaggaaatgatgcaaatagaagaagacatagcaagctggggatga

SEQ ID NO: 53995 - DNA, 102 bp, Glycine max
  misc_feature (27)..(27): n is a, c, g, or t
  Peptide Sequence Number=SeqID_170773
ccaccttgatgttactctaacatcaantgttggacctgagtgtgtagagttgatctctatagtgtgtggagttgatctctattgttcagagagcaatctctg

SEQ ID NO: 53996 - DNA, 252 bp, Glycine max
  Peptide Sequence Number=SeqID_170774
atgacactcttatgcctcgtgtctgatcaagacatttggatgaaaggacaaaggttacacgatggaaatggattgcgtgcaatgaagaaaatatgcagtaatctccaaggcaaggacaatgcacctccacctccacctcaatggattaaggctaagtatttttcagatggaacagcattagacactgacaccatgacgacaatacgcaagaaatgggcagcctattttctagaagttggaaaatggatgtaa

SEQ ID NO: 53997 - DNA, 550 bp, Glycine max
  Peptide Sequence Number=SeqID_170775
atgattcagttccatgagattgagagctttttaaagggtggaatgaatatcttgacggcacacagtcaagagtgggaacaagaattaagttctaactatcaatatgaagaagaaagaactcctaatcttgaaaagctactcaatagaaaactttcacgtgggaccaaagttacaaccttcctatcaaaatgcagcaaaagaggatccaatatggataaattgttgatgcaattcatggaaacaactaaatcaactcaacaagcactccaaagtgtagaaatccaggttggtgagctggcagaagcagtaactcaatttatgtccagacgagaaaaatcctttgtagaggctgaagctcaagagaaaagccctataaaagagcatgaatcaagagaaaaagatgaggagaaagatgatgaacaaacacaacaacaatgggagaagtactcaacagtagaaaaccaacaaggaaatattctccaaagcaataaccttcctcatcaactgattgacaagaaaggaaggcaaggagagcatgaggaaaccttaa

SEQ ID NO: 53998 - DNA, 438 bp, Glycine max
  Peptide Sequence Number=SeqID_170776
atgaatgtgggagctctcatctctggtcagattacatctatggcccagtctaactcttctagacttgggttccctgctcttatcaccgctttatgtaagtccagaggggttgcttctaacagcctggtcttcgaacacctgagcccggttattaacttggcctatatcaggaaaaattgttggaaccctgatgatctgatagttactatcagaggggccaagagagtgaggataaggccagttgaggcctcttccacatctacaactcctcctccaacacgtacccttgcagctccttctgccccagatcctgcagattttcagcatcttgaagccatgcttcaaagcatcaatcaggggcaaattatcttattacaaagtttacagatggtgacacctccagactctattcctttagtagagcagtttaacgagtgg

SEQ ID NO: 53999 - DNA, 873 bp, Glycine max
  Peptide Sequence Number=SeqID_170777
atggagttcatgaggttacctaacccaaaggtggaaggtgctgatagaaaagtatttgccgaaaccatggagagcattccaataacttatgatttggcagagaaattttacggtaatgggattacggtaccagtttttgaagtaattttaccaatgacaactagtaatttggagataataagtgtggctaggtattacgaaaaagcagttgcaaatgaagatgaactagaactttacgatggtgtaaaagtaaaggatttagttggagaaatatatcctaaagtaatagaagttataccactagtcgaagatagggactctcttcaaaatattgacaatatagtggagggatattataaggtaattaaacctaagtatatgagagtctttttagccaggtcggatccagcaatgaattatggaatgataacagctgttctgtcagtaaagattgccttaagtgagttatacaaactttcagaatcgttaaactttgaaatatatccaataattggtgttggttcacttccatttagaggccatttatctcctgaaaactatgaaaaagtattggaagagtataagggagtttatacatatacgattcaatcagcgtttaagtatgactatgattacgacaaagtaaaaagtgctatttcttcaataaataactcacggattggcccagctaaaatattggaaaagtatgaggaagatgttctaagaaagataacgatcttatatactgaacgttaccagccaattatagaaaatcttgcaaacgctataaatgacgtctccgtgttacttcctagaagaagagccagaaaacttcatattggcctttttggatattctagaagcgcaggcaag

SEQ ID NO: 54000 - DNA, 567 bp, Glycine max
  Peptide Sequence Number=SeqID_170778
atgaaggttgatatggagtccatgaaggaacatatgacaacgatgatggaagcaatgatgagcatgaggaagatgatggaggataatactgctatagttgttgttgtgagtactgctactgagatggacccgattcacccggccggtttcattcaagtgaatcgtccaatctcaaatgtagtaggtcaaaaaggcgaggcaacgaaaaatgcatgtgggccttatcatgttcaggttcagagcaagcattccttcgcaccatatgggttgcctcctaattatacaccacccactgttgtgtatgcttctagtgagaatatcagcaattctgcacccgtattcattgagaatcaacaaccccaatctgatcatgcacatgtctctcaacccatgggggaaacacatgaagttccccaagaccacactctggctaggttcggggtttatccaggatataccactgaagggcagacattttctagcatccctatgctgaatgctcctagaatatcccaatgtcgcccgttatcacaacccttgcatttagtaaggggagagatgatgtag

SEQ ID NO: 54001 - DNA, 336 bp, Glycine max
  Peptide Sequence Number=SeqID_170779
atgatggcacatcagttgcctcccaggaagcgcttctttaacgtcattagcttgacgcttttacctcagtgggcgaactcacgttttggttcttacttccaaaacctccttacccacttccattacctcttctttctccccatatcaactatgcagctcatagttaatatgaatggccttcccaatattacaggaatgtcattatcttcacagatgatgcaatcctaccccacaagggcattggatagaagactccaagaagattgggccaaagatgcaagagaaggccctagggttctcatgagccttagggtagatttcaggctcatgggctaa

SEQ ID NO: 54002 - DNA, 975 bp, Glycine max
  Peptide Sequence Number=SeqID_170780
atgaccggtaacgtctcatccctgtccgatcatctggcgaaagccaatctgcatatcgggctgttcttcctgctgattgtgctgttattcatcgccggttcgtcggtctcgacgctgatcatcaattccggccgcaggcggcagatacgcggcatctacgccatcaatattctgctcgagggcattgcgttgctgcgagggcggcgtgttgctgattctcagcctgagctttctgatgggcctgcaaaatgcggtggtaacgcgcatctccaatgcccgcgtgcgcacgacgcaccggctaaaactgcattgctacaccgtgctggcatttctcgctggcggcgtgctgggcattctgctgctgcagtggctaagctacgcgctgctgatcgtcattgggttactgctcagtgcgctggcgctgtcggcgctgaaacgtgcgggcagcaatccgcttcacgcccgctaaggaagggaatcatgatctcgctcgaggaccgcctgcaagccatctggcagctgcttagcacagccaccacatcgcgttcggctttcaccctgatgcagctggcaacggtgaccgctgacggccagcccagcctgcgcaccgtggtgatacggcagtttttacccgcgctgccggccctgcgttttaccgccgatcggcgcagcgccaaaatgcaggatattgcagcccagccgcaggtggcgttactggcttatgatgccgccagtcgcgttcagctcaggctggcaggcacggctcagcgcgttgacgatgcacaacagcgtgccgcagcctggcaagcattgcgcccgcactcacacgcgttgtttcagtcaccggtcaggccgggcagcgtgattgcccatcctgatgacgcacagcctgccagcgcgcaaaaggcgggcaccgggcccgacgagcactttgcgctggtgcagatcaccttgcacagcgtggaatggctggat

SEQ ID NO: 54003 - DNA, 987 bp, Glycine max
  Peptide Sequence Number=SeqID_170781
atggcatatgacaaagaaattctagcagaacaatacaacacgacataccaattgctcacagatgagcaaaaaactattgttgataccattatgtgtgtagttaacactcaatcagctgcagtttactttctctatggatatggtggaactggcaaaacatttgtttggacaaccttatcatctagtatacgctccaatggtggaattgtttgtacagttgcttcaagtggaattgcttcattactcttgcctggttgtcggaccgcacattccaaattttctataccagtccctgcaacacaaaattcaacatgcaatattcatcaaggcagtgacttagctgaattattaaaggttacaaaactaatagtctgtgatgaagctccaatgtgtcacaaatttgcatttgaggcactagataaaagccttaaagacatcatgcaaaacaatctgcttgtcggagggaaaattatcgtttttggtggagatttccgacagatcttgccaattgttccaaaaggtatacctaatcataaattaaaacttaaggtcagaactccaatcatgctaatacgaaatctcgaccagactgatggcctgtgcaatggaactaggctcattatcaccaaactcggatctaatgtgattgaggctgaagtaattactgggcctaatacaggaaataggacatacatacccagaataaatatgtctccttctgaatctccatggtcattcaaacttatcaggaggcagtttccattcatagtttcttatgctatgactataaacaaatctcagggacaatcattacaccacataggactgtatttgccacacccagtttttagtcatggccaactatatgttgcactctcaagggttaaaaacaaagatgaacttcatattctcatacatgaaaatgacggtaatccaaaaaatattatcactaatggtttttacgacgaagtctttgccaatttataa

SEQ ID NO: 54004 - DNA, 339 bp, Glycine max
  Peptide Sequence Number=SeqID_170782
atgtctaatccttggaggtttacagtagggaactggttatgtgactcagatctggttagtcctactagaattgaacgggttctagccgaaaaagaccttctggctgactcatattcagacctagagacttctatccttgatgaaaaagaatttctcctattgaaggttatctctacctttccggagttatcttgcttgatatgctctatggttggagcgggtcggggaatagacggtgttgccttatccataacccatctttcgggaagagttacctcatcccattttatttttctcgggagagaaacgttagcctttgtcatatcagtgataaacaag

SEQ ID NO: 54005 - DNA, 429 bp, Glycine max
  Peptide Sequence Number=SeqID_170783
atgacaaaggctaacgtttctctcccgagaaaaataaaatgggatgaggtaactcttcccgaaagatgggttatggataaggcaacaccgtctattccccgacccgctccaaccatagagcatatcaagcaagataactccggaaaggtagagataaccttcaataggagaaattctttttcatcaaggatagaagtctctaggtctgaatatgagtcagccagaaggtctttttcggctagaacccgttcaattctagtaggactaaccagatctgagtcacataaccagttccctactgtaaacctccaaggattagacattacttctagcatacctagaacaacttacaaccaagaacaagaggacgaccaaaattcgatccaatccctaacatactcttctatggaaccttatgatgttatctga

SEQ ID NO: 54006 - DNA, 258 bp, Glycine max
  Peptide Sequence Number=SeqID_170784
atgactcaacctccaatcttgaggacctatcagatgaatacgagagttgttggatcaaaaaccatggtagtgatactgactccttttccgggcccgaaggaagtaacatgtcttcatcccatgaaacaatattcaaacgagattgttaaaaatttccagtttatccacttctactgcaataggtggcatggtaacataacgatcaaaattcacaacactttgcaatttacacttgacgtctgctacattaggtactag

SEQ ID NO: 54007 - DNA, 797 bp, Glycine max
  Peptide Sequence Number=SeqID_170785
atggctcaaaagaaactcttaaaactcagtgtgaggatcagtgatctatggtttattagcacgcctaacaaatctgagcaagctgaaatggtgtttgtggactccgattacagagtgtgtgatcatcaatttaaattggtgtttattggggttactgttgtgagggagtgtgttctaggggacatcccttttagaaaatacaggtttgctggatttgcagatgttgtggctggccagtttgaacgtggactattggttgatgttattggtgttgtggaagaggttgtctttcggcaagttttaggaaaaggtagaagggtagttttcaaattaaaggacttgagccagcaattgctatcttgcactttgtgggatgattattgcttgcagtttgtgaagttcttagatgattatgaaggtgatggtccaattacagttctattaagccattgtaggatcaaggaagcgcagggatcttatcccgcatcgatcaacaattctttcaaggcttcaaagttaattattaaccagcccgtgatggagattcaagaattcaatgaacggcttgcagagttgggcattgaggcccggtcaggttttaaatcccatggtgaagggagtacacagcttttaggttctatccaattatcatcaaaagaatcattctttggcaacgctgaggcaaagactattgttgagattaacaccatctctgaagaaattgtttgtgtcactgttgacacaattactaggattcaactggacaatcattcatggtgttatacagcttgcattca

SEQ ID NO: 54008 - DNA, 187 bp, Glycine max
  Peptide Sequence Number=SeqID_170786
ttgggctaagcgcgcaaccaccgctaagcgcagcttcaacgcgcttagcgtgatagaagaatcaggcagggcatcaatatcaaggctgtgcgctaagcgcgagatcagtgcgctaagcgcaacaggtgtcttcagccaggctcagcgcacgactggcgctaagcccgaatccacttacccgcgttga

SEQ ID NO: 54009 - DNA, 261 bp, Glycine max
  Peptide Sequence Number=SeqID_170787
atggccctacaaattggccaccaaattgactgggctcatcttgttcgctaccgtatgcataaggcattacgggtaaatgcacctctcccttatccccacccagttactctgattctgcagcacttcagcattcctcttgctaatgaaccttttgtcaaggttaaatgttcatttgccattggagccactgcagttgaatcctttggctataggaaagatctagacggtcaatgggttcgtaaacatgatctcccaatttag

SEQ ID NO: 54010 - DNA, 189 bp, Glycine max
  Peptide Sequence Number=SeqID_170788
atgacgatggcggtcatggctgacaatagcaaagttcataccgacaaaagcggtgacaatcatggtgatggtgatagagcaatcggaggaggaaccctagagggcattggaaacaccaccattgctaatggagaacacttgaatgactaccttgagataaaggatgagttactcaaacttgggaattag

SEQ ID NO: 54011 - DNA, 300 bp, Glycine max
  Peptide Sequence Number=SeqID_170789
atgtctagcaggaggtcacggtcaaggcaaacaagtagttcaaggaatatcaccgatgatcagatcaatgatcttgtctccaagttgcaacagcttcttccagagattcgcgataggcgctctgacaagatatgggtgcaatttgcaactgatagtttgtctactttaaagaataagagaatcggtgttaccatgttactagttttaattttgttttcattatggtttcaaattgtgaatgcggttgtagttgtgagcattagggctgttgcggttcttattgcggttattgcagtgtga

SEQ ID NO: 54012 - DNA, 666 bp, Glycine max
  Peptide Sequence Number=SeqID_170790
atgttatgtgcctcaattggacattcaagtcaaaagttatggcaatttgaatatcttaaggctttctttttcaatttcgagcgtgtcgatatattatggtttgcaatcgaacatccaagtcaaaagttattgtcgtttgaatttgttaggagctttcatcttcatgatggagaaattgaaggggatgtgaatcatcgcattcaagcaggatggatgaaatggagaaaagcatcgggggtgttatgtgatgcaaaggtaccgatcaagctaaagggaaagttttatcggactgcggtaagaccggcgattttgtacggaacagaatgttgggcggtcaagagccaacatgagactaaagtaggtgtagcagagatgaggatgttgcggtggatgtgtggtaagactcgacaggataaaattagaaacagagctattagagagagggttggagtagcgcctattgtagagaagatggtggaaaatagacttaggtggtttgggcatgtagagagaagaccggtagactctgtagtgaggagagtagaccagatggagagaaggcaaacaattcgaggcagaggaagacccaaaaagactataagagaggttatcaagaaggatctcgaacttaatgatttggatagaagtatggggcttccctcttag

SEQ ID NO: 54013 - DNA, 276 bp, Glycine max
  Peptide Sequence Number=SeqID_170791
atggtggtgaagtggcgtctccaatcatctttcttccttctccattccgctgtcattgatcttcaagaagcaaaggactccattgatgaagaagatccaaggcctacaagctccacatggagctacatcatagcttctcaaggagcttcttatccatggcactctcttggtggtgaagctcctccttccatggcttattccctaatggatggctcctcctctcacctcttgtcctttatcttctgctacatctccatggttgaaaatcaccattga

SEQ ID NO: 54014 - DNA, 252 bp, Glycine max
  Peptide Sequence Number=SeqID_170792
atgaaagaaaggattgagagcttgttctccaccgaatccttaaggtggattatgaggatttcgctccaattaaagtgttcctctccatgcggtggtccagcgacaagcaatggtggcttgtggtggccaccgatgattgtgggtggtggaggagaagggatctcgcttagtgagctcgtctcactaagcggaaatctgcttttggcattgagcatggcctctcgcgttgcgtgcattgcttccttgggttag

SEQ ID NO: 54015 - DNA, 957 bp, Glycine max
  Peptide Sequence Number=SeqID_170793
atgcctaagaaaaccaacaccccaccaaaggctgaccactcaaagcattgtcgatatcatcgcaaccgcgaccactcgatagaagagcgtagcgctttgaaagacaagatagaggaacttatcaagctcgaccacctgaaggatttctccataggtcacagtcatacaagcccgagggaagaaattgacccaaatctagtcgaggaagagactaagagcatgtcggacggtcaggaaggcaaaggagccgaagccgatctagggagagagaaaagagaacccttgaccaatcgaggttcggtcatatccgtcaacatgatctctcagcaccaagtgccaaatatgctacctataacattcacaaccaaggacttcaaggcaattgacccagtgaaggatgacccaatggttattagcgtagagatagccaattccatcgtcaagaagacccttgctacacccccaggcgagggaaggaccccggaagctgtccaccatgtggaggctagaatcaaggccgaagaggtagaagaactcgagcttgaccccaaaaccagtgacaatagccgggtcatccaattaggaaatcagttacacgaggacgacagtagcagtatacaacgagtcaatcgagaatacgctaacctgtttgcctggtccatgacagacatactcggtatcaacccaagcttccattgtcatgggttaaccatatgtgaagacactgtttgcgggtacatctacttgggtttgactgagaacaagagagggtacatctcttgtggatctgttctagtggagggtacatccactaggttcaaagagaacaagggagggtacatcccttgtggatctttgcttgtaagagacaccaagccagccaccaagaagaagaggaagatgggtgaagagaggtgtcgtgcagtgcagcaagaagtggacaagttgactacatag

SEQ ID NO: 54016 - DNA, 291 bp, Glycine max
  Peptide Sequence Number=SeqID_170794
atgaagttggccgatgatgacaagaacctacaagaccaagtgcttgccttgtcgaatgatgccaagggatgggagacgcgtgccttaaatgccgaggccttgaaggcctatgatgatgtctgtaacgctcataaggctggtttcagccattgtcttcgacaagtgttgcacatgtgtgatgtctcagaccctagcatcttcgacatcaacaaagatgtgcatgaaggggagctagtgcttattaatgacattccgaaggacgaggttgcaccttcaccctcgatttgttga

SEQ ID NO: 54017 - DNA, 267 bp, Glycine max
  Peptide Sequence Number=SeqID_170795
atggctacttttggtggagctacgccgatgttgacgccacctgggcatcgagaccttgtgaggttccagttgatgtggtgcctcttgtcagcaaggacccaaaggagaagtataagcataagaagcaaagccatcaagaccatcgaagtggctcgggggaacactccgggcaccgggaaggcacctctgaggagaagaggctcaagtagccaacacttaagttctaacctatcgttgcctccactctgggcaaccatgcggctttaa

SEQ ID NO: 54018 - DNA, 264 bp, Glycine max
  Peptide Sequence Number=SeqID_170796
atggtgtcggttgaaggttcaccgttgagggagtcgattaaaggcgggtttgaggggtctagcgacctctcgacttttttgagccaattgccggccaatatagttaagaaggtgggtgagagcatagtggctccagtgatggtcgctactaccaaggtggggactttcgagagggttgcttctcaacccaagaagcgcctagtgttgatggagaactgtcttcctcccccaattacgcttctagagtacacatggattgactaa

SEQ ID NO: 54019 - DNA, 606 bp, Glycine max
  Peptide Sequence Number=SeqID_170797
atggttgcccagagtggaggcaacgataggttagaacttaagtgttggctacttgagcctcttctcctcagaggtgccttcccggtgcccggagtgttcccccgagccacttcgatggtcttgatggctttgcttcttatgcttatacttctcctttgggtccttgctgacaagaggcaccacatcaactggaacctcacaaggtctcgatgcccaggtcctttaatggtgattttccaccatggaaatgcagcggaagacaaaggagaagaggatgcttcaatgaaggaaaagaaagagggagagaaagagagagggggggagcacgaaattgaaggaataaaagagggagagaagtggaactttgaacccaatctacttggagtcttctacccaatgcccttacggagtaggattgcatcacctggcttggaggaaagcgttcatgatccagtgactaaagaagcgacacagggggctaagcaagtagttgttgagggagtgattcgagacaatcaaggtctcgacattcgtcaacaatcagcagttcccttgggtactcactgtactgccgagtacactactgctagtagaagggaaaaatga

SEQ ID NO: 54020 - DNA, 192 bp, Glycine max
  Peptide Sequence Number=SeqID_170798
atggctttgggtaagcccatggcagttgatttggcctcccctccatctgccataaattcttgggtcgagatatatgttactcagccccacggtgggcgccaaaatgttcctgtcacaaatggaacgggtactcatcctcttgtcaaagggtcttctatgccaaaggatcgtctgcttgttgttcctcattga

SEQ ID NO: 54021 - DNA, 543 bp, Glycine max
  Peptide Sequence Number=SeqID_170799
atgggaggatacgtaggagcaaaagcctcgcttttgtcgaccgcaccgctttctgttaccatgaccgaagagctggtagcccgcggagataccttacggttatccgcacccttgtgtcatccagaggcggcgggcccgatgatacgcggagataccttacggttatccgcacccttgtctcatccagaggcggcgggcccgatgatacgcggagataccttacggttatccgcacccttttgtcatccagaggcggcgggcccgatgacaagcagagacaaaatttggtcattctgcacccttgagtcatccagaggcggcgggcccgatgatacgcggagataccttacggttatccgcacccttgtgtcatccagaggcggcgggcccgatgatacgcggagataccttacggttatccgcacccttgtgtcatccagaggcggcgggcccgatgatacgcggaaatacccgagtggttatccgtataaacattcttttgctatctgtaagacagaacgcttgatagcatgcagagactga

SEQ ID NO: 54022 - DNA, 1063 bp, Glycine max
  Peptide Sequence Number=SeqID_170800
atgtctttactccctgattatacccagcagcgggcgcgattcctggccactgtcacgcgccagcacggcgcgctgactgcctatcgccatccgctgaccgcgcccgatggtgccgcgctgtacaccgacgtcgcggtgatcggcgatccggcggctcccaaacgcatgctgattctctccggcacacatggtgtggagggctattacggttcagacagccagatcgcctggcttgatagcttcgatgtcgccgcgttaccgcccgactgcgcccttgtgctggtccatctgctgaatccgtggggcgctgcgcatctgcggcgcgtcaatgaagacaatatcgatctcaaccggaatttcatcgatttcagccagcccgcacccgctaatccgcactatgcgctatggcacgatctgtaccacggcgaccgcgcacatgccgatcggctgctggcggagacactgcagcagtcaggctggccggcgctaaaacgggtggtggaagcgggccaatatcaggcagcagacggcctgttttatggcgggcagcagccggcctggtcgcaccgcacgctgcacgccattgtcgaacagcatctgcgtcaggcgcaggtcatcctgagtttcgacctgcacaccggtgccggcgcgtggggccatccgatgctgctggcgattgctgaacagcgctatccggcgcatgactggggcaagtcgttatacgatgagtggctgacgctgctgtttaccggcgccgggcgcgacagcgacaccggcgtgaccgccacggcaacgggctatgtctcgcagtttctgctgacgtcgctgcctgacacgcagctactgccattggtggtggagtgcggcacttatccgggtgaggagatgcaccgccgggtgcgcgacgatcactggctgcatctgcagggcgatccggcaagccacgccggacgcgcgctgaagcagcagcttgtggaggggttctggcccgccgatgaagactggcgcgccttaactgcgtttcgtacccgggcagattttcctgcgcggctggcgcgcgctg

SEQ ID NO: 54023 - DNA, 222 bp, Glycine max
  Peptide Sequence Number=SeqID_170801
atgaatgaagttgggaacttacttggatcgaagatgctcattgaagattggatgcaaaatgcaagattgaagctcgaagatgcaatgtgtgaatttcataagggagaggttgcaggaaaacctttgaaatatatggagtatgtcgcaaagaagcacgctaagcgagttttgaagataacgaaacctgcaactctcgctaagtcgggctcaaggacggcttag

SEQ ID NO: 54024 - DNA, 582 bp, Glycine max
  Peptide Sequence Number=SeqID_170802
atgagtgagatagaggaagtgcaagagcagatgaaggtcgacatggaggccatgaaagaccaaatgacctccatgatggaggccatgttaagtatgaggaggttgatggaggacaacacggccgtagttgccaccactagtgtcactgctgaggcagatccgactcacccatccggcataaaccaaacaagtcgtccaatcctggacatggtaggtcagggagtagaggtattaggcaacacgggcggtccccatatggtgcaaaagaagaattctttcccaccgtacgacttacctcccaactatacaccacctaatgccgtgcacgtgcctaacgagaacaccaaccactccgttccaattccccttgaaggccagcaaccccagttgaggcatgcaccctttgttcagcctgtggggaaagcccgtgaagagccctgggatcatgctctggcccaatgccacgagagctcctcaacaccagccgctgcaacctctgcacttctcggtggggagactaccaccggccatggaagaagaagagaagttggatctcataaaagaaaggttgagggccattga

SEQ ID NO: 54025 - DNA, 538 bp, Glycine max
  Peptide Sequence Number=SeqID_170803
atggcagcgcgcgcccttggcgtgcctcggcacctgcgcgctcctggcgtcggcctgtgggctccccattcggcccgtcttgaaacacggaccaaggagtctgacatgtgtgcgagtcaacgggcgagtaaacccgtaaggcgcaaggaagctgattggtgggatcccctgtgggttgcaccgccgaccgaccctgatcttctgaaactctggtggaggcccgcagcgatactgacgatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtg

SEQ ID NO: 54026 - DNA, 756 bp, Glycine max
  Peptide Sequence Number=SeqID_170804
atgctctcactcgaacccttcacagaagatcagggtcggtcggcggtgcaacccacaggggatcccaccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttgttagtttcttttcctccgcttattga

SEQ ID NO: 54027 - DNA, 651 bp, Glycine max
  Peptide Sequence Number=SeqID_170805
atggccgctggccaggaacaggcggctggaaataccggtcccggcgccgatgtcggcgaccagcgcctcgcggctgacgcccatcgggccgtgcagccattccagcagcgcggatgggtaatcgggccggtagcggacgtaatcggcgacgcggctgctgaagcgttcagtgctgtcggaggcggtcatggcagtcagttcgacatcgcagcgagccaggccaggccgccgaagaacaggatgaagaccaggatggcggcgatcacggcgccgaccatcacccagcccagcaccagaccggtgacggccaggccatcgccttccagttcgtgcgggcggcggcggatttcggcgcgggccatgtggccggtgatgatggcgacgatgctggccacgaagggcaggacggtccagctggcgatgcccatgaccaggctgaccacggccagggcgcttgtctgtcggggtgccacgctcatcggggtcctccttggcagtgtgcacatgatagtgcgtctgccccggcaatcccatgcccggcggatacaatggcaggcgtcgaccttggtcgacgaaaggcatgccaaccaaggttggcagctacagggtgccggtgtcagcccatcaacacctggccaccatccacgttga

SEQ ID NO: 54028 - DNA, 531 bp, Glycine max
  Peptide Sequence Number=SeqID_170806
atgacttctatagcccagtctaactcctctagacttgggtttcctgctttgatcaccgccctatgtcgagccaaagaggttgtctctgacagcctcacttttgagcgcctgagtgtggtcattaacttggcctacatcaggaagaactattggaatcctgatgatctgacagtttctatccgaggggctaggagggtgagggaagatgaaggtcccacagcccaagtaccacagcatgtagaggatgcgtcatctgaggccaccgttccgaagccattcattgtaaagaaggaggcaggtgagacacaagttagacaggaagttgctgccattcctgagaggtcacgagaagtcacatcggatccacccacaccagtggtggacctatcctcacctcagcatgaagcaaatccctccactcttatactcgagataccaaaggacccaaccacaccagtcctgactctgaacacttctcctccagctactccagtacttcatctgacagatgaggaggatgttcagacatag

SEQ ID NO: 54029 - DNA, 202 bp, Glycine max
  Peptide Sequence Number=SeqID_170807
atgagagctcatatgttcatgtctatacgagagactaggccaaagatcagcctaactctgtccattgtcaggtcagaggtgtgcgatgtgggggccaggttggagtatgagagaacactccacacctgggctaaagtcgtcaagtccttcctcaggatcctcccaggatggccctcagcgttcaagatgaaccctcggcctg

SEQ ID NO: 54030 - DNA, 312 bp, Glycine max
  Peptide Sequence Number=SeqID_170808
atggggtgtgttgttgtgaagcaggcggtgtctgtgacgcctgcgattgagcactcggttgaatcggagaagaacaacaggaagaagaagactgagtcagtgggggcgagtaggagcgagttgggtgagtctgggagggcgagttccaatggtggaagtgagtccctgagcttcaggttggggaacctgagtaagtacgtggagggagagcaggcggcggcggggtggccggcgtggctcagcgccgtcgcgtgtgaggccattcacggttgggtgcctcttcgagctgacgcgtttgagaaacttgataag

SEQ ID NO: 54031 - DNA, 709 bp, Glycine max
  Peptide Sequence Number=SeqID_170809
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggggcatggaaacactgaaattccgcaagatggtatcagcatagaaaaatacactcaggaactggctgaatactgtaagcaacaaaaactcaatgatgtttatattttcggacatagcatgggtggctatgttggtctctgctattctctgcagctaccggaaaatgtaaattccgtattgacattaggcacaaaattcaactggacagaggagcaggctttaaaggaaagtacaatgcttgaccctgagataattcttttaaaaattccgaaatacgcggaacaactggaattacaaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 54032 - DNA, 231 bp, Glycine max
  Peptide Sequence Number=SeqID_170810
atgatggttgacgatgacatcgatgaaggtcctgcaaagtcctcaccgtcaatgatgggaggaaacgtaagtttgctagctaagaagaagagggacgtagggtgttttggctgtcgctggaagttaactccggcaacgctgatcggccacgagttatgttgtgggggtagatcagacgaagaagggtggtcagagagagaaaaaggaaaggaagaagaaaaaataatctag

SEQ ID NO: 54033 - DNA, 3816 bp, Glycine max
  Peptide Sequence Number=SeqID_170811
atggaacagggagatgaatgggcaagggaaagtgggaaacacataaatttactttggatgttaggatggagcactagactgttctacatcaaaggaaagtgggaaacacataaatttactttggatgttagaatggagcacgagacttggcttggcttgacttcagaagcagtacaggaagtgagggaccatcaccaggaaacagctctgattgaggaacagattgcaaatgaatcctctggcaagcaagtagtaggtgaaactagtgtccaaattaactgttctgatggagatggattaactgaacttgagaaactattaaagcagaagactttcaccagatcagagatagagcatttgacagaacttatgcgttcaagaactgtgggttcatctgttgcagaagaagggatgagcacagaagtggttccatcagatccagtttttccttgtgaacaaaagggagaatatcccaaaactccaggaccagaaaatgggattgaaaaccagcttgtttcaaccccatatgttactaagactacctccactgtttctgttgacgatgttgcttcccctgcggagcttgccaaggcttacatgggtagcaggccttcaaagttatcgccatcaatgttaggcttgcgaagttctcccagggaggatccatttctactaaaaaatcaacacgttgctcagaaatctcctattaagtcaattgtgccaaaggctactacccttactagggttcatgaaaatggtttagtgaccccaaggtctcatggcagatcagcgatatatagtatggctcgaacaccatatgcaagagtttatccaggctctatgctcaagggtgctggggtggctgttgaaggtgagccgtcatcttcagcttgccatgcgattgatcatgatatgctttctggatccaagcaaggggtattaaaacgtggaagttctctattaggtaatgatataggatcctttggtccaatacgccgaatccgtcacaagtctaatcttctatctgctaaaagccttaccttacctcattcgggaaatgctctagctatagataggagtagagttggcattgatgctgctcagcaaccttcatcttccatgcagaagcctaatctgttggttgaagctaagcataggcatacaaatctgtctgcagaaaatgtagatgataccatgcctagttccaacattcctcctttaccctcaaaatccagtgagatggcctcaaaaatacttctgcatcttgataagttggtttcccctaaagaaaaatctccaacaaagatgtcgtcatccatgttacgaggacaggctcttcgaagtatggagacagtagattcatcaaaattcctggataacatacgggataatggattggatggctcacatggaaatttgtctgctggtgctcaaaagttaaaatcgaagatagatgaaactgagagtggtccgtcgaaatttgttgctcctactgatgtattagtttctgtcgatgcaaatactacagccccaaagaagcaagatatatctatttttaaatctggagattcctctggaacaaaacctgtttctcatcctccacaaaagaagagggcattccatatgagtgcacccgaggattatttggagctggatgatgatgcccatcctaatggagctgtgtctcctttctctacttctgggaaagaaacaaccgtctccactgctgtggctgataaaactacctctggtattggaacagctgtactggagaagcccccatgttcatctgtgctaatgccatccaaaagttttacaatagatggtaaacctcaagttaggacagctgatgggtccaaagttgaaaagaaggttgatgtaccaacctctataacttcatctgtctctgatcctatttttaagccaatttcagaagcttctaacacaagtttaggctttaacaaatctactacacctaatggatcagttgctaatcctcccctatttaactttgggaataaagttgttccatcaatggagctgacggctgctgatgctccgtcaaaatactctaccaagtcaggtccactatttggtttggagaaggttccattatcaaaagagccaggtgctgatgctcctttggttaattctgggttcaacaaaaatggtggcaatgttttacaagtacctgttactttctcttcatctgttggtgaatctgctgtttttaaatttggctcttctgactcaaagccgataagctcaatcagctcaactactgttcctggtgctgttgattcaatgccaaaagctcttgattcagacaatgctggtgctaagactaatataatagctggtttctctgctcggttatctgaaccagctgtttcttctgtggcatcgatgccatcgttgacatcacctgcaaatttatttacctttggcaacaattcaaatcaaaataatggacctgctgcttcaagccctacattttcctctccatttccccctctgacaaacaattttacaggtcagaatatattcagtagctcatctcttgcagcaagcaacagcagtgttagtgcatatgtagcctccactagcatgggcatgacaactagcacccctgctgtagttgccgccagcaatagcagttcctccacccaagtctcatcttcatctcccacaacttcatttttcaaatttggatctaccccttcagcaccaacaagtttacctgtgtcatcttctggctcagaaccactggaaaacaagagtggcacagggattggcatgtttggaagctcttctgctgcaattggaagcacagggagtggcatttttgggtttagtaccccagcaatgacaactgggagtagccagtctctgggttctgtctttggcactacaagtggatctggtactagtggttttgccacttcatctgagagtcagtcagtggcatttggttcatctgcatcagccccattgtctgggttgactgggagtgcagctttttcttcagggagttcattgttttcttcttcaagttctgccacaaacattttcaatgcgggtacaacttctgggaaaagtacccctgctgcttcctcagaagccaaccctgttagctccagtggtggcacaagttcttctgtgtttgggctttcaagttggcagcccagcaagtctccattgggttcttcctttagttcatcatcttcaccttcctctgggttttcttttggttcttcttttagttcattgtcttcatctactcctgggttttcctttggaggaacatccacatcttctgttacttcttccagttcccccatgatgtttggatcatctgctgttgcatcaactcctcagttttcattcacttctgctacagctactaccaacacacagcctgcttttggaagttctagtcctagtcctggcttcacgtttggtggttcagctccagctcctgttaataatgatcagatgagcatggaggacagtatggccgaggacacagttcaagcaactccacccgcaactccacccgcaactcccatatttggtcaacaacctgccccacttcaatcaaattttgcatttggagcatcagcttcaacaggagcgagtcctttccagttcgcaggacaacagaacattgctcctccacagaatccatctccatttcaggcttctggcagtcttgagtttaatgctggagggagtttctcattgggcactggtggggatgacaagtctggtcgaaaatatattaaagttaggcataatagatcgcggaagaagtaa

SEQ ID NO: 54034 - DNA, 333 bp, Glycine max
  Peptide Sequence Number=SeqID_170812
atgaagctgtggctatttacggatcacctgatccgtaaacaaatccaagtttccctactccgacatcaatggtggaaaatgattgaaatgcttacctcgacgaccgatgctgacgatgctcgacggtggacgctggaagaagaagaagatgatagcgcgaggaagaagaatggctgcaaggagaatgcgaggaagaagaatggctttgtgggggaaataagaagaatacgaggaagaagaggctgcaaggaagaagatgaacgcgaggaagaagaagaatgttgggtgcgcgaggaggagagagagagtcagatgtttttttttttaaaataa

SEQ ID NO: 54035 - DNA, 759 bp, Glycine max
  Peptide Sequence Number=SeqID_170813
tatgacgagttccttgaggaactggagccacaaggaaggatcacttccctctgtcacctcaagaaaattctcccggagaagaacatggagctagcctacacctatcctagggaagctcatcatgttcgacacccagatgttgaacgctttcctagagacaccggtcatcattccggaggaggagtgcctgaccacattgtcccaatggacatggacctaggtagcatgatttcttctcaaatcacctattccaactctttgaagttgggcgtccctactttgatcactgccttctatgacatcaagggggtcattttagataccctgacctttgagtcgttgagcccgatgattaacctgccatatatcaggaagaactactggaatccaatagatccttccactgtcatttcaggtccacggagggccagggctcatgctgctccagatgctcctcctgtcatccctccgtcagtgtcttcaccatggccagtattttcttatgcaaagtctccatcagctctccctctatcaaccagtcatgtcgccagaggacttcctagagcatgtagcttagcctggagtccagccttcctctattggggggtgacacctttggagctagatctgatgcaggaccagctggtgattctgattctgcagaggttggtgatgatgatgactaagttgcagatgtcacagctacccagggagcttgggacactaggcccacttgggattgagaccacttttgattag

SEQ ID NO: 54036 - DNA, 1512 bp, Glycine max
  Peptide Sequence Number=SeqID_170814
atgagtgatggattttgtggtactcatttgcagatcatggtcactggcagaggtgtgggcagaggagatcgtcatgattccaatgatgctccgcagcgtcgacagcctactgcattcgcacggaggcagcgagtcgctgtgactgcggatcacgtcgatgagccagtcatccctgtgccagatgttcaggatgacccgatggaggcaccagctgctgtggaggacattcctgcggacattcctgcgaacgcaggtgcagaggcggctgaggatcagcctcagggatttccgggtggtccgagcgacccatccgtgttgacagcgtatgcggatcatgttgcttgcagcgtatggacgggagaggagcgtcctgaattgaagttatcctctcatgggaggaaggtccacagtttaggtaggcctgtccctgccattgagggacttattgctggtacaggactaagtcctctgatcgcgtattcggtagacaccggcgattggggatttttgtccgcgtttgtggagcggtggcaccgggagacatctagttttcatctcccggtgggagagctcaccatcacattggacaacatctcctctcttctccatcttcccgttataggcgactttcacgcatttgagcccttgcacgtggatgatgcggttcagatgctggtggacttgttgatggtgtctccagagtttgctagggctgagacagtccagtgttgcggacctgcaaccaatgtccatgttgtctacttggaggcccttcgtgacctcagtatgacagagaggtacgcttggggagtggctgctttggttcatatgtacgaccagctgaacgatgcatccatgagccacagtcaacagcttggcggttacatcacactgctgcaggtggattgcgacaaagaagaccgtgaagagcatttgcacgccgtcatacagggagcgcctggaccgactccggattccggatgtctgttggatcccgtatggggagcatcgggaggtccgggacttccacgtcagatcatgttattccggtctcttgcgctggaggcctgttgctgtttattaccgaccggagaggatcatatcgtacctgcaggtgaggtgtgcgttgtgctaggggcgtgttccagtgactacatcgactggttcttccgcatctcccatcctttcatgacaccaggccacgcattagatcctctgcctcatggtcacgccccgcagcctcgagtcgtccctcaggccccgcagacgaatatccttagcgtgccggagccaggagcatcgtcgacatttgcggaggagtccagacatgcagtggaagtttgtgatgacattgctgagaggttggagcgccatttgagtctaggggtggtcacgcctgactcatcgacatatgaggtgatcgaaaaatgcctcagattggccaggagtgtgacacaggaccatctagtatacgttaggtgtagacgcaggtggcgcactgatcagacttag

SEQ ID NO: 54037 - DNA, 267 bp, Glycine max
  Peptide Sequence Number=SeqID_170815
atggggaatggcaatctagaaatgagtgtggaggaccaaaaggtgaccttcaacttgtttgaagcgataaagcaccccagtgatagcaaaacttgcttcaaggtggaggcggttgagcaagaagccgaccttgttgtgcaacgctttaccattcattcaccatttgaaaaggccttgatgaatgctattgatttccttaccaatgaggaggaccaagatcttagggcttgtctggaggacttagatagattgaaggagttcccctag

SEQ ID NO: 54038 - DNA, 126 bp, Glycine max
  Peptide Sequence Number=SeqID_170816
atgagggagtgtggatatgaaatattggccactttaacttctagccgtgctatactgcgttgtttctcctacaagttgcttccatctccagatttaatggaacaaggtcatcctatgaagttttga

SEQ ID NO: 54039 - DNA, 327 bp, Glycine max
  Peptide Sequence Number=SeqID_170817
atgatgacaatgatagtagacacattaccagtattctactatgaaaagatggtgggctacacaccttcaagctttgatgatatggtcttcaccgacaaaaggatcaaagtgggtctaaaaagaggcaaatctgatcatcatgctttgataaatgcaaaaaaaaaaaaaactggggcaaacgaagagggtgagaatgagggagaagcccatgctgtgactgccattcctatacagccagtttcccaccaacctaacaatgtcattactcagctgataacgacccttctcattacccaccacccagttatcgacaaaggcaatccctaa

SEQ ID NO: 54040 - DNA, 1410 bp, Glycine max
  Peptide Sequence Number=SeqID_170818
ggctgtggagtgattttaaccactcggagtagagaagtatgcatttccttgcaatgccaaacaataattgagcttaatctcttagctggcgatgaagcttgggatttgttcaaattgaatgcaaacataactgatgactcaccatatgcatcgaaaggcgttgcaccaaaaattgtagatgagtgccgaggattgcctattgcaattgtgacggtgggaagcacactgaagggcaaaactgttaaagagtgggaattagcattgtcaagactaaaagattcagaaccactagatattccaaaaggcttaagaagtccttatgcctgtcttggattgagttatgataatttgaccaatgaattagccaagtccttgttcttgttgtgttctatatttccagaggatcatgaaattgatttggaagatttatttcgatttggaaagggaatgggcctacctgggacttctggaacaatggagaaagcaaggagggagatgcagatagctgttagcatcctcattgattgttatttgttgttggaggccagtaaaaaagaaagggtgaaaatgcatgacatggttcgtgatgtagccttgtggatagcatctaaaactggtcaagcaattttggcaagtactggaatggatccaagaatgttgatagaggatgaatccataaaagataagagggcaatatccttatgggatttgaaaaatggccagcttcttgataatgatcaattgaattgtccatcacttgaaattctcttgtttcattctcccaaggttgcctttgtagtatcaaatgcttgttttgaaaggctaaaaatgattaaaatcctggcattcttaacatctagctatacgtggtggccatgggggacagatggcatcttgtcactgccacaatcaatggagtcattacaaaatcttcatactctgtgcttgagaggttataaattaggtgacatctccattttggaaagcctacaagcacttgaggttcttgacttgcgttgttcttcttttatagaattgcctaatggaatcgcgtcattaaagaaattgaagcttctggatttgttccattgttccattcaggaaaataatgcttacgaggttataggaagatgtatgcagctgaatgaattgtatttgtatataccttcatatgcaaatgaggaatttccgcataatatctctttctcaagattagagaggtatgttttaatttttaaaatggacccctcatactggaggtcgtggtcgtggatggaaatattggaagaacatagaccatgtagagcgttatgcatagatggttttaatgcctcagttcaaagttttatatcattaccaatcaaggatttctttcaaaaagcagagtatcttcatttgaagaacccatga

SEQ ID NO: 54041 - DNA, 357 bp, Glycine max
  Peptide Sequence Number=SeqID_170819
atgtatgacgtcgcaccccactcctcccctccaaaccttccctaccacactccgtcacacgttttgttgccgcctctacaccaggagaagcgaagctcggtgtcgatgtcgccattgatcgaaggcatgccgctttcggtgttggtagaggtgtctcactggctagcgctggatgaggcttatggagtcgtgggtttgaggctgatatttcaaggcagagtaaggttgaaggctggggccatcaaaactgcacactacagattctacgttaagtgggatgttttgataggtttgaagaaaggcttggtggttcaagttcctctcctcggagttacaccctgcgatgtcgatcaatga

SEQ ID NO: 54042 - DNA, 1017 bp, Glycine max
  Peptide Sequence Number=SeqID_170820
atgaccacaacaaagttagggtttatacataaaaatgatatccatgcaaccaaccagataggcataatcatattttcgcagaagacaaaagtataccgtcaatgctacgaagaagaagaaacactgagtaccgtcaatgctaggaagaagaaactatccactttggaagacgacaccggtgaaggtttcgcgggcgcaaccaaccttggagatgtcagggacggtggcgaggtgtcaagtgtgctgcagagggaaggtgtccttgacgaaaatgacggtgttgccaatgacaagcttcttgtggttgaagaacttgctccagccggtggtgaagaggtggcgacatggcgtgccgcggtagatgtggtggaagcgccactcaacgccgtggatgtcggcgacagagaggagctggataggtggatcggcataaaagtcgagtggagggaagcacaagtcggcgcaaaagcacggcacggagaagccaccgctgttgttggcgtcggagggagtgaggatcttcacaaacgaaacgacgccgttgttctcgcgaggggagtgaggaggaacttggcaggggacaaaggggagagagcggataagagggttgtggtaatgcgagggagaggcatgctccatgtgaccctaggcctaggggaagcaattgcaagggaagtgttggatgcagctgctccgattattcagtctagtgtgacgactgatgagattgacagagttgttcatgcggcaactattactgcagaagctactccatcggttactttcgagaatgttgtaaaagagcacaaatttgctgctactcatactcactcgttgaaaagtgttgtggagaagaccattacattggggaaattggaagtttgtttggagcttaggtattctgtcttgtgtattcaggctgttcgaacaactctaaggatgctagaggacgggcacaatattcgggatgcagaagctgtttgtgtccctgatgttctaaaccagatatttaagtag

SEQ ID NO: 54043 - DNA, 881 bp, Glycine max
  Peptide Sequence Number=SeqID_170821
atggcgacatcgacaccgagcttcgcttctcctggtgtagaggcggcaacaaaacctaaagcattattgcaaagagttgttgttgtggagagggagcctcacgatgagcaagtgcctgagattgaagccacgatcgaaaatgaaatgaatgagaacaagctaggggtcctatggccttctctgcctttgacggaagatgttatggaatccctgacaaagcatattgcggttaatatggttcagtctccaaatgctagccatggagttatggggcttgagcaggaacctacaaacattgtgaaagtggtcaaaatggtggaagaagatgctgcaattaattcaaataatgggaataccgaaattccaacaacaaacgttggcaacatggaaggaaatattgtggcgcaccaatcccaaggtcgaggtgtaggaggaagtgggaccaggcctagccagattgagggtgacgatgccatggagaatgaaagtgaagttgcaagtcagctaggtgagctaggaccaattgagggagtactgttcttcttctgtttgtttgctagaaagtcacgcttgtgggaagaaagcaatcaagttaacaaaagactagggttgaatggttattttattgaagaggcacaaggtcacatgggggaatttggtgcttttgggacccttgtgaagtggaagacaggtgatgacaggctccttaaagtggtgtatggaagacctcgttatcaacatcatcaaagtttgtgggatactctagttgacattgccactgatgtggagggagtgtcgcaacctaccctttggcagaagggcgacatgagactcacgggtgcatcttccaaggaaagaaaacgcacggagtcgccaccaac

SEQ ID NO: 54044 - DNA, 348 bp, Glycine max
  Peptide Sequence Number=SeqID_170822
atgaaaactattggagttgtgattgtgatcatcactatgttgggtttcacacaagctgatcattataatccttcatatgtgcaagttgagccaaacagtgagtctaacggaattagttgtaaaaccatatgtaaattagaatgtgcacctttagtaataattgctcagctgtatctaaaatgtgttaaagattgtagtgcaaaatgtcttacaaagtccattgttgcggccaacgattgcatgactagttgtggcttagtcaagtccattaacgtcaacaatgatgttcgtgatcgcacgacttatgtggtgaattcttgtatgcaagagtgtctaaacaagaaataa

SEQ ID NO: 54045 - DNA, 294 bp, Glycine max
  Peptide Sequence Number=SeqID_170823
atgaatctggggatcccacggtcatgtggctccgcatgccaccggtctcttgggacacgcatttcgtttctaaatgaccatttagaggaagcactgggttcaacaaaaatagaagaaaatcactcaaagtgtatcaatctcacacagggtaaggattatggtgagttaggattttggctcaaggcttgtagaacggttggtcatgatacatgtcaggatttggccagcggtttggggataaaggggatgtccccacattattcccatgatacacatgcaacaaatgattattag

SEQ ID NO: 54046 - DNA, 339 bp, Glycine max
  Peptide Sequence Number=SeqID_170824
atgggtgccaagcaccttgcaaggaccaaagaaaagtcgcatgtcatcaagcaaaggtccccggacgaaattaggaatgccaaattggctgtttattatccagatgaacatcagacaccaactgacactacacagcatgatcaatttgtcggctatgacagctcagattccagtgatgatgatgtaaatatgacacaggaaaacattgatatagaatactcattaaatgacccaacaatagatgatcttgatgattatgatgaacagacctttctatctgcctcatctgcataccaaaatacaggtggtacttacattgatatcggagatcctatatag

SEQ ID NO: 54047 - DNA, 183 bp, Glycine max
  Peptide Sequence Number=SeqID_170825
atgcatgtagcattcaacgaggaagctctatggtgtgctacggcgatcgtcacgagcgtttgtggcattgcaggagaaggggatgctagtaacacaaaaacttgttctgaaaagaacatcaacgagtgtttgatgtcgacaccgacattgccttcgtggccgcaagacgcaggcatattgtag

SEQ ID NO: 54048 - DNA, 175 bp, Glycine max
  Peptide Sequence Number=SeqID_170826
gcgtgacggggagctgaggaaggggttccaaggttcagaaggtgaggaaattgagagaagagagaaagaagaagaagaaagaagaggaaacgaagtcgaggcgttgccaaatcgcgactgtgatcaatctctacgttgttccttgttcggtgttcttcgtgcgaccatcgattag

SEQ ID NO: 54049 - DNA, 480 bp, Glycine max
  Peptide Sequence Number=SeqID_170827
atgggattgagccaggtgccttctcttaaaaagaggttctatcaagtcaaggtcaagagcctaggaattgccagtctgaaagagttaggacagttgatgggtcagctccagcgacaagcctttcgcaaagcttatggtaatatttgggacctaaccatggtcgaggtctccacggaggccattgcctccctcgcccaatattatgaccagcctttgaggtgcttcacctttggggacttccagttagcacccacggtggaagagtttgaagagatcctgggatgccctctgggaattagaccgcgggaagcaagtcaaaaatggggtagttggggtaccaaggaaatgtttggaagcaaaggcgagagtcttggcaagtcaaggcgaaggggccccgttcatggacatcttggcacttttgatcttcggggtggtcctctttccaaatatggatgggttagtggaccgggcagcgattga

SEQ ID NO: 54050 - DNA, 360 bp, Glycine max
  Peptide Sequence Number=SeqID_170828
atgtcacaaagaaaggacaaggaacttagagggagtagcaatgggcccatcggtggttaccataggtggttgaaagcctacgcacaagacctggattggctcccgagtttgaggaccactaaggggatggagattgaaactccggaaaaagatgaagagacagtcaaagaaaagttcaagtcagtagctgttaggatccgaaaggagaacgccaaactgagagacaatatagccaccaccaaggccttggagcaaaagaccaagagggcccgtaaggaagaacatggccggaacaaatttcgaggggctctgtggggcagtaacagcgagcttaagctccaaagaaaggggagggactaa

SEQ ID NO: 54051 - DNA, 492 bp, Glycine max
  Peptide Sequence Number=SeqID_170829
atgggtgacctagaggaagtacagaaacagatgaaactggacatgttggctttcaaagaacaaatggcttccatgatggatgccatgttgggaatgaaacaactaatggagagttacatggccatcgccgccgctgttagttcggctgccgaagcagacccgactctctcaactaccgcccaccaccctattccaaacatggtgggacgagagggaagcacatcgaggcatatcaacaacccccattcgtggtacaaccgaggtacttatccctatggtttaccacccaattacacaccaccagccatacatgaagacgtgggtcacgttcctaccctcatcctcgaaggggaacctcctcgacatcctgacggggtccacgagaatcctcaagagcatgctcagggagacatcaactcctactgtagaagcaaagcttcatggaagcaacctggctcgcctgggcgagctgagctcgcccaggcaagccag

SEQ ID NO: 54052 - DNA, 333 bp, Glycine max
  Peptide Sequence Number=SeqID_170830
atgtcacggaacttcacggattgtgcaataatgcttccttttgacttccagcatgtcacagaacttcacgaattgcctaacgatgggtgccaaggagctatgggaccagtaaaactctcagataggccggatcatgaggttatgtgggatgctaccatgttcggggtgtttaatcaagacttccccttgtacataaagcatgaagatttgttgaaaatagcacacggtggtcaatgtctcagcatctctgtcatacagttgtggattctgcatctgactgagacaagtatgcgagcggggaattccgatttatatggattcctcgagccatag

SEQ ID NO: 54053 - DNA, 255 bp, Glycine max
  Peptide Sequence Number=SeqID_170831
atggatggacaagctccaacaatgttcatacttgaaggtgctttaaccaacaggcctcttggccttgatggaaaagatttcaactactggaaagaagaatgtggaattgctcaagaattttggaacacactcagaacaacacaagagggtacaaatcagattcatgaacataagtccatagaagagatgtccaacaaattcactactatagtgaatgagtggaatgctctaggagagaagtacccaacacattag

SEQ ID NO: 54054 - DNA, 567 bp, Glycine max
  Peptide Sequence Number=SeqID_170832
atggcggaggcggtggagcacagcctgcgtttcctgagcgacgacgatctcgacgccatcgccgactggcttaaacagacgccgccgatcgccaccgcgcaaggaacgaaagcggcctatgcctatcagggaggcggtgaaggccgtgccgccgggcaggcgctgtatgccgctgcctgcgccagttgccatcgcttgggcggcgaaggcgcctacgacggccatttcccttctttgacacacaattccaccgtaggcagcgagcaggccaataacctgatcatggtgatgctgcatggcgtgcagcgccagggagagacgctgcaaacctggatgccgggattcgccgacagcctggatgaccggcaactggccgagctgggcaattacgtattgcagcaattcggcaatccggcggtcaggataacgccggagcaagtggctcagctgcgggctggcggtgagaaaccgtggttgatcgcgtcactgccttatgtgttttggggcggggtattgctggcattgatcgtcatcggggcgtgggtgaaacgtcgggtgaagcgttga

SEQ ID NO: 54055 - DNA, 381 bp, Glycine max
  Peptide Sequence Number=SeqID_170833
atgaaggaagaacaagaaaaagaaaaagaaaaaaatcagaaaaatgaaaaagaaaaagagaaggttgatgaggagaaaaagaagaggaagagtgaggtttcaagagagaaaaagagagagattacttcagcagaaggcaaggaagtaccatatccattggtaccttccaagaaggataaagagcgacacttagccagatttcttgacatcttcaagaagttggagatcactttgccttttggagaagctctccaacagatgccactctatgccaaatttttaaaagacatgttgtcataccctaatttcgtcgggggaccatccgttgttaggatgcgaccctcgtttgaccacttcgaggtatttgacacccatcgttag

SEQ ID NO: 54056 - DNA, 759 bp, Glycine max
  Peptide Sequence Number=SeqID_170834
atggcatcaaagaagagaaaggcacctgccacaccttcccaggtccgatatgaacaatccaggttcacttctcctgaggcctgggaaagttacactgacattcttgtacctaggaagctgcttccggaaagaaatgtggtaatctaccacactgagtttgatgagttcaaggaagaactggagagaagaaaatgggatgaggaattgaccagttttgatgaatcacctaagcaggtgatggtgagaggtcatttggtaatcttctggaaagagttttatgctaacatctatgatcccgaggataaatcacctaagcaggtgatggtgagaggtcatttggtgaagtttgatgtagacactctgaacactttcttgaagacccctgtgataattgaggagggggaagagctgactgcctactctagatttgcactcctgaggcttgatcctcaagagttggctgccaagctctccatcccagggagaggatttgagcttaatgttgatggcttgccactgaagatccttaggaagaacataaccatacatgctcaaacttggagtgttctttcttactccaacttggtccctacctaccacacttttgacatcacactggattgggccaagttgatttatggcattatcatgaagatggacatgaatatgggctacctcatctcccaccagatttctatcattgcccagcatgactcctctaggcttggatttccaagccttaatcataactttgtgtaa

SEQ ID NO: 54057 - DNA, 228 bp, Glycine max
  Peptide Sequence Number=SeqID_170835
atgtgggatcggcacaggcttaaaggagcactcaaaccaggtgtatttacccccaaggcctacactccgaagagtctgtcaggatctctccctcctcattcagtgattccatcacaatactcatcacgcattaactcatcgccctcaaagggtcttagcattaactcgtcgcccttaaaggatcttagcattaactcgtcatccttaaagggttttatagtcgtgtga

SEQ ID NO: 54058 - DNA, 279 bp, Glycine max
  Peptide Sequence Number=SeqID_170836
atgactaggggcaatccagatgatttacaaccctttgatcctgaaatagatagaacctttcaaagattagttaggcatagtgaagatcctcataagcatcttaaggagttccatattgtttgttccaccatgaagccccctgatgtccaagaagatcatatctttctaaaggcttttcctcattctctggagggagtggcaaaagattggctatgctaccttgctcccagatcaccccccaaatctatgtccttctttgcagcaatctggagtcaatga

SEQ ID NO: 54059 - DNA, 140 bp, Glycine max
  Peptide Sequence Number=SeqID_170837
gagaatctagcagagcatcagcatcaaggccgcgcactaagcgcgagatcagtacgctaagcgcagtaggagtcttcagccaggctcaatgcaagactggcgctaagtgcgagggtggtgctaagggatgtttcccttga

SEQ ID NO: 54060 - DNA, 210 bp, Glycine max
  Peptide Sequence Number=SeqID_170838
atgtcataccctaatttcatctgggggccattgtttggtggcatgcaacctttgcttgaccgcttcgagcaaccaggcccacttgggcctttcgggggttccaacagaaggcggtgccttctggtggaagcaacccaacttgcctgggcgagctgggttgcaactacctccctctttttccctataaataggggaaatagggcagagtaa

SEQ ID NO: 54061 - DNA, 291 bp, Glycine max
  Peptide Sequence Number=SeqID_170839
atgattcaagagaaaaagatgaagaaaaaaaataaggagaaagcacaacaatgggagaagtgctcacaagtagaaattcaacaagaaagtattctccaagtcaatactcctcctcatcaactgattgcaaaggaagaaagacatggaaaacatgagaaagtcataagtgtcattctttccttaatcactagcacttctcttgcaatgatatggaaggtgtttccgaaatacatgagtttcatggagtctttgctaagaggtgaaaatgcaaggaagatgtgttctttgtga

SEQ ID NO: 54062 - DNA, 571 bp, Glycine max
  Peptide Sequence Number=SeqID_170840
atgaatggaaacggtggatttaacactcacttaccagtgtttgatggtaagaactggaatcgttggtcaatacagatgcgtgtgttgttcggagcacaagatgtgctcgaatttgtgaatgacggagttccggatttggcggaaaatgcgacggaagcgcagaggaatttgcatcgcgaaaagaagaagaaggatcagaaagccttgttctacattcaccagtgtgttgatgcaaagatctttgagaagattgcggaatcgacgacggcgaaagctgcttgggacacgcttgtgcgttgctatggtggtgatgcaactgtgaagaaagtcaagcttcaatcactgaggaagcagtatgagaacctgaatatgaaacacaatgagaaggtagctgattatgtgtctcgcataattactgttacgaacgaaatgaagacctgtggtgagacaatttctgagcagatgattgttgaaaaggtactgcgttccttaactgctcaatttgatcatatagttgttgctatagaacagtctaaggacactagtacaatgaagattgatgaattgcaag

SEQ ID NO: 54063 - DNA, 351 bp, Glycine max
  Peptide Sequence Number=SeqID_170841
atggcgatgaaaagacaaaaatttaggaggagctcctccggcggctactcttgccccgcctcaaaatttcacttctcctcaaccattccttctccaggaagcttccacctctacgtaggtctggcatgtccgtgggcacactacaccctcataatacacacactaaaagggttagaagatgccatgcccgtctcgattgcatcatcagacctcaatgggtcgtgggagttcaagcggccactgcgtgtttcaagagtggatcgaggagatatggtagagagaaaggaagtgagattgattgtttattggtgtgttggtatgaatcccgataagatgaaatgcttcaattaa

SEQ ID NO: 54064 - DNA, 702 bp, Glycine max
  Peptide Sequence Number=SeqID_170842
atggcaatggcttctgattgtccaagagaatctgatggcgcctccatacaaatgagattgtcttacagcccagctgctcaatttttcctttttctggttcagtggactgattgtcaccttgctggagttttgggattgctgagaattctcatatataaggtatatgaagatgggaagacaaccatgtccatttatgaaaagaaagccagtttgaaggaattctatggtgtgatctttccctctttactacaactccacagaggaatcagtgatgtagaagaaagaaaacagaaagatttatgtgctacaaagtacaagccaagagatataataagaagaggaaaatcatctgaaattgatatagagagagaagaagaatgtggtatttgcatggagatgaacaacaagatattgattgatgcccaagaccatgtagttgtagggtacaagtacaacagaagaaggcatgcacgatctcaatcttgccctttctgtcgggacactcttcaaagagtaaactctggtgacctttggatctacatgaacagcaatgagatagatgacttagcttcaatcaacaaggagaatctaaaaggactatttatgtacattgacaagttacctctaattgtgccagatcctatattcatgtcctatcctcagcgctttcgatttttccctaatcaatttgggtctgcatga

SEQ ID NO: 54065 - DNA, 234 bp, Glycine max
  Peptide Sequence Number=SeqID_170843
atgaagctgcaaaagaaaggaaagatcaaatggctatcttgctatgaagcatatggaggaggaggaatgacaaggtatgagaaaacaaggatgtctcaagtgagtttgtggttaggaggaggaggagtgacaaggtcatttcctagaggaggttttgttatagatcgaatcaactgcaaaagaaaggaaatatcaaatgactatcttgctatgaagcatatggaggaggaatga

SEQ ID NO: 54066 - DNA, 249 bp, Glycine max
  Peptide Sequence Number=SeqID_170844
atggtggtgctttctccaccagggataatgagggaactaattgtgttaagctgctctggctttcgaatctccacgccttgcacccctaaccttctaagagctgccataaaaaacaaaagggttgttgaaaagagaaagaagggaaagatgaacgtgccagctatgtgttcgttgaaagatccttgcagcgcgaggacgccaacgacggccatgttggggagagtggagaaagagatagcagcgttttga

SEQ ID NO: 54067 - DNA, 177 bp, Glycine max
  Peptide Sequence Number=SeqID_170845
atgagtttctacgggaaaggaaaatgctacaatgcgaggggtatttctcttagctcagccatcatatcacaatttccaacggttaggtggcctgcgggaaaaagagagggttttgggagaagagggaaaatcgaaattgtgaggcagaggaagctaaggagtcagtctaaaaactga

SEQ ID NO: 54068 - DNA, 225 bp, Glycine max
  Peptide Sequence Number=SeqID_170846
atggcagccccagatctcccttatacttggttgagtgggccactcaagaatgacctttattctcttaggatagatgaatcaaaagaacatcacctagatgaagatgctctaataccacataatgtagctccatgtagagcttgtaggccttggatcttcttcatcaatgaagtccttttcttcttgaagatcaatgacaatggaatggagaaggaaggaaggtga

SEQ ID NO: 54069 - DNA, 607 bp, Glycine max
  Peptide Sequence Number=SeqID_170847
accaactgaaggagtggtggatattgctgtttctgagcatcaaattgccaaggaaatcactgccaagcaagtccagcattggccaaagaaagggaagctttctgcagggaagctaagtgtgaagtatgcaatcttgcataggattggcactgccaactgggtacccaccaatcatacttccactgttgccacagaatcttttgctgtcaaattacccattgccttcccaactgtattgtgtggcattatgttgagtcaacatcccaatattttaaacaacattgactctgtgaagaagagagaatctcctctatccctgcattacaaactgtttgaggggacacatgtcccagacattgtctcgacatcagggaaagctgctgcttcaggtgctgtgtccaaggatgatttgattgctgaactcaaggacacatgcaaggtgctggaggcaaccatcaaagccaacacagagaagaaaatggagctggaacgcctgatcaaaagactctcagacaatggcattgatgatggagaagcagctgaggaagaagaagatgcaacagaggatacagaatcagatgatgatgattctgatgccaccccatga

SEQ ID NO: 54070 - DNA, 666 bp, Glycine max
  Peptide Sequence Number=SeqID_170848
atggaggatatggagtggcaagaagccctcaacgttaagagaactaagttgcaagacaagagtgaagtcatggtattgattggataccactcaactggtggttacaagttgtacaatcccaagttgaagaagacgtgtattagtagagatctcttgatcaaagaagatgagtcatgggactgggagataggggaagtgaaattcaaggctgcaccagaaatcgatatatgcagtgacagtgagagtgatgatcacagtgctgcagaagtgaataatgatggtgtgaatggtgtcgtagcacctaatgatgatgtgcctggtgacgtagtacacgatgtgcccgctactccagcagtgagaccacagaggcagaaacaattaccaaggagactgcaagattgtgaggtgctgccagatagtgctgtgactgacgaaggtgacttgattcacttcgctctcttagcagatgcagagccagtcaacttcactgaagcattgaagattagtgagtggagagcagcaatggaagatgagttgagatcaattgaaaggaaccatacttgggatcttgttcaattgcctaagaacaagaaaccaataagtgtaaaatgggtattcaagttgaaattggatcctgagggcagaattgtgaagcacaagggctag

SEQ ID NO: 54071 - DNA, 927 bp, Glycine max
  Peptide Sequence Number=SeqID_170849
atgtactccatttcagaggactacatgtcctccacatcagaggactacacgttctcccctttggaggactacatgtccttgccttacgagggctacacggcttcaccttttgaggactacacgccctcaccttcagaggattacacaggattacacaacctcgccttccgagggctagacgccctcgccttcagaggagtacacatcctccccttgagagggctacatgccctcgccttcgtagggttacacacccttaccttcaaagcactacacatactcaacttcagaggactatacatcgtcaccatcagagggctacacgtcctcgcctttagagggctgcacgtcctccccttcagaggacaacatgacctcccctttagaggactgcacgccctcgccttaacaggactgcatgttctcaccttcagaggactacacaacctcgccttccgagggctagacgccctcgccttcagaggagtacacatcctccccttgagagggctacacgcactcgccttcgtagggttacacacccttaccttcaaaggagtacacgtactcaacatcagaggactatacatcgtcgccatcagaaggctacacgtcctcgccttcagagggttacacgtcctccacttcagaggactacatgcccataccttcaaaggataccttcataggactacacgcccttggcttcgtaaggcttcacgccctcaccttcagaggactacacatgctcgcctacagaggactacacgcctttgccttcgtagggctacacgccctcaccttcagaggactacacatcctcgttttctgagcgatacatgccctcgccttcagaggactacacgcctaacctttcaggggtctgcacgtccttgccttcagtgggctacacgtccttgcctttag

SEQ ID NO: 54072 - DNA, 630 bp, Glycine max
  Peptide Sequence Number=SeqID_170850
atggaggacctactagtgaaagatcttttttactttgattacaccgtgaatcctgttgttattcgtcgtgaatcgcaccatagatcacaacaaacttcgtcgcaaaaatcattgcctacccatcaggcaagaaaggtcattgacatagaggttgttggtggtgttgtcaaactcagcggcgctggtggtgtcgttggcattgtgcgcaagagagggaaaaaaggtcaatgtatcacaaggttgttagtggtgatgaagtcaatgacattggtggtgtcattgacggcgttgcgcaccagtgcccagatgcaaataggcataattgggaatgacctgaagcttgagcacggtggttttatcagtagtagtgagcacactaagatgagaaagaaactcgagccaacatccactccaacccccacggtgaggagctcgaactcgaagtcctcgacattgagtaactccttgaagatagtgtatgtcaatctgagaaagttcctgttcctcacgagtctgattaaagccaatggtgagcgtttgtacaatggtgaggtgcaacggaggaatgacggtcacggaggcacagcgggttcccttatcaagtcgcaaaggggagcgacaaagggctaa

SEQ ID NO: 54073 - DNA, 1851 bp, Glycine max
  Peptide Sequence Number=SeqID_170851
cgtcccccaatcaagcttgacgtaccacgatttgacggtcacaatccactggggtggatcttcaaaatctctcagttctttgattatcaaggaacaccagaggaaaactgcatcatcgtcgcatccttttatcttgacggcgtggcgcttagctggttccaatggatgtatcgaaatggcttcatcatattctgacgaatcctccacttctaacaccatattcatagaggccccaagccaatctattgaagagaccatatcaccttttgaccccaccccacttcaccctcatattagcctccatgccatggctggtgttccagctaccgatacatttcgtctctatggtgttattaatcatgctcgtgtcactatcttggtggatagcagcagtatgcacaacttcatccagccgcgagttgcgaagtttctgggcttatcaatggaggagaccatgccccttcaagtgatggtaggaaacggttcagtcctggaatgccgacaactgtgccccgccaccaccttgctcatacaggatcactcgttcacggtgacgctgcgtgttttgccgttaagtggagccgacatcatttttggcattgagtggttacacactttgggccccattattaccaattacacctcctttaccatgcaattcacccatttaggacagcccattagtctccacgcaaatgttcacacaaacactgacccaacctcagcccaccaacataaacacatcatccacactcattcagtctcaggtctgttccacttgtccctcctacccgtcaacttacctgaaccaaacactgacccgccccaccccattccagccattaacgagcttttgctcaagttccaaactatttttcagcagcctaccaccttaccctcccctcaacagcatgaccaccatatcaacctcatcccctcagcccacccagtcaacgttaggccctataggatggcatgtgcacggcgtatgtgcgttgactatcgagaacttaactctatcaaggtgcgagatcgtttcccgattccaacaatcgaagaacttcttgatgagcttggtcgtgcttcatgggtcatgcccttcggcttgtgcaacgcaccctcgacctttcaggcggccatgaactccctgctcagtcccttcttgcagaaatttgtagcagttttctttgatgacatattgatctatagtgggtcccttcctgatcatcttcatcatctggagtgcatttttcatgctttatctggggtgcaacttgatccctctaaggttcaggccgtcgtcgactggcctacccctcattccccgaaggaccttcgagctttccttggcctcacggggttttatcagaaatttgttaaggggtacgcaagcatgtcggcgccactaactaagctactatgcagggatgccttccattgggtcccagagtctcaggccgcgttcgacaccttgaaaaacgccatgaccgcaaccccaatcctcactctacccaatttcgcacttcctttcgtcctcgagatggacgcatcaggcatcgccatgagagaggtcctacagcagaaaggccatcccatagcattttttagtaagcctttttgccttcatcttcagcatgcatctgcatatgttcgtgaattgcatgcgatcattgccgcagtccgaagaccaccggagcctccaggaacttatgtctcaggtggttcagaacctgaacaacagttctatttagccaagctcttaggattcgattatgatatccagtataaggctgggtccttgaacgtagttgcggattccctttcccacattgatagctcaacctcaggaca

SEQ ID NO: 54074 - DNA, 303 bp, Glycine max
  Peptide Sequence Number=SeqID_170852
atggaagctcatgctctggttgccaggttaattgagaaagatttgcagtttccattcatggccgtacttatttcagaaagcggtgtaaggacgagggaggagaggggaagagaggtacatttctcaggtacattttctgagtggagacgagggaggagaggggaagagaggtacatttgtcagatgaagattgcaagattgtttccaggattaggcaaagatcgtcgtggacatggaaggattcaagcatctcgatctccagcaggtgacattttcacagtcatggtgatagaagtgacatga

SEQ ID NO: 54075 - DNA, 192 bp, Glycine max
  Peptide Sequence Number=SeqID_170853
atgtctctcaatcaagttcttgtgaaaagaaagaaagcagaatggtgtgataaaaatactgagattatgttgaaagtgtgcatagaagagcttattgggaaggacacaggtcttggctgggatggggagaagaaaaccattgctgctagtgatgaatggtgggaagccaaaattcagattcttgatctatga

SEQ ID NO: 54076 - DNA, 614 bp, Glycine max
  Peptide Sequence Number=SeqID_170854
tgccattgcaatgtactggatgcagtgctttccacctgcctcagtttgttcttaggaagattaatgctatttgccggagttttgtttggacaggtaaacaagagattagcaagaaaagcctagtagcttgggatacaatgtgtaggaataaaagccagggtggtgttggcattattaacttgcagggcaatgatgctattactgcttttgtcaggcctaatagttcttggatccttaagaacattatgaatcaaagagataaactgggtcagatacaacaacattgggaccaagcgctcagtagacagaagtttcctatgagtgctatgtatcatgggctgacagaggatcaccaaagagtgccgtggaggtctgtgatgtgtgggaacaaggctagactgcgagctgtcatttgcttgtggcttgcttgtcacaaaaagctctctactaaagatagattaagaagatttggaatgatcaaaagtagtgattgcagtatttgtaactgtgctgatgagtctataaatcatcttttcttcaactgcagtggcactagagaaatttgggggaacattttggattggctgggtagaagacatgatccgagggagtag

SEQ ID NO: 54077 - DNA, 789 bp, Glycine max
  Peptide Sequence Number=SeqID_170855
atgatccaaaaagctattgatgaaggaaggttgaagtttgaagagaaacctatgcaagtggatattgatcttttccaagttcaaaccaattatgttgaacctattcagattttgatggtaggggcttcgattggaatgtccaaggttaagatagccttatttgaatatgaagataatcaagctttggtagagatcaagaaggaagaggaatatgtgtctccacttgttggggaaactttgattgaatttttgacaaagaaacaaaaggctggaaaaaaaggtgatgctctggccttgatgatcactaaagatccccctagtttccaaaagaaaattccaacaaaagtaggtgaagagaatgaagtggttacaaactgctttgaatcaagggattatgcaagggaagagtgttttgaagacccctctttaagtccaaaggttgtttgggtcactcaagtgtcttgtttcactcctcatcataatgttgttgttttcgatctaccaacagatgagatgaaatgtcatataaagccacttcatttgactgccatggtggaataccaaattatcaacaaaatcttggtagatggtggagtagcaatcaacattcttccaaaatctatgctgacgaggtttggtaagactgttgatgatcttattcctcacaatattgttgtgtctgatttctatggaaaaacatatggtttagatgaagttatcttttcagatgagttcatggatttctttgcatgggattatgaaaaatggcttgactcagtagagatctag

SEQ ID NO: 54078 - DNA, 414 bp, Glycine max
  Peptide Sequence Number=SeqID_170856
atgtgttttgtatgcggtgacaacaatggtgatggtggtggtgttagcagcaatagcgatagagatgctaatggtggttgtggtggtagtagcgatataggcaatggtgatggatgtgttagcaatgctgatggtgtcgatgacgatggtggtcatggtattagtgttgatggtgacagtagaggtggtatttgtggtagcagcgatgacaatgatggtgatggtgacaatgacggtggcgatggtggtgaccttgtggtggtggtggtggtggtggcattggttgtggtggtgatagtggtagtaatctggtggctgggtggtggtggtgactatggtgatagcgatggtggtggcgacagcgaggaccttggtagtagcgatgacgacagcgacagtaacagcgaaaggtag

SEQ ID NO: 54079 - DNA, 357 bp, Glycine max
  Peptide Sequence Number=SeqID_170857
atggactggataggtcatggaggtagtgatggattgcatggttatgttccatctcttgatcatgtggttgtagatacggttttaagttccaagacatgcccattaacacatggatggagtatcaattggatgaagcaccttgagattgcagaagactttacaaaagggattgagtatcttcacatgggttgtgttcatccagtcatccatcgagacttaaaaaacaacaacattcttcttgacaaacaaatgagagccaaggtttcggattttggtctctcaaaacttgcagtggatggagcctcccatgtttctagaatagttcgtgggacagtaggatatttggatcctaagtaa

SEQ ID NO: 54080 - DNA, 678 bp, Glycine max
  Peptide Sequence Number=SeqID_170858
atgggctccagtgccgcctcagagtttgatagtcaccgttttcggtgtgtcaagcaccagcagtgcttcgaggccatcaagggatggtctttccatagggagaggcgtgtccagctcagggaagacaagtatcctgacttccagggagatatctctcgcagacattgggcacgactagtgacccctatggctaaatttgacccggagatagtcatagaattttatgccaatgcctggcctactgaggagggggttcgggacatgcgctcacgggtgaggggtcactgggtcccctttgatgcagatgtcagtagccagttcttgggcgacccattgattttgaagaaagaccagcaatgtgaattcagccagaggaggagccaggcagacggtttcgatgaggaagccatcgcccaactgctgtgcataccggggcaggattttgcccggatcgctgcagggaggcagatgagcgttcacatgccccaagtgattgctgatgccatttatttgtttgcaggaatagcgcctactaggcaccctctggacccagagaagtccaacagggccttggggtttccggctttgatcacgggcctctgccagtcctacggagttcctatcacccccaacaaggtaatccgaccactgatcacccgagccttcatcgagaagtaa

SEQ ID NO: 54081 - DNA, 954 bp, Glycine max
  Peptide Sequence Number=SeqID_170859
atgggggctcgttgctctaaattctctttctgctggttccactcccacctcaaaccttctgtccttgaatcctctgaccaagaaaatggcgagaagggtgagagaaaattgtggccaagttttggtgagttcaatttggagcaactgaaggttgccacaaatgggttctcctcagaaaacatagtgtctgagcatggtgagaaagctccaaatgttgtttacaaaggaaaacttgataatggacagtggatagccatcaaacgtttcaacaagtttgcctggcctgattctcgccaattcctcgaggaagccaaacaagtggggagccttagaagtgaacgtctagcaaatttggttggttattgctatgaaggggaagagaggctgctagtagcagagtttatgccacatgaaactctggccaagcatctctttcattgggaggcacaaccaatgaaatgggcaatgaggttgagggtggctttctacttagctcaagctctagaatattgcactagtaaaggaaggggtttgtatcatgatctcaatgcctacaggatcttgtttgatcaggatgctaatcccaggttgtcttgctttggtctcatgaagaacagtagagatggcaagagttacagtacaaacctggctttcacccctcctgagtacttaaggactggtagagtgactccagagagtgtggtttacagttttggaactctgctgctagatctcttgagtggtaaacatattccaccaagccatgcacttgacttaattcgtggcaaaaactttttgatgttgatggattctgccttagagggtcacttttcaaaggatgatggaactgagttggttcgtttggcttctcgttgtttacaatatgaagctcgtgagaggccaaatgcaaagtctcttgttgcatctcttttgtcacttcagaaagagacagag

SEQ ID NO: 54082 - DNA, 633 bp, Glycine max
  Peptide Sequence Number=SeqID_170860
atggcgactagttattataaggacttgtttaaagatctaggtatatttgatgaagagattcatgaagccataaggaggatgatgggatttaaggccccaagtctagaaggcctgcaaacaatattttaccaatcacaatggagtattgctgggcttgctttgtgtgatttgattcatatgatggaagataatattggagacatagcagatgtaaatgagacattcattatgtttattctgaaggtagataatgtgaccttttcgaaacatatgagacccataggactttgtaatgtctcctacaaggttctcacaaaggttctagctcatagccttaagacagtgatggagacatggttagcccccaatcaatgtagctttgttccccaaacaaagcctatgacatacttaattggaactttgttagaggatgctctaggatatttgtcttcctcattccttcatctcattggttttggctttatcaacactcctaagatgagaatgttatggaataacgaggtgcttgatgaatttgaaccttcttggggcaagcaacaaggagattcgatctccctttatctctttgttctatcaagtatggatcaagtggatattattcaaattgcttag

SEQ ID NO: 54083 - DNA, 180 bp, Glycine max
  Peptide Sequence Number=SeqID_170861
atgtttgggaatgagttccgaacctggtgctcaaatttcacaacgatccaacggtttgatggtatacgggaaaatgagagggttttgggaggaggagaggagaaaacgaaagtgagagggagaggaggcgtagagggtatcgttagtctcaaaactgacctaagatgtccttatttatag

SEQ ID NO: 54084 - DNA, 363 bp, Glycine max
  Peptide Sequence Number=SeqID_170862
atgcctacaagaagtcaacctagggttacgaaggtatggatttccacaggtggaaagaaccctcaagaagaacgtgtcaaagagactccttatggtggggcaaatatgtctaaaaataagcaagtggtgtcacatggagtgaatgctatgaaaagtagtccggagaatattgaaaaggattctgctaaatggagtttggaggttctagagtactctaaccatttttttcatttcaaagtcacccaaggagttgtgtcctggctttggacaattgtgtatgtgagtcctcactcgcaattcaaagtgcatctttggagagatttaaggggcattgttgatcatgtaacctatactagagcataa

SEQ ID NO: 54085 - DNA, 294 bp, Glycine max
  Peptide Sequence Number=SeqID_170863
atggtggccgctaatgttgtggcagaacttgccgaagttcaggaaaatagttgtagtcccatctttgagatctccagtcacagactatccaagctcctttctgctttaaatgaatgtacagaatacaaggcagctgatactcgtgaggctgaaaacatagtagaaagagttactcctcgcttacaacatgccaattgtgcagttgttctatcagttgttaaggtggttttttctttttatcctatgtcaccttatgtctctgataatccttctgcaaatggagcttatcactag

SEQ ID NO: 54086 - DNA, 567 bp, Glycine max
  Peptide Sequence Number=SeqID_170864
atgggaaaagggtctaaaaagatgagagaaaaaacgaactctattaggatttcagagttgagtcctactaaagatgatatcctctcaataggagttaaaaaaaaagtcaaaaccaaggacatcaatgccttggtgaaggaggcaatgactgagcaactagttgctaaaggagtagtggaggaggtatcaatgactgagcaaccaattactgaaggaggagtggaggagagatacaagatcccgaggaggaattacttcaaggagagggagattatagatgatatgggtaaggatttggatccgtgccctacgatccctatcacggcagaggaatttgaagaatggcgtgaaccctggaaaaataccttgattgttaatgtgctaggtaagaggatgagttataaaatgatggagaataagttgcaacgtcattggctgaaaacgggatctattcgcattgttgatttgccccaggattatttcttggttccttttatagtagtggaggattataggcatgccacatttgaagggccttggatgctagcagaccattacttgttgtag

SEQ ID NO: 54087 - DNA, 309 bp, Glycine max
  Peptide Sequence Number=SeqID_170865
atggaggtaggggagtcaacaaaggagaaggttgatgatgctagccctagccaaaacgagactcttgtaacggaagtaaatgctagtcaattatctactgataatgcggatctctatgggccttggatgatccccgacaatattgtcttcgattcggcgaacaatcttaatctcattgacttcgatttggtggagtggttcagagacgggaagagcatgagcaacgtggtggggacaccatactatgtgacgccggaggttctgttgggaagggagtacgatgagaaggttgatgtgtggagctatggg

SEQ ID NO: 54088 - DNA, 543 bp, Glycine max
  Peptide Sequence Number=SeqID_170866
atgatgatctcaggttccttcgtaaagagattaaataaattcctaagaaacaaagaaaatcaaagaagatcaaacgtcaaacctaagaaaagaggagaggattcatcgtttgttccaaagtattatgaatgtaatcaaccaggacatctgagagttgattacccgagttccaagaaaagaatggaaagatctgagaggaaaactttcaatgataagaaagcaaataaagcttacatcacttgggaagataacaatatggattcatccgaagactcagaaaatgacgtcatgaatttaagtcttatggaaaaaaattgtgaaagcgaagaagaggatactttgaagaagagttggtacattgatagcagatactctaaacgtacgatgggagatgcatcaaagtttacttatatttctcccaagaatagtggacatgtgacttatggcgacaacaataaaggtagaatccttggagtcagaaaactagataaaacatcagatcatgatcaatgctttctttgtaaagatgatgattcttggtaa

SEQ ID NO: 54089 - DNA, 1107 bp, Glycine max
  Peptide Sequence Number=SeqID_170867
atgtggaaaataaccttagtactacaccatggaggtatctttaccaagaatgaagctgatggaaaattggagtatgttggtggggagttagatgtgtgggataagatagaaactaattatttaaatttctttcttctaaccaatctggtgaagcattgtagaaaatataacaatgtgggtgacattcactgggttgtggataaggaagtggatttggaagagggtttgcgtgtatgtgaaacagattttgatattcaggatatggtcatcagtgcaaggcacaatggagatgaggtggagttgtactatgaccacaaggttgatgaacaacctatcctatttgaagccgatgtacctgaagatggtttaagtaatttgaatccaattccagaagttgaggaagaaggagataaagatgatggtgatgtgggtattgatgacaataatggagtggatgtaaacaccaatggtgaggagcaggaagacattgctagtgaggagcatgatgacattgatggtgacgaggatgtagatgttgatgtgagggtaggccgtgaatggtggagtgatattccagaatacaatgatgaagtccaagaggatgaagctgaaccagttggttatgaatctgaaaagttagatagcccgagaagttctaatgatgaaggtggatttgaaaaagaagtcttccctcaattcaatgaatgcagcaagtttggtaatgtgttggaggtgggaatggaattcagtaacctggaaatatttaaggaaacagttagggattacaccattgagttgggtagggatattaaatggaagaaaaatgatgctattagagcaagagccaaatgtagagagcctgagtgtgattgggaaattttttgtatatccgcatgcttcatatccaactctgacgaaatggaattcgaggatgtcgtttcggccattgacgaggaccaactgctgcaacccgatcaactttatttcgcgcttccattgagtctcttgaggcaccctttgcagccacacgagatggctgcattagccatcaaggccagctccgcactcatgaaaaccaccgacaaatgcggctctcgccgaaaatag

SEQ ID NO: 54090 - DNA, 294 bp, Glycine max
  Peptide Sequence Number=SeqID_170868
atgcgtttgaatgatatagtgccagttcaactacgttggttcaacgcaagaagaccaaatgcagtgaaaaacaaaactcttgcctctactggaaagcatcgattgcatcaggtgacgaagagcggcaaccaccaccactgggagagcgatgatcgacgtgaacctagcacaggaacactatccttcaatcataggagggagaaaatggtggcacttaacatgccacatcatacatttactaacgatgttaggagactactaacggcagggactaacgtgacaaacagagtgtaa

SEQ ID NO: 54091 - DNA, 528 bp, Glycine max
  Peptide Sequence Number=SeqID_170869
atgaattcttctacacttttccttttgtcattcaccctttccttgatcctcatttctcctttgccaaccttaggcacaagcttgtatgaatctctatgcgataatgctggtgtggacaaggctaggtgccttgaagttctcaaaggcgaacctcaaattgttggggctaaagatagtgttgaactttgcaagttggtccttgaattaggactaaaaaagggattagaggcccaaacattcctaaaagaagcgatgaagacaaatccttcaccagccattatgcaatgtgcaactaccctttatgatggtacgattggatctttcaaaagttcattgggtgaattgagtgaggatggtctaaccgcaaattatgatgccaaagtggctggtgatgggcctacaacttgtgacacagccttgagtaatgccaatatcatcaatccttctatttcagctttaaacaaggacatcttgttgattagcaaacttgcatatctagccaccgataaccttcccgataatccataa

SEQ ID NO: 54092 - DNA, 159 bp, Glycine max
  Peptide Sequence Number=SeqID_170870
atggtccttttctcttgcaaaattttaatcggattgtttatgcaggctgctaagattctcgcaaacttgattgtgatgggtggaggaatcttggcaagagcagttgttcaggcatatcgtcaagcgcttactaaattagtagccaagtccgttgtctaa

SEQ ID NO: 54093 - DNA, 153 bp, Glycine max
  Peptide Sequence Number=SeqID_170871
atggcgaatgctagggttccaatttgggaactgttggagctattctccgcctcaaacacagtacgatgtttagaaaattctggaaccggtacaattactaaactagacataatgaaagttgatcttggcaccgatttttctcttagtccttaa

SEQ ID NO: 54094 - DNA, 282 bp, Glycine max
  Peptide Sequence Number=SeqID_170872
atggctactactcgtcaatggccacttcatcagttagacatcaaaaatgcctttatgcatgggagcatgggttgctttaaaaggataagggagatacccaaatctctggatattgtgacactgattcattggagggatgctacagtgacaggtgatctactactggatattgtatatctccattggagggaacattatctcttggaagagctagaacaaaattttgttgctcggtctagtgcagaagcaaaatatagagctatggtcattgccactagttag

SEQ ID NO: 54095 - DNA, 336 bp, Glycine max
  Peptide Sequence Number=SeqID_170873
atggtgatgactatggagatgaaaatgatattaaggcagacattgaagatgatgacaatgatgaagaggaggaggatgacgaggttgaatgttataagtataagtagtcctgttgatattagaatctttgacacgattgaagatgtttcaagattacatttttgtgataaggagacaacatacaaattttattgttggggttatgacaaagttgggttcattaagaaggatatatattatcaagatatgaggaatatgtggctaacaacatctgatgcgactggtgtgctaaagtatttaaggcaattgtgtgatgaattatcaagtgtttggtga

SEQ ID NO: 54096 - DNA, 252 bp, Glycine max
  Peptide Sequence Number=SeqID_170874
atggaggatggggtctcgcttaaggagatgtatccaagactgtaccagatttctcaacaacaaaatcaacatatccagcaaatggggacaatagcaggtataggttgggaatggaagcttcagtggaagaggttcttcttggaggctaaaatagacacggttgcaaaatttatggaagacttacagcgaagtcatgatgagaacgaggctcacttattcttcacttgtgctaacatcttgccactatggtag

SEQ ID NO: 54097 - DNA, 1128 bp, Glycine max
  Peptide Sequence Number=SeqID_170875
atggtgggtgccgatgtgagacttgggtttattggcatgagagggtgtcttggaaaaaacccagtgttgattcttctctttcttacttcctctcgtgatccgggcgttatcccaaggaatttacatccaccagaggaagagttccgttatgactcttcagtttctgttgaaattgggggacgccaaactccgagccttcagttccctcgaacaaaagaagtaatggtaaatggccattctgtgaaggtgaaatattgtgacacttgtatgctctatcgtcctcctcgttgttcacattgctccatttgcaacaattgtgttgaacgttttgatcaccattgcccttgggtgggccaatgtattgggctgaggaactaccgttacttctttctgtttgtttcttcggcaactattctatgtatctatgtgttttccatctcagctttttacatcaaggttctgatggatcattataaggggacagtttggaaggcaatgaaagaatcccctgcatctgttatattaatggcatattgtttcatctctttgtggtttgtcggtggactaactggctttcatttgtaccttattggcacaaatcagactacctatgagaacttccgctacagagccgataacaggatcaatgtttacaatctgggttgttttaacaatttcctagaagtattttgtacaaaagtgaagccctcaaggaacaatttccgagcttttgttcaagaggaggtaccgaggccaccccctccggtcatttcccgggaacccgaaccagatctgggtggtggagatccacgttctaaagttgaagacgatctagatatcggtgaagacctgttaaagatatcacagcgtcggaatattgaagaaattgacgaggacatccggagcagaggaagcaatggacctccccataatacttctgaagtagattcagttttgggttcagatcgccgggccccaacaattcgatctgaagcaaggcactcaagtgagggaagaagtgaaagctgggaaatcgggtctgaggtccttgccaattcaactgtaactgaaagcagaagctatgttgtatcaaaggaggtgcgccaaaaacttgggggttctttctga

SEQ ID NO: 54098 - DNA, 150 bp, Glycine max
  Peptide Sequence Number=SeqID_170876
atgaaaaacaagataggatcgggggcacaacagagtgggaaacctgatccccaagcaaggacagggatgagtctaatttttggacccgacagggatcaagggcgaaagcggggagaacttggggagttggggtgggagtacagagactaa

SEQ ID NO: 54099 - DNA, 426 bp, Glycine max
  Peptide Sequence Number=SeqID_170877
atgggtggtggtgcatggccgttcttagttggtggagcgatttgtctgatcattgcaattgttggtcttcaacgaggaattcctagtaagcgcgagtcatcagctcgcgttgactacgtccctgccctttgtacacaccgcccgtcgctcctaccgattgaatggtccggtgaagtgttcggattgcggcgacgtgagcggttcgctgcccgcgacgttgtgaacctgcggaaggatcattgtcgatgcctcacaatcagattgacccgcgaacttgtttattcatctaccgtcgggagggaggggatgaccacggcgccccgtgcgcccggcctcctcgtcctcgcgacaaacacaaaccccggcgcttcgtgcgccaaggaactcaaatctgttaagtgcgactccacgggggccacggagacg

SEQ ID NO: 54100 - DNA, 318 bp, Glycine max
  Peptide Sequence Number=SeqID_170878
atggggctccgaataagatggtggaggatgcacgaacaccgcaaggcaatcaattcgtggggctccggactcaatgttggaggatgcatgaatgacattcaattcatggggcttcgaataagatttgatgatagacaatgcatgaacagctcttggcaatcaattcatggggctacgaataagatggtggaggatgcacgaaaactgctgggcaatcaattcgtggtgctccgaataagatttgatgatggaggatgcacgaacaactctaggaaatcaattcgtggggcttcagactcaatggtggaggatgcatga

SEQ ID NO: 54101 - DNA, 297 bp, Glycine max
  Peptide Sequence Number=SeqID_170879
atgagcaataggctccaagaggactgggctagagctattgaagaaggcctgatgattctcataaacctcagggggttgtcgcaacctacccttttgcgggcgagcgaggcgaggctcgtgggtgcgttttccaaaggaggaaaatgtacggagtcgccaccaacgtttatttgtggaaaacgtcagaaaaaccgaaggaaaccggtcataaagaatattccagattcgggagttgtatttacgtttgaggaaggtattagcacctctcacgtttgtcccaaaggacaacaaccttaa

SEQ ID NO: 54102 - DNA, 333 bp, Glycine max
  Peptide Sequence Number=SeqID_170880
atgttggctactggtaatcgattactatcttctggtaatggattaccagagaacattccttccacaatatgggcacctctctctggtcaattgttaaaggttgataaatcagtccttgagttacaagatgaaaaagctcagtcgttgattctcttgtcattgtttgatgaagttctttatgagctttctaaagagaaaattgcttttgtgttatggctcaagctagagaaactcttcttgaggaaatcaatctacaacaagttggttctgaaaccatatttgtttggtcttcgaatgagaaaaaggaagtccactaaaagaacatccttatga

SEQ ID NO: 54103 - DNA, 487 bp, Glycine max
  Peptide Sequence Number=SeqID_170881
cctgagatctttgtctcaacacattggagggtacatcctttgtggtacaagtagagggtacatctacttgggttcgactgagaacaggagagggtacatctcttgtggatcagttctagtggagggtacatccactaggttcaaagagaacaagggagggtacatcccttgtggatctttgcttacaatatcaaagcctgttgaagatccctctaagctccctaaatggaactatgatggatctagcacaggacaggcacctggtgatgataatgaagtaatcctatatcctcaagcaattttcaaagatcctttccgtggtggtaacaatattttggtaagggctgttatacttgaaagaggtcacatggtcatttgcgattcttacaccccacaaggtgagcctatccctacaaacaaaagacacagagctgctgaaattttcagtaacccaaaggtccaagttgaagttccatggtatatataa

SEQ ID NO: 54104 - DNA, 792 bp, Glycine max
  Peptide Sequence Number=SeqID_170882
atggcttccctcaaaattatgcaactagaggaggaagaagaaatcaaggttttggtagaggcaattctagtggaaaatgagctctataagcctcaaggctcaagcatcaacaacatgaatgcatcgaaggaagatggagatagtgttgttccagaacaaagtcaagatacacataatgctgaaatgagattgacttctcaacaatataaagctttgatgacattgttgcagcaacaaagctcaattcacaataattcacatgatatgcataacctgaagaagattggcacaattgacatggtggagggtctttataggctgaagatgcttcctttcaaacctctcaagaaaactctaactgatcatgccattgatgaacctaacaccattattcccgaccttgctatctcacaaagagccacccagacacctagaaggtccatgaggcagatacaaaggctaagtaaatataaagactttcacatcacttatccactatcaactgctgccaatctctctataggtactaccctttatcctctcaattctgttttgtcatatggcaaattgtctccttcctgtcacaatgttatcttgtatgttacacaacaagttgaacctcagtcatgcagtgcaacttctaaacatcctaactggatcgaggctatgaatgctgagattaaagcattagaggttaataatacttggagccttactgatcttccaaaacataagactgctattggatgtaagtgggcttacaaaattaacacaggtctgatggttctatag

SEQ ID NO: 54105 - DNA, 1170 bp, Glycine max
  Peptide Sequence Number=SeqID_170883
atggaatcaaaggtagcatcacttaagagtgaagttgcgagccttcgcaatgtcctggtcaccatgcaatcgaaggttaaagagaatcaggcgaaactccttaccttgcttgaggagcgattgtcattgaacgaaggggaaaaatcagtcatgaagacatctgcgaatgtgattgttgatgaatttcaccaagagtggtatgggggtattggcgaaggggatgtgtatgaacaactagccgcgctccaacagacaggggaagtagatgagtatatccaagaatttaaacgtttgattgctcagtatgcgaatgttgggaactctatctcattctcggttgctcaatttgtcacgagcaatagatcgtcgggttggtccaatcgggcaaaccagaatcctatctccccttgcaccaatttggaccatcaatatgggtgtgattggagaatgttccatggtaacaaggacgtttgcaatgataatgctaatggacatgggcctggcctggtcctccaaaaggaccattttctgacagagattgtaaccaacccaaagataaattgtccagatcatcaattaagggtgatgctcattgatgatgatgacgaggaagagaggtggacaacctcaaatgctgaagaattgaggcaccataaaaggggttccaatatgattctggagactcacccaatgagaattaaaataggcaatgggtacaaagccacaacacaaggaacttgcaaaggaattgagcttaagttgggagaaatcaccattccaattgatacattcttgtttgatttagagtggatcaacattgtattagggatatcgtggctaacgtctcttggtcgcatgtgggttgatttgggaaaacagagcatgcaatttcaattagagaacaagtgggtggaattacaagtgctacaaatcaatcattccaagtcgttaggatctgaacatgacgtgttgtctaaccaaccccttttagaaatcactagccttttggatgggtattttgaaatttttagggaaccaaagggatttctgcctcagcatgataaagagcatgtcattaccttgatggaaggtcctttaatggtgattttccaccatggagatgcagcggaagacaaaggagaagaggcgagaggaggcgccatccactag

SEQ ID NO: 54106 - DNA, 318 bp, Glycine max
  Peptide Sequence Number=SeqID_170884
atgagacagctggaggcgaatgttcgagaaggtacgaatgtagagaatattcagcaaggagtgggcagaaaggggatatctttaggactaggagtccccttcgaagcttttaatcagttaaatagagtgtcagtttcaagtggggatcaggtctttcatcactcagttagaccgccagatatttcaacaggagatggagttcatcttcatgttcaattccaccaaccctcttatgttttgaatgagggtagtacgggaaatttttctatggaagttgttatggagtcacctcttgatcaaggggtgcctggtgtttag

SEQ ID NO: 54107 - DNA, 432 bp, Glycine max
  Peptide Sequence Number=SeqID_170885
atgtatgaagaagaagaattgaatgacatggcacaccaccccatatggccagagggaaaggcagttattgaagaagtccaccacaatgacgtccttcgcaacatcattgaggccttgcaacagaacaaagacaccaaacctgattacttttttatagggagggggtgcttctttataaagggaggctgctataagagactcacaacaagtttattttgggtgggcatgaagaaagatgtcaaagactttgtaaaggaatgtgatgtttgtcaatgtcaaaagtatttggcggtggctcctggtggtttactgcaacctctgaacattcccaaccagatttgggaagaaatttctatggattttattactgggctccccaaatccaaacgatacactgcaattctgttggacaagaggcctcagaaattttaa

SEQ ID NO: 54108 - DNA, 4509 bp, Glycine max
  Peptide Sequence Number=SeqID_170886
atggcggattcaacccccacttcagccgacaagctcgaagatgccctcgttcgtcttacccagcaacagctcaccatgacctctaagattgacgaactcctccatcgtctaccaccaattttttcccccaacacaaacccaaacacaatcctgtcgcacccacctccgccacctgcatccattcacaagatgaagttagacgtgcctcgttttgatggcacatacccatttgggtggatctttaagatccatcaatattttgagtaccatggcacacccgctcatgagcgtttgaccatagcctcattttatatggaaggacaggcccttgcctggttccaatggatggccaacaatggccaatttacctcgtggtcgaattttttgcaagctctacaaaatcgatttgccccgtcacactacgaggaccccaccggaacattgttcaaattgacgcaaaaaggcactgtgagtgcttacctggctgagtttgaagctctcgcaaatcacgtggttggtctcccctccccgttcctcttaagctgtttcatatcaggactctcccccgatatccgccgagaagttcaagtgttgcagccgctaacgatggcccaggccgcggggcttgctcgcatgcaggaggaaaaattaatggatgcccgaccccttccgcgaccacgacaaccctacatatccaccacgacatcccctcgaccttccatccccgccctttcgtcttcaccacctaacccccttccccttcttcccactctaccacgaccaccctccaccattaagcgactgacacctgaggaaatggcctcgcgacgtgaatgcgggctatgcttcacgtgcaaggagaagtaccatcgagggcacaagtgtgcctctcgggtgtttcttctccttgttgaaggagacgacccaactactgcacatataaaccctattgacccgaccactgacccgcctgacccggacccggcccactacatacccgactcccatgacccgattccagcccagatcagccttaattccttagttggacacgtagcccctaagacactccgtctcgttggcaccatctccggtctacaggtgctcatcctcattgatggaggaagcactcataattttattcaagagcagcttgtccgcaagttgggccttcattgtcggcagaccacaccacttcgagtaatggttggcaatggtcaacacctcgagtgtcaacagctgtgtatggaaattccggtggaaattcagacgacctcgttcacggtggacttatacgttctaccaatttctggggccaacattgtgcttagtgttcagtggcttcagtctcttggtcccatcctcacatactacaacaccctgtgcatgcaattcttccatcagggtcgtcttgttgagctcaaaggtgagaatgacaccaatctcaggcaattgtcttctccccaatttcacaggttatgtcagacccagggagatgggttttgcttccacatcaccatgctgcccgacaatccctccacgactgagatcacctcgctacaccctgcccttcagaccctccttctccgatatgatgccttgttccaaccaccacataccctgccgccggcacgcacaacagaccatcacatacatttaattcctcaagcaacccctgtgaacgtgcgcccttatcgctatcctcatttccaaaagcaggaaattgagtcacaggtggatctcatgctccaacgaggcctgattcagcccagcacgagtccattttcctccccggtgttactcgtcaagaaaagtgatggtacatggcgattctgcgttgactaccgcgcactcaacgccgtcacggtcaaggaccgtttccctattccgaccatagacgagctcttagacgaattgggaggtgcctgctgcttttctaagttggatttactacagggttatcaccaaatccgaatgcatgatgccgatattcacaaaacagcctttcgaactcatcatggacactatgagttcaaagtcatgccttttgggctatgtaatgccccatcatcgttccaggctacgatgaacttgttgtttggcccctatctacgccacttcatcatcgtcttctttgacgatatcttagtgtatagctcctcgttcaatgaacacttgcaacatcttgaaaccacctttcaggtactcctcacgaaccaattcgtcctgaaattatctaagtgtttcttcgcgcaggcacaggttgagtacttaggacacgttgtttcgaccaaaggtgtggaacccattgcttctaagattgatacaatcaagcagtggcctattccacagtgtacacgagctctccggagcttcctcggcctcgccggtttctacaaaaggttcattcgtaattatgctacaatggcagcccctctggtcaagattaccaccctgccttctttccaatggtctacagacgctcagcttgcctttgatcaccttaaggaagctctctcctcagctccggtattggccttaccggacttcactacccctttcacactggaaactgatgcttccggggttggcatgggggcagtcctttcccagaagggtcacccggtggcgttcttcagcaaacccttcacccccaagttgttgcgttcatctacatatgtacgagaattatgtgctattaccacagcggtgcgtaaatggcgccaatacttgcttggccgtcatttcactattatcactgaccatcgaagtttgaaggagcttttgacccaagtgattcagacgccggagcagcaccagtacatggcaagactcatggggtacgactatgacattcaataccggtctgggtcccataatcaagcagctgacgccttgtctaggatttccgagcaacaaccaacccttacaatgatcctttcagttccctgcttatccttcatgaaagaattgcgagctcagtttgactctcatgatggttacggtcaactgcgacaagctattttggcagaacctttccgacaccccgactactctgtcattcacaacctcattatacataagggttgcatttggattcctcatgacttacccatcatttccactttgttgcatgaatatcacactactcccacaggtggtcatgccggaactcgaaagactttagctcgtttatcaaagaattttatctggcagggactcagggaagatgtggctcgctgtgtggcaaattgtttggactgccaattgacgaaatatgaagctaagaagttcgcaggactgttatgtcctctccctgttcctcagaggccatgggaggacctctccatggattttattgtcggtctacctccttaccatggccacaccacaatctttgtggttgttaacagattttcaaagggaattcacttggggactttacccacttcacatactgctcacatggttgcttcacttttcttgaacatcgttatcaagcttcatgggtttcctcggagcatagtttcagacagagacccacttttcattagccatttttggcaggatttatttcgattaagcggcactgtcctgcgaatgagctcagcttaccatccgcagactgatggtcaaactgaggtgctcaatcgagtgattgaacagtacctgcgtgcgtttgtccatggaagaccaaggaatttgggaagattcattccttgggtagagtggtctcataactcatcttggactgtgggttcggggtctacaccgtatgagattacatatggtaggaagccttttgcatttcccgaatatctcttgggcacttcaagaattgatgctgtggaggaattcttggtggacagggatacgacttttcaatccattcggaagaagcttatcaaagcacaggaggctatgaagctttacgcggacaagaacagaagggaagtcaactatgaaatcaatgattgggtattggtcaaacttcgaccttatcgacagtccacggtgagaggatctccggcgagctccggtaagctgaccaaacgctactttggtccctttagagtcattgaacgaattgggatggctgcgtatcgccttgaactacccgagggagctaagatacattctgtcttccactgctccttgcttaagccttttcgaggatccccgacacagcctgactctacttctctacctccacaattcattgatggacatcctagcactactcctcttgctatcctcagttctcggaaagtcaacaattcctgggaagtgcttgtccagtggcaggggatgtcccctgatgaagcatcttgggagaactggactaccttatgccaagcttaccaccttgaggacaaggtggatttccaggggccatggagtgataggaatatgcaggaaacacccatggcaagggtgcagggagaagaagagaccaatagtaagagaagggtgaaaaagccaagttacctgaaagattacacgacttga

SEQ ID NO: 54109 - DNA, 363 bp, Glycine max
  Peptide Sequence Number=SeqID_170887
atgcatcctccacaatcttactcagagccccatgaattgattgtcattcatgcatcctccaccatcaagtctggagccccacgaattgattgcctagcgctgttcgtgcgtcctccaccatcaagtctggagccccatgaattgattgtcattcatgcatcctccaccatcgagtccggagccccacgaattgattgcctagcactgttcgtgcatcctccaccatcaagttcggagccccgtgaattgattgccattcatgcatcctccaccatcgagtccggagccccacgaattgattgcctagcactgttcgtgcatcctccaccatcttattcagggccctacgaattgattgcctag

SEQ ID NO: 54110 - DNA, 381 bp, Glycine max
  Peptide Sequence Number=SeqID_170888
atggggaagcaagtagcagcgaaggcaagaggagaaggaagcagagctgggaacgaaatagctaagcttaactctgccaaagctagcattgatggtgctcaatcagtggggaacgagaatcaaggggatctcaacatgtatggggggacacacaaaaacaagagaacacatatgtatgaacgtatgggagaacatggtgaacaaataaataatgatgcacatgggcagaaagggatgttttttccagatggcttgaagaaaaccatttatgtcggtacctcagctttaatgataacgattgtcgaatcattcaaaaacaaatctactaaggaattttgtagcacagaattaacctatgtcaaactcagaaatatgatttaa

SEQ ID NO: 54111 - DNA, 771 bp, Glycine max
  Peptide Sequence Number=SeqID_170889
atggccccaacagggaagtcacacggggacggtgatgaagtcaaggaggggttcaaagtcaagacgatgatgcctatgaagattgtggcgtcaaacaagatggagtgggtgttggaggcggacatgcttgacatatccatggtggaggaaacctcactaggggagttgccttttggggtttatgcaagccctaattttgcaactcgtagaactttttggcgttatctggaagtgcttcaagagcaagatggaggggtattcccaaatatgagagctttggaattcaaagcttcgtggaggttggcaatcccagaaacgtccatggaacaccttatgcaacaacactcaggtcacaaccctcttttagggagggaggcatggtcgaaagggagtcagagtgtgccagtggcacttatgcatgttggtgaagacttggtgaagtttaatagggatatatttgagagtgtgctgagatggaagcatgaaatggaagcaaggttaaagggcattcaacgttctcttaagaggcataataagatccatggccttcatatcatagatgggagctggtgtactgatgagataaagcttaagaatgaagttgtgagtttcttcatgtctcttttctgcttagttgaggctcaaggtggcaaggaggtgggggatttagtggggaggttaccatatgaagctaaggtgaacctcttagccacggtgacgaagggcgaagatgacatgtggaggttcgtagaagaagcatttcaaacatga

SEQ ID NO: 54112 - DNA, 219 bp, Glycine max
  Peptide Sequence Number=SeqID_170890
atggagccgtggtgctggcttgggtgcgggactaggtggcatgggtgcgggcatggaatcgaagtcagcagaggaaggggagtcggaataggggcgtttgttggtggtgactgcacagaagaagaaaacagggggcgatggttgggtatcatggtattcaatttcaggaggatagcatcgagcttggagtccatggaagcttgggtcgcagcaaagtag

SEQ ID NO: 54113 - DNA, 774 bp, Glycine max
  Peptide Sequence Number=SeqID_170891
atgtcagtggaagtgggtgtggaaactgaaggtgccagctacaattcagttctttatctagcaagtttgacaccaagcgcttccagtgaagaatgttcaaatgtggtgcatacatggagaagcatccatatcgttcttggtcacttacctgagtccaatgaccatgtttccacgaaggtgtacgaaatggtaaggaggaaaaacttctactgtggtggagattcaagcacaaattcaatccttgtgtgggatatccatagtgcttatggtctaatgccccctcataatgagattggtaaggaagtgggttgggtgaaacctaactatggttgggtagctctcaatgtaaatggcagtgtcatggaagccaatcaggccgcaggcaatataaagtatatggatatcctatgtgtggaaattcaagccttgctacaagggattaagttgtgttgggagaagggtttcaggaaagtaatctatttgtttagattcatcagcattggtctccatgttcgtcatactatgagggaagggaatcgttgcatggatatgcttgctaagatgggtttgacaaagatgaggtcgtgtgaggcgttcatacacccactgggtgatagtaaccccattctactttggccactgtggattctttctttgaacaatcgacactttctcaataaaggagatgcaccacctgatagcaatatcgtggtggctgataccagaccaacaaggttcaacaggagaccaacatatgtcactgactatgcataa

SEQ ID NO: 54114 - DNA, 522 bp, Glycine max
  Peptide Sequence Number=SeqID_170892
atgtcgctaagcgacttggctttggtgaaagagttctgtgcaaatttatacagttctgaggaccgtccaccaaatcagtccagagtcaaagactatagagagatagaggttgccttatgcacacctggtcgagggttcatcttgaactctgagggccatcctgggaagattctcaggaaggatctgactacactagctcaggtgtggagtgtcctcttatactccaacttagcccccacatcacacacttctgacttgacagtggatagagctaggctgatctttggcctagtctctcgcatggatatgaacataggagcgctgatctctggccagatgacctctatagcccagtctaacacttctagacttgggttccctgctttgatcaccgcattatgtagagccagaagggttacctctgatagcctcacttttgagcgcctaagcccaatcattaacttggcctacatcaagaagaattgttggaaccccgaggatctaacagtttctatccgaggg

SEQ ID NO: 54115 - DNA, 765 bp, Glycine max
  Peptide Sequence Number=SeqID_170893
atgcacgccctcgccatcagagggttgcacgccctcgcctttagagggctacacgtcctcgtcatcagaggactacacgtcctctccttcagagggctacacgtcctcaccttcataggacaacatgtcctcacctttagagggctacacgccttcgccttcagaggaatacacgtcctcgccatcagagtactaaacgtcctcgcctttagagcactccacgtcctcaccttcagaggactgcacgtcctcaccttcggagggctgcacgtcctccaatttagaggactacacgtcctcgccttcagaggactacacgtcctcaccttcagtggattgcatgttctcaccctcagaggactacacgtcctcaccttaagaggactacacgtcctcccattcaaaggactgcacgtcctcaccttcagtgggctgcacctcctcaccttaagaggactgcacgtccccaccttcagagtgcaacacgccctcgccataagagggctacacgtcctagccttcggtgggctgcacgccctcgtcttcagagggctgcacgccctcaccttcagaggactacacgtcctcaccttcagaggactgcacgccctcgccatcagagggctacacgccctcgccatcagagggcagcacgccttcaccttcagtggactgcacgtcctcagctacagagcgctgcacgccctcatcgtcagagggctacacgtcctcaccttcatagtagacacgtcctcgcattcatag

SEQ ID NO: 54116 - DNA, 699 bp, Glycine max
  Peptide Sequence Number=SeqID_170894
atgatgcctaatagaacctgcccaaggctgcccatctgtgatgagggggagaacaagggctttaggctctacttcatcaaagaaatacgaagcagagaccttgttccaaggttaaaggctcatcacgtcttttacatcaggaagacaactatggagaaactagaagcccgcgtccaatgccttcttagattgcaacaagctgacaaggccaagtatgatgcaacatggaaaattaggctagaaaaggaagcaaagcagaaagctgatgcagaagcaagacacaaaactaatgtcaaaagaaagaaggctgaggcaaaggcagaaaagactagaccaagcaagttggtgtccaaaccaattgttgtgactgctgaaacaacaaaaatggccaagtccactccaattcctactgctgagatgcccaaagataaggaaaatgtggctccaactgaatcaaccttacatgaagccacatctataaaagcaactgttgtcactgtccacaccaccatctatggacccactccaatcaatttttctcctccagaagtaatgactaaagctaaagtaaaggagatgattggactagccatggacagctttgctgagaagcaaagggcatcaaatgaagagtttagacaaaccatgcaacaagctatatctatttattccaagaaaaaagatcaatctacacaatga

SEQ ID NO: 54117 - DNA, 249 bp, Glycine max
  Peptide Sequence Number=SeqID_170895
atggcacacaaaaccatcttgttatcctttcttgtcttcctcattctgcaacacaactttggctcaatggaagcatcaaggaagaggattaacattcacccaccaccagctatacctaggagtccacaacctccttccgtttattggtacatcccaaacgatgataatgttggtggtggtgatgcttaccgcccaacgagtcccggtcatagccctggtgtggggcatgaaacaccaccaaccaaataa

SEQ ID NO: 54118 - DNA, 246 bp, Glycine max
  Peptide Sequence Number=SeqID_170896
atgggagatttggagaagaagcaagagagggtgatggaggaagaagataaagagaggttggtggagggtgtggcggttttggactttgatatgctttgctccactgtggctttgcgagctgcacatggcaaatgggggaagctgggagttgaagatagaggaagaagaagaagaggagggtgttgtccttgctaccgatttgggaaaaacatgaagagagctgatttcggttcttgctacattcag

SEQ ID NO: 54119 - DNA, 393 bp, Glycine max
  Peptide Sequence Number=SeqID_170897
atggattcctctaagagaaaaactatagcttcaacgtctctggccggttatgatagatcaagatttgtatcacaggaggcctgggatcgttactcagataatgaattctatgcaaatctttatgtcccagatgacaagtttcccaagcaagttagggttcgagggaacctaataaaatttgatgttgattccctcaacaccttcttggagactccagtggtcgtggagcaaggggagagcttacctttttactccaggtttgctaaactgaggcctgatcctcaggagcttgcagcccggctgtgtatccctgggaggggatttgttcttaatgttgagggtctaccgtggaagctcttgaggaaatatcttaccactctggcccaaacctag

SEQ ID NO: 54120 - DNA, 855 bp, Glycine max
  Peptide Sequence Number=SeqID_170898
atggctctgctgctgatggcccctgccctgcccctgcaggccgccgacggcaggaccgggcgtggactcacggaaatccccgacccggagctgagcctgatgcgggggcgctacaccgtgggtggcaacaacgttgcctggttcggggtcaccatggtgtcgcagtggcaggccagcaacggcacgaccctgcagggcagcctgaccctgggcatggacttccgtggtggtggcgcgccgaagctcagcttccagcccagcgtgcatgtcacggcagccgatgcgccgctgcccgatacccacggacgcagcatcgacagcagcggcctggccaatgccagcggcctggtgcagagcgtgcaggtggccggcgatggcaatgtcgcgcgcaacgtcaccacgctgaccgtccgcgaaggtggcgtgccggctgttctctctgatggcgcaggcaacgtcaccgcgcagcaggccggcgccagcgcgacggccgtgctggaaggcaaccaggcacacctgctgctgcaggtggatggccaggggctggtgcagcagtggatccgcaatggcagcgtcggccagggcatcgcccttaccggtgatggccagatcgccagcaaccagctgcggctggagctgatgcgcaactccgtgggcggcaacctgccgttgagccagaacgtggcccaggcgattgcgttgaaccgcggcatggggccgggccagtatcagggcctggcattgggggaaacgctccacaacgcaggacacgaacatgcacaccctgatgaggatcaccccgttggcgctggcggcgctggcgggcaccgcccttaccgtgccgccgacgcctga

SEQ ID NO: 54121 - DNA, 165 bp, Glycine max
  Peptide Sequence Number=SeqID_170899
atggccgagacaggccaatgtgatggaccatacgccctgcgtgacctcactcttactaggcggtatgcatggggagctgctggcctcgtccatatgtacgatcagcttaatgatgccaatctcagcaccagtcgacagcttgctggttacatcaccttgttacaa

SEQ ID NO: 54122 - DNA, 207 bp, Glycine max
  Peptide Sequence Number=SeqID_170900
atggccacctctactcagaccatcagtaactcaaccaacagcaacaccgcctcgtcgatggagaagagacacaacatcgtccagcgtgatcaaaacctcccctacaagaagatggaaactagaagtctcctagtgccacctctcgacaaaggaggatataagtccccgatcgccgatgtctatcgaacacgcgatcaaaggacttaa

SEQ ID NO: 54123 - DNA, 393 bp, Glycine max
  Peptide Sequence Number=SeqID_170901
atggataggagtatgattgatgctgccagtggtggagctgttggtgatatgacccctgctgaagctaggaatttgattgagaagatggcttccaactcccaacaattcaattcaagaaatgatgttattgtccttagaggagtccatgagcaatatggagtcaatgagcaacctgaagcttatgctgcaaacatttataatagacctcctcaacagcaaaaccaacaatggcaaaataattatgagctttcgagcaatagatacaatccaggttggaggaatcatccaaatctgagatggacaagtcctccacaacaacaacagcctgtccctcctttccagaatcctgctggtccaagcaagccatatgttcctcctccaatacagcagtag

SEQ ID NO: 54124 - DNA, 210 bp, Glycine max
  Peptide Sequence Number=SeqID_170902
atgaagagggtttacacgagggtgtacgactttacaagagaaacaagggcatgggtttacaagagagaggatttatgggggaaagggtttacacaagagagggtgtcaagctcttatgacgggggccttgacggagaaatgacttggatgtcatcactgaagttgctcattaaggagcactacgcacaaccatgttcttcaaggtgttag

SEQ ID NO: 54125 - DNA, 1080 bp, Glycine max
  Peptide Sequence Number=SeqID_170903
atgaagatcttcattctctttagcatagcctttgcttatggtttccttggaaatgttgtttcaaatgccaatccacatccatatgaagccattttcaactttggtgactctataagtgacacgggaaatgctgctacttatcacccgaaaatgcctagcaatagtccttatggttcaacatactttaaacatccttctggacgaaagtcaaatggacgactaatcatagatttcatagccgaggcatatgggatgtcaatgttgccagcctacctaaatcttaccgaagcacaagacattaagaaaggagtaaattttgcattcgctggctcaactgcacttgataaggattttttggaacaaaaaagaatcaatgtacaagaagctgcttattcattgagtactcaacttgattggtttaagaagctcaaaccctccctttgtgaaagcagagaagagtgcaataaatacttcaaaaactcattatttttagtgggagagattggtgggaatgacattaatgcaattatcccatataaaaatattacagaacttcgtgaaatgaaattaattgaagaaggagcaatagagctagtggtaccagggaacttcccaattgggtgcaattctactgttttggcaatagtgaatagtgataaaaaagatgactatgatcaatttgggtgtttggtaacttacaatactttcattgagtactataatgaacaactcaaaaaggccatagagacattaaggcaagagaacccagatgttaagataacatattttgattattatggtgctaccaaacgtttatttcaagcaccgcaacaatatggtttttcttccggtaaaatcgagactttcagagcatgttgtggaaagggtgaaccttacaatcttagtgcacaaatagcttgtggaagtcttgctgcaacagtttgctcaaatccgttaaaatatataaattgggacggacctcattttactgaagcagcatataaactaatagcaaagggactaattgagggcccttttgctagtccttctctcaaatcccctcctttcaagatagcttag

SEQ ID NO: 54126 - DNA, 1329 bp, Glycine max
  Peptide Sequence Number=SeqID_170904
atgctcgccgcacgtgtcgcccctcagacctacaccttcaacctcctcatccattctctctgcgagtcgcgcgctttcgatcatgcactccaactgttcgaaaaaatgccccaaaaaggatgctgccccaatgagttcactctcgggatcctcgttcgcggcttgtgccgcgctggcctcgttaaacaagccttggagctcgttaacaataacaattcgtgtcgtattgctaacagggttgtgtacaacactcttgtttccaggttttgtagagaggagatgaataatgaggctgagagacttgttgagaggatgaacgagctgggtgtgttgcctgatgttgttacgtttaattcgaggatttcggcgctgtgtagagctgggaaggttatggaagcgtctaggatttttagagatatgcagatggatgcagaattgggacttcctaggcccaatgttgtaacttttaatttgatgcttaaggggttctgcaagcatgggatgatgggggatgcaaggggtttggttgagaccatgaagaaagttgggaattttgactctttggaatgttataatatatggctgatgggtttgcttaggaatggagagttgttggaggctcggttggttcttgatgaaatggtggcgaaaggcattgagccgaatgcttacacgtataacattatgatggatgggctgtgcaggaaccatatgttgtcggatgcaagaggattgatggatctgatgatgaggaatggggtttacccggatacagttgcttatagtactctcctgcatggatactgcagcagagggaaggtttttgaagctaaaagtgttcttcatgaaatgataaggaatggttgtcagcctaatacttacacctgcaacacattgctgcatagcttgtggaaagaggggaggaccctagaggcagaggaaatgttgcaaaagatgaatgaaaaatgctatcagccggatactgtgacctgcaatattgtggtcaatggtctctgtagaaatggagaattggacaaagcaagtgaaattgtaagtgagatgtggactaatggaccaacttcccttgataaaggaaactcatttgccagtctaattaattcaatccacaatgtatcaaactgcttgcctgatggaatcacatacacaactttaattaatggactttgcaaggttgggagactagaagaagccaagaaaaagtttatcgagatgttggcaaaaaacttgcgccctgattctgtgacctatgatacgttcatatggagtttttgtaaacaagggaagatatcatcagccttccgcgtctga

SEQ ID NO: 54127 - DNA, 714 bp, Glycine max
  Peptide Sequence Number=SeqID_170905
atgaaagaaaaagggataagtccagatatttgcacttataacaatattatcacttgcctctgtgaaggaggaaaggcaaaggatgccatttctcttttacatgaaatgttggataaaggtatatctcccaatgtatcctccttcaaaatattgattaaagctttcagcaagtctagtgattttaaagtagcttgtgaactatttgaggttgctttgaatatatgtggccgcaaagaagcgttgtacagtttgatgttcaatgaattacttgctgggggacaactctctgaagcgaaggagctatttgaagtttcattagatagatatcttacattgaagaatttcatgtataaagatttgattgcaagactttgccaggatgaaaggttggcagatgctaatagccttctttataaattgattgataagggatatggcttcgatcatgcatcattcatgccagtgattgatggcttaagtaaaagaggaaacaagcggcaagcagatgaactagcaaaaagaatgatggaattggaattggaagacagacctgttgataggacttattcaaacagaaagagagtcattcctggaaaactacttaaagatggaggaagtgactggcaggacataattaacaggtatggccatatgggtgatgaagataatcaatttttgcttttctcgattctgttcatcttcggtaaaaacaag

SEQ ID NO: 54128 - DNA, 1274 bp, Glycine max
  Peptide Sequence Number=SeqID_170906
atgtctgaagtaatgatactttcattatcaataatagtggttctctctggcacaacatactcaattttcctagagtctgaaaatcatatcaaatcggctacttttgtgtctaaaagttttgaagtgggaccaggaaaaattgcatcaaaagcactttatgatattgagtttccaaaaggtcatattggggtcaagagttttgatgccgaactagttgatgaagatgggaaatctgtacctttatatgaaacctatcttcatcattggtttgcaataaagtacaacgaaaatattactatgtcacggtacattgagcaatctcatgacattagtaaaggtatcaattacacaagaaatgatggtgcatgcagaggctttttgcttccacattattggggcttaggaggagaatcacgaggaacatcctcaaatcttccagacccttttgcggtagaatttggtaaccctaaaaatattccacatggatttaaggaaaaatggttgttcgacatcatggcagaatataccattccaagaattggtcatggtgacttccctcatgttaagaaagcaaacatcccaatgaaaaaaggtggttatcttatatatggcacttctcatatgcatactggtgttgtcaatgcaactctctatggacaggatggaagggttttatgtacttcaacaccaaaatatggaacgggaaaggaagcaggaaatgaaagaggttacctagttggaatgtcaggttgttatcccaaaccaggctctgttgagattaaagatgagcttggcctccggttgagctcttgtcaaagtagaggaaagaaaattcctaaaacaacagaagaaggatttaatgtgaacaagcctcccatgtttaagggagccaactatgatgactggaaggaagggatcattgccttctttgaatccactcacattgatatgtgggatgttgtagaaaagggcagtcagattcccctagaggaatattccgaggttgatagctacagaagtgccaaacagatgtgggacacctttgccattacctatgaagggtcctgtgaggcaaaacataaaaggttgagccttcttatgcgtaagtataaactcttcagtatggaagaaggaatagatgtccaaaccatgccaaaacacaacactacgtctaaagagtcattgtccaaagcccttgctattgatgatgcttcagaagaagaatttgatgatgatgactctgatgaagaagattgtgaatgtatatcatgcgg

SEQ ID NO: 54129 - DNA, 261 bp, Glycine max
  Peptide Sequence Number=SeqID_170907
atggaggttgaggaatggaaggtggtgacttttgtggtgaaagcggaggcgtataatgtagctccatgtagagcttgtaggccttggatattcttcatcactagagtccttcgcttcttgaagatcaatggtagggtacctgttcaatttcccatatggttccttcttctccaatttttaacaaatatattcaagggaaatgaaatactggcaagcgcaccgggtcatcaacctaaagtattaaacctcgatccctcataa

SEQ ID NO: 54130 - DNA, 197 bp, Glycine max
  Peptide Sequence Number=SeqID_170908
agtatccacaatttacttatgctgcatactcttccatcttcaccaatgatctgttacctactgcttacagggatgctggcagtggaattgcactgaaaactcttaagcgtgtgcagaaaggctggggccaaggaagtatatctagtttacagcctcagcagaatgattttcttgattactatgatggtagtggttaa

SEQ ID NO: 54131 - DNA, 1311 bp, Glycine max
  Peptide Sequence Number=SeqID_170909
atgggaggttccactaaccccctatctctcttccttctctgcttcaccacttttctcactctctttgaagtttcaatctccacagacaccttaacaagttcacaatccctccgaacaaaccaaaccctcctctccccaaacgcgatttttgaactgggttttttttcctacaccaattccacctggtacttgggcatttggtacaaaaccatccacgacagagatagaacagtggtgtgggtcgcaaaccgagacatcccacttcaaacctccctcggattcctcaaaataaacgaccaaggaaacctcgtcatcataaaccaatcccagaagcccatatggtcctcaaatcaaaccacaacaacaccctccaatctaattcttcagcttttcgattcgggaaacctggttctcaaagaaccaaacgagaatgacccaaagaaaattctctggcagagcttcgattacccaacagacaccttgttaccgggcatgaaactaggttggaacttcgacacaggcatagaaaagcacataacctcgtggagtgccacgaacgaagacccttcaagcggggatttttccttcaagctcgatccacgtggccttccggaaatattcctctggaacaagaaccagagaatctaccgtagcggcccttggaacggcgagagattcagcggggtgcccgagatgcaacccaacacagattccatcaaattcacgttctttgtggaccaacacgaagcttactacactttctcaattgtgaacgtttctttgttttctagactctctgtgaactcaattggggaactccaacgcctcacgtggatccaaagcacacaggtgtggaacaaattctggtatgctccaaaggaccaatgcgacaactacaaagagtgcggggcgtacggggtgtgtgacacgaacgcgtcaccggtgtgtcagtgtatcaaagggttccggccgaggaacccgcaggcgtggaatctgcgagacgggtctgatgggtgtgtgaggaacacggaattgaaatgtgggagtgacgggtttctgcgaatgcagaatgtgaagttgcctgaaacaacgttggtgtttgtgaacaggagcatggggattgtggagtgtggagaattgtgtaagaagaattgttcttgcagtggttatgcgaatgttgagatagtgaatggagggagtgggtgtgtgatgtgggttggggagcttttggatgtgaggaaatacccctcgggagggcaagatctttatgtcagattggctgcttctgatgtagaaatacaaaaacactaa

SEQ ID NO: 54132 - DNA, 1713 bp, Glycine max
  Peptide Sequence Number=SeqID_170910
atggtgagaaaatcctccattctcttggcgtgcctcttggccatattcacatcatgttgcaactctttgcctctctcagttcacaagagatggatcattgatgatgcaacaggaaaacgtgtgaagcttcattgtgcacattgggtggctcatgcaacgccaatgcttgctgagggtcttgacaaatcgcccatgaatgacattgctgctaatatagccaaagcaggattcaattgtgttcgtttgtcctatgctacgtacatgttcactcgctatgctaataacactgttcgtgacatattccacactcatgatattccgggcattgtgtcagcaatcgagaattataaccctagggtgttgaacatgacccatcttcaggcctatgaggctgtggttgatgctctaggggatcatggcgtgatggtgctcattgataaccatgttagtttggcaaagtggtgctgtgccaatgatgatcaaaatggattctttggagataggcattttaacacttctgaatggcttcaagggttggcttttatagcccaccatttcaaaggaaaacccaatgtgtttgctatggacttgcgaaacgagctaaggggttcgcgtcaaaaccaccatgattggtacaagtacatgacccaaggagcaaacacaatccacgacatcaaccccgattttatagttatcatttcagggttagcctttgacaacgaccttagcttcttgaagaaaaaacctcttgacttaaacttccctcacaaaatagtgtacgagtcacacatctattccgtctcaggagatacacacaggtggcgcgtgcaaccagtgaattggatatgcaacgccacaattcaattgttgcaccaacaatcaagctttcttctgagtggtaagaatccagcacctttgcttgtgagtgaatttggatacgacatgactggtggttcttttgccgacaacatgtacttaccatgcattgtgtcctattttgcctctgtggacttggattggagcttgtgggctttccaaggaagctattactatagacaaggcaaagttggactaggagaatcatatgcggtgatggatgatgattggaaaagttatagagaccctaacttcactcaaaagtttgagcttctgcaaaggatggttcaagtgacgaccattattgccgatgtgaacggttactcgctgttgaacaggaaggcactgttggccttctgggaggcgccgaacaagccctacctaggcctcttcaactcatggacggcttatccaacttcaaatgtctcaaagtccaatataattttccatccattgactggttactgtgcacatgtgaataatagtaaggagcttgtaatgggtgattgcaagagtaatagcctatggagttatgaaggtgatggatctccaattaggttgatgaactctgccaagtgtttaaaggcagttggtgaaaggcttcctccatctctctctgaagattgcttgtctccacaaagttcttggaaaactgtttcaatgactggtcttcacttggccacttttgataaggacggagaccttttgtgcttagaaaaggattccaattcttccaagatagtgaccagcaaatgcatctgcataagcgatgatgattcttcatgtttggacaatccccaaagccaatggttcaaacttgtttcgaccaatgtttag

SEQ ID NO: 54133 - DNA, 1632 bp, Glycine max
  Peptide Sequence Number=SeqID_170911
atgtctcggcactgcgattgttgttgtggcggaatcccaccggggcttctactaatccgaggaaaacaatggaacctccaaacatatcgctacatggttctcctcaccaccttcatcgcttacgcctgctaccacgcgtcgagaaaacccaccggaatagtgaaaagcgtgttatgccccgaacacaaaggaacaaaccagggttggagcccattcaacggccacgatggaacgtcgaagctaggtgaaatcgacgtggcgttcttagcgtgctactcgatgggtatgtacgtggcaggtcacttaggagactccctcgaccttcgcttgttcctgacaaccggaatggtcggtagcgggatattcgtatcactcttcggaatggggctaccgggtggccttcggttgtggcggttatcggtaactgggttcgggaagagaaagagagggctcataatgggggtttggaacgcgcatacctcggtgggtaacattagtggatcccttcttgcggcgagtgttttggagtatggttggggttggtcttttgttgtgcctggtgtggtgattgttcttggtggggttcttgtgtatttgtttctggctccttatcccgaggatgttgggttctcttgtgttcatgggggtggtggtggtggtgatgaagaggctcaggtgaatggtgtgaaaaaaggtggcggtggcggtggtgttgctcctcctactagagaaggctctgtgaatagaaaaagcgttgggcttgttgaggcgtgcatgattcctggtgttataccttttgcgctgtgtcttttcttcgccaagcttgttgcctacacgttcttgtattggttgcccttttacttgactcagacagcagaaattggtgggaagtatatctctgttaagtctgctgggaacctttcagccttgttcgatgtagggggcatttttgggggtattcttgctggctacgtatctgataaactcaatgcccgtgctataactgcggccagcttcatgtatgcagcgattccttctatgcttttataccggcattacggaagtgtttctatgaatgccaacattggacttatgatggtgtctggattatttgtaaatggaccttatgcacttatcaccactgctgtctctgctgacttgggtacacatagttctctcaaaggagattctcgtgctctagctacagtcactgctattatagatggtactggatctgttggtgcagctcttggccctcttctcactgggttcatttcatcgaggggatgggatgaagttttcatgatgttagttcttggtgcttttattgcggggcttcttttgtcgcgtttgatcatagcagaaattgcagagagaagtggcaaacctttatcaagtggacagcaaaacccagaagccactgcatctcaaccgcttctggaggaaagactctggaaggttccaaaggggatcacaactcacaactggggatggaacttgatctcttttcatcgtgaattgattttctcaagggacaattgtggagatttactgctcgcactgaatcatcttgacaccagatattccaaagtgacatttgttcccttaatccttgtgtcacactcattttga

SEQ ID NO: 54134 - DNA, 342 bp, Glycine max
  Peptide Sequence Number=SeqID_170912
atgaggcttcattgtcatcaagcgaatcagagactcggcatgaccacagatcggcctccactcattatggctcacatagacccggtccccagtggagtcgccaattgtggcaacctgccttccagcgggggtgcgacatgggcctcgatggtgcatcttccaaggaagaaaaatgcgtggagtcgccaccaacgtttattcgaggaaaacgtcagaaaaaccagaaaaggaaaatgtcgagggtttgcgtattttgaaaatgagggttctagtgttatttacgcacgaggaaggtatttgcaccccacgtgcccgtcacaagggacgacaacctctaattga

SEQ ID NO: 54135 - DNA, 339 bp, Glycine max
  Peptide Sequence Number=SeqID_170913
atggaattgcggttacaagttacaacatgcggtggagcgaagaacatgggaaccgaaggctcaggggaaaaaaaacataaaaatggttccaagtttgtagccacagagatcgcttggtctgaaccaaagcgaaggaaaacctcgaagtcagaggaaacagaggaacgagagttttggtgcggtgttgtgttgcgcaccccaacctctcctcaatgggaatgtatgagagagagagagagagagagagagttggcacacgtgtccaatggaggaaacgtttacgtccggttccaaaatgcaaggggggtcctcgtaacgtgtcagtggaaggaaagctag

SEQ ID NO: 54136 - DNA, 234 bp, Glycine max
  Peptide Sequence Number=SeqID_170914
atgagggcttctggtaatcgattaccaagggggtgtaatcgattaccaggcttagaattgaaggcagcaggttgtagaggcctctgttttcatgccctgaagctgtgcgattcgagtttggcttctggtaatcgattaccaaggctgtgtaatcgattaccagagatgaaaagcctaaagatacccctcttacttgcatgtaatggttatgagaagcattgtgttgcggcatag

SEQ ID NO: 54137 - DNA, 464 bp, Glycine max
  Peptide Sequence Number=SeqID_170915
tcaccctccaggctcaacaagaataccctccagacatgcaatgcaaagacaagtttctcttgcagagtacaatagtgaatccaaacactgatgttgacgatcttccgccagatacttttaataaggatggcgaaaagtcgatagaggatatgaaactaagagtggtatatatctctcctatgtcaccccaaggaagcacagaagatgacacagtgaagaattcaactcaaaaacttgatgctaattcttcatatgttgcatattatgtatcaaggtggaatcctgatctccacatccaggcgttggccctttacaaaaaatgcaaattttgtaacagattaagcctaacaaatgagattaaggggtttcttaggatgatttggccaagtgaaaaaagaaatgacatctactctataggtcacactcaactttactctaggttgtatcctgattttctgggttga

SEQ ID NO: 54138 - DNA, 228 bp, Glycine max
  Peptide Sequence Number=SeqID_170916
atgaagaacaagttgaagcattccaaatctgcaacacattgtgctagatctttgatcaatcacagactcattttttctataaagtccaatcgtggttggcaaaggaagaaatccagtggtgtaactggtctagcaaagctaatgattcttgaggcatgggattcagttccaaatttagttacaatggttagcgtgcttcaagcagcctctggaggacatgctgattag

SEQ ID NO: 54139 - DNA, 225 bp, Glycine max
  Peptide Sequence Number=SeqID_170917
atgacgaatgaagaacaccgaacgaagaatgatgtagaagtcgattacggtcgcaattcgaaaaatgagggcacttggtggtcttacagctcgcccaggcgagctggttacttcacccctaagctatttggggggcccaggcgagccaaagcccagaaaattcctaaaatgacctttttgccccttcccttgggtatttaccgcattcttgaaccaaaacattga

SEQ ID NO: 54140 - DNA, 234 bp, Glycine max
  Peptide Sequence Number=SeqID_170918
atggtgttgtggaaaggaaaaatagatcccttgaaggagctagaactcttcaaaatgaaacaaagctaccgaaatgaagatataggttttcaggataaggatattgatcttgaagatgaaaccaaagttgaagagcttgaacaaaacaaagaaatcacttccacacctcctaaagacctcataagagaatggagaactcaaaaaagacatttccttggacaacattattggtga

SEQ ID NO: 54141 - DNA, 454 bp, Glycine max
  Peptide Sequence Number=SeqID_170919
atgagaggcaccatgcatgagccccaagcaaacctaggggcagataagaagttctcacccggccctctcaaagagtcaacctcttgctttctcataaggttaagccctttggtactagtaccttctggcttgtttcataggactcaacgtcctttgctttacgatttcatgggattcaaagtcctcacctttatccttcataggactcaaagtcccagctcacccaggctagcatttggctcgcctgggccaccaaataacttcaaggctaaggaactagcttgcttgggtgagctgcaaccgccccaagggttagaaggatcaaaagtggagggaattaagagaattaagaaagatgaagaagaaagaagaggaaacgaagtcgaggccttaccaaatcgtgattgtgatcgtccctacgtcgtttctcgttcggtgttcatcgtaccagtcg

SEQ ID NO: 54142 - DNA, 369 bp, Glycine max
  Peptide Sequence Number=SeqID_170920
atgggaggtcaatccagtaagatacctagcaatagtgatgttccaacacccatcaaaatgggtacctattgtctgtatccggctgatttgagctcttatgaggcgacatgtgttaaacatccaaacttgcaatccttagatgctacaattgaggagcgcaccaacagggtgatcacctcgcttgtgcaagggattgaggttcattccatatcgattgagtcattaggggaagtagttgtcaagtaccccaagtgctaccttgtagtaacatgtgaaattcttgtatatacactagggtctgagcagaaagctggtccatatattgtctggtttcttggccaattttcagatagagctcatactgaataa

SEQ ID NO: 54143 - DNA, 153 bp, Glycine max
  Peptide Sequence Number=SeqID_170921
atggtgagggaacaaggactagttgtgtttgggagtaaggagggagtgaagaaatggtgtctgaacaaggtgcagtgcatcatagacaccgacatggacaccggacacgacacgaatatggacatgtggacacctgtaatgttgaaaatgtaa

SEQ ID NO: 54144 - DNA, 228 bp, Glycine max
  Peptide Sequence Number=SeqID_170922
atggtttccgtcacattgacaggggagcgaccttactatcatcgtaagcaccacctcttcactgtggcgattacctttacgggaaagtgcacactatgcaataagcgttgtgtcccgacgtctttcaacataatattccttaaagcagttcacctagtcatctgctcccccgaacacaaagttcaagatcatcacaggatccaaacacaaacagcaaactgggagtga

SEQ ID NO: 54145 - DNA, 546 bp, Glycine max
  Peptide Sequence Number=SeqID_170923
atgacacatcagtggtctatggcagaggggcttgccaaggacaatgagcatcctcagttggaactgttggagcttggaaccataagaatgaaatttggttttgattcttgcttttcagttaatgtgaatggagatttcaatgatcttctttcaaatgatgaaacaattggtaattctgagcatgcaaaccggttgattgaagaattccatgactccatctttcatagtaatctccatgatctaccaatgaagggttacaaatacacttgggcaagaagaaaaggaaaaccaaacgacattgaagaaaagttggatagggctttagccctggattggcattttccctcaattcaaactcacaaatggaatttatacaacatcttcaagtttgaaaattcctggttactcaagcctgaattagaaaagatagtgcacgaaggctggctcaattcatgctccaacgaggtaatggaaaaattcaaatcatgcacaagtaacatgtatacctggggaaggaaacataactcaattttggccacgcattga

SEQ ID NO: 54146 - DNA, 183 bp, Glycine max
  Peptide Sequence Number=SeqID_170924
atgggtaagggctggggtcctagcgctgctggtgtaggagccccatcctctgcatgtgagccgagatggactttagagatggtggctgctgtagaggtggcggtggtgcgttcgcggccaactgctgctgctggtcctgccccggctgctgtgcttgccttgacatgcagtacttctcaatga

SEQ ID NO: 54147 - DNA, 228 bp, Glycine max
  Peptide Sequence Number=SeqID_170925
atgggacaccttaggtttgttatactttttggtaagagtaatcaacatgaaaatacagaaaaaggtgttgaaggaagaagcccagagtttcaagaacctctagatttgagatcaaatccttttcaagggggaggggatgatgcaatcctaccccctcaagagcattggatagaaggctccaagaatattgggccaaagatgcaggagaaggcccttggattctcatga

SEQ ID NO: 54148 - DNA, 476 bp, Glycine max
  Peptide Sequence Number=SeqID_170926
atgctgattggggtgggtgtcctgacacccatcgttccacttctgggtattgtgttttcctcggagataatccgatatcttggtcttccaaacgacagcctattctctcccgcagcaatgcagaggcagaatacaggggtgtggctaatgttgtttctgattcctgctggatcagaaacctgcttctagagttgcattgtcccattcaaaaggctactatagcttactgtgacaatgtgagtgcgatatacttatctggcaatcgtgttcaacatcaacgcaccaaacacattgagatggatattcacttcgttcgtgagaaagtggctcgtggcgaagtccgtgtgcttcatgtgtcgtcccgttaccaaattgctgatattttcacaaaagggcttccgcgcgttctatttattgatttcagggacagtctaagcatacgagagcctcctgcttcgactgagggggagtgttag

SEQ ID NO: 54149 - DNA, 298 bp, Glycine max
  Peptide Sequence Number=SeqID_170927
atggcacaaagcgccaaatttcaccctgccctcactatcacaaatgtgaaatctcttgttcctgtcacattagataacgagcaggctttgtattactcatgggctgccttgtttaccaaccttactcgggttcacgatctctacgatcatattgtcccacccacagaggaacctgccagagcagcataccttgttgcaaaaacagttgatcctgccatgtggaaacgtcttgacgctgcgattctccagtggatatatggcaccatttcctctgaccttctccttgctatcctacgac

SEQ ID NO: 54150 - DNA, 627 bp, Glycine max
  Peptide Sequence Number=SeqID_170928
ggcggcataggtcacatactaaacatcactcccaaagaagagaaaaggatagaaggccttaagatgttaacattagcctcccatatttccatggaaaaagataatgttgaggcctacctagattgggaaatgaaagttgaacaactctttgcttgtcatcatattagtgaagagagaaaagttccattggctacccttagcattcaagggtatgccctctattggtggacttcccttgttagggaaagaaggatttatgggtgtcagacccaaatttcgtctggggactatcattcatggatatttggattctcgctagccgaattgagttgttcgacaccagttaccgtgcaagatgaaagatcattcgatgttttggtcaagggtgcgaaagatactaaaagggatgggcaaaagggtctttttagggatttttctagacctcagcttgcccaggctagcctctggctcacctgggcccccccaaatggcttagggttgaagtccccaactcgtccaggcaagccaagtcacttcagagtgaagcatcagctcaacacacatctttctcgcgttagggctgaagtccccaacgccttaacaacctctttcgttcttgttagttaa

SEQ ID NO: 54151 - DNA, 654 bp, Glycine max
  Peptide Sequence Number=SeqID_170929
atgggattcggccatggtagaagtgccgttgaagccatcacatccctcactcaatactacgaccaatcactcagatgcttcacttttagggaatttcagttgacaccaaccatagaagagtttgaggagatcttaggatgcccattagggggaaggaagtcgtacctctttgctagattctatccttctatggcaagaatagcaaaagcgatccagatctcggaacaagagctaaaccgagtgaagcaaaataggaatggggtgatagggataccaagaaagcacttggaggagaaggcagaagctttggcaaataaaagggagtggacctcattcattgacatattagcactattggtgtttggaactatactatttctgaatgtagacgggctagtggacctagcagcgatcgacacctatcttgcttatcaccatagcaagcaaagcctggtcatcaccattttggcagatacatatgatacactcgacttgaggtgcgagaagagcagtgcaagaattatctattgtacgcctactctttatgtgtggttggtctcccatgttttcgtcatgaaggtaggcctatttgtcctctacaaggtcatcgcatgtgcaccgaaaagggaaaagaaaattgggaagaactcttga

SEQ ID NO: 54152 - DNA, 282 bp, Glycine max
  Peptide Sequence Number=SeqID_170930
atgacagcagtagaagttttccttttaaaaattgaaatttacgcagttttgagtggtgatatcgtagcaacaaggtgggtcgttacatttggcaccctcaacctgtctcaccagttgcgcgtcgagccaccacgcctgacttacggtgaagttactaggtcgttttccatgaggtggaaggacatggttgaacgttactggcatttggttgacaaaaatggaaatatgcataccattgtctacaaccaagatttggatggcccaaccattgtattagggtga

SEQ ID NO: 54153 - DNA, 243 bp, Glycine max
  Peptide Sequence Number=SeqID_170931
atgggcagttcagatagaatcgaactttcgattgattcgggtacttggaatcctatggatgaagacatgaaaacgggattaactgaggctgttcaaacaggtactggtcaactaaatggtattcctgtagctattggaattatggattttcagtttatggggggcagtatgggatccgcagtaggtgagaaaatcacccgtttggtagaatatgctactaatcaacttttacctcttattctg

SEQ ID NO: 54154 - DNA, 1159 bp, Glycine max
  Peptide Sequence Number=SeqID_170932
atggcgaagaaactacgcgagatcgttgtcgcagtgacggcggacactggcgcctaccagcgcgaaatgaaccgccaatcgcgcatgggaggcgagtatttcaagtccgtcgagcaaggcgccaagcgcgctgacgcggcctaccagcgtaatgcggcgtccatccggatgcaggtcaccgcgatggacgaggccacccaatcggtggcggcctatacccgcgccatcgctgccgcgttctcggccggaaaactggtcagctatgccgatagctggaccaacctgaataaccggctcaagctggtgacggacggcgctggcgaatttaccgcggcgcagacggcggttttcaacatcgcccaaaatgcgcgggcaccgcttcaggccacggctgagctttaccagcgtattgcgaccaaccaggatgcgctggggctgagcggccagggcgtggcctccatcgttgacacgatcagcaagacgatggtgatttctggcgcctctacccaggccgccgacgctgcgctggtccagctggggcaggccttcgcttccgggacgctgcggggcgaggaactgaattccgttatggaacagacgcccgctctggctaaggccatcgcggacggcctgggtatccccatcggggaactgcgggcactgggcgccaccgggcagctgactgcccagcaagttgtgactgcattgcagaagatggcgggcagcgttgatacgcagttctccaagatgcaggtcacggtgagtcaatcgctcaccgtgttgaacaacgagatcaccaaatggattggacaggctgacgaggcgacgggcgcgagcaaggcgctcgccgatgggatcatttccctttcgaagaatctcgataccgcggccgccgtggcgggcggtgtggcagtggttgcgctcggccgttcgcttggtcaagccagttcgcaggccttccaggccacgcaggctttcatggccaaccgcgctgccttgatcgaccaggcgcgggcgcagtcgctggccgccgaggcaggcttgcgcaaggcgcagttggatgttttcctggcggaaaaggaagccgttgccgcgcgtggaactgcggtccagacgcagatggccattcagctggcccaggcgcgagcggtggagcgtg

SEQ ID NO: 54155 - DNA, 1338 bp, Glycine max
  Peptide Sequence Number=SeqID_170933
atggtttcccaggcctacgagaacacctatcaacgggcgctggacactggcgcggagcgcaccgctacgcaattctcgggcattgccgccaataccgaggtcaagcgcaccggtaagaagtccggcgacgattgggcgaaatgggtgaaggaacgccaggccgaaacggcggcgcaacttgacctggctgcagcgtaccttgaagggggcgcggcggttgaaaaggccacccaggcgaagcgcattgaagaggaagttcttaagcagggagccaagcgccgcgccgagatcgtatcgctactcgatgccgaggcccaggcgcgcgccaaggcggacgccgccaagcaaatcgccgacatgggcaaggaaattgccctgattgacgcgaagaccgaggccgagcggatcttgtgggagacgcagaacggatcctacgccgcgctggacgagaacatccggaaggcgctggtaggccgcgcccgcgagcttgatcttgcacgcaaggcacaggcacagcaggcctatatcggccaggtgtccggccgcaccgaggcggacgagacgctggaaaagatgggttggctggccgacgccttcgaccgcaaccagttgagcgccgagcagtacaagcgcgccctcggcgagttgacgggcgaaggcctgggcagcttgaccgaatttgcggtgcagggcgcacgcaacatccaaagctaccttggcgatggcctttatcaggcggtgaccggaaagtttgagggcatcggcaatgccttcttcgacatgctggcgcgcatggcaaccgaggctgccgcggcgaacctcggcgaaatgctgttcggcagcttcggcaagaccaaccagatcggcggcctgttcggcgccatcgggggcgcgattggcggcatgttcggcggtggcagcagcatgccgtcgacggccagctgggcgatgcccaagtttgcgaagggtggcgcgttcaccaatggcgttgtggacagtcctgtggcctttcccatgggcctgatgggtgaggccggccccgaggccatcatgcccctgcatcgcggcgctgacggctccctgggcgttcgggcagagttcccgagcgtgccagggggcggcctgggcggcggtgggtttggcggcatgcaggtgaatatcaacgtcgaccggcgtggcgagaccagcagcaattcgtcggacggggccgaagacttcgaacgcggcctggcggccgtggtccagggctacgtgcagcagtacgtgccccaggagattcaaaagtcattccggcctggcggctcactctggaacgcccagcagaaccgcagaccataa

SEQ ID NO: 54156 - DNA, 915 bp, Glycine max
  Peptide Sequence Number=SeqID_170934
atggctgagcacatcgccgtgctcgtcaatccgctttccgggaaggggcagggtgcgcgagccgccgaggcggccatcggacatctccgagagcgcggagccgaggtacgcgcctacgcgggcggttctgcagcggacaccgcacgactcgcgatcgccgccgtggcggatgaaccgcgcgttctcgtggtcgtgggcggtgacggcacgctctcgggcgtgctggacacggtgtgcgcggccgccatgcccgtcgtgctggtggcggcgggcacgggaaacgacctcgcccgcgcgctcggactcccgcggggcgacgccggagccgccgccgaactcgccctcgtcggtgtgccgcgggccgtcgacgttggcgtggtccgcaccgcgaccggcagccggaagttcctgaccatcgccgcgctgggcttcgacgcgaaggtgagcgatcgcaccaaccgacttcgctggccgcacggtgccgctcgctactacctcgccctgctgatcgagctcgtgcgactgcgtccgatggatttcaccctcgccgtcgatggcgaacccgcccgcagcgcgccgggcacgctgatcgcagccggcagcacctcgagctacggcggcggcatgccgatctgcgtcggcgccgttcccgacgacggactcctcgatgtcgtccaggtcgccccgctgagcagacggcgcctgttgcggctgttccccctgctgcttcgcggcacgcacctcgctcgccgtgaggtctcccatcgccgggcacggtcggtcacggtgtccgcgcccgacctggtggtctacgcggacggcgagcggatcggcgaggatgagtgcaccatctccgtgctgccgggagctctcacgatgctggtgccgaaggagcctgatgaccgagttcgatga

SEQ ID NO: 54157 - DNA, 432 bp, Glycine max
  Peptide Sequence Number=SeqID_170935
atgtcgaacacttcttccggaagagcgtgtcttccggaattcttccggaagaaccacttcttccggaaagtttccggaaaaggttttccgggagtcttccggaagacgtttggttacttccggaagaacacttcttccggaaactttccagaaaatgttcttccggaacttccggaagaacccctaacgggtcttccggaagactccaccgtcagccttttccgccattttttccggcgtactctcgtcttctcccctctcgtcttctaccctaaggttactatcctaaggttccattgctatgctaatagtgctgcacattacaagcaaagggtaaggggaaggggaactaacctgttcgcggagaagaagaagaaagccttggcgcgcctcgcggaaaagaagcttcacggagaagagaagaagaagcag

SEQ ID NO: 54158 - DNA, 219 bp, Glycine max
  Peptide Sequence Number=SeqID_170936
atgggtgacctccctgttgttagagtgtttcctaaagtgttccctgaagatatatctggtttaccacctgagaaagagagagttttctgtagacctgtgatgcaatcctacccgcaaaggacattggatagaagactccaagaagattgggccagagatgcaagagaaggccctaggattctcatgagccttagggtagattttgggtccatgggctaa

SEQ ID NO: 54159 - DNA, 591 bp, Glycine max
  Peptide Sequence Number=SeqID_170937
atgagccacacatcttcaacagcatcaattgaaactatcataccgatttcatcattctaccataaacaatgggcaccagactatccccagcatgttgacctgaaatatgatggaaccatctacaaaatacgagtcaggcagcacaaaacaagatgctatttggcagatggactcgaaaacttcagaagagaattagaaatatacgagtcgaccatcatcaacttctttgcatgcaatcatctctacgagtttgacatacacttcacccctccactacaccgacaaacatgtggcagaccaagacatttgtgcataaagcatatctggagtgttaacattacacaggcaatggtcgttgctcctcaacccctgaaacttccaccatttgtagaaatacctcttaatgcttgcggccatcacatgacagtattaagacgattgggccctccattacaatggcctgttgaaactctcaaccctggcattgctactaaagccattactcaaccatcgtatgatttccttgcagaaagtgactttgatcatggagatgaagtctccttttattatagacgttttgacaaagtctag

SEQ ID NO: 54160 - DNA, 528 bp, Glycine max
  Peptide Sequence Number=SeqID_170938
atgaagactatcaagaatgcaaaaccaacaacaggtaaatctaagcaagtctcggttgcatcatcaaacaaaacattagtagccaccactgataagacaaaagaaactatagcaccatcaagaaaaccaattcttgcacttgcaactgtaattgccacggataagaatacatttgcaaagataaaaacaagtgatgctacatcaactaatgtgactcatgcacctgcaactatagctagaaagttgaagacatcctttgtgtcaagaaagagaaatcagaaaggaaaaatgcagcatccaaagtcattgaatgaccaaacaccaactgcaacaagtgttgatggtccttctactcaaatgccttctttgattgcaaagtctagtaacatgcttgtaggcctaggatcttcttcatcaatggattcctttgcttcttggaagataaatggcagcggaatggagaaggaagagagagaggagacgccacttcaaggagaagataagtctagaagaagctcaccaccatag

SEQ ID NO: 54161 - DNA, 1482 bp, Glycine max
  Peptide Sequence Number=SeqID_170939
atggactttgacacggacactgacactttgacatgcagtgagctagcaaattttgatcccttgggtattaactcagatttatcttctggtctgaattctacctggaaaaatctggtgtgctcaattacacaaacatttgagagtacttcaagtgcagaaaagggaaaacctaactcttctcaaggggtagcagctgcaatagaggatagttcaatagattttggtgacttttttaagggcccactgccagggaagtttctcaagcttttagggtttcttgccttgtcaaggcttggagtgtacatacccctaggtggagttaatagggaggcttttgttggaaatttggatcagaacagtctattaagcactttggactcgttttctggtggtggtattggtagacttggggtatgctcccttggcattgttcccttcatcaatgcacagattgttttccagcttcttgcacaagtatatcccaaattgcaagatcttcaaaagagagaaggtgaggctggaagaaagaaagttctgcagtacactcgatatgcttcagttggatttgccattgtgcaggcaattggccaagttcttttcctacgtccctatgtcaatgacttttctacagagtgggttatttcttctgttatcttattgactcttggctctgtgtttacaatgtacatcggagaacgaattacagacctaaaacttgggaatggcacctctcttttgatattcacaaacattatctcgtacttgccagcttcttttggtaggacaattgctcaagcatttaatgatgcaaactacattggacttggtaccattgttttgtccttctttttgttggtagttggtattgtttatgttcaggaagcagagagaaaaatcccgcttaactatgcttctagattcaccagcagaagcactggtcttgaaaagtccgcttacctaccctttaaggtaaatagttctggagtaatgcctatcatattttctacatcatcattagctcttcctggtactttagcgcgcttcactggtttaactgcactaaagaaggctgcagtggcgttaaatccaggaggttctttctaccttccatttaacatacttttgatagccttcttcaactactattacactttcctacaactggaccctgatgatgtgagtgaacaattgaaacgtcaaggtgcttcaattccacttgtcagaccaggcagaactacagctacatttatcaaaacagttcttagtagaatatcagttctgggttcaacatttttggctatcttggctgctggtccagcagttgttgaacagatcactcacttgaccgcattccggggatttgcaggaacatctattcttattcttgttggttgtgcaacagacacagcaagaaaagttcaagctgagattatatcccagaaatacaagaacatagagttctatgattttgataaatactaa

SEQ ID NO: 54162 - DNA, 225 bp, Glycine max
  Peptide Sequence Number=SeqID_170940
atgaccaaacttggtctctgcttgtcatcgggcccgccgcctctggatgacaaaagggtgcgaataaccataagaatgaccaaacttggtctctgcttgtcatcgggcccgccgcctctggatgacaaaagggtgcgaataaccgtaaggtatctccgcgtatcatgggtgcagaatgaccaaacttggtctctgcttgtcatcgggctcgccgcctctggatga

SEQ ID NO: 54163 - DNA, 213 bp, Glycine max
  Peptide Sequence Number=SeqID_170941
atggctggaattgcacttagcgagctggtgtcactaagcaaactatttactatggatggaattgcacttagcaagcatgttggcactaagcaagctgttcagcaatatctaagttcacctagtcatctgctcccccgaacacaaagttcaagatcatcacaggatccaaacacaaacagcaaactgggagtgagttatcacattcctaactaa

SEQ ID NO: 54164 - DNA, 903 bp, Glycine max
  Peptide Sequence Number=SeqID_170942
atggttcacacttcagatggcttactatcatttatccgttgcgtatatatagaaggaccaagaaagggattaaggcgtgaggggcatttggttgggttcttagtttttgcggcgatgacggtgctcggaggttgtctctcgaatatgttcagggaaccggcaatggagttgctcacaatggggaaggaaatcaacggctctcgccctgccatcacgggattcctggatttgcatttgagacacattttggtaccgtccatcattcatgagctgagagatgatggtgcagaaacaattcctatatggccatggttcgttttcttagctggaggaatgggctgcttggctttcagtactctttcccatcttctggcctgccactcaaaacccttcaacctgtttttctggcgtctagattacgcaggaatttctcttatgatagtctgctccttctatgctccaatttactatgtcttttactgcaatccttacataaggactttctatttgacctcaatatctgtgtttggagtcctagctatcatcacccttcttgccccttcactctcttcccctcacttgcgacccttcagagcatctttatttctctgcatgggattttcaggtgtcattcctgctgttcatgctcttgcaacccattggcaccactcacatgttgtcgttgcactcgggtatgagcttctaatggccattctatatgccaccggagctgtgttctatgttactagaatacctgagcgatggaagcccggggcattcgatattgcaggccacagtcatcagatttttcatgtttttgttgttcttggggcgcttgcacacactctagcaacactacttgtaatggaatttcgacggggatcacccacatgcaccttttag

SEQ ID NO: 54165 - DNA, 447 bp, Glycine max
  Peptide Sequence Number=SeqID_170943
gttagagatgcagatgctcccattcttatacccactgaagaagttaagttagtggggcagacacttaacaccttatttgcttggccgacatatcttgtcaagcatttatcaaaacagggagctatgggaccggcgaaacctgcagttaggccagatcatcatgtcaatgatcccctatatctgatgacattgactatcccacagctttttttgaagttgttacaggttatgtgggatactaccgtgtttagggtgtttaatgacaacttccccttgtacataaagcatgaaaatctatctgaaatagcacacagtggtcaatgtctcaacatctctgttatacatttgtggattatgcatatgactaagacaaaaatcaaagagggatgtgtacctaggagcctacttgaatggtgcacattggcaaatggttgtcattttgcctaa

SEQ ID NO: 54166 - DNA, 480 bp, Glycine max
  Peptide Sequence Number=SeqID_170944
atgaaccttcaagaacttgttgcaaccttaaaggtccatggacaagaaattaaaaaagatgaagaattcaagaagggaaaatttgttgctcttagcactcagacagaaaggaaaacaccatcatccaaggaatcttcatctagaccatcatccaaaagtgtgtataaagcattgagtgtggaatacttttctgttgtggaatttaaagaagaatctgatgaggatgatgagttggctttcattgccagaaagatcaggaagatgtggaagaacaagaatgggtccagatggaagaacttctccaagaaggtgttcaaggaaaagaaggacacaagaaagagctccattatatgttatgagtgcaagaagcctggacacttcaagtcaaaatgcccaaaattggagaaatccaaggaaagtaaaagtcttatgagcacttcggaggatctcgacgaaccacctctgatgaagaaggagtag

SEQ ID NO: 54167 - DNA, 153 bp, Glycine max
  Peptide Sequence Number=SeqID_170945
atggctcccaaaactgggaaaaccaaaccgcacaaggccaagggagagaagaagaaaaaagaagagaaagttttgccaatcgtgatcgaaattacagtagaaacaccagacgaatcacaagttacgctcaaggtatgggatacggagtggtaa

SEQ ID NO: 54168 - DNA, 3057 bp, Glycine max
  Peptide Sequence Number=SeqID_170946
atgtcacccattatacttggatggacgaaagtgcgaggcgcgaggctgaaagacacggtggaaatcgtgtccttgaaaccttgccatctgaccatcgtccaagaggactacacggaagagctcgccgtcgcacacattcggcgactcctcgacatcgtggcctgcaccacctccttcgcctccgcctccgccgccgcagcagcaaaaccccccgccggaaagtccaaagaccccaacgaacccggttcagaaaatggacccgaaacaaacccgaaacccaaacccgtggatccgaattcggacctggtcaatgccaaaagcgacaaagctgacgctgacatctctatgtgtccacctcccaggcttggacagttctacgatttcttttccttttggcatcttacaccgccgtttcaatacatacggagatcgaatcgtcctttccttgaggataaaacagaagatgatttctttcaaattgatgttagggtttgtagtggaaaacctactacaattgttgcttctagaataggattctatcctgctggaaaacgtccacttgtgagccatactttggtgggtctccttcagcagataagcagggtgtttgatgcagcctacaaggcactaatgaaggcgttcacagaacacaataaatttggcaatcttccttacggttttcgtgcaaacacatgggttgtccctccagttgtttctgacaatccatcagtctttctgccacttcccatggaagatgaaacatggggaggaaatgggggcggacaaggtagagatggtaagcatgaaaatagacagtgggccagagattttgcaattctagctgcaatgccttgtcaaacagcagaggagagacaaattcgagataggaaagcttttctacttcatagtttatttgtcgatgtatcagtcttcaaagcagtttctgcaataaagcatttagtagatattaagcaaaactctttcagtaattcagctttgccaacttcatatgaagaaagaattggagatttaactattaaagtgacgagagatgtatctgacgcaagtttgaagttggactgcaaaaatgatggaaatcgagttcttggattgtctgatgacgaactagctcagagaaacttgctgaaaggcataactgctgacgagagtgcaactgttcatgatactcctactttaggtgcagtacttataagccattgtggctacacagctgtggtaaaggtctcaggtgagagagatatggaggggagtcataattccttggaaattgatattgaggagcagcctgaaggaggtgcaaacgcattgaatgttaacagctttagcttgaaggtgcttttacttttttgtcttttgagcttaaggatgctattgcataggtcatctacacctcaatcatctaatgcaattcaacgaatccaaagctcagatattgaatattcacattttactcggtcattggtaaggaaagtcctagaggaaagtctactgaaattgaaggaagaaaccactagacacagtaagtctatcagatgggagcttggggcatgttgggtacaacatttacaaaatcaagctactgggaaaactgagccaaaaaaggaagaagaggctaaagttgaaccagctgttaaaggccttgggaagcaaggtggattactaaaggaattaaagaaaaagattgatatcagaaactcgaaagttgaagtaggaaaagatatttcgccatgtaatggcaatgacataaacaagccagaagccactaaacaggaattagagagacaagatgaagaaaaggaaattatatggaaaaaactgctatctgatgctgcatatacacgccttaaggaatctaaaactgatcttcatctgaagtcacctgatgaattgatggaaatggcacataaatattatgttgatactgcacttcccaagctggtggcagattttgggtcccttgaactctcacctgttgatggaaggacgttgactgatttcatgcatactaggggcttgcaaatgtcttccttaggacgagtggttgagcttgcagataaacttccccatgtgcaatctctatgtatacatgagatggttgttcgagcctacaagcatatcttgcaagcagttgttgcagcagttgataatgtttctgagttggcttcatctatagcatcatgcttaaatatattattgggaacaccatcacctgaaactaatgatgaagatattactagttgcgaagaactgaaatggagatgggtagaaaacttccttctaaagaggtttgggtggcagtggaaggatgaaaatggtaaagatttgagaaagtttgccattcttcgtggactctgtcataaggtggggcttgagctggttcctagggactatgatatggatacagcaactccttttaaaaagacagatattcatgtagcttgttcatctgctgatggccgcacacttttggaatcatctaagacttccttggataaaggtaaattggaggatgctgtcaactatggcacaaaggcactctcaaaattagtgtccgtatgtgggccttaccatagaatgacagcaggagcatatagtctcttggctgtagtgttgtaccatactggagatttcaaccaggcaactatctatcagcaaaaggcactagatattaatgaaagagagcttggactggaccatcctgatacgatgaaaagttatggagatcttgctgttttctattatcgactccaacatacagagttggctttaaagtatgttaatcgtgctttgtatcttctgcacttaacctgtggaccatcacatccaaacacggctgccacctacattaatgttgcaatgatggaagaaggattggggaatgtccatgttgctctcagataccttcatgaggctttaaaatgtaacaaaagattacttggagctgatcatatacaggctaaatcaattagtagttgcactaatagtagcagtagcaatctagcaatacagccaccaccaccacaacaacaacaatga

SEQ ID NO: 54169 - DNA, 610 bp, Glycine max
  Peptide Sequence Number=SeqID_170947
atgggctcactaaaagcacttcctcatgttcagtttcttcacaaatatgcatcagagaggacggctgcaagctatcatgcaatagctattgctctttctttgatggaagcatactctctaagtgttcagcatgaacagaccaccctccagatcctgcaggctaaacttggttctgatgatctaaggacacaggatgctgctgcatggctagaatactttgagtcaaaggctctggagcaacaggaggctgcacggaatggtacacctaaaccagatgcctcaatctccagcaaagacctcttggattacataactccagatgctgatcagaaagcacgggaagcacagaaaaaggcccgtgccaagggaaaaccaggccaaaactgggaaacagcttcagatgaaaatcagaaggatgaagacatgtctcgtggttattcaattacagagattactaacgataaagaaaataaatctgaagctcaaattaaagatcacgggattgataaagttgagtccgctcacttagaccaaacaatgctcaatgaaagtgataatctggcacaggatgacagctcagatgaaggatggcaggaggctgttcccaaag

SEQ ID NO: 54170 - DNA, 336 bp, Glycine max
  Peptide Sequence Number=SeqID_170948
atggcctcagttaccttaagaaaaaggggggttgaattaagatgcaaagactattccccaattgaactatcaatctctcttttcggattaacaatgcatacagggataacccttcccttgtgttcaggaatcctctacaacaagagacccacgctgaaaaatccttcaactatttctcgtccttggaaaattctttttgcaagaatcaactgcttctttcattcttcctcactacgaggtcgtgaagacaagacaacacttggtacctctaagccctacactggggcaatgaggggcaccgtgcatgagcctcaagtgaacctaggggcagattag

SEQ ID NO: 54171 - DNA, 339 bp, Glycine max
  Peptide Sequence Number=SeqID_170949
atgttggtcttcattttcttgtacatcactatattgggtgagacaccattgctggatatgacattccagcaaagactcagggatccaaagcactgggataaccctcttgagtttaggcctgaaaggtttcttagcaatgatcatgagagtggaaaaatgggtcaagttggggtcaggggacaacattatcaacttttgccttttaggagtggaagaagagggtgtcctggagcttcactagcactaaaggttgctcacaccacccttcctggtatgattcaatgctttgaattaaaggctgaagaaaaaaggagggtattatggtcgtttcttaattaa

SEQ ID NO: 54172 - DNA, 348 bp, Glycine max
  Peptide Sequence Number=SeqID_170950
atgactggtccttgtcctagactagtttctattgtccctatcaaagaatcttcgaatttgttgtgcctaatatctctaaggcacatcaagactgtgacatctatacccatgtctactaaagtcatccatgttttggctaatttcttcgaagcagacctcttcaccaaagagattgtgtttggggtgacctcatgggtctggttgtcttgctctgtgagcaggttgaggcattttggatcggatgaggacggagagcttgtacgaaaagaaatacgagagaaagagcgcaaaagacgaggcatcctaagatataacctccaatatctttgccttcatttggtttcatag

SEQ ID NO: 54173 - DNA, 540 bp, Glycine max
  Peptide Sequence Number=SeqID_170951
atgacattgctgctcagcaatgtcttgcctagcgatcacaactccgacctccctctgccagttggtgtatgccatcctgacacggatgagcatccacgtggcccaggtatggcgcctaccaggcaccctctggacccagataagtccaacagggccctggggtttccggcgctgatcatgggcctctgccagtcctacggagttctcgtctcccccattaaagcgcagggtgatgcacatcaggccgcagacgcaccgccaccacctcggcaggcagatccagctgggtcactgggcgtggagtgttatctacagcatttggttcgccagcaggcaaccaaccaccgtgggcagggttccgccccttttgtatgccctactctggagcagtttggggatgaggtcgcatggcctggagactggcacgatgcccaggttagggaggagcctgcaggatccctcggtgaggcagacgaatcccatatggatgaggatatgactgacctactcggtttcttgggagggagcggagccacgtga

SEQ ID NO: 54174 - DNA, 159 bp, Glycine max
  Peptide Sequence Number=SeqID_170952
atggaggatcatctatactgcaaggatttgcatgagcccatcatctacaaagacaaggtagaagttaaagtaaaagagagaagcacacaaagaattatattcattcgtctcaaacctaagactacgtcaagttcttggcaaccaccaaggttccactaa

SEQ ID NO: 54175 - DNA, 321 bp, Glycine max
  Peptide Sequence Number=SeqID_170953
atgcagaaaatacccaaaagggagggcaaaagggttagttggaagctttttttgacccttggcttgcctaggccaccaaataacttcatggtgaaaggggctgagagggaggttctgaggtccagaggtgaaggattggggaaaaagaagagaaaagaagaaggaagaagagaaaaagaagctaaatcaccgtctagtcggtcctgcaatcggtttctacatcgttcttcggtcgttcttcgtttattcttcgtttattcttcgttcttcatccggttagtgtttgtctttaaggatttgaacatgattcatgacccttag

SEQ ID NO: 54176 - DNA, 468 bp, Glycine max
  Peptide Sequence Number=SeqID_170954
atggagatgacaatagtgagggccaacaatgaagagggcaccaaagcagtgcatgatggcttcaccaacaagatttctttccagcaccatgaccagaaaattattcttaaacctctatcccctagagaagtgcaaattgcaaagaagaatgaaagctatgccaagcaagccaataagaagaggaaggaagtggtacttgaacctggtgatgatcatggacatttttgggcaaatgctttccaagaaggaaggaatgatgagaatcctaaaattggccaaatacaagggcctatgaccaagagtaggaccaaacattcagtggataccttccaacaaatggtagcagtcatatttaacaaggcccaagtggagaaggatgaaagcccaagtggagaaggacgaaggcctaaatggagaagaatgaaggcccaagtggagaaggatgaaggcccaagtggagaagaatga

SEQ ID NO: 54177 - DNA, 545 bp, Glycine max
  Peptide Sequence Number=SeqID_170955
gagtccgcaaggcatgggatgcggcgcaaaggaaggacaaagagcttaggggaagcagtaatgggatcatcggcggctatcataagtggttgagagtccggacacaagggttggattggctcccaaagctaagggctgcgagaaaggaagaggctgaaactccggaagaaagtgaagaggtacaagccctaaaagcggagcttgaacaagcccgagcagtcaaagagaagttcaagtcaacggccatcaaagtccgaaaggagtacgatgaactaaaagacatcaatatggccaccaccgaagccttggaacaagaaaccaagaaggccctaaaagaagaacacgaccgaaacaagttccgaggagctttgtggggcagatacaatgagcttaagctccaaagagatgaaaaggatcagtcgcgggtcgaagtcatgatcttgaaagatgagttaaaagattgtcataggtcgaaaagaagcttgtcccagcaattgagcaagactgaaggaaatatatgggccatcatcaatgattacaaataa

SEQ ID NO: 54178 - DNA, 198 bp, Glycine max
  Peptide Sequence Number=SeqID_170956
atgtgcattgtgggtacaaaatcagcagtcacttggagctttcttgatcaaaaattcatgaaaggtccattatgggcaatggaatctgtgaaggagataacggaaaaactgctggcaaaaacaaacacggataatcctgaaattgtaacacgatccactgggtcaaggaaaaagaaaagagacacttttaagcaatag

SEQ ID NO: 54179 - DNA, 705 bp, Glycine max
  Peptide Sequence Number=SeqID_170957
atgatgccctggaaaagtgcagataaaagaaaatggaaaacattaaattattacccaaattttctgcaaaagaaaagaatactattgtcgcaacctaccattcgacgggagggcgacacaaggctcatgggtgcatcttccaaggaaggaaaaatgcacggagttgccaccaacgtttattcaaggaaaacgcgagaaaaaccaaaagcgggtctacgaattttaagaaataaaggttcgggagttttttacgcacagggaaggaaaatgagcggaggaggttgcacatcagctcacccatgcgagctggttgtttcctccaaaggcaacctagcttgcctaagcgagctggttgcttcatccctaagctttctagtttcgatgcatcaaggttgtagatggacgattagaaatggcctcaaagtgaaaatatgggatgacccttggcttcgggatagcaacactcatgttagatcagcagttccattagcatgtaaaatttgggtggtgaatactctctttgaacaggatggagcaattgatggacttaaaatgtcaaaaagtcccaagagaaaggagagcaatttggagcttgagcattcccctaaggaggagtttggtatgagagaaattcagtttcctgcaaatctcagattgggaatctttatttcctatgtttgtcatgattcccagacattaaaatag

SEQ ID NO: 54180 - DNA, 261 bp, Glycine max
  Peptide Sequence Number=SeqID_170958
atggatccttccaaggttcgagcagtattggagtggcccattccaacctccaccaaagacattcgcaaattcttatgcctcactggatattacagaaggtttattcgagattatggcaaaatgacccaaccattgacggcattatcagatttcacacaggaatttgtgattgaatgggatgtctcaggacaaggaattggtgtcatcctgatgcaaaatcaacagcccattgcctactttagcaaggctctttccctctaa

SEQ ID NO: 54181 - DNA, 231 bp, Glycine max
  Peptide Sequence Number=SeqID_170959
atggaggagatgagggaatcaggcttggaagattgggttgaaatagaggactcatgtgactcgagcaagtttgatggcggcaaggtcagcttccatggcatcgagatgctgggatgtcatcctagtgcacatacaaggaaggggcgactctcaatgaaaagcaccaatgatatgagtagtatcaaagatcccaaagatgatatctccaatcatcgcaacactcccttataa

SEQ ID NO: 54182 - DNA, 297 bp, Glycine max
  Peptide Sequence Number=SeqID_170960
atggagctgctcataattttattgcttgtgaccagggatagcttggctgacagtgtgggtcataccactattgataggcaaaagaagacaaagaagacaatgagttttgaagaccacaaccaattaatcacgttacaaggcactaacccagttagcgtgcgtcaatacaaaaatgcttaccatcacaaggacgagattaagcgacaagtgcaagagcttctcacaaaggacatcatccgtcactcaattagtccattttcgagccctatcatcttagtgaagaaagatgaatcataa

SEQ ID NO: 54183 - DNA, 906 bp, Glycine max
  Peptide Sequence Number=SeqID_170961
atggaaagggaatgctctcttaagaatcttaaccaaaacatgggcctaaattcaacggttccaattaatcagactttttttgaagtttatttgcataggaggcaagttgatggtgaaacacgtgtgggtgtatttgccgcttgttcaatagaagctggagagccgttaacatatgattacagattggtcatcttagcgaattcttcttggattccaatcctattacaagagttccatagcatacctatgggtaatgggtggcctttcgggctaatacatatagaagattggttaaaaatgtctattggtgttttagctctagaaaacctaagacatggcttagctttgttatgtgatgcaaaggtaccgatcaagctaaagggaaagttttatcggactgcggtaagaccggcgattttgtacggaacagaatgttgggcggtcaagagccaacatgagaataaagtaggtgtagcggagatgaggatgttgcggtggatgtgtggtaagactcgacaggataaaattagaaacaaagctattagagagagggttggagtagcgcctattgtagagaagatggtggaaaatagacttaggtggtttgggcatgtagagagaagaccggtagactctgtagtgaggagagtagaccagatggagagaagacaaacaattcgaggcagaggaaggcccaaaaagactataagagaggttatcaaaaaggatctcgaaattaatggtttgaatcaaagtatgaaatacaaaggatgtgaacagagggaggagaccagggaacaattttttagagttccaatgtgcaagttagcgggaaactccaccagagtgatgggttggtcagaaattccgttggccattttaccagaatgcaatgggtttgcctga

SEQ ID NO: 54184 - DNA, 606 bp, Glycine max
  Peptide Sequence Number=SeqID_170962
atgaattttgcaacatctgattttgtaccactgaaagattgggccaaatacttacaaatagtggtgcctagaaagatacttacagagagaaatgtggtgatataccacactgagttcgatgatttcaaagaagagcttgagagaagaaattggcatgaagagttgaccagctttgttgaaggtagcattgatgttgccattgtaaaagaattttatgctaacctctatgatccagaggataaattaccaaaacaggtgagggtcagaggccatctagtgaagtttgatgaagacgccctcaacacattcttgaagacccctgtgatcattgaggaggggggaacactatctacttattccatgttcgcactcctgatgcctgatcctcaggaattggcagccaagctctgtatcccagggaggggatttgagcttaatgctgatggcttgtcattgaagatcctcagaaagagcctgactaccattgctcagacgtgcagcgtgctttctttctcaaacttggtccctacctcacacacatcaaatatcactctggatagggccaagttgatttatagaataattcagaggatagggccaagttga

SEQ ID NO: 54185 - DNA, 204 bp, Glycine max
  Peptide Sequence Number=SeqID_170963
atgcagagagagaaaggagaagctgaagaagaaaagaagaggaggagtaggagggggcatgggacaaggcttgtatttacaattttgccaggtcctgccttgcgccccaattatgaggggactgctgaaatttttaatttccccgtgaaagacaaaagtggccttcggagcgtctcaacaggaaggaaagacgcgctaaagtga

SEQ ID NO: 54186 - DNA, 438 bp, Glycine max
  Peptide Sequence Number=SeqID_170964
atgacttctgcgaacaacaattcttctctgccaccacctttgcctcctcctccaccaccagttccgatgctggttcaacttgtaatcatcaggcatggtcttctcggttgcattccctctctacagattccgcagaaatttctcattgctgaaaatcgtgacaacaacatcgttagcattgcttatcgtttttgggagcaacaggatcaattgatcctttcttggctccaatcgactatttcagaagcagttcttccttgcatcatcaattgcgcaaccttgtggcatttgtgggatcgattgtatgagcactttcaatccattgcgtgtgcgaagaagaagcaactgcttagtgagcttcgttcttcttctcttgagactatctacatgcagaagccactaggccttgaaagttcagataaaaccttggtttgctag

SEQ ID NO: 54187 - DNA, 456 bp, Glycine max
  Peptide Sequence Number=SeqID_170965
atggataagagcttgaaggtaggagaagatgagtggagggagagggagagaaagggcacaaaatttatgcctcaaatgaggatggcaccgactgagctagttgagttgaagaagcaatttaacaagctcactatcaagaacaaatatcctttaccaaggatatatgacttgaaggatcacttacatggagctacaattttctcaaagatatatctgagatcgagataccatcatattagagtgaaggatgaggatataccaaagatgaccttccagactcaacgtgggcattatgagtatgaggttatgccttttggggtgacaaatgatcccgacatattcatggattacatgaataggatcttctgtcccttcttagacaagtttgttgttgtgttcatcgacgatattcttatctgttctttttttctcatgaagaacatggagaacatatga

SEQ ID NO: 54188 - DNA, 150 bp, Glycine max
  Peptide Sequence Number=SeqID_170966
atgcctcgatgtactcggcatcttcagtacctgaaagttgttgattgtagggtcgggagtgatcaacatataaggatagatggtacaccaatcccgaagctcccaactcaaaaagcattgtctcagagcccgtcaagagtagcaaagtga

SEQ ID NO: 54189 - DNA, 1047 bp, Glycine max
  misc_feature (1044)..(1044): n is a, c, g, or t
  Peptide Sequence Number=SeqID_170967
atgaagattcaggactattggcttgttcataggatcatcaaaatgaaaaagttgtatgggggagttctgattgtctcactgtttacgttgtttatgcttatgatcctgcgatatggggtcatgaaaaatcctatcggtgaaggttatctgactatacctgctatcattaatggtactaatcctctagaatggataaatcccacagtaccagctgctattaaaaaacatccagatggtccttctcaagttatttcttctgatattttagtatctagcctctttactgggagcaacttttccaaagaagagcaacaagctctgcagacatggaaccaattgaaccacttaattgataatgttcagggtttacccaatgcagcagaagctatcaaggaggctgccagtgcatggaatagctttatttcctcaattgaagagcaaaaacaaggtcatggaaatgatagttcaagagctaaagagaagcagtgtccccattttcttaataaaatgaattccactgaacttggtaatagtagttataaactgcaattaccttgcggcctgacacaaggttcttccatcaccataattggcattccgaatggccttctaggtaattttcggattgacttgactggagaaccgcttcctggggagcctgatcctccaattgttttgcactataatgttcggcttcatggggataaaatcactgaggatccagtaattgtccaaaacacctggactcaagctcatgattggggtgaggaggatcgttgtccatcccccactcctgaaaaggttgagaaagttgatgatttggagcagtgtaataagattgtagggaggaacattagccaacaccacacagctggcatgcattcccactcttcaagacaatcttcaacaatggaagaacaatcaataaataggaaatactttccttttaagcaaggttacccatttgtggcaactcttagagtgggatctgaaggaattcagatgacagttgatgggaagcacataacttcgtttgctttccgntga

SEQ ID NO: 54190 - DNA, 264 bp, Glycine max
  Peptide Sequence Number=SeqID_170968
atggcggagaatgtagagcgagaaagagagagaaactacagaaggttttgtgtttgcattgtttctgtgttttccaaggtgaaatttcgctgttcttttgtgtcgtcttcgtctttcttctctccgtgtgatagaggttccttcaacttaatagtacgaagattcaaagagaaaaaagatagagagacaaaagtgaaaacaccaaccgagacacctcgctaccgtgtcctacggtgtaactggagttcttggattcatgcgtaa

SEQ ID NO: 54191 - DNA, 849 bp, Glycine max
  Peptide Sequence Number=SeqID_170969
atgacgtttggatatagtagagacgatgttggcaaatttcttcctacatacctatctgatgggattctgcagcatgatccattcgagcttttgctacgtgttggtgtggtgaatgccctttctgttctgcgtgtgccacctctgtcagctagtgttcactacacccacaacacaagctcttacagggtttttaagaaagatcaggttggtgttgaggaggttagagatacagatgctcccattcatgtacccactaaagaggttaaggtcatagggcagacacttaataccttccttgcttggctgacacatcttgtcaagcatttatcagaacatggagctgtgggacccgcaaaacctgtagataggccggatcatgaagtcgatgatcccttatatctgatgacattgaccatcccacaactttttctgaagccattgcagcatgaaaatctgtttgaaatagcacacggtggtcaatgtctcaacatctctgttatacatctgtggattctgcatatgattgagacacgtatgcgagtggggaatgtcgatgtgtatggattcctcgagccacaatccatccagagatctggccatcgcaatttgaatcagaaagatcttcttcatcaatggattcctttgcttcttggaagacgaatggcagcagaatggagaaggaagagagagaggagatgccacttcaaggagaagatgagtctagaagaagctcaccaccataggaggccatggataagagcttggaggaagaaggagacgaatgaagggagagggagagaagagcatgaaattttgtgctctaagagagctttgaaatctgaagtttaa

SEQ ID NO: 54192 - DNA, 1333 bp, Glycine max
  Peptide Sequence Number=SeqID_170970
atgcccaataggttcacacacttggtggaattagacctcactcagttcgtctctcattccttctatcctggtgtcatcgattccgacctcgctatcattggcattgcttttatggcaccaatagcgaaggaagggacagcagtggcggagggcctagttggcaacgacaacaaggatgaagagacgcagcagaatcaacaacaaatcactgactcgtccctctccaccgagtcacgcacttccactccttctgatggagcgccacccaactcggaaaccctagttctccgctcctcgcttctgcatgaccttgccactcatatgcagggaagctctaccgcacgtaagggtggaaaagctgagagtaaggtgtctgctcagcctcctgatgaggaaactgttgtaaaagatgcagttgaggcacctaaaaaacagacagaaaatcgacttcagtctttttgttcaacttcattatctggagtatcaccaacttctgtttcacattctttatcatctgcccttagtccaactgtaccacaacagagaccgtctcctcctaaggctaatagtgtacaagtgccaaaagtagacaaaggaacaccttctgatggtacaaccttatcttctgtttctgttgcaagggcatctgcatctgatggatacaactggcggaagtacggccagaagcaagtgaagagtcctatgggttctcgaagctattacagtcaacatagtcatgatcccccgcataaaattgataccgctaaggaaagtaagctcctgccttccagtgaacctaaagtagaaagcagtgtttcaaagcactctaccaatgttttgaatgattctgatccatcatcttctccaaaagaacttttacaagaaacaccttgcagtggtgataagaatctagaaaactcatctaatgttgagaatggcaaaattattttgaatgatgaacatgatgtggggatatcaggtgatggataccggtggcgcaagtatggacaaaagttagtgaagggaaatccacacttcagaaactactacagatgcactactgctggatgtcctgtccgaaagcacattgagactgctgtggataattcaaaagctctcatcataacgtacaagggaatgcatgatcatgacatgcctgtgcccaagaaacggcatggcccgccaagtgcttcacttgtggctgcggcagcacctgcttcaacgaacaatgtgcagttaaaaaaaactggattgctacaaaaccaggaaactgaagctcaatgtttagaggacacagaaggagagttaaccggggaagcgttggaccttggtg

SEQ ID NO: 54193 - DNA, 597 bp, Glycine max
  Peptide Sequence Number=SeqID_170971
atggcagctaagctgaattccttgcggcaatacgccctgcgtgacctcactcaggctaggaggtatgcatggggagctactggcctcgtccatatgtatgatcaccttaatgatgccagtatcggcaccagccgacaagttgctagttacatcacgttgttacagcactttccatctgtttcggagtgcaatgctgatccagaccatgacgaggtgtcaccacgtgcgtgtcagtggattgccacaaagaagactgtcaagaagatatctacaacgacgtatagacagcgcttggattgtctcaggattctagatgtctgctggatgccatatgcggagcaccgaccagtccaggagtttcatccgattacatgtttcttaggacagctcctctgggggcctgttgttgttagatacagaccggagagggttatgctccaatttggatgcgtctggtgcattcctgcacaccctgttgattcatgggtgtcatttgatgacgtagatgataggtgggcgcactactccgaccatctagcgccagcaagtgacatatgtgttgtaccaggtcagtgtgctttcgactacatcgattag

SEQ ID NO: 54194 - DNA, 687 bp, Glycine max
  Peptide Sequence Number=SeqID_170972
atgtatgcacttaacaagttattagaaaaagagtgtgatatgattcgcatatcccataacatgccttacaagctatttgaatttgatttcttctactttgttcagcagtggccaggagcatactgtgacacaaagcagagctgctgctatcctaagactgggaaacctgctgctgatttcagcattcatggactctggcctaacttcaaggatggctcatggccctcaaactgtgaccctgacagtgtctttgataaatctcagatctcagacctcattagcaacatggagaaggattggccatccctgagctgcccaagtagcaatggcatgaggttctggtcacacgaatgggaaaaacatggtacttgtgcagaatctgagcttgatcagcgtgagtactttgaaacaactctcaaactgaagcaaaaagttaacctccttcggatcctcaagaatgcagggattgagccagatgatgaaatttacaccctagaaagggttacagaagctataaaaaaaggcactgggtttaccccagggatagagtgcaatagagattcagctcgtaatagtcaactttaccaagtgtacatgtgcgtggacacttctgggtcaaatctcattgagtgccctgtgcttccaaggagcagatgtggtgaacaaattcaattccccaaattttaa

SEQ ID NO: 54195 - DNA, 339 bp, Glycine max
  Peptide Sequence Number=SeqID_170973
atggagtttaagggatccgtttttattaagcttctgctgctgctacacttcttctcggttctatgtgcttctcaggactttgatttcttctactttgttcagcagtggccaggatcatattgtgacacacagaagagttgttgctaccccacaaaagggaagcctgctgcagattttggcattcatggtctgtggcctaattacaatgatggcaaatacccatctaactgtgatcctaacaaccctttcgatccatctggggtacttcattctgcacctattgaatttttcattttatcttgtgtagcctccaaaactgtccttttattaaccttgtaa

SEQ ID NO: 54196 - DNA, 462 bp, Glycine max
  Peptide Sequence Number=SeqID_170974
atggatcgctttcatgaaaatgaaaatggcatacttgttgctacagatgttgctgcaaggggtcttgatattcttggtgttagaattgttgtccactatcagcttccacattcagcagagggttatgttcatagaagtggaagaacaaccagagcttttgctgaaggttgtagtattgctttaatatcatcaagagatacatcaaagtttgtttcattgtgcaagtcattttccaaggataagaaaaattggtttgatcggaatgctagctcactggaattagttacagaaaattatgacagtgaagaggcacaagtgaacaaacataagcaaatgaagaccatctctagacaattgaagaaattgcaaaagatgcaagtgatggttctaaaggagatacaaacactattgcaaaaaggctatacaaagatggttctaaaggagatacaaacacgattttga

SEQ ID NO: 54197 - DNA, 561 bp, Glycine max
  Peptide Sequence Number=SeqID_170975
atggccaaatttgaaacgtcttcatctgtaggcatgttggctattgtcgaggatagggatggtgtggatgtaggtatcgaggacggtccacatgcatcaagatgtgatggagatggtctaacttcagtcagaggtggagatggtgtaggtgcaacatcgaaagatctgactggcatagatacagtagacatggatggggttgctatcatcaccgacaaggaagagaagatgcaatcatggatctacaatggtctttccttctctcatttttcttcttttttgcttcctgattttactatttttccactgattggtgcaattgatgcttgttttcttgctgatcgcaacaaattgaagctttaccaatttgacaaggacgagaaccagtggaaggagcgaggtgccgacaccatgaagttcttgaagcataaggcttctagcaaggttaggcttctaatgaggcaatccaagacgctcaagatctatgctaatcatctcattttgcctatgatgagtgtgcaagagcaagctgggaacgagaaatctcgtgtcttctactga

SEQ ID NO: 54198 - DNA, 1207 bp, Glycine max
  Peptide Sequence Number=SeqID_170976
atgattaaaaatgagcaacttaaacatggtcaacaagaaaagtggtttaataattttcatgaaaatcttgatctgaatgtgactgctcaagagctggagcagcagcctgattttcggtgggaattgttagaaaaccgctatagccaatacagtgaactatctggaaagattgagaagcacagagatagcattagtttggaggcccaacaacaaggaaatcagatacctcagacaaagatttctgaggcatgtgttaatgacttgttgattcttgcacaatctgctgagatagtagcacaatctgaagatagtgtggctggggagcatacaaataaccaaaaaaataaagacttacaaagtgacctgatcgatcaaatgtcacaagagcatgctagcaatatcaatgtggatgatcaggaatgctctctagagctacttgatagactgtcagcagtttgtcacagggatgacaatagccgctgcaaacattcacaaggaaaaacaatccgcctgaaccaaataaagcatcaagctcggtgtaaaagtaagaatgatttggcaccacaaatgatatctagggctgaaaatgagcagccaaaaggtagaatacttcgattgagccagatgaaacatcgagctcggtccaaaggtaattcaacagtgaaagatgggactgagaagcatatggatcagagtctgccttgtaacagatttaaagattccagtccttctgtcgaagatgtgcctgcacataactttagaggagccattcaatcatctgttgtaaggcgggatattgaaaatcttaaggaacatcaacgtattgcaaggcgattaagggcattcaagactaaaaaactgaggcaacagttcaggagagagtgtaaaagaagtgtttccagtgcgggactgcatgcaatggggacaagcctgactgggttaaaaggttataaggtcttgggatctccaactacaatggctagcttttgtagtgtggttctcccaagatcttaccaattggtatcatgtttctccaactacaatggtgtggatgatgatgccattgttgcaattaaggagtggatgctgtatatgaaccatatgcatctaaaggaatatcacagggttgttgcatgccagcatagagcagagtgtgttgaagagaaaagggcatcaaatgttaagaagaaaaataatcctgcactag

SEQ ID NO: 54199 - DNA, 1434 bp, Glycine max
  Peptide Sequence Number=SeqID_170977
atggatccgatcaaaaccaaaacccgctccaacaacctcttctctcgtaaccctaagccctcgcaatcgaggtccctccgttccgtaatcctgatctccctctctctctccttcctcttcctcgtttcctactacgctttctcctcgccgatggcgaatttccggtaccggatcatcgtcgacggcgggagcaccggcacgcgcgtgcacgtgtttaaatacaggtcggggagatcgctggagttcgggagggatggtttgaagtcgatgcgcgtgaacccggggctgtcggcgttcgcggaggatccgcagggcgcgggggggtcagtggcggagttggcggaattcgcgaagcggtggatcccgagggagagctggggggagacggagataaggctgatggccacggcggggctgaggatgctggacgcggcggcgcaggagaggattctggcgtcgtgcaggaaggtgctgcgtgactccgggttcaagtttagggacgaatgggcttctgttatcacagtttggagttggactggtgttaagttgttaattggatctttggatgaatgggatggtcacaaaacttcgcatatggagctttgttcgtggaatgtcttttttgttggtgtcagtgggagggggaatggttctgatgaaggaatgtatgcttgggttgttgctaattatgcacttggcactcttggaggtgatcctttggaaactactgggattattgaacttggtggtgcttctgctcaggtaacctttgtatcaagagaagtggtgctgccttcattctcgcgaactgttaaatttgcaaataccacttacaacctttacagccacagctttcttcattttggcctgaatgctgctcacgactcatggaaagaagcgcttgtattgggagaatttaacttggcttctcaatctcttcaagaagggttgcggatagatccttgtactcctacaggatactcttataatgtcgagtcatggaagttccctcctagcacagagagtgaaaaaaaacatcagtccattgtccaaactaggggaaacttttcagagtgcagatctgcagcacttacgctgctacagaaagggaaagaatcatgttcctatcagcattgtgacataggatcaactttcataccaaagcttcaggggaaatttttggccacggaaaatttcttttacacatcaaagtttttcggattgaggtcaagggcctatctgtccaagttgatgagtgttgggcaagaattctgtggagaggattggttaaggttgaagaaaaaatatgtctcccatgatgaggacgatttacttcgttattgtttctcttcagcatacattgttgctttgcttcacgacagtctgggaattgctttggatgatgagaggtattcctgcttgtttttcttttaa

SEQ ID NO: 54200 - DNA, 243 bp, Glycine max
  Peptide Sequence Number=SeqID_170978
atggttcttggtttactcatgtggaggcactgctgtgattatgatgaaaatatttatcctttaaaactcgatggccacatcatactattgaaggccacgccatcgggggctcagattgtaaatcattggattttggatgcagaattgagtgttataccaatcgctttactggtttcagataacagtaaggccagaagtggagcaggtcagcctaggaattgttgccagggggaactagtctag

SEQ ID NO: 54201 - DNA, 1539 bp, Glycine max
  Peptide Sequence Number=SeqID_170979
atgaataagggtcatatgatgcatggtgtttttcactctaatggattcgggcatttgctttgtatcaatggattggaaatgggttcgaatttggctgggaaccagatcatggagttttggaaccgtttgtgctacggattgcaagcaaggaaggtgagtttgaatgacatttcacaaaagagaggaatggaactaagacttgtgaatggaatagcatacaacgagtcatggtttggccattggggttacaaatttggtcgaggatgctttggtgtaactcaatccatgtaccacaaggccatacaagcaataagaagcatgccattatacttaatcatacaccacattgccaattccaaccatggcattccactcatattctcaaggtaccaaacactttcagatcaatccctagtgacccttggtgacctattttgttacatgttagaccttaaatcgcgccttcctcgtgaaacatgcattagttcctataacacaaataccttagcagtcgagaccaattgtcgttggtcccctaaaaggattgagatggcaacaagggtaattgttgaggccttgaaaagaacaaagtttagatgggtttcaaggcaagaagttagagatgctgctcgtgcatacattggtgacacaggattgctagattttgtattgaagtcactagggaaccatgttgtaggaaactacttggttcgtcgaagcttgaaccctgtgaccaaagtcttggaatattgtttagaagacatttctaatgtgcacccttatgataatgaaggcttggttatgagtaacaaagtgaaggacaagtataagatcacaagggctcaactaatgaaggacatgctttatttgtataagtacattcttatagatccaaaaccaatgatggggtcagaatttctctcggctataccattggcagcaaggataattcttgataccaagtattttataaaagattactttggagatattccttaccaggttgaattaggctcgaatgataaactcaacctttattgtacaatttggttgagaaacaatgttggcagtgatgagtacttaaacaaagccattatgccaccccatgaatgtttcacattgaaaagaaatgctactatcaatgacttgaagctagaagttgaaaggaattttagagaaatttattgggggttaaggagttttgtagtggaatcatttcggaatttaagtgtcaataatgagacagaaatggtttttggtctaattgaagtgggtggaaaagttgtgcttgagggttggcaaggtgacataggaataaacatgattgagcaaatatgtgaaagtgatccgaacaatggtataatggattgcacttgtggaactatagaagatgatggtgagaggatggtctcgtgtgatatttgtgaaatttggcaacatagtaggtgtgttcgaattccaaatgatgaagaaattcctcatatttttttatgcaaaaagtgcgagcaagaaattgtcttgtttccttcgttgccatag

SEQ ID NO: 54202 - DNA, 132 bp, Glycine max
  Peptide Sequence Number=SeqID_170980
atgggtgctattcaaggagttcctaagatcaaagaaggttataatcctgcaacctggatgttggaagttacatcagcaggcatagaagcatctcttaaggtcaacttcaccaatgtgtacagaaactcataa

SEQ ID NO: 54203 - DNA, 213 bp, Glycine max
  Peptide Sequence Number=SeqID_170981
atggaaggagagaattcttctacaattagggccaaagaagagaaggtaaaagctgctgatgactcgcttagcaaggcaaattggctaagcgagatgcatccgcttagcgaggcatccagctcgcttagtggatgggaaaccctagaagaggacaagttagagatctgcacggccaacatgcccagcgaggatgtcgtctcttctcgtgcttag

SEQ ID NO: 54204 - DNA, 1131 bp, Glycine max
  Peptide Sequence Number=SeqID_170982
atggatggtggtgagcatgcacctggaagactagtaattgaagaaataactgaagatgtgccttctggaagctcttctttggaacaaacagtggttcaaccaaaaaaatctggtgactcctctaagagttacagtacagctaacaatggaaatccaaaaacaaatgcagacagtttagatgcattgaaaaaagatcctgaagctgtcagatcattccaaaactttatttcaaataccgatcctgacatgctggcttctttgaatgctggacaattcaaagacgtgtctccagatatgattaaaactacctctgatatggttagtaaaatgtcacctgaggaacttcaaagaatgcttgacatggcttcttcatttcaaggggacaacccattttttagaggaggttcccctgattcttctttcaaccctggatcaatgcctccaaacgtgacacctgatatgtttaaagcagcaagtgatatgataagtaaaatgccagcagacgaacttaagaggatgtttgaaatggcatcctcactgaaagggaaagaatctactccattagcagcagcagtagatgagaatgaaagaaatgtttcgcggtcaaacttaccatcatcaagtactaatggaactactgcttttggagaatcaagttctcataacgtgttttcaaatatgagaaatgcttctcagtcaaacttcccttcctcgagtaccgatctacaagaacagatgagaaaccagatgaaagatccagccatgcggaagatgtcacttccgttgtctaagattgacttttcatattctcattgtattttcttttggcaagtagtacagatgttctcatccatggttaaaaatatgagcccggaaatgatggctaacatgggtgaacaatttggtgttaagctttcaccaggagaagctgcaaaagctcatcaagccatgtcatccttatcaccggagagcttggataaaatgatgctttgggcggacaggattcaaagaggagttgaatccgcgagaaagacgaagaactggctgctagggaaacctggcatgatctttgcaatattcatgctcattttggctgtcattcttcaccggttaggcttcattggtggctag

SEQ ID NO: 54205 - DNA, 594 bp, Glycine max
  Peptide Sequence Number=SeqID_170983
atggggtgtctgctacctaggtatcaaacacaggcatcttgcattgacattcaatgtagtctgaagttttacatacatccatatcaacctgggtatactgcccccccacctcgtcctaatcctgaagaaactaccattgatataggaggtggctggacaatatctggcacacccttggacttgcgtgatcctcgactcttggcaattgcagaggcagaacgtcagttcttggatgctgaatatgatgagtatgctgcttccaacgccagtggagctgcattttgccgctcagctgctttaattttaatggcccttttactcttgcggcatgcactttctgtctcagatggtgataattctgatgatgatccatccaattttttctcccttttcttgcttcgtgccgctggatttctattaccttgctacatcatggcttgggcaatcagtattctgcagcgtcggcgacaaagacaagaggctgcagcactagcagcaacccaagttgctttcgttctacaatctgggcagcgtagaggtttacagtttgcaatagcaccaggatcacccactgtaccccaggaacaagtctaa

SEQ ID NO: 54206 - DNA, 285 bp, Glycine max
  Peptide Sequence Number=SeqID_170984
atgaagagttggatgcagagttcaaaatgcgatgactgccttggagtatacctgaatgggccagacaactaccttaagggaaaaattaacagtgctttgaaaggacttgataatactccacaacctaaatccaaggctggtgctaggtggattattgttaagtgtaataaacaaaaagaaagcactgagtgcggctataatatcatgcactggatttccacgataatcttaggaactttcaggaataattgggaaacgataattgtttatttcaaacaaagttga

SEQ ID NO: 54207 - DNA, 555 bp, Glycine max
  Peptide Sequence Number=SeqID_170985
atgggaggaatacttcaaggagtccacaaagcatggagcgtggtgcaaaagaaatacaaggagcttagaggaagcagcaatgggatcattgatggttatcataagtggctgaaggctcggatgcaagagttagattggctcccaaagctaaaggtttcaagcgaggcagaggctgaaacccccgaggagagtgaggaggtgcaagtcttaaaggaagaacttgaaagagcacaagcggtcaaggaaaaattcaagacgacggccatcaaggtccggaaagaatgcaataaactaagagatgtcaatacgaccactgctaaagctttagagcaggaaacaaagagggctcgaaaggaagaatggggccgaaacaagttccgaggggctttgtggggtagcaacaacaagcttaagcttcgaagggccgagagagaccagtcgagagtcaaaagcatgatattggaagatgagttgaaggcttgtcaatggtccaaaaggagtttgtctgagcatttgagcaagaccaacgaaaacatgtgggccatcattgactaa

SEQ ID NO: 54208 - DNA, 258 bp, Glycine max
  Peptide Sequence Number=SeqID_170986
atggtgtttcatccttctagaacaatcattcttcttctctttgttgggttcttaatatcaattcaaacagagaatgtgttaggcctgagaagttcagaaattgcactaagacacagccacaaagaccaaaggatattgctgcagaatcaagatgctctgaaggctacagaggaattatcgaacacaaagaagaattcagcaaatgcgaacaaagggcgcaatcggacaaagaagaactcggaaaattttacccactga

SEQ ID NO: 54209 - DNA, 876 bp, Glycine max
  Peptide Sequence Number=SeqID_170987
atggacctaaccaaggacacaaattctcaaacccctccacaacccaacaccaccacaaacggttccctcaagcaccaccaccaccacccaaccaccgtgtcaccgccgcaacagccaccctccacgacggttttctacaaagagtgcctcaaaaaccatgcagccagcataggtggtcacgcgcttgatgggtgcggtgaattcatgccctcttcttcatccaaccccaatgaaccgcgctcgctaacgtgcgccgcgtgcggatgccaccgtaacttccaccgccgccgcgacacacaggaaaatcatcaccgctccaactccaggcccaatttcataagcttctaccactctccgccgctgtctcgtcacgggccgggcctgagcccaactccaagcccgatgtcgagcccaagcccgagccccccgccaatctcgcatcatttcccaccttcctcccaccatttccaaggtccaataccggcccacgggcttttgggccttggaaatgaaaatcaccatcatcacatgagttttaattttaactcttcttcccactccacccaaggaaacacgagtggaaagaagaggcataggaccaagttcagccatgaacagaaacaaaaaatgtacaatttcgccgagaaattgggttggagaatgcagaaagcagaagaaggattggtgcaagatttctgcaacgagattggcgtttcaagaggggtcttcaaggtgtggatgcacaacaacaagaacacttctgccaggaacaaatcgttggaaccaggtgaaaaaatcaatggcactggtactcatagtaataataataataatcatccttacaacacaaacagcaccaacgatgacactcactga

SEQ ID NO: 54210 - DNA, 739 bp, Glycine max
  Peptide Sequence Number=SeqID_170988
atgggacatattgatgctcgtggtggtggcggcatgatgatgggtggggtgcacaccaccaccactgcacaaaagcaaaaggtagtcatggaggtttggggagaagtgaatagggtttgcttgggagagaaaaggcccccttgtgctattcgtatcattcccgaactcatcaaaaacactttgtcctcaaggaatgaacgaatgaagattagtgttgtggaagtcgagtcattttgcgatgttgatagtggcataaaaaaggaaggagtggtcaagctccttgcagcggttggggacgcgtgggggttgctgttagcaaggaggggaacaaccgcaatgggaagtggagccgacaagggtgtgggatgcgactgtatgagtgtaggaggtggaggtggagtcggcatgggcggcggagtcgacatgggtgatggagtcgacgtgggcaacagagtcgacaagggtgattggttgtgttgcatcggtacggggcatgaaggcgcagtcagtgtggaaggcggaggcgacggtggtgactgcacggaggaagaagatggctacaacaagtttggtcatggcgacctcaaggcggtcctctcgagcggtagaaagttcgacgtccgccattcgagctggtatggcaaccatgggctctcaatgaaagcaccaaaatgttacgtcttgaaattcgagaaccaagacaagtctcctaagagagaagaagagaaagaactttctg

SEQ ID NO: 54211 - DNA, 3451 bp, Glycine max
  Peptide Sequence Number=SeqID_170989
atttcatgaagagacagagggagaaacagagagctctgtttctttcatggaggttgctcctgaaagtgagagaagagatggagaaacagagttctctgctttttccatggagattactcctgaaagtgagaaaagaaatgttgaaacagattgctctgtttttatggacatccactgtgatgctcatgaagatggggtgaaaacagaggtgcccacagagagctctgtttcagaagagattgattctgacattcgtgaaggtggtatgagtaggggaatagaagaagaaggatttgttttcatgaagagtgagtcagaaaactctattattcatgaaaatagtcacgaagttggaaaagaaacagatgaacttttttccaaggaaaccaactcagatgttcatcaacatggtaaaaaaattgatgaagatgaaatagagaactttgtttacttggagaatgactctggtctccatcatagaattatgaagagggaagaagaagaagaaattgatgaacctgtttctgcggagattgattctgttgttcatgaagaattcaagaaaattgatgaaaatgaaactgggagtggtgctttaatggagaatgtctctagtgaaactgtaaatgacgatggtgagaaaatagatgaaaatgaggactctgttttcgaggaacaagagtctaatgttcatggagatgatacaaagagagaagaaaaagaagaagaaacaaatgtgcctgttttgggggacagtaactctgtaacaaccacaagtaagtgcgagtacttatcaggaaaagatataagtgggttcatggaggaaccaacaacattgaggttcagttttcgagaattttacatgggtccagatgtttcaaccgtttctgacaatgcatatgccagcacaaaaattattgccgacaaggaattttcagagtttggttcagagaaaaagcctctggctcaagcacaaacagaggactctgttcaagaagaggtttcagcaccttctacccatatccctcttcactttgagagtgagatgtttggtggatccgattcatccgatgaagattattttctttacaacgaaaactcggtgacatcggattcggagtcagagtcgtctagctcaagtggtctgaactggggcaacagcaacaaaatggatgattcaattgtataccagtttctgggtggtaaaaatggtggtgaaggatttcaacctgagattctgaagctaatgatgagagaagaaagagcagaagatgtggaggagaagcattcttcatgtgatggaaaagtttcagaatttagtgctcatggcatttattctaaagatgggtatgtggaaatggaaccttgcatgaagggtttgaagtccttaaaagcacatggttttggtggtaaagaatctaaaaaagctgtggttaaagatcaaagagaaggttcaaaaaacaaagaagaagaggtgtgtaggaatggcttgaagagaaatgaagaaattaggtgggaagatgaattgagtgattcagaatcagatgagggtgactttgaatgggagcatgatgatttagttgaacagctgaaattggaattgaaaaattcaaggcaaggaggacttgccacaattttagaagaagtggaagaggcgaacgaagaggaagaggtggtggcgtttgaagaggaagaaagagtgtccccaagagtggttgaagatccaaagccaatggaaattgaagagaagcttgaatacaaggatcaaattgatgaaattcatatagtttacaagagctatgcagagaagatgaagaaacttgatatcttgaattaccagaccatgcacgcattaggtcttcttcaactaaaagaccctctaaaattaatttcattaccaaaatccgcaatccaaggtgcaaagcctgtaatctctcagaacttgtggccacgcaaagcttcaaagaactcatcagatccattggtgaagcttgttcatgaactgcatagagatttggaattagtatatgttgggcaagtttgcctctcttgggaaatcctttgttggcaacacaagaaagcccttgagttgcaacaatatgattcacaagggtctcatagtcataggtataaccatgttgctggtgaatttcaactttttcaagtcctagttcagagattcatagagaatgagccatttcaaggccctaggctacagaactatgtcaagaaccgttgtgtgattcgcaacttgctccaagttccaggcattaaagatgatagtaaaggggatgaagaagaggatgctattgcaagtggaaagttggcagatatcatcaaggaatcaatgagggtgttctgggaatttgttcgagcagataaagattatgggaatgtgatctttaaagcttctcagcacaacagaattgatcttaaagaccctataatttctggtcttatggtggacattaaaacacaactacagaaaaaggacagaaggctcaaggacatagtgagaaccgggaattgcatagttaagaagttccaaaagcaccatgaggatcaacttgatcatgagcaattggttgctcaggaagattgtccagaaagagtgttgctaggtgcacccagcatttttgctgcttcttactccattttcaaagagctttcttctcgttttccactttttcctgcggcattgtctctggttcgtgggggtagcaaggttgagtgcagcagtgaaggtgaagtttccggcgtgaagcgttgcggtggtcggtggcggcaaacaagctttttacggatcaaacaagttgcgcctcgtgggattcccccttatggtgttgatgaaacacaaatgcttcttgcggcgcatgtttttgctttcgccgaaaaccctaacaacacaggcgcagagcgtgatccattgacgaagatggtgcagcgtctcacctaccgcaagaggcacagctatgccaccaaatccaaccaacacagggtcgtcaaaacccctggtgggaagctcgtttatcagaccaccaagaagagggccagcgggcccaagtgccccgtcactggcaagaggattcaggggtgtgacaaaaagttgttggcacaagtggatcagtacttgggtcccttaaccaagatttggggttctatcaccggcttgttcatggaggggcaactgcagataccactttacccaaaacgggctgacccggtgggaggaggattacacctcctgattccacacttgaggcctgcagagtacaagagatcaaggttacccagaaaccgtaggactgtcaaccgtgcatatggcggagttttgtctggaagtgctgtcagggagaggattatccgagctttcttagttgaagagcaaaagattgtgaagaaggtcttgaagatccagaaggcaaaggaaaagcaagcctcaaaggcttga

SEQ ID NO: 54212 - DNA, 1326 bp, Glycine max
  Peptide Sequence Number=SeqID_170990
atggaagagagaaataataatgatgctgctgagaaactggatgaagttatgctaccagggtttaggtttcatccaactgatgaggagcttgtagggttttacctcaagagaaagattcaacaacgccctttgactattgagctcatcaagcagcttgatatctacaaatttgacccttgggatcttccaaagttggccaccacaggagaaaaagagtggtatttctactgtcccagggacagaaaatacagaaacagtgcaaggcctaatagggtaactggagctgggttctggaaagctacagggactgataggcctatctactcctcagaaggttcaaagtgcattggcctcaagaaatccctagtcttttacaaaggtagagctgccaaaggagtcaaaactgattggatgatgcatgagttcaggctaccttctctcactgactcactatctccaaagtacatagacaagatcaccattcctgctaatgaatcttgggctatctgcaggatattcaagaaaaccaatgctacagctcaaagagctttgtctcactcttgggtctcttccctacctgaaacaagaacctctgatcatcatatcctaaccaaagatcaagacaacactacccagttttgttcagacaacatgtcaatgacaaagaaaactaccttagccagccagtactgttctaacaattacaatgattcacaacccttaaccactaatagcagtactctttgtcccttagatgtggcctcatgcaaatccatcattaacccattgctttacaaagcctttgatcattttcccatttcaaatgaagaccttagcactagcttgttattctcatcacccccctttgaaacatcagaaactaatcccaaatctacaataatggacgtttcttccatgctgttgaacatgtcatcctcagtgcttggagattttaacaagactacttcagaggacacaaatacaaatgcagcttcaaactttggtgtgttgcaagagcactgtagtggctacccaataccatttctacgtgagaatatgcaaaccacatttggtaaccagcaacaacaatattgtgataatatttatgcattggtaaagggtcctaatgtgaatgtgcctcgtgttgatgacccagagttggagttggagacagtagtacaacgatccattgggtttccattaagtgttactatgcctttgaatattggagatgcctggaagtcaaataatctgctttgggatacttcctcttttccttgtgatgtgccatctagttattattccacaactaagtgctatacttag

SEQ ID NO: 54213 - DNA, 201 bp, Glycine max
  Peptide Sequence Number=SeqID_170991
atgggggtttttccctttctgctttgtaatctttctgcaatgccaggtgccaacttgttggcaatgggttcctcatcagattctacttcttctaggtcaatgaggtcacctggagcagagggtgaaccaggagatgaagtatcttttggtgaggtagccatggagaagcagagcctttggagtggtttcgtgaatctctga

SEQ ID NO: 54214 - DNA, 1998 bp, Glycine max
  Peptide Sequence Number=SeqID_170992
atggcaaaaccaagttcagctaatggtaggactagaagccatgtgcagatctttatagtagttggtatgtgctgtttcttctatatattgggtgcatggcagagaagtggttttggaaagggagatagtatagcattggaaattactaagaaaggcgcagactgtaatgtagttcccaatttgagttttgattctcaccatggtggagaggttagcaaaattgatgaatttgagtcaaaatccaaggtttttgaaccttgtgatgctcgttacatcgattacactccctgccaagatcaacggcgtgctatgacttttcctagagaaaatatgaattatcgcgagaggcattgcccccctgaggaagaaaagttgcactgtatgatcccagcacccaaggggtatgtaactccttttccatggccaaagagccgtgattatgttccatatgcaaatgctccgtacaagagtcttacagttgagaaggctattcagaactggatccaatacgagggaaatgtgtttagattccctggtggtggaacccaatttcctcaaggtgcagacagatatattgatcaacttgcttctgtgatacctataaaggatgggacagttaggacagcactggacactggttgcggggttgccagttggggtgcatatctctggagcagaaatgttattgcaatgtcatttgctccaagggactctcacgaagcccaagtacaatttgctcttgaaaggggtgtacctgctgtcattggtgttctgggaaccattaaattgccttatccatctgcagcctttgacatggcacattgctctcgctgcttgattccttggggagctaatgatggaatgtatatgatggaagttgaccgagttctaagacctggtggttattgggtgctttcgggtcctccaatcaattggaagattaattacaaagcctggcagagacctaaggaggatcttgaagaagaacaaagaaagattgaagagactgctaagctcctttgctgggagaagaagtctgagaattctgaaattgccatttggcaaaaaactctagacactgaatcatgtcgtagcagacaagaagaatctagtgtaaaattctgtgaatcgacagatgctaatgatgtctggtataagaaaatggaggtctgcgttactccaagtcctaaagtttctggtgattataagccatttccagagaggctatatgccatccctcctagaattgctagtggctctgttcctggagtttcagttgagacatatcaagaagataacaaaaagtggaaaaagcatgtaaatgcttataagaaaattaacagactgctggatactggaaggtatcgcaacattatggatatgaatgctggattgggtagttttgctgctgctattcaatcatccaagttatgggtcatgaatgttgtgcctactatagctgagaaaagtacattgggtgtcatatatgagagaggacttattggcatctatcatgattggtgtgaaggcttctctacatacccaaggacatatgacctcattcatagtgatagtctctttagtctttataaggataattatagtaaattcattaaatatcaattcataagcaatatttttgggcaccaaggatgtctagctcagttggttgagcaaggtgtgcaagtcttgacgtgttggggggtttacaacaactcacgcacccatgctcaatcaacatttgttgagtctaatgtgtgcctgtacatcctatgtgatacagaagacattcttctggagatggaccggattttacgcccagaaggtgctgtaataatccgcgacgaggtcgatgtcttaattaaggtaaagaaattagttgaaggaatgagatggaatactaaaatggtggaccatgaggacggtccacttgttcctgagaagatactaattgctgtcaagcaatattgggttgcaaatgccacatctacacaataa

SEQ ID NO: 54215 - DNA, 1404 bp, Glycine max
  Peptide Sequence Number=SeqID_170993
atggccagcagcaagtgttgcatgatctctccacaacaaaaccagaatgcccccacatgttatccttcaccaatgggaatggtctatgcagacatgatggggtctctctctcttgccaccgtttcaaataatgcttcttcatcacaagaaagtaatggttatagttatggttatgcctctggggtggaaaatgcaaggagtacaaggtggagttttcctttcacgagggagtttctttcttcaaactttgaagactgcagtgatgtagtagtaggggctggggacagtaacaacaacattaatgagaaaacaaaccataataatggcaagttcagtgaagaagaaagtaaccctaatgagaacaaccctgccggtggcaaagaggtggatagtgggcactccaaactttgtgcaagagggcattggagacctgctgaagattccaagctcaaggagcttgtggctcttcatggccctcagaattggaacctcatagctgaaaaactagaaggaagatcagggaagagttgtaggctgaggtggttcaaccagttggatccaaggatcaacagaagagcattcagtgaagaagaagaagagaggctaatgcaggcacatagaatttatgggaacaaatgggccatgattgcaaggctttttcctgggagaacagataatgcagtgaagaatcactggcatgttataatggccaggaagtacagggaacaatccagtgcttacaggaggaggagaatgagccaacctgtgtacagaagagtggatcaaaatccaacctttgtttgcagcagcagagataataatgcctcaaccacagaaccagaaccagaatcatcaccttcctattatcccaatctcaatgaccgtggagtagcactcaccaataacatggctagtttcccatccttacatggagtagctgctggtgctggtggagttgttgagtttggctcaaatgtttctccactaaacatgactagaggtagagaagcagtgtcaaacaccacacatgttggcttgtgtgctcaagctcaacaacaagcaccatttgatttcttctctggtggtggaagccatgacatggtgttggagtctatgagccagatgagaagcagggaaaggaccaatgaatcttacaatcatcattgccaattatctggtttctaccctcatcatccccaacaatatttgatggcaatgcaacaacagctagacaacaacaatttttacagtttcttgaattcctcatcatcagcatcaacaacaagaactagggaaccatcatcaccatgtgttgcagaaatcagagataaagtggtgaatagtgaccccccagatggtgttccacccccattttttgacttctttggagtaggagccacatga

SEQ ID NO: 54216 - DNA, 333 bp, Glycine max
  Peptide Sequence Number=SeqID_170994
atggacgcagatcaatggaggtatgactttgcggtgtcacaagaagttcatatggattatgattatgataatcaagaagaatgtggggtgaatgaaccacatgtcgattgttcaaatgcttttaatacatctcaggtattcgctactcgagatgatgttttgcaatgggctcgaacagttgcccatgaaaatgaatttgttgcagtgattatgagatctgacacagagaccgaaataaagaattcgttagaaatgacaccgggagtaggaaatgtggttgtcccttcaggcttcgtgggaaaccagtgcatggaggggaaggttggatggtga

SEQ ID NO: 54217 - DNA, 552 bp, Glycine max
  Peptide Sequence Number=SeqID_170995
atgtcacctaaaagcaagaacaagaatattattcgtgaagtgactaggacatctttgttggcgtacgaggcaaaagctattcccatttcgttggaacttgtggttgtgttcatttatgtctctcaaacatggaaggcatggaccaaaactagagttaataactcaaattgtgaacatgtgaagcagagtttggactacattgagagaagtgcaagagtgagcaaagaagacgtagttctggtgatggaaaagctgggaatcaatgctgaattatgtgatgatggtatagaggagtttggtttaaaaattattggggaattgtttgatgatgaggatgttaacttgtcagaggtagagcaagcctttgatgtgtttgaccaaaacaaagatgggtttatagaggcaagagaattgcaaagggtcttatcctgtttggggttagggaaagacttgatggaatgtgaagaaatgattaatgcagttgatcaaaacggagatgaactaattgatcgcaatgagttttttaggattatggaacagtgttttgggtga

SEQ ID NO: 54218 - DNA, 1458 bp, Glycine max
  Peptide Sequence Number=SeqID_170996
atgtctgaggttgttactaaagactctgccataaagctgtttggtagaacaatttctctgtcacgcaacaacaacaacaacaacaacaacaacgaggtttcttcttctgctaatggtttttcttctgatgaacctgctcctcctgaagattcatcttcatcttttccacgtgaagtgagctccacaacggaacatgaagctgggagggataaggaaccatcaaggaaagaactcacctcggcacaagaagaagacgaggaggcctcacatcaaaccatagaggaaccaaaatctccaacatcatcttcatgcaatcttgagaaccccaagaccccttcaacagaaagagaaacttccatactgaaatcttccaaaaacggagaccaaagcgacgcaacaacaacaagtccatcacaggacaaaactctaaagaaaccagacaaggtgcttccatgcccacgctgcaatagcatggacacaaagttctgctactacaacaactacaacgtgaaccaaccgcgccatttctgcaagaactgccagagatattggaccgccggaggaaccatgaggaacgtgccggtgggtgcaggccgccgtaagaacaagaacactccctcttctctgtcgcattttcgccagatcatggttcctgagggccttcagaacggatcactgcacggtgctgctgttttgacctttggatcagaccctcccctttgtgactccatggcttctgtgttgagccttgctgagaaaacaacacaaaatggttttcattcacctaatggggatgaatattatgatactgttatggcttcaactttgagtgaaaggagagacaatgctactactagtactaactcacgtcaagaatcattggataatcataagagttatcatcatcatcatcatcatcatcatcatcaaggtttcactcctcaattgtgcttcccaggttcttcttcttctccttggccttatccatccaataaccctataatgactccttcagctttttgccaccctgtgccattctaccctacacaagctttctggggttccatgccaccaccctcttggagtgtaaactaccaatctgcccctggttctggtccaaattcacccaccttagggaaacactcaagagatggtgatatcttgtttagcacagacatggcagcaaacaacaacaacaacacagtgttgatcccaaagacactgagaattgatgacccaactgaagctgctaagagctcaatatggtcaacactagggatcaagaatgagaagggaaactccctcaatggaggagggcttttcaaggcatttgcatcaaagggtaacagtgatgacaagaagaaccacgcggtgatggttgaagcatccccatcaccagtgttgcaagccaaccctgcagctttgtcaaggtcccttgtcttccatgagaggacataa

SEQ ID NO: 54219 - DNA, 1125 bp, Glycine max
  Peptide Sequence Number=SeqID_170997
atggatccacaaaacatgcaaaaccaaaccatgcattttgtgctgtccactgattccaaaccaaggctaaaatggactcctgagcttcaccgacgattcattgaggctaccaatcagcttggaggtgaagatacttatattatttgtcacactgtggcatcatgtggcagaagcaactccaaagagtctcatgagggtgatggggattccaggactcactttgtaccatctgaagagccatttacaggcattcattccccttttaaatttagacttggaaaaagccaacaactagaaacctgttctgacaacaaacaagaagattacatagaaaccaagagcagcagtgatgactatgtgtctcatagggaaatggtatttcctagagcttttattgatctagttctgtgtttgcttaccagaaacatgcagattgctcaagctctccaaatgcaaatggaagtgcaaaggaaactctatgaacaaattgagaaacatttgcagctcagaattgaagctcaagggaagtatttacaatcagtgctaaagaaggcacaagaagcacttgctggatacaattcttccccagttgggatagaactcacaaaagctgaactttctcagctagttaccatcatcaacgatgcttgtccaagttctcccatctcagaactgacagaaacaagagggttgagtttaagctgtggggagaggaaaagagacagaggcactatgtgttcactggaaagttccttgacatcttctgaaagctcagggagaaaggaagagaaacagccaatggaagagattgtggaattcaagagttccaataatgtttcatttgaattgccattgatggagattcacactgaggataaagcatccaatggaggcttatcaagcaatgagggtagtgggagaaagagaagtttagcagcaacagaatctgatgatggaagctgtgttgttgagcaaccatgtgggaaaagatgtggcaacaagttgttgaggaaagtcaagttgtcagaaatgcttgacttgaacagccaatgtcagagtgacatggactcaacaggttcaaaaacattggacttaaattgcagtttaaacttgtgggaaccatga

SEQ ID NO: 54220 - DNA, 210 bp, Glycine max
  Peptide Sequence Number=SeqID_170998
atgaagaagaaggtggaaaggggagtgaatataaggggaaaacagaggaggggggctgcgcccactgatatgatactgagagaatgttgtggaaggatctggaacattgttttggttgttgcgtcgctgagttgtgctgtgttatgttatgaggtgaccggccatgtttatcttcacaattcaatcactatcttagtcattaaaacttga

SEQ ID NO: 54221 - DNA, 1632 bp, Glycine max
  Peptide Sequence Number=SeqID_170999
atggaacatccacaaattaacaaggttcataagcttcttctcacagcatttgttttgttcttccttgcaagtttgggtttgtctttccctttagagcctccaggaaataataggcaatggcacatgacttcagatgttaagcaagtggcaggaaaatcttatgactatattatagtcgggggaggcacttgtggttgtccattagctgctacactatcacaagatttctctgtgctactcatagaaagaggtagttcaccatatgggaatcccttggtgatagataggaggtactatggttttccattaattaagaccgataagtacatgtcagtggcacaaagtttcacatcagaggatggagttggcaatgtgagaggaagagttcttggaggatcatcagctataaatggagggttttacagtagagcaagtgaggaatttgtttgcaaagctggttgggacaaggaactagtcaaagaagcttatgaatgggtggaatccaaggttgtctttcctcctttttatctttcaccatggcaatctgttgctgaattcagcattcttgaagcgggagttttaccatacaatggcttcagcttggaacatatcaaaggaaccaagatttctgggagtgtgtttgatgagtttggaaagagacacacctcagctgaccttctgaatgcagggaatccaaataacctcacagtccttctaaatgccacagtcaagagtatcatctttcatcacagtagtaacaggaatgaaactagagctaagggtataaggttcatccagagtaatggcaccttggatgaaacctatgaagcatacataaacaaagccaagaattcaagttcaaagggtgatgtcattttggcagcaggtgcattaggtagccctcaacttatgatgctaagtggcatagggccaaaagaacagctgagaaggttcaacatttcaatagtgcatgaaatgaaaggggttgggcaaggaatgcaagacaacccttgcatagcagttttggtggactcaaagccacagaataggctccctgatccaccccaaattgctggcataacagatgacttcaagatcatagttgaagcatcaatacttcccctaacttccaactcatcaagggttaatgttgctgccaagatagcaatgcctacttcaaaagggatgcttgaactgaacaacactgaccctaggttgaacccttctgtgaggttcaactatctagcaagtgatgatgacatggaagaatgtgtcaagatgacaaagctacttgagagaattgcaaggtcgaagtctattgcatttttccttggagaatcaaagcaagaaaaactgacatctactgatattgatctaagaaacttctgcaagaaaaatgtgagaacaatctatcactatcatgggggttgcacggttggatcagtggttgatgagcactacaaggtttatggaataaagggattgagaatattggatggctcaactttttcagagtcaccaggcacaaacccaatggccagccttctgatgctaggaaggtatcaaggactcaagattctaagagaaaggaatgcagaatctggcttaaatgccaaagagcaccgaaaatga

SEQ ID NO: 54222 - DNA, 468 bp, Glycine max
  Peptide Sequence Number=SeqID_171000
atgaaagaacacactttatggaacccttaccgaatgcatgccaaagctagaataatgagtaaaatagaggaggtacaggaacagatgaaggtcgacataggggccatgaaagagcaaatgaccacaatgatggaagccatgatgagtatgagaaaaatgatggaggtcaacacggctacagtcattgccgcaagtatcaccactgatgtggatccgactcacccatctggcctcagtcaagggggcaaagcattgggaagtatggacgacccccattttgtgcaggttaagagcaagcattccttcccaccatatggattgcctcccaactatataccacccaatgttgcacacgctcccgatgagaatgtcgataactccgatcccacacccattgagaaccaacaaccccaatctggtcatgcacaggtccttcaacccatgggggagacacatgaattaccctga

SEQ ID NO: 54223 - DNA, 195 bp, Glycine max
  Peptide Sequence Number=SeqID_171001
atggaatcatggttacctcaaaagaaaagcgaaagggtttcaacggagaacaatggcggtttgtggtggctaatggtggctatgggtgatggaaaaagtgcttgggacattagaaatggctttggaagaaagaaagaagaagaaatgacgtttttcttaagctacatgaaagcaaaggctgaaatgctcaagtga

SEQ ID NO: 54224 - DNA, 763 bp, Glycine max
  Peptide Sequence Number=SeqID_171002
atggatgggttttcgcccgtcgctgccggacagcctgccggccatcggcgaagcgcggcacacggcacgggtggtttatgctttcggccacgggcatctggggctgacgcaatcggcgggcacggcccgcatcgtcgccgatcttctgacggggcaaaaacccgccatcgatacaagggcattttcgccgcaaccattctggccggtgcggccgaaggccccgtgatcgccacgacagaagcgttgagtttctggggtggtgtcgatcccgccaccggcagggtgatcgatgtgcatcacccgctgcacggcatctgtctcaccggcggcgtgctgttcatgccgaccagccgcggctcgtgcacggggtcgggcgtgttgctcgatctcatcctcaccggccgcgcgccgtccgcactggttttctgcgaggcggaagatgtgctgacgctgggcgcacttgtggcggcggaaatgttcgaccgggcgctgccggtcatccgcctcgacgccgaaaatttcgcccgcttttcccgggccactcatgcccgcattgatggaaacagcatcgaggccgatggcctgtcgcttgccatcgcgccgccggcaattgcccatctcgacctcgaggatgaagaccgggcgatgctcgagggtcgggatggcattgccgtgcgtcaggccatgcgcatcatcgtcgccatggcggcccagcagggggcgtctgcgctcatcgatatcacgcagggtcacatcgacggct

SEQ ID NO: 54225 - DNA, 439 bp, Glycine max
  Peptide Sequence Number=SeqID_171003
atgccgattgtgcctccatgtcctacacccgtgcaaccattccttgcacccttgccggctccacttcccatgcctgctgcctacctcctcgatctctgccacactcgtgccactatttcttgcaacaagctcttcagtactgttgctcagtatggtcgtgcaacaactcctaatgacaaggctctcaaagggagaaacatgacgttgtttgagataggaactgaatactatggacctaccatggttgcatgcaagcgccaaccagttatgtttgcattatggacggctactgacccagaggagccttgccgaaacaaacattgggatcctggtaatagcctatataaggatgcaacaataaggcaattggggaatgaatttgagtatgaatgctttagagtagaaggaagccccttgttctcgaaacaaggctcacaag

SEQ ID NO: 54226 - DNA, 402 bp, Glycine max
  Peptide Sequence Number=SeqID_171004
atgaccctagactataaagccacttacatacttcttttgtgggacaaagaatctgttgaaaagagctatggtgtgagcatttcattttacagagctccttatttggatgtggatgtggtccaagggaagagaattctgaggctggaaaaggtaggtgagaatggtgacgcatggaagagagctgatgtgctgtctttcaaaacagggcattggtggagtcatcaaggatctcttcaagggtgggattatgtagaattgggaggcaagtactacccagatatggatggcttagcagctttggaaagtggtatgaaaacatgggctaattgggtggacaacaatattgatagaagcaaaaccagggtgttctttcaggcaatttctcccacacactacaagtag

SEQ ID NO: 54227 - DNA, 132 bp, Glycine max
  Peptide Sequence Number=SeqID_171005
atggcgacaacagtgaacaaaaagcttgatcggtgggttatgatgtggaagacagacatgaagaggagacgattgatggtggtggtttcttggttcacgatcggagttgaccggaaaaaggaacaagattga

SEQ ID NO: 54228 - DNA, 2247 bp, Glycine max
  Peptide Sequence Number=SeqID_171006
atgtcgaaaactccgaaggagaaggaaacggaggagcctctgccagaccacctccgctgcgggcgcacggacgggcggcaatggcgttgccggcggcgagtgaaggagaatctgaagctctgcgagattcactacctccaaggtcgccaccgccagtacaaggagaaggttcccgagtcgctgaagcttcagcgcaagcgcaaatctaacaacaacaacaacaacaacaacgaggaagaagaagaagaagaagaagaagagaaaccagagcctgataagaagaatgttctcgacgacaatgtcgaatctagggcacggagaacctcgagaatcgtgaagaagaagcgcatgctttctgaggattccgatgcttcagcttcttctcctccggcgaggaagaaggcgctgaagcagggcgatatgcagttggagctcttgaggatggtgctgaagagagaggctgagaagaacaaaaacaagagcaagagcaagaacaagaagaacaataacaaaaagaagaataagaagaaggaaaagaggaggaaggaggaaaaagaggaattgtgttacactaaagaagagttgagaagagaattgccaaatggagtaatggaaatctctccggcttcaccgacgcgtgattacaacaatgtaggttcgcattgtgatgtcaaagttggtgttgatagtaaaactgttactccgcgttactttaggtccaagaatgttgatagagtccccgcggggaagttgcagattgtgccgtatggatcaaacttgaaaaagggtaagaggaagaagtgtcattggtgccagagaagtgagtctgggaatctcattcaatgttcgagctgtcagagggagttcttctgcatggattgcgttaaagagcggtattttgacgctgaaaatgaaattaagaaggcatgtccagtttgtcgtggaacttgcccttgtaagtattgctctgcaagtcaatgtaaagacagtgaaagtaaggaatgtttgactggtaagagcagagttgatagaatattgcattttcattatttgatctgcatgctccttccagtactaaagcaaataagtgaagatcagaatattgagctagaaacagaagtaaaaattaaagggaaaaatatttctgatattcaaatcaagcaggttgaatttggatgcagtgagaaaaactattgcaatcactgcaaaacacccattttggatctccatagaagctgtcctagttgttcatatagcctatgctcaagttgttgtcaggaattaagtcaaggaaaagcttctggagcaatgaactcatccgtgttcaagcgacctgataaaatgaaaccttgcagtgctagtgagaaccatactttggaggagagagccacatctattggcaatttaactgatacttcagtattgcctgagtggacaaatggtaatggcattgatagtctatcatgccctcctacagagcttggtggttgtggtaaaagccaccttgagttgagatctgttttcccttccagttggatcaaagagatggaagcgaaggcagaagaaattgtttgcagctatgactttcctgaaacttcagataaaagttcaagttgctcattgtgttttgacactgatcatggtactaacagatataagcagttgcaagaagcagctctaagagaagattccaatgataattacttgttttgtcccacagtgatggacatcagtggtgataactttgagcactttcagaaacactggggaaaaggccatcctatagttgtccaagatgcgctccgaagtacctcaaacctcagttgggatccactgaccatgttctgtacttatcttgagcagagcattacaagatatgagaacaataaaaacttgcttgaatcctgtttggattggtgggaggtggaaattaacattaagcagtactttactgggtctgtcaagcgtcgtcctcagagaaacacttgggatgagatgctgaaactaaaagggtggctttcttcccaaatatttaaagagcagtttccagctcattttgctgaggtaattgatgctctaccagttcaagaatacatgcatcccctctgcggtcttctgaatttagctgcaaatttgccacatgggagtgcaaaacatgacattgggccatatgtctacatttcttatggctctgctgacaaagaaactgattcagtgacaaagctctgctatgactcatatgatgtg

SEQ ID NO: 54229 - DNA, 198 bp, Glycine max
  Peptide Sequence Number=SeqID_171007
atgggtgtgcaaatagcaaccaggcccacttgggccttccagggggttccaatagaaggcgaaaatccacgccgaagcgcttccgtaacgcttccgagacgtttccatgagcgatttcgtgaacattcttcaccgttctttaccgttcttcatcgttcttcgttcgttcttcgtcgttcttcggtcttcaaccagtaa

SEQ ID NO: 54230 - DNA, 488 bp, Glycine max
  Peptide Sequence Number=SeqID_171008
atgggttatcagccggataaaaatcgttaccagacaatgcagtatcgtcgctgcggtcaaagcgggctcaggttgcccgtcatatcgctgggtctgtggcataactttggggacgccacgcgtctcgaaaacagccgtcaacttttacagcgcgccttcgacctgggtattacgcatttcgaccttgccaataactatggtcctccaccggggtcggccgagcgtaattttgggcgtattttgcaggaggattttctgccctggcgcgacgagctgattatctcgacgaaagcgggatataccatgtgggagggcccctacggcgactggggatcgcgcaaatatctgctggcaagcctggatcaaagcctgaaacgcatggagctggagtatgtcgatatcttctatcatcaccgtcctgacccggaaaccccgctgactgaaaccatgaaagcgcttgaccatctggtgcgccagggaaaagcgct

SEQ ID NO: 54231 - DNA, 387 bp, Glycine max
  Peptide Sequence Number=SeqID_171009
atgggtgcttgctttaatggaaaagtgtcacataaaaaagcagaagtagagccactggaagtcacaaaacctgtttacagagatgagttaacaaaaaaacaaccgccaaggaagacagtgaagaaaactgtccggtttgcagaatcagaacctaccattttgggagaagatagtgaaaaagagtttgagaaaacaaggtggggtagtggtaatgaagtgggagaaaaagaagggatgagagtgaggattaaattgacaaaggaagaagctgcacggttgctatcaaaatgcaacaatggaggaattctccaattcaaggatgttgctcatgagcttgtgctgatcccggttaaccgagttagcgttgcgcccgatgcacaatgctaa

SEQ ID NO: 54232 - DNA, 1929 bp, Glycine max
  Peptide Sequence Number=SeqID_171010
atggagaatctaatctctttggtcaacaaaatccagagagcttgcaccgccttaggtgaccacggcgaaaacagtgcactccccacactatgggactctctccccgccatcgccgtcgtcggaggccaggtcacacctccgatccctctctctctcttactctattctcttttcatctcccaacgaatcataacgtcgtgtttctctcactttcagagctcaggaaagtcctccgtcttggagagcgttgtcggcaaagatttcttacctcgtggatcaggtattgttacgcgacgaccgctcgtgttgcagcttcacaagattgaagagggaagcagagagtacgcggagttcctccacctcccgaggaagaggttcaccgattttgttgctgtgaggaaggagattcaagacgaaactgatagagagactggacgaaccaaacaaatttctactgttcccattcatcttagtatatactctcccaatgttgttaacttgacactcgttgatcttcctgggcttacgaaagtagctgttgagggtcaaccggatagtattgtgaaagacattgaggatatggttcgctcctacattgagaagccgaactgtataattttggccatttcaccagccaatcaagatcttgcaacatctgatgcaattaaaatttcccgtgaagtggaccctactggagataggaccattggagttttgacaaagattgatcttatggacaagggtactgatgctgttgatatattggaaggaagagcatataggttaaagtttccctggattggtgttgtgaatagatcacaacaagacataaacaagaatgttgacatgattgctgctaggcgtagagaacgtgagtacttcaatagtacccctgaatataaacaccttgcgaacagaatgggttccgagcatctggcgaagatgctctcaaagcatttggagacagtaatcaagtccaaaattcctggcattcaatctctaattaacaaaacaattgctgaacttgaagctgaactaactcgtttaggaaagcctgtagcagctgatgctgggggaaagttgtatgcaatcatggaaatatgccgctcatttgatcaaatatttaaagaccatcttgatggcgtgcggcctggaggtgataaaatttataatgtctttgacaatcagctccccgctgctttaaaaaggttgcagtttgataagcagctttcaatggaaaatataaggaaacttattactgaagctgatgggtatcagcctcatcttatagctccagaacaaggatatcgtcgtctaattgaatcttctctaataactattaggggccctgctgaggcagctgttgatgcggttcactcgctgttaaaggacttggttcacaaagctatcagtgagactttgttgtgtttggacttgaagcagtatcctggtctccgggttgaggttggggctgctgctgttgattcactagaaagaatgagggatgaaagcaaaagagcaacactgcagctagttgatatggagtgtggctatctgactgttgatttctttcggaagcttcctcaagatgttgataagggtggcaatcccacacattcaatttttgatagatataatgattcatatctaaggcgaattggaaccacaattttgtcatatgtcaatatggtctgtgctacactgcggaattcaattcccaagtccatcgtctattgtcaagtgcgggaggcaaaacgaagtctacttgatcacttttttaccgagctaggcaaaatggagaccaagcgtctgtcatcgttattgaatgaggatcctgcaattatggaacgacgtagtgcgctcgcaaagagactagagttataccggagtgcacaagctgaaatagatgcagttgcttggtctaagtag

SEQ ID NO: 54233 - DNA, 225 bp, Glycine max
  Peptide Sequence Number=SeqID_171011
atggtgccaaattttacagtaacaaaaaggaaagttcgaagaaatctaagaggtaaatgtttgggaggaatattacagtcatcgctctatcgaggtgacaaaagcaagagctttaaggaagaggagggtcaaaacataaacttggtggttggcttagctagacttgaagccgcacaatgctgtttgttaacttatttgggagaaatcccgagtgttgcttcctga

SEQ ID NO: 54234 - DNA, 853 bp, Glycine max
  Peptide Sequence Number=SeqID_171012
attcacgccgccgaggaagcatcactgcgattgcacctccaattccgacgccgccgccgttccctacctcaacggcggccgcactgaaatgctcgagcccagtcctgttccggcgccggcggttttgacggagcggcgaatggggtcgtccatgatggaggaactggttccggagattacgacgcacgcgctcagttacttggattatccgagtctctgtcgcctctccatgacaaattcgttgatgcgaaaggctgcgaatgatgataatgcttggaaggccctttatcacaaggacttcacattggagcaagatagtatcacacccactaatgggtggaaggcttactatgctgcaacaagagcaattgtgaatattaatacagaattcttcaacattgttagagataagtctcttcaagcaatgagtcatttttggctgaatgcagattatgtcaagtgcattcatgcctcaggtttcttttccgggaaccacctcccttcccgttctcgtttcctacttttctgttctgttaaggtggggcgtgttccttgtgctggagagatctcatctagcttgtacaatgcagttatgcagggttggcaacttgtattcaactgggagcaaggattgaactttcaggttcgagatgtatgtgctcgcgtcttgacagacatggcttgggttaccatgaaaacatatgttgacatggatacagggccattcaatttctgtggatggggatgtggaccatcagattgtgcatggataatagtgagagatgatgatacattgtttatgtctgaaactggttacaaaaggtggttttatttgcagaagcaagatgcttga

SEQ ID NO: 54235 - DNA, 351 bp, Glycine max
  Peptide Sequence Number=SeqID_171013
atgtcatcaaaggttttgtcaagacagggccttccaagcattatcatcattcgcagcctttcgcatcaacgaatttgtcatggagaggcgacagagactcggataatccaagtaactgagcgcgtgcgtcgtaatctccggaaccagttcctccatcatggacgaccccattcgccgctccgtcaaaaccgccggcgccggaacaggactgggctcgagcatttcagtgcggccgccgttgaggtagggaacggcggcggcgtcggaattggaggtgcaatcgcagtgatgcttcctcggcggcgtgaatctccggggaagggagaaggaggatcggaggagagagaatag

SEQ ID NO: 54236 - DNA, 489 bp, Glycine max
  Peptide Sequence Number=SeqID_171014
atgacaatatctgttttcttagttccttcgacgcctcagttgtgtaactacagaatctcatggccaattcccacttacccttctctttcttcttctaagttaactgtttcactgtgctctccttcccctccaacatctgttatcgaagagggtccttctccttcaccagaattgaccagtggttgtaaggcgtgtggaagagaagaagtggagcaaggatgcaatggtgaaggaaggattcagggtgggattgctacagtaccaggctttgggtggtggcctataaaggcttacaggccatgccctgcatttgtggcatctggtggtaggtataggcgccaaggacaaagcatggacgaggttgtctccggaagtggtaaaactaaaacacccattgccactgactccaacacaaggtacacctgcaacaacagtactattcactgtcttgtattttcaattcctggggattcaattttcactttttga

SEQ ID NO: 54237 - DNA, 621 bp, Glycine max
  Peptide Sequence Number=SeqID_171015
atgggtgctgatgagaaccatgatcaagaccctcttaggaaggaagagtttgaggccaagttcaagcaggtttctgaggcctatgatgtgctcagtgaccctaagaagcgccagttgtatgacttttacggtgatcactatcccattgagtctaatagcttcagcaaagaaaatggcgatgggaatatgaggcttgcagtggtgagtgaatgcagcttgatttgtatccttgaagacctttacaagggttgcaaaaagaaagtgttaaagtctgcaagaagaaatcttgaagatagacataaaacctggttggagaaagggcacaaaaatcacttttcctgggaaatgcaacaaagaacaatgaggcctcatgctattttcaagagggaaagaaatgatcttgtagtgatccagaagatattacttgtagatgctctcaaaggaaagactctcaacttgactaccttggatggaagagatctcacaatccaagtcacagatattgtaaaatcaggctatgagctggtggtcccaaatgagggtgcatgcccatcccaaagaaacctggcaagaaaggaaatctcagaatcaagtttgatgttatgtttccatcaaggatga

SEQ ID NO: 54238 - DNA, 282 bp, Glycine max
  Peptide Sequence Number=SeqID_171016
atggaagcaaggaacgaacctagccccaccacaccctccacaaactggggagcatcggtggcgtcgagcaagttgagtttgtgggttgatgtgcttaagcttctgggattatccatgtggttaagtttatataatggacagcgagtgagagatgaggggccttacgataaatgtctggctgaaaattcgcctgcctccttatccaaaagtgcttcaagtccagacaagaagtatgggaattttcttcagctcgaagtaaaagttcaacgaatgaacttatga

SEQ ID NO: 54239 - DNA, 984 bp, Glycine max
  Peptide Sequence Number=SeqID_171017
atggagaataataatcagtcgttttggcaattcagtgaccagctgaggttacaggcatctaatttggcgaacctttctctaaacgattcgatttggagcaacagttacatctccaagaggcgtgatgaaaggattaattttgacatcaaagttgggggtgagatcaactctttcaagtcaaaggagccagcttgtgattacaatgaaaacatgaatggatctcttcttgccgtgccttacaacaacaataacattttgggtgttggtggagttggtctcaatggaggcttcaacaaaggaatttactccaagcctggttttgccaatcttaacaacaatattaacctgaatatcaatcctaagggacacaagttcaaggatgaagatgagctttttcacccatccaaaccttccaagaaaaacaacaacatcaacaaaaagcatgggggcaacaccaataacgatgataacagcaaggattccaaggctgctggcgacaagagattcaaaacgctgcccccagcagagtctcttcctaggaatgaaaccattggaggctacatctttgtttgcaacaatgataccatggctgagaatctcaagagacaactctttggtctgcctccacgatacagagattctgttcgggccattactccggggttgccccttttcctttacaactattccactcaccaactccatggaatctttgaggctgcaagttttggagggtcaaatattgatccatcagcttgggaggataagaagtgccctggtgaatctcgtttccccgctcaggtacgagtgataactaggaaaacttgtgaaccactggaggaggattccttcaggccaatccttcaccactatgatggtcccaagttccgtcttgagctgaatgtgcccgaggcgttgtctctgctggatatttttgcagaacaagacaccttcagtgacacttttaaggctttgccggcataa

SEQ ID NO: 54240 - DNA, 708 bp, Glycine max
  Peptide Sequence Number=SeqID_171018
atggggtgttgttgcaccaaacagcgagtcgaccaaaaagatccagcagttcttgcttcccaaacctattttaatctttctgaaattgaagcattgtatgatctgttcaagaaattaagcagctccatcatcgacgacggggttatcagcaaagaagagtttcagcttggcttatttggaagcagcgagaaacggagcctctttgccgacagggtcttcgaattatttgactcaaaaaataatggggtgatagaatttggagagttcgttcaagctctgagcgtcttccacccagcagcgccacaaacacaaaaagcagattttgcatttcgactctatgatatatgtcaaagaggctttattcaacgtcacgaggtaagagagatgatactggcactactaaatgagtcgaatttggttctgtctcatgagataattgaggtcataattgataagacctttgaagaagcagactcaaaaggagacggaaggattgatccagaggagtggcaagaatttgtagctcgaaatccatccttattattgaggaacatgacaattccctatttgaaggatcttactacacagtttcatagtttcaagctaacatcaggcattgaagactgtacaagcagaagcagcacatcccctgagaaagataacatcttagaattgaaggacaatttcaacggtgtcagcattaattaa

SEQ ID NO: 54241 - DNA, 609 bp, Glycine max
  Peptide Sequence Number=SeqID_171019
atggcgaaactttgcattggagaaggaaaattgaaaaatcgtctttacaattataatcgggacgccttggtttggttacttaacatgactaacaactacaacagatccatcagttacggcaatggcaaccctgcaaccggctttggcgtaaacgtgatgggtgaaaaagtgcaacactttgacgcgccccgccatctccaacttagactcgatttccaaagtgggctcaaccctaagcccatagttgaagcccactccgtcgccgttggccaatgtggggcccattcgaggcggcgccgagagggggaaggactggacggagaaggtggcggccatgtactgcgtccggcccgcgtcgatctcgccggcggggatgaacatgaagccgacctggctgccggagtagatgagctggagggagctgtcgtagtgcgagaatgcggcgcggttagggtttctaacggaggcgtactgggagaaggtgaagttgacggtgccgttagcgacggagaaggaggggagctggacggcgttaacggcaattttggggtcctggggtttgaagatggtgtagtagacaatgaggatgacgatgacgatgaagattag

SEQ ID NO: 54242 - DNA, 1710 bp, Glycine max
  Peptide Sequence Number=SeqID_171020
atgtcaattgctttgagttcagtttgcaaagagaaggtaaactgggaagggcaaccaggacattgttctggtgaaccaatcttgatttacctcactgtggatggtgctgtgaccgcaatgcgtgtgttggagtctgattccatcgcttcggtgaaactgaggattcaacagtgcaaaggcttcgtggtgaagaagcagaagctggttttcagtggcagagagctagctcgcaatggcaccctcattaaggaatatggtgtcactgatggtaatgttcttcacttggttcttcggctctctgatcttctcttcattgttgtgaggaccgtctctgggaaggagttcgagttccacatcgacagacaccgaaatgtggggtatctgaagcaacgcattagaaagaacaaaggggaatgtttcattgatcttgaggatgatgatcaagagtttttctgcaatgatcagaagctcgatgacgatagtctcttccatgacatatgcaagagtggtgatgatgtgattcatttgataattaagaaatccgttaaggttaggaccacaccaattcacaaggacttgaatctctcggtggtggcaccaggtgaaagtgtgaaacataaaagggacaaacatgttcagatagcaaaggtgccacctgatgtaggtttctggttggagccaattattgtgaatcctaagatcattttttttcctttcctttgggacatggtaaagtccacatttgaaggtttgaagaaaggaaatcaccccgttaggtcctctgagggcactggagggacatacttgatgcaagattcaacaggccaggagcatgtttcggttttcaagcccatggatgaggaaccaatggctgtgaacaacccaaaaggtcttccgaattcatccaatggtgaaggtttgaaaagagggacaaaggttggagaaggagcctttagggaagttgcagcttatttattggatcatcccaagagtggaccgcgtttggcgtcaggtgaagctgtaggattctctggtgttccccctactgttatggtgcagtgcttgcaccaagaatttaaccacccaaatgggtttgcttcctcctcaaaacatgttaagattgggtcactgcagaagttcattagtaatgatggtaattgtgaggactatggaccctcggctttcccagtggaggaggtgcataagattgctgtacttgatataagattggctaatgcagacaggcatgctgggaatatattgatcaaaaaggaggcagatggccagataaagctcattcctattgatcatggctattgtctaccagataaatttgaagattgcacatttgattggctttactggccacaagtacgtcagccttactctcctgagactgtgaattatataaattctctggatgctgaaaaagacttggaacttttgaaatgttatggatgggatattccacttgagtgtgcaagaacacttcgcatttccacaatgttgctgaagaaaggggttgaaagaggccttacaccctatgcaattggaagcattatgtgtcgggaaaatttgaacaaggaatctgtcattgaagaaattattggggaagcccaagattccttgcttcctggcatggaggaatcagcatttcttgaagccatctcccaaatcatggattaccaccttgataagcttgcaaactag

SEQ ID NO: 54243 - DNA, 660 bp, Glycine max
  Peptide Sequence Number=SeqID_171021
atggccgccggagccgcgccggtaccggcgccgaggccgaagcggcctcggcctccgtcggggcgcaccaacctcgcctcctgcgtggtggccaccatcttcctaatcttcatcgtcatcgtcatcctcattgtctactacaccatcttcaaaccccaggaccccaaaattgccgttaacgccgtccagctcccctccttctccgtcgctaacggcaccgtcaacttcaccttctcccagtacgcctccgttagaaaccctaaccgcgccgcattctcgcactacgacagctccctccagctcatctactccggcagccaggtcggcttcatgttcatccccgccggcgagatcgacgcgggccggacgcagtacatggccgccaccttctccgtccagtccttccccctctcggcgccgcctcgaatgggccccacattggccaacggcgacggagtgggcttcaactatgggcttagggttgagcccactttggaaatcgagtctaagttggagatggcggggcgcgtcaaagtgttgcactttttcacccatcacgtttacgccaaagccggttgcagggttgccattgccgtaactgatggatctgtcttagaacaagcggaacgtcgagaggggaatgagacatttaatttataa

SEQ ID NO: 54244 - DNA, 706 bp, Glycine max
  Peptide Sequence Number=SeqID_171022
gctctgtaagaagcgcccgtcaacggtgcgggcgcccctcgatcctaccccgcgcaaccgagtttccccgcgaacgcagcacgtactgcaggatgccgccgttgcggtagtagtcggcctcaccgggggtgtcgatgcggacgaccgcgtcgaactcgaccggctgcttgccctcgggcgagtactcgctcggggtggccgtgaccttgacggtcttcggggtgaccccgttgttgagctcctcgagccccgtgatcgagacgatctcggtgccgtcgagacccagcgactcccagctctcacccgcggggaactgcagcgggacgacacccatgccgatcaggttcgagcggtggatgcgctcgaagctctcggtgatgaccgccttgacgcccagcaggctcgtgcccttggccgcccagtcgcgcgacgagccggagccatactccttgccgccgaacacgacgagcggggtgccctgctcggcgtagttcatgcacgcgtcgtagatgtacgactgcgggccgcccggctgcgtgaagtctcgggtgtagccaccctcgacgacctggccgtcgttcacggccgagaccatgaggttcttcagacggatgttcgcgaacgtgccgcggatcatgacctcgtggttgccacgacgcgaaccgaaggagttgaagtccttgcggtcgacgccgtgctcggtgag

SEQ ID NO: 54245 - DNA, 489 bp, Glycine max
  Peptide Sequence Number=SeqID_171023
atgcggttatccgcacgctcgatgagtgataaatgcgcagagacaaattctgcgccctttatcattcaggagcagcgagtcgagtggaacaacaagttgggtggtaaacacgcagagacagattatgcgccctttatcattcaggagcagcgagtcgagtggaacaacaagttgggtggtaaacgcgcagagacagattctgcgccctttgtcattcaggagcagcgagtcgagtggttccgctggcagggaggttcactggccaaatggtgtttcgctcgaacgaaattagtgtcttatctttacttcccttttatctccaataaaagacaagtaaagaggggcaactgtcataccctaatttcgtccggagaccatccgttgttgggatgcgaccctcatttaaccacttcgaggtatttggcacccatcgttaggaaatttgtgaagttccgagacatgccggaagccaaaagaaaagcgttgtag

SEQ ID NO: 54246 - DNA, 542 bp, Glycine max
  Peptide Sequence Number=SeqID_171024
atggaggcggatttcgtcacgaatgatatgctcacactcacgcaggacgctttttatgccaacgataatgatgatgcagctgttgaaggggaaagatgtggaatatgtatggatatggttattgacaggggacttctggattgctgtcagcactggttctgctttgtatgcattgacaactgggctaccatcactaatctttgcccactttgccagaatgagtttcagttaatcacttgtgttccagtatatgataccattggaaacaataaagttgaagatgattcattcttcagagatgatgactggtccattgaagagaagaataacacactgtcatttccctcttactacattgatgaaaatgcagttatttgcttggatggtgatggctgcaaggttcgtaatggtttggctactattgaaggagattctgatctcgacacatcaatagcatgtgattcatgtgacatatggtatcatgccttctgtgtgggatttgatactgaaggtacatcggacagtacatggttatgccccag

SEQ ID NO: 54247 - DNA, 114 bp, Glycine max
  Peptide Sequence Number=SeqID_171025
atgtcgaaacaccttgggtttgccccaattgggatacccaaatatagaaaaggtatggccaatagcctacgtagggctactattactcagtatggatatagaagcggattttag

SEQ ID NO: 54248 - DNA, 165 bp, Glycine max
  Peptide Sequence Number=SeqID_171026
atggaactccgaagcgaactccgaggcacgtaccgacccaaattcttctcctacgaaggtcacccacagtgctctgcaaatcctcttccgcgactaacgaaacccggttcggacgatttcgtgagccgggttcttgaaggaaaacccgagccaagtgcaacccaa

SEQ ID NO: 54249 - DNA, 1307 bp, Glycine max
  Peptide Sequence Number=SeqID_171027
atggggatcaaacctccacatggtgttcttcttgagggccctcctggatgtggcaagaccttggtagccaaggctattgctggtgaagctggcgttccattttaccaaatggccggatcagaatttgtggaagttttagttggtgttggttctgcacgtattagggatttatttaagagagccaaggagaacacagatcacctgtataatgcagccacccaggaaagggaaactacattgaaccaattgttgatagagcttgatggttttgatactggaaagggtgtcatatttctagccgccacaaatcgtaaggatttgttagatccagcacttcttcgtccaggtcgcttcgatcgaaagatcaggattcgcccacctagtgccaaaggaagacatgatattttgaaaatccattctagtaaagtaaaaatgtcagagtctgtcgatttatccagctatgcacagaacctacctgcgagattggctcaattggtccaagaggcagctcttgtggctgttaggaaacagcacaactcaattcttcagtcagatatggatgatgcagttgacagacttacagttggacctaaacgtgttggaatagaattaggttaccaagggcaatgtcgtagagctactactgaattgggacttgcattaacttctcatctgcttcggcgatatgagcatgcaaaagttgaatgctgtgatcgcatctcaatagtacctcgtggtcagtttgagcctttgtcgcctaaacaggttctgcttggaggtagagctgctgaggaggtcatctatggacgtgacacatcaaaagcctcagttgattaccttgcagatgcatcctggcttgcacgcaaaatattaaccatatggaatttggagaatccaatggtcatacatggtgaaccaccaccttggaggaagtcagttaaatttgttggtccaaggctggattttgaagggtctctttatgatgactacaacttgatcgaacccccactaaattttaagatggatgatcaagttgcacaaaggactgaagagttgatacgggacatgtacagaaagacggtgtctctccttaggaggcaccatgctgctttgctcaaaactattaaggttcttctcgatcagaaggagatcagtggtgaggaaatagagttcattctgaacaaataccctccacaaacacctatatatcttttggaagaggaatatgctggtaaccttccattcaccagagaacaagtgcatgatttggagtatgccttaaaaattcaatcaaacgaagaaaccat

SEQ ID NO: 54250 - DNA, 366 bp, Glycine max
  Peptide Sequence Number=SeqID_171028
atgtctaaggatggtattctttactctgaggtgcaaaatatacccatcgttattaatcagtctttattcttctcattgactaaattacccagtcaaggtgttccttttgagggcactattttttatgactggaagtttgattactcgagtcgtgatgctcgccgtatggtctgtaatgaccaggctgatatgaccggcagtttgcttgctgggtcattaacttttgactgtcgcatcatgcactacatcattgttcacattttgttaccccgttcgtctaacctggctcaagcctccgaggggggacttgattttgatatgggctttccttaccggtcattagatcgactgggctcacttggttag

SEQ ID NO: 54251 - DNA, 456 bp, Glycine max
  Peptide Sequence Number=SeqID_171029
atggatgactcctcgaccattgaagaaactgaggtaaattctgaatttgaagaagttttggaagcatttaatgaaatgcatgaagaagctcaaaggcttgctattttaaacaaaaagttgaaaagcgatctaaaactgcatatcactaaattgacttcaacacaaagtgagttggataaactaagacaagaaaatgaaaaacttgtttcaagctataaagccactggttgtgtttgtgcatctacttttcttaatatggatgattacaaatctttgcaaactgagtttgaaaaatttaaaaaggatcactatgcaaaacaaatgaagtttcaaactgacatttcctatcttaaatatttgtttagaaaattgaacaaaggaaagagtgatcttaatcagttgctcagtgtgcaaaagcatactaccgataagactagtttggggtataacaagtaa

SEQ ID NO: 54252 - DNA, 186 bp, Glycine max
  Peptide Sequence Number=SeqID_171030
atgagagtgaagagcatctcaagaaggattgccctaaatagacgaagaaaaagagacatgggagatcagaggagtcataatggtgatgctatgttgtctcagaagggcaacaacaaggcctgcaaagggataggtattggagctgttacacctaaacttgcagaaggagccataagaaccctgtaa

SEQ ID NO: 54253 - DNA, 381 bp, Glycine max
  Peptide Sequence Number=SeqID_171031
atgtctttctcaagggatttcgtctctggtaatcgattaccaaagtatgtaatcgattaccagtgcctaaaaatgaattacacagcctttgcacattggaaactaaaaattacactaggtaatcgattacacctaaatggtaatcgattaccattgccctatcacccggggccatttagcatcctgtctccatttttaacccctgtaatcgatttcccacaaatggtaatcgattaccagaggctaatttccagataccacccaagatacatagctggccagccaccacacaagcctccttgcttcgtggactttgttcttttattggttgactgccaagagctcgccggtttaggtacgtcacaagttctcactgactga

SEQ ID NO: 54254 - DNA, 315 bp, Glycine max
  Peptide Sequence Number=SeqID_171032
atggctcatgagaaccctagggccttcccttggatctctagccaatctacttggagtcttctacccaatgcccttacgggtgtatactttgtcggtaagtacctatggtttttcatgaggaagaatgttggtacttggggcatatcactcagttgggctaagctcaatagttgggctaagcgcagcttcagcgtgcttagcgcgaaggagaatctggcaaagcatcagcatcaaggtcgtgcactaagcgcgagaccatctaggcctagtcttacaagagggatctgcagacgaagcttagacaaattaggctaa

SEQ ID NO: 54255 - DNA, 276 bp, Glycine max
  Peptide Sequence Number=SeqID_171033
atggatgctcaatttgcaagaatggatacacgcatcaccaagcttgaggaggatgattgtcatcatcaaaaagggggagattgcggaagcgaagcttccaagcctattttgatgatgccaaagactcaactcaagaatcaagagtcaagcaagtttcaagaatcaaagagttgttcaatcaagaatcaagatccaagtaaagaatcaagagaagactcaagatatgcaagaaccattaagataagtattaaaagagttttccaaagtattgaatag

SEQ ID NO: 54256 - DNA, 231 bp, Glycine max
  Peptide Sequence Number=SeqID_171034
atggatgtcgttacggaatccgtaaagtttcatgagatttcggaaagaaaacagccacaaacacaaaaatggggggatgaacttatcaagataggggtaaaaatcgagtcgaagagcttctataacacttccgtaagtgattctgtggaaattcttcatcgttcttcaccgttcttcgttccttcttcgtcgttcttcagtcttcaactgttttcttttcttccgctttaa

SEQ ID NO: 54257 - DNA, 261 bp, Glycine max
  Peptide Sequence Number=SeqID_171035
atgataaatgcaggaatgatattccattatgatcccatgaagagatgcatgatgcaatcaaggaaaccagacatgggactatcagcgacaatgcatcaccaaaagaggaaaacactagatgaggcttcactattatcaagcgagtcagggaccaaacataccacagatcgacctccattccctatggctcacacaaacccgggtatagggcctaatatctcaaagtgtgtgcaaaaaagtgtaggtgtcatgtgtgaatga

SEQ ID NO: 54258 - DNA, 507 bp, Glycine max
  Peptide Sequence Number=SeqID_171036
aagacagctgacaacttcggtaagggtgtagatggccacattggtctctacatgtcatcggacttggggtctccgaatgaagaggtgcggataaccgtaaggtatctccgtgtgcccccggaatctcagtctgtacgtgtcatcggacttggggtctttgaatgttggtgtgcggataaccttaaggtgtctccgcatgccactggactctcgggtcgctggatagcaacagatggtgtagataaccgtaaggtttctgtatatgccaccggactctcgggtcgctggatagcaaaaggtgagactaaatggtctcagccggaagacggtgacatctccgagaaaggtgagactaaatggtcccggctggaagacgctgacatctccaagaagggtgcagatgaccacattggtctatgcgtgtcattggacttggtatctctgaattacgaggtgtggataactataaggtgtctccgcatgctaccggactttcgggtcgcttga

SEQ ID NO: 54259 - DNA, 174 bp, Glycine max
  Peptide Sequence Number=SeqID_171037
atgaagttccccggcaacggcgcaaaaaacttgttcggctccagcaagtgcaccggatcgcagggtgaggcaccacaacagcccggggatgatcagcagcaggctgcatgtgctccaccaccacctctagagtctacctctaatcacctgcggagattggagcggaatatatga

SEQ ID NO: 54260 - DNA, 414 bp, Glycine max
  Peptide Sequence Number=SeqID_171038
atggctccacctaaagaaattgcgaccatcatttaccacgatggtcacattgtagacgatccagttcaaggatcgatgtacacgtctgcgaccccaatatttttttacgtcagtcattctattacgtttacacaattcattcaaaaaattaacaatcgtctccctgctcaagcaactgaacaagttgctcaattgttatttcgtgtccctatttcatttcatctcaatcagacacgttttatttcagctcaactattcgacaatgatgatcttagaggcgcgatggaaacaattctccagaatccacaattaaattctcccgaattctatgctattactgagcttattcttcaaccacaaccattgtctccacaaccctcatgtccacaactacaactaccgcctacacaatag

SEQ ID NO: 54261 - DNA, 255 bp, Glycine max
  Peptide Sequence Number=SeqID_171039
atggagatggcagtagtgtggttgtctttccttgtacgaaagcaaaatcttgggggtgtgagggaatgtatggctctacgaattaagacaaattgggtgtcaagcaagagaaaggtggaccagcatcatattcatgtccttccttttgcctgcctactctcatttgattttcagattccactaggagtgatttttgccagtgttgatcctgcgctcattgctgtttccaaaagtgctcatgtgctcattatataa

SEQ ID NO: 54262 - DNA, 171 bp, Glycine max
  Peptide Sequence Number=SeqID_171040
atggccagaatagtaacaaaggcttgggaaattgcagtgaaaatcgtgaaggttggagaagttgcaaaaataacttgcaagccagaatatgcatatggtagtgcaggatctcctccagatatttttccggagtactgttctcatgccattgatatttgtttggaaacataa

SEQ ID NO: 54263 - DNA, 372 bp, Glycine max
  Peptide Sequence Number=SeqID_171041
atggtgacaacaactgtgacgaaaacaattatggtagtagtgccaacattgacagtggtggcgatagttgcaatgataatgatggtgatggttgtggtggtggcggtggtggtggcattgttggtagtaattgtggtagcaatgctagaggaagtggcgatgttggtggtggcagtggcgacaatggttatggtggtagttactatggcaaatgtgacattggtggtgtggtgtgacgacaacgatgataatggtggtagtggtggtatcattggaggtggtggtgatagtggtgttggtgtaacgacattgatgatgatggtggtagcggtgccgatggtggtgatagcagcagtgacaacaacactgata

SEQ ID NO: 54264 - DNA, 672 bp, Glycine max
  Peptide Sequence Number=SeqID_171042
gagcaccagaccaaaagaaggcatgagtctgccatgttcgctcctgctagtccacccgcaataaacccagttgcacaaaggttgaaaggcataagtgagactaatgatgatggtgaaggactagaagatccaacctcttcctcattagatggcgagtccactgatgacactcccttcatgcctctacgtaagtcagcaccaatcccacaatcacgtccaccttcttctttgttacaccttgataggttcagaagggaagcttcaagggagccattgacggatgctcaacttttccctctggcctacattcacagtaatcctacaccgctctatccctactctgaagtcattttcattgaactagtgggaacctacaacttgaagaagatgacaaaagctcaaatgatagcccatgtgactcagatctatgaggctaaacaaaagaggagagctcaagctgctgttggtgttgttgagattgttgagcaaaaagctattgcgaaagaagctaccaccactattcaagctgaagcatatgctaaagttatggatgacaccattgtgcatggggtccttattgaccttacaaacactagtgtcatagaagagattggtgaagcatccaatgcagctatggctaatgatgttgaaccactcattctggatccttag

SEQ ID NO: 54265 - DNA, 228 bp, Glycine max
  Peptide Sequence Number=SeqID_171043
atggtgggggaggttgggaaggtggtggagaggatagaaggggtggtggtattggagccaagggttgtagtggaggttcaagaatggaaggtatggagattggttgagaaacaagtgcagttgatgttatgcataattaagaagggtaggactagaacttgtggggtatacaattacaacatcatggtcacccttgtctcaggaggtggcttcattggaagttattga

SEQ ID NO: 54266 - DNA, 342 bp, Glycine max
  Peptide Sequence Number=SeqID_171044
atgtctgaagaaattagtatgaatgaagacacgagagaggaacttgctgtggttgaaaatattgattgttttgatgccttcaatacttctcaggtgtttcctacctatgaggacgtattgcaatgggctcgtattattgcgtatgatattggttttgtgactgtgataatgaggtctgacacatcaactagaaagaaaggaaggatcttatccattttaattggttgtgagaggagtggaaagtatagaccacacaagaaagatttagtaccgacggtgactagcactagaaaatgtggttgtccttttaacctgcgagcaaaaccagtcctgggaggttaa

SEQ ID NO: 54267 - DNA, 1566 bp, Glycine max
  Peptide Sequence Number=SeqID_171045
atgctctacaacaaggttgttattgaggaatcagagctagagaaaaggagaaaggaaaaatcatatagtaagatgagatatgaagcactgatcaatttggtcattggaggggtcaagaatgagaaattcaaagggttgctaaatgatggcataaagggtgaacacaaactcagatttatcacgcttgctcggaagagatcatctcttttgaagctttggacacttcgagctgcatttgtgatgctgctttggaccattattgtagtgcaattcaaaggccttggtgacatggtaacacctgccatgttcaagactagtactcattcttctgccttctctctaccacctcaaagggtttacgagaataataatgggtatctaatggtttcttcgaatggaggattgaatcaaatgcgagctggaatatgtgacatggttaccattgcaagttacttaaatgttacactaatagttcccgagctggataatatctctttttggaatgatcatagccaattcaaagatatattcaatgtggattatttcatcaattcattgagagatgagattcagatactgaaagagcttcctccccaacaaaagaagaaggtggaaacaaaatccatctattccatgccacccattagttggtcaaatatgtcatattactacgatgtgattcttccccggataaaaacatatggggtggtacacttcactaaatctgatgcaagacttgcaaataatgggattcctgaggaggctcagaaacttagatgccgagtgaattaccatgctttgagatttgttcctccaattgagcaattggccaagaagattgttaagattcttaaggaaagagggtctttcttgtcacttcatcttagatatgaaatggacatgatagctttcactggttgcaatgaaggatgcaacaaggaagagattgatcagttaacaaaaatgagatatgcttatccatggtggaaagagaaagagatagattctgagaagaaaagaaaagatggtctttgccctctgactcctgaggaaactgctctaacactacgtgcattggacattgatcgtaatattcaagtttatattgctgctggggacatatataaaccagagaaaagaatggcaagtctcaaagaagccttcccaaatctggttaagaaggagacattattggaacccacggagcttgatcctttccggaaccattcaaaccaaatggcagcattagattattacgtgtcaatagagagtgacatatttgttccctcatacatagggaacatggcaaaactggttgagggccacagaaggtacttgggattcaagaaaacaattcttttaaacagaaaaattctggtgaaactcatagacaagtacaaaaatgggatcataaattggaaccagttctccacttcagtgaaggtagctcatgcagaccgtgtagggaacccaattacaagatcaatggtgcctggaaaacccaaggaagaggattatttctacacaaacccacaagagtgcttgtcaccagttgatggaccttaa

SEQ ID NO: 54268 - DNA, 690 bp, Glycine max
  Peptide Sequence Number=SeqID_171046
atggacgaagatcaatggatgtatgataatataaggtctgaagaagttgatatgaatgaacaaaatgaagacaaagttggtgtgaatgaagaacatgttgattgttttgatatgttcaatacttctcagctacatgggaaaccagttgtgggaggtgaaggatggatgatgaagttaatttgtgggagtcacaatcatgaattggtgaagtcattcgttggacattcatatgctggtcgactgactaaggcaaagattgagtttgttcattgggccttaagcagactactaccaaatagccttcgagacctatgtagtgtttgggaagccatgaacaacatgatcacgctgcaacacactaaaattaaggcatcttttgagacaagtgctccgaagaaactgatgaccaagaaacaaagatcaacaaagcgcggcccatcttactgggagtatgttgatgcattacattttgtgcagaatagtaattcttcagtcaaacgtagtacatcatcatctgagcaaccaattcaaagaaggaccatgccgatgttgatgcattacattcaaagaaggaccaagcaacaaagatcaacaaagtgtgattcgtcttactgggagtatgttgatgcattacattctatgcagaatagtaattcttcagtcaaacatagtgcatcatcatctgagtaa

SEQ ID NO: 54269 - DNA, 1185 bp, Glycine max
  Peptide Sequence Number=SeqID_171047
atgagagcagggaaagggagccaggaagaggatgagtacgaggaagaagagtttggttcttccaagaaacagggtacttcctctgcccctaacgccaacaaagatggaaaagccatcgacaaggctagtgcgataagatcgaaacattctgtgaccgagcagcggagaaggagcaagataaatgagagattccagatattgagggatctcatacctcatagtgatcaaaagagggacacggcatcatttttattagaggtgatggagtatgttcagtacttacaggagaaggtacaaaagtatgaaggttcatatcaaggttggggtcaagagcccctgaagttgatgccatggagaaatagtcattggcgtgtccagagctttgctggtcaacctacagctgtaaagaatggtttgggtccagtatcaccttttcctgtaaagtttgacgaaagcaatgctagtatctctccaactatgcttagtggcacccagaatacaatagatccttatcagagcagggatattgtcaacaagacggctgagaggcaacctgatttagtaaacaagggaatgcctcttccccttgctatgcatgcaaacatgtctgttcctgtcagaagtgatggtgtacttgcacatcctcttcatggaactgtttctgatccacaatcaactgaatgcccaacaactagtgaaccacagaaccaacaggatgaattcacggttgaaggagggacaattagcatctcaagtgcatattcccaagggttgttgaataatctaactcaagcgctacaaagtgctggtttagatctgtcacaggctagcatctcagttcagattaatcttgggaaacgaggaaacaaaggactgagttgtgggacctcttctcccaagcctgccccgcataattcacaggttaatcgggttttacccgcggacactaaactaaacctaaatccctttggcacactcacctcaacactcagactacctgcatcatgcacccaccagccaccagccagtcaccacgccggcactgccacggctgttacagctgttataagttggatgcatcatgacaacccttcttcaaacaatcaaacaattgcacattttagagatgcaggcagtggagaagactcggatcaagtacaaaaaagaatgaaaacatataagtga

SEQ ID NO: 54270 - DNA, 150 bp, Glycine max
  Peptide Sequence Number=SeqID_171048
atggcggctgagaacaacactatttgcgaacatttttgcctcatgaaactagtggtttggccttattacccaagtgtggggaaggaagaacctctgaaagataaaactattccaagagaccttagagggaatatgaggggtaagaaatga

SEQ ID NO: 54271 - DNA, 273 bp, Glycine max
  Peptide Sequence Number=SeqID_171049
atggccataccagatactgttggtggaaaacttataggacttgtgacctcaagggaagaaatccctaagctacttaagctggatgatgtaatcgatctggtgattccaagaggcagcaacaaacttgtttctcagatcaagagttccactaaaattcccgttttaggtcatgctgcttgttgtgtgttcacattgtttaagcggttagagtccctaacagaagcagagaaacaagcactgcttgaagaagttgaggaagagaacaatcactag

SEQ ID NO: 54272 - DNA, 530 bp, Glycine max
  Peptide Sequence Number=SeqID_171050
atggagattataattcaacaggctcagggttcaactcaatcaaacatattcaagctcaaaatgggtgcaagggattcatcattcataaacaaggctcatcatgaggtgaggaaggggcatcctgggctggttgaggctatgcctctagttgcggctcctgactccagatcatggatactctgcatcaccaagcataagccatggtggaggctctgcgacattggcactgtgacatctgagctcggagtggaggtgctggagggtactggagtggcaggaacgggagctggtggtgttggtggaggagctggagctagaggagcggaagaagaagtggcttcagattctcaagcccgtgccttgcgggtccccgaaaaagagatcatgggatcatccggggactcaaaggtcagagaattagatatgactcctctagctatgcacaaagctgtgatacgtgcaggaaagccaagccgagaggagttggactgggccatctacgagatctggcctgagatgagcaagcccac

SEQ ID NO: 54273 - DNA, 225 bp, Glycine max
  Peptide Sequence Number=SeqID_171051
atgccgcgacccactcaattagtcactcaggcacagcgccacaaagatcctctctctgccgcgagcccgcaacccactcacaaacacagctcgccaccgcgaccccgtgccactactttttcgcgaccctgcactgccgcgaacgctcaccctccatctttcctcactcatctctatctcccagtggtgcaagctttttttgtgtattacagtattagtgtttaa

SEQ ID NO: 54274 - DNA, 504 bp, Glycine max
  Peptide Sequence Number=SeqID_171052
atggctgagagtgcagtgagttttcttctcgaaaggcttaaaccagtttttgagaataagttgaaattgttcataggggttgaagcagaagtgatatatctgaaagcacagttggaactgataagagccttcttaagggctgcagatgtatttgaagagactgatgaggaactcaaagtttgggttaggcaagtcagagatgttgttcacgaggctgaagatcttcttgatgaattggaactggtccaggtacataaccatacaaatggattctctaattatctcagtatcaggaatatgaaagctcgttatcggattgcgcatgagttaaaagccatcaactcacgcatgaaaactatttcttcaactcgcaagagattcctcagtaaacttgacactgcttcagaggcttcaaattccacttatacaggggaaccacttaattatgctattattggtgttcttttgttccagatactaagtccctcacaatcttttaactaa

SEQ ID NO: 54275 - DNA, 246 bp, Glycine max
  Peptide Sequence Number=SeqID_171053
atgtatattgttgtggtaaaacaggggcaggatcaccttgggctaccttctgaggtagagacaaaacgtgagcggcagaaaccaatcaaggtagggtacttaaggacggatgcaagtagggatggggtcacgaccgaccgatcgttgccccttctctgcgcgagacaagcagagaatgtcgctgcgcggcagccccgtatcctttgtattttgcagctttcttttactatttgtaagtataagtaa

SEQ ID NO: 54276 - DNA, 613 bp, Glycine max
  Peptide Sequence Number=SeqID_171054
atgcgatcagagaagaaaccatggtcgccactcctctgtgacgaactcatcgaggaaatcttgtctcgtcttcccgtgaaacctttgatccaattcaagtgtgtgtgcaaaggatggaactccctgatgtcagatccctatttcatcaaattgcaccttagtaaatctgctgcgaaggacgatttggaacaccttcaactgatgaaaaatgtatgcctcggatccatccctgaaatccacatggaatcgtgtgatgtaagttcgttattccattccctacaaattgaaacgttcttgttcaatttcgcaaacatgccaggctaccatctggtcggttcatgtaatgggttgcactgtggggttagcgaaataccagaaggataccgtgtttgtttctggaacaaggcgacaagggtgatatccagagaatcaccaacgctgtctttttccccgggcattggtcgtagaacaatgtttgtgtttggctatgatccgtcaagtgacaaatacaaggttgtagcaattgcattgactatgctctcacttgacgtatctgaaaagactgagatgaaagttcatggcgcgggtgacagtagttggagaaaccttaaag

SEQ ID NO: 54277 - DNA, 162 bp, Glycine max
  Peptide Sequence Number=SeqID_171055
atggggtcaagacaggatcacccacagttgcaaaaccctccaacaccatcacatcctccaagaagtggtgtcctaagacaaatacctttttgttaccataaagtgagaaaaaaacaccttggaggatgtgatggtgttggagaattttccaatagttcatga

SEQ ID NO: 54278 - DNA, 642 bp, Glycine max
  Peptide Sequence Number=SeqID_171056
gtgtataagatcaagtacaaatcagatgggtcagtagagagacataaggccaggttagtggccaagggctacactcaagtggaagggcaaggttacctagacacattttctccatttgccaagctaaccaaagtgagacttctattggccttagctgctatcaataaatggtatctcaagcaattagatgtgaataattctttcttgcatggtgatttaaatgaagaagtgtacatgatgcttcctcaaggaaatgatttgattgaaatacaagctattacacaattgctggacaatgcttttaagataaaagatttaggtgacttgagatacttcttaggttttgaagtggccagaaaacctactggtatcaatctttgtcagaggaagtatgccttagacattctcagtgatgctggtatgcttggatctaaaccagtatctactccatcagattatgctactaagctgcatcaacaatcagggactcctctttcattagaagatgcttcctcttttagaaggttaattggaaggttgatctacttgaccaatacaaggccagatatcacttatgttgtgcaacatctgagccaatttgttgctgctcccacctcagctcatcaacaagctactgtttga

SEQ ID NO: 54279 - DNA, 348 bp, Glycine max
  Peptide Sequence Number=SeqID_171057
atggagtggtacattctttatttcaatcaggttgtcgaaggaataaactcatccacagtggctattaaatctgaacttctaaaggaggaacttgtttgcactactgcaaaaagaccctacaacaacggttctaaaccacttttaaagatgaataagatgcaccaaaaaaccatggattatacaagaaatgagattgccaaatttgtggagatagcggtttcacagaatgttcatacaatccaaagagtgaaattaaactacactgttgtacatcaagttgaaattttatttaatgggtccaaccaaggccatgcacagacattttggggcctaaggcgaaaatgttaa

SEQ ID NO: 54280 - DNA, 861 bp, Glycine max
  Peptide Sequence Number=SeqID_171058
atggctgccatcatcctgttctcaccgatacaacgggcaattgcagctgttgccaaagatattgagcatgtggatgatgctgttgacggggctcatgaggagcctcactatccaactacagaggatgaacgtattgagttgaagttgacctctcatgggaggaaggttgaaaaattaggaaggcctacacctgaaattgatggtttagtggttggtgccttccatacctatgatgcaataaatgtagaccaggatgtggagttgttagttgagttgcaaggagtgactacacaagaagcaatagatgagacaaagcaatgttgcgcactatttgctaacaagagttccacacatatcagtgtggtattcttggatgcatttcgtgaccctaatcaacgtggagggttttcatggggagcggctgaactaatacatatgtatgagaatttgaattatgcatctctgaacaaggctaaatatctttcttggatctctgagcatttcccaagtattgagaatatgattgctaatgaggactaccacaaaagcaaaccacgtgtgtgtcgctggaagtgtgggaaggtattaccagtgactacctatcataagcggttggataagttgacgactaatgctgtttgttggataccttatggctatatggagtggttttatatgatatctcacccattcatgagcccaccacaggttggggagcctcctaaacatccacccatggtgcataatcctatagtagttatgccacatccaactgtgttgcccgatgatataacaactatgccacatccacctgcaacaacacctattgatgttgagatgcctcgaaatgcagtggtataa

SEQ ID NO: 54281 - DNA, 201 bp, Glycine max
  Peptide Sequence Number=SeqID_171059
atggttaatcgagatttaatctccaatgagatgcaacaattgcgccaacagttgaagtatttgcaggctaaactttgttctcggggaggagctcctgttgatgaagtgtggttctcaaggaaaggattgcttggcttgagtctactaatgaggacctttgtagagaacttcacgaatatcacagtagatgtggttttgtag

SEQ ID NO: 54282 - DNA, 147 bp, Glycine max
  Peptide Sequence Number=SeqID_171060
atgagtcacgggcgtctgtaccagaggcgggtgaagaatgcttttgacatgaaggggaaatgggctccaaactgtgaagggccattcatcgtaaataaggccttcttcggaggagccctgctgctcgccaacatggatgacgagtag

SEQ ID NO: 54283 - DNA, 387 bp, Glycine max
  Peptide Sequence Number=SeqID_171061
atgtccgatgttgttatgatggtggctcgtgtcatgctagggcatgattttgaacccaacatgggcttggggaagaataacaacgacatggacaacttagtggatgtcaaagaaaaccgtgggaagttcgggctaggatataagcccacacgggctgacttgaggagaagtgtcatagaaaggaggagaagggtcgcaggcctgcaagtaaggccacaagcgggggaggtccctccttgccatatcagtaaaaggtccgtgagtgtgggcttcagacttgaagaacaagtcgccgtgatatatgaagaggtccctcaagaatgttcagacttggtgcagccatgccttcatgattttcaattgggaaactggcaagtcgtggaatga

SEQ ID NO: 54284 - DNA, 111 bp, Glycine max
  Peptide Sequence Number=SeqID_171062
atgggtgccaagtaccttgaagcggtcaagcaaaggatgcatgccatcaacaatggtccctggacgaaattaggagaatatggagtagaagagaaacttaacagaaagtaa

SEQ ID NO: 54285 - DNA, 99 bp, Glycine max
  Peptide Sequence Number=SeqID_171063
atgcctgatagccccagagtctaccacctatttgttcacattggtgacaacattcacttgagaaatgaccgcagcaataatgccatctccctcaaccag

SEQ ID NO: 54286 - DNA, 321 bp, Glycine max
  Peptide Sequence Number=SeqID_171064
atgcatgatgcgatcaaggaacaagccaaaggactatcagtgacaatgcatcaccaaaagagaaaaactttagatgaggcttcactgttatcaagtgagtcggagacccaacatgaacacagatcgacctccactccctactgtggaagcaatgtcttccaaggttattttgatgatgccaaagaatcaagagttaagcaaagtttcaagcaaagattcaagaatcaagtttcaagaatcaagaatcaagaatcgagaataatcaagatcaagattcaagactcaagattcaagaatcaagagaagactcattcaagataa

SEQ ID NO: 54287 - DNA, 228 bp, Glycine max
  Peptide Sequence Number=SeqID_171065
atgtatgaaaatccaactccctcaaatatcttgttgattaagctggtcaagtccactttgaagggcagcttgtggttccaccttcttagttttcttggtctctccgggccgaaacagaacacaccaaagaagaatgatgcgtttcgggaacccattactattcatgaaaatcaaatgacattgaacggagtcagtggaagatcatatgagaatgttcctgctaattaa

SEQ ID NO: 54288 - DNA, 372 bp, Glycine max
  Peptide Sequence Number=SeqID_171066
atgggaaaatgtgtggatgggagatgggtgtcgggatttagatggagaagagaatggtttgagtgggagaaacaaagagtggaggagtttttgcatgagatcaataatgctaatatttgtggacaaggtggtgaccaatggatttggttattgggcatccacactgtagcccctgaaaaggctattgatcattttaggcatatctcactaggattacaaggggagaaacctaaattatggtgggcagttggatggagttctatcgtgtggaacttaatggcataccagagccattttgatacttcttatcaacaatggcaaattgatccagaatgccctgcatctattcctgcatgcactcccgagagctag

SEQ ID NO: 54289 - DNA, 465 bp, Glycine max
  Peptide Sequence Number=SeqID_171067
atggagaaggctcaagctacttcaaatatggaatcatttgttgttgaagatgcccgcggaccggcccgtttgacccgcagggtccgcagggcgggacggaccaatttatttagtccgtgtaagaagcgaggcagactggcccagtccgctgccaatgcggacttatgcgggcggaccttacacggggtggacgggctcacttacccacccctacttgcagtacgggccttttgggacaagaggatttcacaggaggtcagcggagatgctctcggtgaggagtttaaaggatatgtcttcaaaatcactggtggttgtggcaaacaaggattcccaatgaagcagggggtgctaacacctggccatatgcatgtctttttattctatgactttattccttttgaagatggtcctgagaggaactccttgcttctgtgggtacggaaggcacaatggagagcgtag

SEQ ID NO: 54290 - DNA, 240 bp, Glycine max
  Peptide Sequence Number=SeqID_171068
atgaagacaaaaaaactgaaggaattacagcttcagatcgtcattgatctcgagcttcttctggcagctgtgggttttaccctacttcgcggagttttgggcaccggaaactgcaatgacagtggagttgttttgggtgagaaaaaaaatagaaagttagggtggggactgtggctaaacgtggagaggggaagaaaacgaaaaaggtatgcgaaaatggaactatgggtaatcaagtaa

SEQ ID NO: 54291 - DNA, 291 bp, Glycine max
  Peptide Sequence Number=SeqID_171069
atgggatgttacatgaaacctgattggaaactaaggttagagattgcatttggggttgctagaggacttgcatatttgcatgaagagtgcatcactcaaattatccattgtgacataaagccacaaaacatactccttgatgagtatcataatgcaagaatttctgactttggattggccaagctcttgaagatggatcaaagcagaaccaacactgccataaggggaacaaaaggtgaaaaatcacacaagcgcgcttggaagtacataacaagacacgctacacaatgg

SEQ ID NO: 54292 - DNA, 545 bp, Glycine max
  Peptide Sequence Number=SeqID_171070
atggcttcctctttgcttctttttttcctcttctgctcagtgattttgctaccctttgttgtagctcaaaccaaaaccaacatagccattggtgattctcatactgcaggaaaaagcacaaccccatggttggtttcatcaccttctggtgactttgcctttggtttcctcccacttgaggccactcctgatcatttcatactttgcatttggtatgccaacattcaagacagaaccatagtttggtttgccaatagggacaacaagcctgcaccaaagggctcaaaagttgagctttctgctgatgatgggttggttctcactgccccaaatggtgataagttatggaacactggtggcttcactgctagagtttctagtggtgtgttcaatgacactggcaaccttgtgcttcttgatggtgcctccagcagtacttgggagagttttgatgattatagagacaccttgctgccttctcagactatggaaaggggtcagaagctttcttctaaacttaggaggaatgacttcaacattggcag

SEQ ID NO: 54293 - DNA, 300 bp, Glycine max
  Peptide Sequence Number=SeqID_171071
atgaaaaaaaaggaagcaacaacgcccaatgctctcccttatgttgctggagaggcttgtctctacccatgtaagaagagaagcaagttgcaacaagtgataattgggagtaaaaaattcaaaaagcaaactcaagaaacatgttctaaatcctatgttaaaccggatagctcattcaagaacttgatttcaaacatgatcaaaggatgctcacaatcaactcaagatgaggacaagtctttggttcttaatcttgaaaatcctaatcatcatctgttggatcaagtggcctcagaataa

SEQ ID NO: 54294 - DNA, 228 bp, Glycine max
  Peptide Sequence Number=SeqID_171072
atgaacaaagcacttaagagggaaggagattccattggtcaaggcgaagactttgagccctctaaagtcgagaactttgagccctctgaaggcaaggactttgagtcctctaaaggcgaggactttgagccctataaagatgaggcctttgagtcccttaaggctaggactttgagtcctataaagcaaaggatgttgagtcctatgatacaagccaatgggcactag

SEQ ID NO: 54295 - DNA, 276 bp, Glycine max
  Peptide Sequence Number=SeqID_171073
acacttcctgcagcggcttccaaatttgtgtatggctccaaaaaaagtattaccatccaccacggactttcaaaatccaccaaatggccactcaccatccaccatgacatccctgccattacacaaccatggttcaacctgattcatgaaaaaaatttaagacccggagatgaggtagtcttttactaccgttttcatgaccatgcatgggagttgctcataaggaaagccatcgaatggaacaacagcaacaccaaccttgactttgatgaataa

SEQ ID NO: 54296 - DNA, 1014 bp, Glycine max
  Peptide Sequence Number=SeqID_171074
atggaggccataaaagagcaaatggtcataatgatggaggccatgatgagcatgaagaagataacggaggtcagtgcggctgcagttgccgcaaccagcgccgttgctgagttgggaagtacgagtgatccccattttgggcaagttcagaacaagcatgccttcccatcatacggcttgcctcccaactatacaccacccaatgttacgcacactcctgatgacaatccttaccttggatacgccactaaggggaaagcagttgtccctcttgccatggtggaaagggaagaattcaatcatatagaggaaatgctgagggctattgaaagaggcggagattatgcctttgctgacatggcagagttgtgcctagtacccgatgtcatcatccctccgaagttcaaggtgttggacttcaataagtataaggggactacttgccccaagaaccacctgaaaatgtacactcaagtagcacccccaatgatggagagggagatgataacaatgatagtagacacgttaccggtgttctactatgagaagatggtgggttacacaccttcaagctttgccgatttagttttcgtcggcgaaaggatcgaagtgggtctgaaaagaggcaaattttattatcctgctttgatgaataggaagcctagggaaaagggagagaatgagaaggagggaggaacccatgccgtgactgttgttcctacatggccaaatttcccaccaattcaacaatcaaagaagcctatagaattcactccaattccagtgtcatatgctaacttgcttccatatctactcgataatgcaatggaagccataaccccagccaaggttcctcaacctccatttttccgaggatataactcgaacgcaacatgtgcttatcatggaggagttccggggcattccattgagcattgtatgaccctgaagcataaggtgcaaaatataattgatgcgggttggctaaaatttgaggaggataatcacttgtga

SEQ ID NO: 54297 - DNA, 1131 bp, Glycine max
  Peptide Sequence Number=SeqID_171075
atgacactctcacttaggaaaactaggcagcaagtgtcgaggtcaccctatcgtgcacaggcaactctccccccccatggtgatcaacctgagtctcaatggagttccaaaccgagtgacatgcccccaagtacaagtattcccccttatgagaaactacaacaagcaacgacggctcgtggtggccaccaatggttgtgggtggtggaagaggagtttctagggtggtttggacagagttttgagatagagaggcctgaaattatgtttttcacgctgaaaaatgttgggaaggtccaagcttctgaacaggttgaggagatggtggtaaagctggctaggctttgcttgctctccctatgcttgttaagaaggcatgccaaactcaagatccaaaggattagcttgatttcctattatcttatcaacatcaaacaaatgagtctcaaccaattctttcttcactttcttctttatgtgcctttgcacatactcaatgaatttttcaacaattcccatcttcacaaaggtagcccccttcaactgagtggctccaaattatggctccatcaaagaaacctctactccaacaaccctcaggatctgggtaaagatcattccataaggaataggatttttcttcaccttggggttgaaactatatttgaacgcttgcatccagtagaagaagatgatattaggtgttgccttcttgtcacctccgtctgggcaaggctttccatagagcaccttttccaaagtttcctgggttatctctttctcacaatctctgctcattgtcagaccatccagagcacatccagatgcaacaacaatagtggttggagaaattaccacctgagtcttagcaatagtcccctaatgttggctccatcttgtttttttgttcctagaagatggcatatgggtcataatgccagggataaactagtcttcaaggaaagcttgaatggcatcttcaacattattgatgatgggaatgctggaggactcacttttccttggaagtgtcattgttcacaaagagttttgaagataaggacaggagagaaagttttgaagttttatgagttctcagacgatgatttgtacaagcataaatacttctga

SEQ ID NO: 54298 - DNA, 1008 bp, Glycine max
  Peptide Sequence Number=SeqID_171076
cgccagcttggcctggcgcgcggcgatcacctctttttcatcctcgacgctctgcaccagcagcacgatcaggccgatgcacaccgtgccgaggatcatcggcagggcaatctgcgacacgatgtccaacccaagctcggtcggcttggcccacagcacgatcagcagcatggtgagggattcgcacagcatgccgccgacgatgccggcgcgccagcgctgctcttttttcaccttgaggttgatgtagccggcgctgatgccggcgatgatgctggtgataaggcaaggcaccgaggtgatgccgccgatgtcgatcagatagcgatgcaccccggcgacgatgccggtgacgatccccacccaggggccgaacaggatgccgccggccatgatggcgatgacgcgcacgttgaccagcgacccttcgacgttgatgccggagtaggtgctgaacagcgcgaacagcgagaagatcgccgtgacgatgccgagctcgagcggcgtatggtcttctttttgcagcagttggcggaacagccgggtgcgggtcaggaaaaacagacagatcaacatcagcgcggcgcgatcaaacaccgccaacagcatttcaaaaaaagggtgcacgacgggttctcgctgcggcctacggatggcggcagtataccacagcgaaaggggcccgtggcgcgcgccacgggcgggggatcagcccatgccgagctgcgctttgcccagcggcgtcagcaggtcgacggtggcgcggccgtcgaaatccacctcgaagtcgtcgggggcgaagtccggcggcgttctgccgtcgataaagctcggcagctggcgctgcagataggcgtcgtttttcgtgcagcccggcgcggcggcgatgtacatcacgttgctgtcgaactcgccgttatgctcgttctccaccgcgtggatcacgtcgcagtgccaaaataccgtgtcgcccggctccagatcgggaataggggaaatcccacttaa

SEQ ID NO: 54299 - DNA, 1878 bp, Glycine max
  Peptide Sequence Number=SeqID_171077
atggcaggaggaggagctccagctaaagcagatgagccacagccacatccaccaaaggatcagttaccaaatatttcttactgcattactagtcctcctccatggcctgaggccatacttcttggttttcaacattttcttgtgatgcttggcacaactgtgttgattcccactgctcttgttccccagatgggaggtggcaataatgagaaggcaagagttatcgaaaccctgctttttgtagccggtattaacacattgttgcaaacaatgtttggaactcgactgcctgcagtaattggagggtcttacacctttgttccaaccacaatctcaattatccttgctggccgattcagtgatgaaccagatcctatagagaaattcaagaggataatgagatcaatccaaggtgctcttattgttgcttcaactcttcaaatagtactgggcttcagtggtctctggcgtaatgttgcaaggttcttaagtccactttcgtcagttcctttggtatctcttgttggttttgggctgtatgagttagggttccctggggttgctaaatgtgtagagatcggcctgcctcagcttatattgctagtatttgtttcacagtatgtgccccatgtgctacattcggggaaacatatcttcgaccgttttgccgtgttatttacaattgtaattgtgtggatatatgctcatctacttactgttggaggggcctataatgatgctccacataaaactcagatatcatgccgcactgatcgtgctggacttattgatgctgctccttggataagaattccatatccctttcaatggggagcaccttcatttgatgcaggtgaagcctttgccatgatgatggcatcttttgtttctcttgtagagtccagtggagctttcattgctgtatataggtatgcaagtgcaacaccattgccaccatctattctcagtcggggtattggttggcagaattttgttggtttccctaccagagaaaatgcaggtcttttggctttgacacgtgttggaagtagaagggtggtgcaaatctctgccggatttatgattttcttttcaattcttggaaaatttggagcagtttttgcctctatcccacctcccattattgctgccttgtactgcttgttctttgcttatgttggtgctggtggtcttagttttcttcagttctgcaacctcaacagttttagaacaaagttcattttaggcttctcaatcttcataggcttgtctgtgccacagtacttcaacgagtacacagcaattaatggctatggtccagttcacacaggcgcaagatggtggtatcagagttatgactgggagcacacaaagcaaagtcttgatcaggcattagaagatgaaaagccagtttctataaatgaaatcgagtggactaagatccaaaggagggttgtgagcacgattcggttagcccttgctcctgatataaaacatgcattgaaagagacaacactgaaggccttgtgggagaagctcaagaatatcgatacgtcaaagtcgctaaccaattgcctttgtttgaagatggagttgtatcaactcaaaatggagatggaaggagatctgcatgaccacatcaacaaagatgacgctgactctcaatcgcgtccacaacgagatatgaataacattcaatgttactattgtggtgagaatgatcatgtgcaagtgaggtgtaaacaaataaaggaggacttgaaaaaattaagagatatgaacaaagatgacactaactctcaagctaatgtagtaaaaagtgtggaagatgaagatatgttttttgcaacaaatgacgaggttgctaaaacaaaatga

SEQ ID NO: 54300 - DNA, 885 bp, Glycine max
  Peptide Sequence Number=SeqID_171078
atgaagattgaggagcttcaaggatctttagaagcacaagaattgatgttgattcaaaggagcaaggaaagtctaaggttgaagataaagcagaatcttcccataggggagaggttggttcttcggatcagggaaatcgaaagaagaaagacaaaaggaagattaaatgggcataaagagtggctcattgatctagatacaagtagatccaaaaaggttaagctagcaggtagtagaaccttgaatgttgaaagagttggcaatattgtgatcagaagaaaggatggcaagacaacatttattgagagtgtgttgtttgtgcctggcatgcagtgcaatctcatgagtgtgggacaactagttgaaaagggattctcagtgattatgcagaatgactctcttaagttgtttgaccctaacaaaaggttggtgcttagatcctcactctcaaagaatataacctttcaagccaacatcaatgttgcatatgcaaagtgtcgtacaacaatagtggctaaggaggaaagttgtctttggcatctaaggtttggccctttaaattttagaagcctaagtcaattacagtctaaagacatggtgatagctctccccaatgtgcatgtgcctgatagaatgtgtaaggtatgcagtgctagtaagcaacctaggaactctttttgcgtatatttaccaatgagatcattagaattgttacatgtggtacattcttatgtatgtggaccttttaaggtagcttcactaggtggccacaaatactttgtctcttttgttgatgaacataatagaatgatatggctatacttgataaaggctaaaaatgaagtgtttgaagttttcaaaaggttcaaattgttagacaagtag

SEQ ID NO: 54301 - DNA, 207 bp, Glycine max
  Peptide Sequence Number=SeqID_171079
atgtacaaagataattggacccaaccttggcccatgggctcagaaatctaccctaaggttcatgagaaccatagggccttcttcagcagctctagcctaatcttcttggagcctcttgctcatggttctagtgactggtcccttcctagggaggattgcatcactgtgatgatctcgaactttgtgttcgtgggagtagatggttag

SEQ ID NO: 54302 - DNA, 528 bp, Glycine max
  Peptide Sequence Number=SeqID_171080
atggttgaaaggcagagtggtaaactggtcaaggttttgaggatagatggtggtggagagtatacctttagggagtttgaagatttttgtgagaaatgtggcactcaacatgaagtcacaacaccctacactccacaacataatgatctagcaaaaagaagaaacaaaacaatacttgatatggcaaggagtttacttaagcagaaaggtttgctgcataacttcgggggtaaagcactaactattgcagcttacttgctcaacaagtgttctaccaagagactaaaggagaaattacaagatgttcacttggaatctgagcaaaacagaagggaatcaaatgatgagattgaagcaacaactaatgtgaataagactcaaaggccacaaaaggaaagacacattccctctagactctcaaaatacgagacacttcatgatagtgaagtcacacctgatggaaactcagtccattttactttaatagctcatgtaaaaccaattgatcatgaagaggccttgcaataa

SEQ ID NO: 54303 - DNA, 351 bp, Glycine max
  Peptide Sequence Number=SeqID_171081
atgtctaagccaaggaaaagtcatttgatggaaaccaagataattttaagggataagtcagacgagaagagaactacaggttacataattgaagtgaagaagtcaatacaattgttaatggataacaagtctgatatcaatttggcaaagcacctagtttcctatggcagaagcaaacacattgagacaaagttccattttcttcgagagctggtcaatcatggaaggattgaagtcatctactgcaagacaaagatgcaggttgttgatatactaacaaaagccttgaagattgatagatttgtaaagttgacagaagcattaggtgttgtagataggaagagcttttga

SEQ ID NO: 54304 - DNA, 537 bp, Glycine max
  Peptide Sequence Number=SeqID_171082
atggtggggtacgtgccttcaagctttgcgggtttggtcttcaccgatgaaaggattgaagtgggtctaaaaagaggcaaatttaatcatcctgcttggacgaatgagaaaactggggcaaatgaagaggatgagaaggagggagaaacccatgctgtgactgccattcctatacggccaagttccccaccaacccaacaatgtcattacttagccaataacaacccttctccttacctaccacccagttatccacaaaggccatccctaaatcaaccacaaaacccacctttagcacaaaccaaaacaccaatcaaggaaggaattttgcagcaaaaagcctgtagaattcaccccaattctagtgtctatgctaacttgttccattatctacttgatactgcaatggtagccataacccttgctaggtttcctgaacctccatttttccaaggatacgactcgaacgcaatgtgtgcttatcatggaggagccccggggcattccattgagcattgtatgaccctgaagcataag

SEQ ID NO: 54305 - DNA, 600 bp, Glycine max
  Peptide Sequence Number=SeqID_171083
atgaagatcttcattctctttagcataacttttgcttatggtttccttggaaatgttgtttcaaatgccaatccacttccatatgaagccattttcaacttcggtgactctataagcgacactggaaatgctgctacttaccacccacaaatgcctagcaatagtctttatgctgaggcatatgggatgccaatgttgtcagcctatctaaatcttaccaaagcacaaaacattaagaaaggagtaaattttgcattcgctggttcaactgcacttgataaggattttttgcaaggaaaaagaattcatgtacatgaagttgcttattcattgagtgctcaacttgatttgtttaaaaagcttaaacctcccctttgtaaaagcaaagaagaaggagcagtagagctagtggtaccaggaaactttccaattgggtgcaattttgctgttttgacaatagtgaatagtgataagaaagatgactatgatcaatttgggtgtttaacagcttataatgctttcattgagtactataatgagcaactcaaaaaggctatagagacattaagacaagagaaaccaaatgttaacatattttga

SEQ ID NO: 54306 - DNA, 310 bp, Glycine max
  Peptide Sequence Number=SeqID_171084
atggcttctcgaaaatgcaagagtatcagttcaagacccacaactcaatatgatacaaggagatttcactccttagatgcatggaaccgatacacagataatactgagttggagaggcgtaatctccataaacgcctcaccaatttggttgatgggagcataaatgtggctttagtgaaagagttctatgcaaacctatacaactctgagggcccttcaccaaagcaagccagggccagaggccatctagtgaagatcgatgctgacaacctcaacacattcctagagacacctgtggtgttggcagagg

SEQ ID NO: 54307 - DNA, 570 bp, Glycine max
  Peptide Sequence Number=SeqID_171085
atggacatgctatcggtgagagagcaacatgctcggacgctgcttatttttcatcgttgggatgtggagaatctgtttgaagtgttagtagacaaggggaaatcatttctctttgctgaagctggtgttagtgtggatgaacatcgcaactctgactcacctgttcctcctgcattcatgtgctacatctgtatggaggaagttcctagtagcaaaacaacgagaatggactgcggtcactgcttttgcaacggctgttggatagagcactttattgtcaagataaatgagggtcaaagtaagcgcattagatgcatggaacacaagtgcaattccatatgtgatgatgccgttgtaagaactctactcagtagagagcaccctcatatggcagagaaatatgaacgctttctgcttgaatcttacattgaagacaataagagagttaaatggtgccccagcacacctcattgtgggaatgcaatacgggtcgaggatgatgaactgtgtgagttgtttgtcagaagcacactccccttgttcatgtctgatgtgggagctttgggctaa

SEQ ID NO: 54308 - DNA, 411 bp, Glycine max
  Peptide Sequence Number=SeqID_171086
atggaggctagagagggaatatcaactttacctataccagagatttttcccttgcctatgcctccaaaggaaacttctcctccttcatatggccttaggtctaggaacatagacctttcccctgccgtttgttgtgagcatccagtgtccagttctaaagaagaacatcataaggcatatcttcaccatttgatgaagcataagaagagtctttctacactcaagggcatatgccagagtgaatatggttttagtgatgagctccataatggccagatcaccatttatccattcagcttcaggtctagtaatgggaatatccctattggtgatgatgagccagagaagcatggtgatcttgtgaaagatgttccctcagtgatgaactggcattggttatttgtcatctag

SEQ ID NO: 54309 - DNA, 915 bp, Glycine max
  Peptide Sequence Number=SeqID_171087
atgaagctgtcatttgattcttctttttccaggtttctattttcgtccaactttttttgccggattgctcctgtttgctgttgtttgcaaaaccaaaaagtgatgtctcacaaagaaaatctgatatctgagttacacaccagaaaaggaacatggaaaatagttgtgcgtatcactgatctttggcaagctcgaaagcaaaatagtaaacaaacgattgagatggtgttgatggaccaaacgggttcaaaaattggaactactctctggcaagaactcttcactgaattgcgggacaagttacagtgtggttgttcgtatttgattcagaacctgaggattgttgacaaccaatctgaatacagagtcagcccagctccatatttggtttatttcctaaaaactacatttgtcaaggaaattcaccatccagaaattccttctaatgtttatctcataactccttttactgatataatctctggcctcgcaccacgccatactttagtggatattgttggtgtcattgttgatctgatcgatgttaagacagttaatccccctcacaggatgatagtcaggctcagggataacagtaactgcgacattctaataactgtttgggaggactatgctattcagctacatgatgctattgacaaaaaccttctgcttcaggaaccattggttgttatgttgaccttaggtaaaatcaaggatgctacagacaagtatcccctaagcgtgcagaatatcaaatttggatctaaattgtatgtcaacgctgatattacagagatacacgaatttcgtcaaagtttgtctatgccattttattctggtgggatgatcaatgataaagatggttctcagtcccaatctagccagagtaatgtggtggaaaaatttctgtag

SEQ ID NO: 54310 - DNA, 762 bp, Glycine max
  Peptide Sequence Number=SeqID_171088
atgtcagccagcatcaacaacaactcaggggttgacaaatacatccatttaattggctctaatgatcatcctcaaacacttggtagggacagaggaaagagaatcatactgccaagtagttttgttggtggtcaaagatatatagagcaactgtattttgatggtatggcaatttgtggacatcttggatttccagacttattcttaacaatgacatgtaatccaacatggccagaaatacgacgcaaggtcacacaatccaatctgacccccaataattgccctgatattatcacacgagttttcaaaataaaactcaatcaattaatgaatgacttaaaacatggcaatatctttggcaacattattggatatatttatacaattgagtggcaaaaaagaggattgccacatgcccacattttaatttttctgcaccctacaaacaagttaccaaacccacacgatattgatcaaatgatttcagcagaaatacctgacaaacagagccaggcacaattatttgaaattgtgtccaaccatatgatgcatggaccatgtgggtttgcaaataaaaaatcaccatgtatggtcaatggaaagtgcattagatgttttccaaaaaatttccatggagcaacaattgttgaccaagatggattcccagtttataggagaagaaatgatggtcgtgcagtgatgaaaaatgggattgaactagataatagatttgttgtaccatacaatccacaaatcctataa

SEQ ID NO: 54311 - DNA, 996 bp, Glycine max
  Peptide Sequence Number=SeqID_171089
atggagcacgacgaagacgaagagccacctcttgctgttcagattcaagggaatgatgaatccgtttctcagcaatcttcttctgttggggtcactctcatcaccggttatcttggttcgggcaagtccactctagtgaatcatattttgaattcgcaacatgggaagaggattgctgtcattttaaatgagtttggtgaggaaattggcgtcgaaagagcgatgatcaatgaaggagataagggtgcattggttgaagaatgggttgagcttgccaatgggtgtatatgttgcacagtcaagcatagtttggttcaagcacttgaacaacttgttcagagaaaggaaaggcttgaccatatattgctggaaaccactggattggcaaatccagctcctttggcatctgttctatggttggatgaacagttggaatcagaagtgaagcttgattctattgtcacggtggtggatgctaaaaatttgcgcttccagcttgatgagcatcgtggatcatcttcatttcctgaagcatattttcagatagcatttgcggacattataattcttaacaaggttgatttggtatctgtagagagctctggagctctggaggaacttgagcgtgccacacaattagaggcattgttagaagaaagtcgttctttgtctaccaaaaagcttcatgatagtgacgtgagaaccatatgcatttgtgagacacggatgattaatcttgataagactcggatatggcttgaggagattctctgggagaagaaatatgatatggatgtataccgttgcaaaggagtgttaagtgttcaaaattctgatcaacttcatactttgcaggcagtgaaggaactgtatgagattgttccatctcgcaagtgggaaaaggaagagaaacgcataaataagatagtgtttattggtcataatctgaaagaagatattctgattaactcctttagagatcgtgcaacttgttga

SEQ ID NO: 54312 - DNA, 822 bp, Glycine max
  Peptide Sequence Number=SeqID_171090
atggtgccgtcgtccaccattgtggcccctttactaagtgtcggtgtggcgaccactggtgttctggcgatgctgcctctttcttcgtcaactgtggtggccctccctgctactattttagcatctatggcatcgccttctttgtcctcgtgccctcgcgtctccctcgatcatttgtacacttctagtgatgttgacttattgtggggtgccacttataagctggagcagaagaccctggttaactttgtatcagccttcgacaaaaatctcttcaggttggctggggtgctaaatgatactaactttgccaaggtgtttctccaaaggagtttggcaattttggaggagaatggactgcgacaccaagaggctgtgcaaaaggttgcatccttggaggcggatgttgcaaagtggagggctactgctcggactctgtggcgagtggagcaccctaaggtggccaatgccactattgatggacttgggtgtcaaagtggagttgagaaggataggcttgccaagaggattgctaagttggaggcccgaattaaagtgtcggagtccagattggaggagtctgagttgcgggcttctaaggagagggaggccagcaaggagctcgaggaagagctgattctttacaagaaggaggccacagagcaatatgataaaggctttcaaaaaaccgtcaggcaggccgatttctttgcaaatgaccttgtattaggtctctttgatcccttcaaggatgtgaaggagggtgtcttgcttgatgaggaagagattgatgtgaaggagcaagctgctgatgaagggtag

SEQ ID NO: 54313 - DNA, 228 bp, Glycine max
  Peptide Sequence Number=SeqID_171091
atgcatgttgacctattgaagcaattcaacaatatcagctctagctctgcaaacactgagcaacatggtgttcatattgaaaaccaacaatctaagtcaaacggtgttcaagcatatgaggaggctgaagatgatggggacaatgtacaacttgatccagcaattgagataaacacagaagattcagttaataattctactatcattaccagcttactccctttataa

SEQ ID NO: 54314 - DNA, 222 bp, Glycine max
  Peptide Sequence Number=SeqID_171092
atggtgttcattggcagacaagttctcaacaatgatggaacatcctattgtgatgttggggatggtgtggttgcaacaagtgatgatggaaactttgtggatgcaacaactacaaaaggtatggttgtagcaactaaggatggtgatggggatggtgcaacaaatggggcttgggcaaatgatcccggtgcatctctttgtaacaatactttaattacataa

SEQ ID NO: 54315 - DNA, 1887 bp, Glycine max
  Peptide Sequence Number=SeqID_171093
atgggtaattgggactttggattgagaggttttagcccttccttttgcagcatattttgggttttgatgaatccattgacattccttcgttattggggaaggaatgttgtggttttttactttgcttgctgctcttggaattctgggctggtggaatttggtgtgggttttgattctgtgtgtctgaggaagttcaaggatttggacatgagaagctcctggttcaataaattgtcaatcattattggccctagacctcctgtgaactggttattcttgtgcctaatcagcctgcttgtgctgattgttgttctgggttcatcttcttctaatattgatgatcaggcgcctgatattccggtttctctcatctacacaaactataggagggttaaggagcaggcggtggttgattatttagagttaaggtctgtggcacggggtgtctctagacaaagagaatttgatctttgtggcaaggaaagagagaattttgtgccttgttacaatgtttcagccaatttgttagcagggtttaaagacggagaggagtttgaccggcattgtgaactgttagttgaagcagagaggtgtctggttcgccctcctaaggaatataaaattcccctgcaatggccagctggcagggatgtcatatggagtggaaatgtgaagataaccaaaaaccaatttcttgcatctggaagtatgaccaaaaggttaatgcttctagaagagaatcaaattgctttccactcagaggatggactgatctatgacggtatgaaagattactctcgccaacttgcagagatgatagggttgggaagtgacaacgagcttcctcaagctggtgttcgcactatactggacattaattgtggatttggtagctttgcagctcatttggcatcattgaaaataatgacagtttgcattgctccatatgaggcaacaggtagccaggttcagttggcccttgagagaggccttcctgctgtgattggcaacttcgttgcaagacagctttcatatccttcattatcatatgacatggttcattgtgctcaatgtggcatcatttgggatggaaaagatggaaggttccttatagaagttgaccgtgttcttaaacctggaggatactttgtattaacctcaccaacaagcaggtcacagggaagttcatcacaaatgaaaaggaggaacatgttgatgccaatggaagagctgacccagcaactctgttggactcttctagctcagcaagatgagacattcatctggcagaagactgctgatgttaattgctatgcatatcgaaagaagcatgctataccattatgcaaggaagatgatgatgctcagtcatattatcggcctcttcaaccatgtgttcagcctgaagatttttttgaagacttacaattctggagatcagctctcaagaactattggtctttgcttacaccactaattttctccgatcatccaaagagaccaggagatgaagatccattacctccatttaacatgatacgtaatgtgatggacatgagtacaaaatttggggggttgaacactgcccttctagaagagaaaaaatcagtttgggttatgaacgttgttcctgcaactgcttctaattcacttccttttctactagatagaggctttgctggtgttatgcatgactggtgtgaacctttccctacgtacccccggacatatgatatgcttcatgcaaatggaattctttctcatctcacttcagagaggtgcagcttgatgaacttattcttggagatggacagaatactgcgtccagagtggcaccttcattcctctttcaacagtttcattcttttgacatattctccagcatga

SEQ ID NO: 54316 - DNA, 1107 bp, Glycine max
  Peptide Sequence Number=SeqID_171094
atggcgcgtcgtcatttcgtcaacgacacgacctttgtcattgctctgaggactctgggtggtgccagggagcttaagaagtgcgtggagtttttccacttgatgaattcaaacgggtgtgaatacaatttgggaactttgaataaggtggttgaggcaatgtgtaagagtaggcttgttgatgaggccaagtttgttgttttcaagttgagggagtgtgttaggcctgatggggtgacatacaagaatttgattatagggtattgtgataagggtgatttagttggggcttctaaagtttggaacttgatggaggatgaggggtttgaggctgatgttgatgctgtggagaaaatgatggagaccttttttaaggtgaatgagtatggtgaggctttgaggctttttgagacaatgaggttcaagaggatgaatgagcttggggcttccacttatgggctggtgattaggtggttgtgcaagaaggggatgatggcccgggctcatgaggtgtttgaggaaatgcgcgagaggggtgttcgggtcaatgactcgacgctgggggatgttgtgtatgggcttctaacgaggagaagagttagagaggcttatcgggtttttgaagggattgaggtgccggatttgtgtgtgtatcacgggtttataaaggggcttctgaagctcaggagggccggtgaggcgactcaggtgtttagggagatgataaggagaggttgcgagccgactatgcacacgtacataatgctgctgcaagggcatttggggaggagggggagaaaagggaccgatccacttgtgaatttcgacactatttttgttggggggatggtgaaggcagggaagtcaaaggaagctactaagtacgtggagagggtgttgaacagaggaatggaggtgccaaggtttgattataataagtttttgcactacttttcaaatgaggaaggtgtgcatatgtttgaggatgtgggaaagaagttgagagaggtggggttggttgatttggcagatatacttgatagatatgggcagaagatggctactagggataggagaagggacagaagtccaataactgaagattaa

SEQ ID NO: 54317 - DNA, 803 bp, Glycine max
  Peptide Sequence Number=SeqID_171095
atgtacgctttcatcgacggttatccttgcgtgcgcctgatgaatctctctggaaccatcagttgttcaagtgagtctcctcgctctctcattctctctctatcgaaattctttgatcctggacgagataaggttgtggctccgattgtaaggttcgaaaatgttgacataatagctgagccttctgctgatgttccaaattcaccagatcctttcatgaatttggctacagcacagattaaggcaacactagttgagaaatataggcgttcaacatatgccacaagggcaaagaacagaattcaagaactgtctattgatggcttcaacctccaacacaacatggaagtcaagctagttggtggaagcaactatttaacactgacaaagagatcatttgtgaacatgtgtagagatgtgggttactactggcttaatggatactatggagtagcagcatatattttagccaacttcctttcttcattcccattcttggttctaattgctctgacatcctgcaccattatgtataacatggtgaaattcaggccaggaatcaatcactttgtgtttttctttctcaacatctacagctgcatctccgtaatagagagcctcatgattgttgtagcttcacttgttccaaatttcctcatgggaataattacaggggctggaataataggaatcatgatgatgacctccggattcttcacgttgctctctgatcttccaaagccagtttggcgctacccatatttatatatcagttatggttcttgccttcttgggcaatacag

SEQ ID NO: 54318 - DNA, 1206 bp, Glycine max
  Peptide Sequence Number=SeqID_171096
atgtatgatttacctccagagttccattttggactcttggattggaaaccaagtgggaatagtgtgtggcctgatgttagaactaatatacctggttaccctgggggtttgaatttgcaacatagtatagagttttggcttacattggatattcttgcttcagaatttccccaagcctctaaggctaggactgtaatccgagttcaaaactctagtgaagccgatattatatttgtgccattcttttcatctttgagctataaccgctactcgaaaagtaaaccgcatgtaaagaaaagcaagaacaagatactgcaagaaaagttagtgacgtatttgatggctcaagaggaatggaagagatcaggaggaaaggatcatttgattttagcacaccatcccaacagtatgttggatgcaagaatgaagttgtggcctgctacattcattctttcagactttgggaggtatcctccaaatatagctaatgttgaaaaggatgtgattgcaccttataaacatttaatcagttcctatgtcaatgacaactccaactttgatagccgaccgacattgttgtacttccaaggggcaatatatagaaaagatggggtaagaaatggaacaaaccaacctattgttttggagatgggaggtttagcgcggcaagagctattctatcttctgaaagatgaaaaggatgtgcatttttcctttggaagcattgggaaagatggaatcaagaaagcaacagaaggcatgcgtgcttccaagttctgcctcaacatagccggtgacaccccttcatcgaaccgattgttcgatgccattgctagtcactgtgtccctgtcatcatcagtgacaaaattgagctaccatatgaagatgtcattgattactctgagttctgcatatttgttcgtactagtgatgccatcaaagaaaagtttctaataaacttcatcaggggtattgccaaagaagagtggacccgaatgtggaacaagttgaaagaggttgaacatttctttgaatttcacttcccttctaaggaaaatgatgctgtccaaatgatttggcaagctgttgcacgtaaggttcctgctatgagattaaagctaaataggtttgagaggttttctaggtcccctccaagtacggacgaaggactaagatcaatacctgttccaaagaatttttggtga

SEQ ID NO: 54319 - DNA, 403 bp, Glycine max
  Peptide Sequence Number=SeqID_171097
atggaacttatgagactctatcaacatgaagagaatgacaaaaagaagaaaggaattgcactcaaagcctcatcttcttctattcacgaggaaaatgacaaagaagactcaaatgaaaagaacttagaagaagatgatgatgatttcaatctctttgtaaagagattcaataaattcccaaggaacaaaggaaatcaaaggagatcgaacttcaatccaaagaagaaaggagaagattcctccttagttcaaaaattctatgaatgcgatcaacctgggcacctgagatttgattgtcctatctttaaaagaagaatggaaaaatctgacaagaagactttcaaggataagaaagaaaagaaagcatatatcacttgcaaagataatgacatggattcatcaa

SEQ ID NO: 54320 - DNA, 306 bp, Glycine max
  Peptide Sequence Number=SeqID_171098
atggctctggatagaatgcagctacaaaatatgtgcaaaaaggggcacgaatctttcaaagaatacgcccaaaggtggagggatctggaagctcaagtgacgcccccaatgacagagaaggaaatgataaaaatgatagtagccacattaccagtgttctactatgaaaatatggtgggctacacgccttcaagctttgccgatttggttttttctggcgaaaggatcgaagtgggtctgaaaagaggcaaatttgatcatcctactttgatgaatgggaagcctggggcaaatagagaggattag

SEQ ID NO: 54321 - DNA, 216 bp, Glycine max
  Peptide Sequence Number=SeqID_171099
atgataaatgcaggaatgatatgtccattacgatgccatgaagagatgcatgatgcgatcaaggaacaagccagaggactatcagcaacaatgcatcaccaaaagaggaaaactctagatgaggcttcattgttatcaagcgagtcaaagacccaacatgaccacagatcgacctccaccccttatggctcacatagacccgagtatagggcctaa

SEQ ID NO: 54322 - DNA, 559 bp, Glycine max
  Peptide Sequence Number=SeqID_171100
atgaatgacgaactcacggccttacactccaacaagacttgggaacttgttcctcgaccacctaacactaacattgttggctccaaatgggtattccgcactaagtatctttctaatggctctattgatcgcttcaaagcacgattggttgcacaaggatttactcagactcccggtcttgattatgattatacattcaatcctatggtgaaggcatcaactgtttgtgttattcttactctagcagtcatgcaacattggccccttcatcaattggatgttaacaatgccttcttgaatggactcttgtcaaatctagtctacatggagcaacctcctggattcattgatcctcgcttcccttaccatgtttgtcgtcttcggaaagctctttatggcttgaaacaagcccctctatcatggtttcagaggttcatctccttcttacttcatcttggttttatcggcagcaaggcagatccatctctcttcatctatcatcataacaccgcaactctctaccttcttgtctacatcgatgacattattttgaccagta

SEQ ID NO: 54323 - DNA, 1230 bp, Glycine max
  Peptide Sequence Number=SeqID_171101
atggcccacgctgcatcactctctgacggtgctctatccttcaacaccatgattcatatgttgaatattcgtctcaccccatcaacctttatactgtggcgtcgccaactacttcccctccttcaaggacaagccttatacgatcatattgatggctccactcccgcccctcctaccatgttaacctctgtcgatggttctctgtcctctaccgtcaatcccgcatttacctcttggaaacaacaaggccaacaacttgtcagtctcctcctaacttccctcacggaagaaaccttggctgaagttctccattgtgagacttctcaacaaatttggactacccttgaatctctctttggcggtgattctaaacaatgggagatcgtgattcgcgaccaacttctgcatctcaaaaatgacttatcctccgtgcgagacttctccaaatccttttgtgccctttgtgatcaactcattctcatgggcaaacctgtagatgatcttgataaattgcactggttcctaggaggattgggtccaacttttaccagcttcggcgcatctcaactggccatgctcccactccccacttttagagatttagtatctgctgcagaaagctttgaattttacataaatgcgatggaagttgtttcttctcaggcttctttctactccaccactcattgtccatcacacccttctcacccacactcctcgtctggagatcgctcctcatctggttctcatgctcccttaagtggtcgaaagggacgtgggcgtggtggccgtggacgtgaaggtcactatgctaccttttgtccccaacagtataatggtgctcccctatcttctgctaatattgttgaatcctttgctgtgtcttgcaatatttcttctcctaacaactcggattggtacttggataccggcgcttccgctcacatgatgtcaagttcttcaacgttggatgccatggaaccatattttggtaatcacaaagttcttgttggaaatggtaatgttctgcctatctctcatattggttctcgtcgcttgaattctaccctgcaacttctagatattttggttgttcctggtttgcagaagaacctcatttctattagtaaactcactcgtgactttccagttgatgctattttcactaataactcctttctacttcagaaaagggacacaaaggaaatcttggcccaagggaggcattaa

SEQ ID NO: 54324 - DNA, 303 bp, Glycine max
  Peptide Sequence Number=SeqID_171102
atgtcttttgaaggacataagccacaagggcgagacaacagtggcatagacaattacaaagacggtttggaaggagcaggcggagagacagcgacaagcttagaaggttcatcaaagagagagaatcccaagtgtgagattgaagaaataggtcctgtgttggagaagggaaacaaaacaaaaagcatcaagccaatacgtagtgggcatgtgggaatgaaaaagcattgcaagacctgtctcggtaatgtggcgatgcttgcatttggccctgccattttgagcaggggtatgggggcatga

SEQ ID NO: 54325 - DNA, 201 bp, Glycine max
  Peptide Sequence Number=SeqID_171103
agtgctaaaaagcagcctactgttgctcattccagctgtgaatctgaatatcgggctatggcaaatgcaacagttgagctaatgtggttcactcatttgctgcacgatttgcatgtttactctgctccccctactcttctttgtgataacaaaagtgctatatttctttcccagaatccggttgctcacaagcgtgcctag

SEQ ID NO: 54326 - DNA, 141 bp, Glycine max
  Peptide Sequence Number=SeqID_171104
atggcagagatggagaacaactgtcagaggtggagcaataacacctgtgcatacaacccccacaaaccccccttcccgaaattgaatgcaaataaaggcacatacaaagaaaagaagcagcatgagaagggacgaaagtga

SEQ ID NO: 54327 - DNA, 420 bp, Glycine max
  Peptide Sequence Number=SeqID_171105
atgtgggacttcaacatgccccattttccttatggctacccaccatgtgggactttcaacacacccctctatctaggcgtgatcacacctcccctcacgctcgaggctacttgcctagagcgtgacaaacatagggatccatttaggataggctctgataccatgttagaaagtgagtttgggcttaactcaaccctacaaaaccgacttataagggcgaagccagaggaaactctgttggaggcccgcaacgatactaacgtgcaaatcgtttgtctgacttgggtagggtccagcggatggaagagcaccgcacgttgcgtggtgtttagtgtgcctccggtggcccttgaaaatccagaggaccgagtgcctcccacacccgatcgtactcataaccgcattaagtctcctaggtga

SEQ ID NO: 54328 - DNA, 546 bp, Glycine max
  Peptide Sequence Number=SeqID_171106
atgacatctgaaacccttgatgattcccagcccagtaaaacacgcctcaaggctgaggcagacgcggcacaagacattggccgtaaactcgtggaactgccaaaagacaaattaaaaaagttacagcttgaagaaatccttctggacgcgattacagaggctaaacgcattacctccaatggagccattcgccgtcaaatgcagtatatcggcagattgatgcgagacactgatttggcaccgattgtagagcaactggaaaagtgggaaggtaaacatcaggaagaaaatgcccggttccatcatatggagcgttggcgtagccggttactggaggaggcgaaagcgattgagttgttcattgctgagttccctcaaaccaatgtgcagcaaatgcgtaccttgatccgtaatgcgcagaaggagcatgctgctggcaagccgcctaaaagtagccgtgagctattcaagatgattcgggaaatcatggaaggcaagagcgtcgtcgaagatgagagttttgatgatggcgcattcgaagagtga

SEQ ID NO: 54329 - DNA, 782 bp, Glycine max
  Peptide Sequence Number=SeqID_171107
atgcaacaggatcaacttcaacaaattgccaaagacatcattcaattgacccgtaaagcaggcgccagtagtgccgaagctgaagtgagttttggcacgggccagaacgtttctgtgcggcagggtgagacggaaaacatagaatacaaccgtgataaagggtgctctgttacagtatatttcgggcaaagaaaaggttatgccagtacatcggaccttagcccgcaagcacttaaagacacggtggaagccgcctgcaacatcgccaaatatacggctgaggaccctttttgcggactggcagaagctgccctaatggcaacggaatttccggacttatccttgcaccatccctggcatattgatgtagatgcggcactcgcattggccaagcgctgtgaagccgcagccctggcagtagacccgcgtatcagtaatagcgagggagcgagcatttacagccaaagcggtgcatttgcttatgctaacagccatgggttcatgggcggataccccagctcacgccatagtattagctgttcggtcattgccgaagcagagggtctgatgcaacgcgattactggtacagcagtgcgcgtgatgcgcaggacttagcgaccccagaacaagtaggacagattgctggtatccgcacggtcaagcgcttgggggctcacccaatcaaaaccggacaatatccagtcatatttgaagcgccactggccagcggactgatcagcacgctgatcagcgccatttctggcggcaatctttaccgcaa

SEQ ID NO: 54330 - DNA, 1045 bp, Glycine max
  misc_feature (1041)..(1041): n is a, c, g, or t
  Peptide Sequence Number=SeqID_171108
atgccagaccaggtttggcgagacttcatgctaacgctggatatcagccgtggcgactggcaactgcagcaaaactgcattcaggaactcaaggacgcgctgcaagtgctttctttccggctatcggcttcaggactggatcccgagctgattttgcaacacgaggatttggaatcaaacagctcaccattcatcacccaaaatatcgaaatccagaagtttctcgctttaaccagtatccaggctgaagatgtgcaacacttgtacagtgtactcaagcgctgcgaacagctgacttatgaaatccgcaaatccaatgccaaaaccgggaccagtatctccctgaccgcattgatgcaacgtattttgcagcaaatccagcgcatgcagctggtggtggatattctgcatggactcatcctcaagcacgacgtcagccaggccattacgcgcctgttaaaacaattagtcgatgcagagtgcaagaaaaacaacctgtcagattactggcgccaaaacaccgagctgctggctttgcgtgtcactgaaaacgccagccataccggcgagcattatattgcacagaagcgtagtgaatatttcaagctcatgggctctgccatgggagccggccttatcattgcctttatggccatgttcaaaatcctgatcgccagttaccacctgccgccacttaccgaagcgattttattcagcctcaattatggcctgggctttgtcatcattcacttgctgcactttacggtggccaccaagcaacccgccatgaccgcggcgaccattgcagccaccattgatgatcatgggcacgacagcaagaatatacacaacctggtcaatatcgtggcacaaaccaccagtagccagaccattgctatcttaggaaatgtggtcgtggtgatcccggtagcgatactgatagactggttaatcatgcaagccactggccatcactttatcgggatagaaaaagcgcatgcattactggatagcaataaacccgttaatcagcttgaccgncttg

SEQ ID NO: 54331 - DNA, 291 bp, Glycine max
  Peptide Sequence Number=SeqID_171109
atggtgaggatatcaaaggaaaaaaaccaattaagacaagcgactaaaacatattttgagggaaaacatgttgttcaagaacaattcaaggctctaaatgcaaaatttgatgatttgcaatctacttccaagtctaaggtacctcttatagaaatcatgataaggaagaagaagaggagcattataatgaaatcactagaaggagaagaaaaggtgaatcaagaaaaagatgatcatttaggaaatattcaaatgacaatcccattattccaaagtaaaaattatccttaa

SEQ ID NO: 54332 - DNA, 915 bp, Glycine max
  Peptide Sequence Number=SeqID_171110
atggttgagtgtatgaagaaagtagcaaaacttgatcttgatctaactgtggaagaaaggaacctcctctcagtgggatacaaaaatgtgattggtgcacgaagggcctcttggcgcatcatgtcctcaattgagcagaaggaagagtctaagggaaatgagcacaatgttaaactgatcaagagttactgccaaaaagttgaggaggaactctccaaaatttgtggggacattctgactattatagaccagcatttgattccttcttccgcatcagcagaagctagtgttttctactataagatatataattgcattttctggttaaaggctaaaagaaaggtattagtacggatctggaaaggtgattattttcggtatcttgctgagttcaagactgaccaagaaaggaaagaggcagctgaacagtcactgaaaggatacgaggctgcttcagccactgcaaacacagatcttccatcaacacatccaatccgtcttggacttgcactcaatttctctgtcttttattatgagataatgaactctcctgaaagggcctgccatttggctaagcaagcttttgatgaggcaattgcggagttggacaccctgagtgaagagtcatacaaggacagcactttgatcatgcagctgttgagagacaacctgactctctggacctctgatttgcctgaggatggaggtgaggacagcataaaagctgaagaaaccaaaccttctgagcctgagctagttttggcatgttgggggatatcattatcgttttggcatgttggggatatcattatcgccgaaccaaatgcttatattggatttaccggtaaaagagtaattgaacaaacattgaataaggcagtaccagaaggttcacaagtagctgaacggaaataa

SEQ ID NO: 54333 - DNA, 498 bp, Glycine max
  Peptide Sequence Number=SeqID_171111
atgggatattatttctatcatcctcctgaccataaagtgtttgtggctagagaaaaaaccattctcgaaaggagattctcgcagaaggaaatcatgataaagaaattgagcttgcatgaagttcaagaaaatgatgaagcaccaaaggctcaagaacatggaaatgaaaatgactatcctaaggttttttggggtgctagaaagagtgctggaatgagaacgaccattctcccaaagagcatggtcgtgttattcttcaaagttcacattttcaccctttttcagcttgttccacatcaattgactttgagtttctgcctaacaccaacctacataaaaacgctcaacaacacaatagagacactatcgcaatggactttggggtggcgtgagatgtgcgacagacttcggagtgacaaagagtcatggaagaaggctagagggttttgttttgggcacgacatcatagaagagaacattgtttttgggtttcattaa

SEQ ID NO: 54334 - DNA, 273 bp, Glycine max
  Peptide Sequence Number=SeqID_171112
atggtgcgggacttggtttcatgggtacggagcatggaggcagggtcggcatggaaagaaaaggcagcgatggtgactgctcagtggaagaagatgggaagtgttgagtggcatcgcgaagggctagccgctgaagaaggtcgtccagtttggtggccatgcatcccttatatagaggcactagccaagggtgctgctaaaacaaaaggtgctagaatgcgaaaagaaaataacagaaaaatatggaaatggcgacaatgcaatgctgcatga

SEQ ID NO: 54335 - DNA, 1068 bp, Glycine max
  Peptide Sequence Number=SeqID_171113
accgttcacggtttctgcgggaaaggaaaagggtacaatgcaaaaggtatttctctcagctcaaacatgatgccaaaattcccaacggttaggtggcctgcgggaaaaagagaggattttgggagaagagagaagaaacgaaattgtgaggcagaggaggctcaggtatctgtaaggtctgacgttgaccaaggtcgcttgtggaaggaagggtgggtgttgataataggatggggtgtttgtggtgactcaaagtgggttgggtcaagcacacagggaatgtcagcacggagggacactggtggcgaggcgaggttggataaaattgtgagtgctaccaccgtcgacgaggatgaccacctgatggtgtgcgatggttccatagagggaaaggctggtgtgctcagaagaagggattggggaagacggaggaggtccatggcagtcttcgtcctcattggtaatcaacaagtggaggcgaggacgacaacggtgaccatttgtcgtcacagtggtaacataagcctttgtcacggcgaagggcaaggggcactgtcaccgaagaagaaggtggcgcgcgtgacggtcgtcgatgatcctagatcttctcctcttgcagcttggcgagagcaatggcatgtggtagagacaagggctgtagagcctgcacctcccgacgaagctccggtgagcgcaaagtgcgactccaaagcctggagcaatgctggccatgaggagatgaacccattacgggtcatccattgttaccaagaaagggctgcttcatgtgggttttggtgtttggtgaagaaggtgtggggtgatgagaaggtggaggttgcaggggaaaaggttgtacgattggcttgggcttgggctagtttggcgatggcctcttccatacggtcaagattggactggcgggtgttatggtcgggcatggtggctggcggtgggagggcagtccttcgtgtggtcgtggtgctatcattcgtacatgctacttgcatggcgggttctgtggggaacatttgctcttccaagggtgatgcggttaacgaaggttaa

SEQ ID NO: 54336 - DNA, 291 bp, Glycine max
  Peptide Sequence Number=SeqID_171114
atgcccgaccataacacccgccagtccaatcttgaccgtatggaagaggccatcgccaaactagcccaagcccaagccaatctcatccaggatcatgccaccctggcccaaacccaaacctccatgaccactaagatggattccatgttagaacacctcgcgaccattaccgtacaaccttttcccctgcaacctccaccttctcatcaccccacaccttcttcaccaaacaccaaaacccacatgaagctggacgttccgaggttcgacggccatgaccccattggatag

SEQ ID NO: 54337 - DNA, 403 bp, Glycine max
  Peptide Sequence Number=SeqID_171115
atggcttttcgcacctaccatggccactacgagttcaaggtgatgcccttcggtttgaccaatgcctcgtcaacctttcaggccaccatgaatgaccttctccggccatttttgtggaaggcttgttctacctttgtcgttccaaatgtaccttcgccgaatagcaactatcttggccacattgtctccctgcatggtattgcaccagacccaaagaaaataaaggtgatgattgactggcctacacccataactccttcagacctcaggagttttttgggcctcactgcacaaacaacgttccaacaattgaaaacactcatgactcaggcacccatattggcctcccctgatttcactatgccatttatcctcgaaactgatgcttctggcacgaccattg

SEQ ID NO: 54338 - DNA, 2022 bp, Glycine max
  Peptide Sequence Number=SeqID_171116
atggcgtcgcaaatggcgatcctcttccgcacgcgcaccctcctctcttcgaaacccaccaccaccaccctcatcaaaaccataaccacattccccttcctctcacaagagccccaattagtggactccaccccaccaccttcttcctcaaccacccctctccctcccaaccccgcctccggaagccccctctacaacgaaaactggcgcagcccaatcccgccgccaccgcccgcttcctccgccgccacctcccacgcgctcgcccccgtgggcttctacaaccgcgccacgtcggaaacatacgacccccgcgccctcctcgacctcttcggcgactggatggcctcgcagcagtggcacgacgtcaagttccttttcgaggcctgggtccgctccctcgataagacgggcaaaccaaacaagcccgatgttaatctgtttaatcactacctccgcgccaaccttatgctcggcgcctccgccgccgagctcctcgaccttgtcgcgcagatggcggagttcgacgtcgcccccaacaccgcgtcgttcaacctcgtcctcaaggccatgtgccaggccaaggaaaccctcgccgctgacaagctcctccaacggcaagattgttgttttgtaattgctggtaatactgtttaccaggcaagagctactggtgctagaagaacggtattcctaaattgtaactgttccttgatttgtttctgtctgttgcctgttctttttgatcttgatgtagaggagagcccactcctttttaaagccaaactgatgctgcagtcaggaaatgatgctctccctgatgatgaatcgtatgacttagtcatcggaatgctcttttccatggaccagattgacactgcattcaaatatatagatttaattttgaaatctggtaatgtgttgtcaatgaaggtttttatgaactgtgcgggcagttgtgtcaataagggaaggcttgatacattggtgacaataattgaaaggtgcagggcatcagatcaaaacaaagctctttgccccaactgggacttgtgcaattttattgttgaaattgcaactcgggaggataatagcaaattagctttttatggcctggagtttatggctaaatggattgtaaagggtgaacgtcaaagacctcctatatatatttctgtagatgaaggtttagttctgtcagctcttttgactgctggtagaacctataacactgacctgctagtggcatcatgggctgttttggatcgctcattgcgtaaaaagaaagctcctaatccagagtcatatcttggaaagatatacgcacatgcatcattggggaatctacaaaaggcttttggtactctgaatgaatatgagtcagcttatggggactctggtcaagaagctgaagacttgttctgcccatttacttcgttacatccattggttgtggcatgctccaagaagggttttgagactctagataatgtttattttcaactggagaatttaaaccgtgcagagcctccttataaatctgtagctgcactaaactgcgtcattttaggatgtgcaaacatatgggaccttgatcgtgcttaccaaacttttgaatcaattggatctacttttgggttgatccctgatattcattcatacaatgggttgatatatgcctttgggaagctcaagaagacacatgaagctacaagggtgtttgagcacctagtgagtttgggtctgaagtctaatgcaaaatcatattctctacttgttgatgcccacctcattaaccgggatgtcaaatctgctctggcagtgattgatgatatgagagctgctggatatgaaccatcaaaagagatgctaaaaaaggtcagacggcgatgcacacgagaaatggacaatgaaagtgatgccagagtgcaatcactggctaattccttgaattaccaattgggttcagaaaaccgacgggacattctgtttaatcttaattacagtatgggttatgcttga

SEQ ID NO: 54339 - DNA, 180 bp, Glycine max
  Peptide Sequence Number=SeqID_171117
atggatcatgctgccgacaaggttcatgaagagtttcacaagccagttacggatcatgaaggtgccgatacgaagggttttccaggcaggccccaagatacatcagtgttgacgtcatatgttgattatgtggcatccagagaacgtactaagttgaagttggcctctcatgggatgaag

SEQ ID NO: 54340 - DNA, 153 bp, Glycine max
  Peptide Sequence Number=SeqID_171118
atggttggagcattctcgcaaaacactgtgaccctgactggtctccctatgatattacctagtgagagtgacttgacttactattgtgtgatgaataggtggatggactatgaagaacctcatgctagaggacacgggaacaccacgctctga

SEQ ID NO: 54341 - DNA, 725 bp, Glycine max
  Peptide Sequence Number=SeqID_171119
gtgggttggaccaagaagctacgaaaggattgtgcctctctaaggggaatgaagatattaggctgattgtcgtggaggaaaatgcacgtgatggccctttgaatggtgaaaaattctgggtgaaaaaagatagagaagatgcaaacaacttactgacagtagggaagaatctgggggtatctatggcagaaaagcacactgcaatggtggagaaacttgtgtttatggagccttgggatataaacagaccagaaagctggaaggtgtgctacaaacatggagggagttggtgggcaatgaggatgtacaagttgttttcacaagaaaccaagaaagaagtcatcaataaagaattgtgttttactttgtggggagatcttgaggtgtgtagagggatgcatgggaggggtggtgatagggatgtggtgttagttagtatttatttgccatatgatttggttggaaaaaggaggttatgggacgagttgaaagtcatcaaggaagactctaatgttactagatggcatgtcatgggagactttaattgtatcaggaagagaggtgataaaagtcttgggggggctcagcaagagagtggtgcgacacatatagaggggtggcatgcacgagccgtagaggaggaagtgaccttcacgcacagtgctggccggggtagggaggcacttcaaagtgtgggagattctgtgacttcaactccaagcaag

SEQ ID NO: 54342 - DNA, 495 bp, Glycine max
  Peptide Sequence Number=SeqID_171120
atgatccaagcttctagttcccagattctcccatgtcaaactgaagcattgtataggaaacagaaagccaggtcaatagctgtagattctgagaggaagaggaggtcaaaagctatccctgttaaaatctctgatcaagctgaagctgagaattcggataatgatggtgacgagagtcaagaagcttctagaaaaacaacttctagtaaaaggaaagcatcctccacaactgctagtgaaaaggttctcgaagaagtttttaaagaagtgaaagaggcttctaaagattcgttggatgaagattctgagtatggtattcgacaaagtacttcattcaaatctgatccctgcgtgaaatcaagaagaaaggaggctgcagggactaaggaaataaccctagaagttacttccaatcttgaccaccttcacgaaatcaaaatagattctgaacttgctactcatgtcacttacttaaatgaatttagatgtctgtag

SEQ ID NO: 54343 - DNA, 1908 bp, Glycine max
  Peptide Sequence Number=SeqID_171121
atgacgacgatggaggaagagagagacgtgtcatcggatgagttatcagaggagaaatatgacccagtggaggagatccaaagagtcatccaatccatagttcaattcggcgagtaccggaggacacagaggaaggagagccacaacctcgtgcgccgtttcaagctcatgttgcctctctgggaagagcttcgtgacctcccacaacccttcccagaaatcggcgtcacttggttatccaaagtcaaggatgtgcttttgttcgccaaggatttgttgaaactatgtagccaaggaagcaagatccacctcgctttggaaaccgaggtagttatgatcacgtttcagaaagtgtatgacaaattaagccaagcgtttggtgatgtgccttgtgatgaaatgggtatctcagatgaagtcaaggaacaacttgagctaatgcacgtgcaactcaagcgagccaggagaagaactgatacacaggacatagaacttgcaatggatatgatggttgtgttttctgataatgatgacagaaatgctgatagtgctatcattgagaggctggctaaaaagctggagcttcatagtgttgaggatctcaatatagaaacattggctattaggaaccttgctgcagaaagaaaagggcaacaggctgagagcactcagaaaataatttaccttcttaacaaattcaaacgaattgcaggcatggaagaaaccggcatccttgatgatcctgccgcacccaagatgcttgagaggtgcacctctttggtcatccctcatgagtttctctgcccaattacactagaaatcatgacagatcctgtcattgtaacaagtggacagacatatgaaagggaaagcataaagaagtggttccaatccaaccataacacatgcccaaagaccaggcaacctttggaacacttgtcattggcaccaaaccgtgccttgaaaagcttgattgaagaatggtgtgagaacaacaacttcaaacttcctaaaaaatacaattcttcaggtccagaaagctgtcctatagacagcaaagaggaaattccagctttggttgagagcctgtcatctattcatttagaagagcagagaaaagcagtggagaagatacgtatgctatcaaaggaaaatcctgagaacagagttttggttgctgaacatggaggaataccacctctagtgcaacttttgtcctatccagattcaaaaatacaagaacatgcagtaacagcacttttgaatttatcaattgatgagggtaacaagagtcttatatccacagaaggtgccattccagctatcatagaagttttggagaatggtagttgtgtggctaaggagaactcagccgcagctttattcagcttgtcaatgcttgatgagattaaagagattgttggtcaatcaaatgggtacccgcctttggtggatttgttgaggaatggaacaattagagggaagaaagatgctgtgacagctctttttaacttatctatcaaccatgcaaataaaggtagggccattagagctggcattgtgacacccttgcttcaattgctcaaggacagaaacttgggcatgattgatgaggctctctccattttgttactccttgtatcaaattcagaagcaagacaagagattggacaacttagtttcattgaaacccttgttgagttcatgagagaagggagtccaaagaacaaggaatgtgcagcatctgttcttcttgagttgtgctcaagtaactcatcctttacattggcagcacttcagtttggagtgtatgagtatttaatggagataaaacaaaatggaacaaatagagcacagaggaaagcaaatgcaatcttagatctcattagcaggagcgagcaaatttaa

SEQ ID NO: 54344 - DNA, 465 bp, Glycine max
  Peptide Sequence Number=SeqID_171122
atggaacacactgaagggcattcgatgacagagaatatgagaattttttacaatactatgaatcagttgacagttacatatattaaattagattatgagttgcgagctttgttgttgttcaattccttgctcgatagctgggattgggaagtccatgttgtgacactgactaattcagctccaaatgggaagttgtcaatgtcaatgctaaaagatagcatcttaaatgaagaagccaaaaggacggagtgcttgagtattacttctactcaatcaaaagcacttgttgcagattcacaggggagaatgttattgattatggagccttatatcattgttggtgattctggcacaataaagatggaaaatgaaaggatatgcaaattgttgttaaagcttaggatatcgacggctatgacatttacattggtggtggcatattcaagctcaccaaagggtcactag

SEQ ID NO: 54345 - DNA, 213 bp, Glycine max
  Peptide Sequence Number=SeqID_171123
atgggtgctcaaagctcaaagctttatacactgccggttaacaagttgattgtgctttatgtggttttcaagcttgacgagagttacacgccgagcaaagtttccatccgtgctggtgatggttttcacaacttgaaggagattaagaccgtggaactcgtgaaggcaactgggtgggtttatctatccttgtctggagctgatcctaggtaa

SEQ ID NO: 54346 - DNA, 120 bp, Glycine max
  Peptide Sequence Number=SeqID_171124
atgaagatgcatgtttgcaagttcccatcgttagacaaagcacatgtggacaaaacagaagtatcagagtgggcactgagcatgacatacatgcaaatagtgaagacacatatcccgtga

SEQ ID NO: 54347 - DNA, 219 bp, Glycine max
  Peptide Sequence Number=SeqID_171125
atgtctcctccacctctagaacctcacaatcactcacaaactcatcccaagttctcaggaaggcttcctcttcaagctcggttctctgcagcggatggactgaagcggtgcgcttcgctagatgacccttcgtttagtgcaaatgaacagctcatccttcttccaaattcttcctcatgctcagccgaggagtgttgcgctcggcggatggctcgctaa

SEQ ID NO: 54348 - DNA, 285 bp, Glycine max
  Peptide Sequence Number=SeqID_171126
atgatacaaacacttcctgcaacggcttccaaatttgtgtatggctccaaaaaaagtattaccatccaccacggactttcaaaatccaccaaatggccactcaccatccagcatgacatcccagccattacacaaccatggttcaacctgattcatgaaaaaaatttaagacccggagatgaggtagtcttttactaccgttttcatgaccatgcatgggagctgctcatcaggaaagccatcgaatggaacaacaacaacaccgaccttgactttgatgaataa

SEQ ID NO: 54349 - DNA, 204 bp, Glycine max
  Peptide Sequence Number=SeqID_171127
atggatgatcgaggagatgaaagagaaggaggaactggtgcaggccattataatcgattacaggcttctataatcgattacagccttgctgttctaaggaatatgatcaacaaatattccataatcagaaagttgttgcttcatccaaagaatttgggcacaacaactgccagcaaaaatgtattccgcttcagcagtggataa

SEQ ID NO: 54350 - DNA, 366 bp, Glycine max
  Peptide Sequence Number=SeqID_171128
atgtatccaagcatacaacacttaaatcataatcatagcacacacaatggtctcttttggaagacaggaaccaagaaagaagaggcagcaaaacaacagcaacagaaaaatataagttttaaatggatccacaaagtgaacacatacctaagaaagaagcagacattatcttcgttcacacaacatcagcaccaacaacgagaggtggcgatcatgtcgacgttgttggagcatgctaacatggtgaagctgaaggtgacttacgaggacgaagagaacattcctctcgttatggagctctgcaccggcgggaactcttcgactagatcgttgtgcgggggcactacaactagcgtgttatcttga

SEQ ID NO: 54351 - DNA, 294 bp, Glycine max
  Peptide Sequence Number=SeqID_171129
atggcatactcagaagccaagttcctttttatgaaattagtgtcaagtaaacaacgcaacagccctaaatatgagtggttatccacgcgcaacaatgaaaccacgatctctcgaactcttgaggggcgtttccacttcttgtttgaggcggcttctttcttgttggatgaggtggttgatattttgaacgtgccggtggccttgatgatagccgactcggcatgctccaagagccaccggatggtcttgccgtcggacttgtggtcgatctcttgggtcaactggaagatctga

SEQ ID NO: 54352 - DNA, 219 bp, Glycine max
  Peptide Sequence Number=SeqID_171130
gcacttggtggacctgcagctcgcccaggcgagctgagactcagccatgaagcaactggctcgcccaggcaagctggttactttacatggaagtcttttggtggcccaagcgagccagaggctagcctgggcaagctatggttcaggaagctcaatgaaaagacccttttgcccccttcttttggtattttttgcattcttgatcaatacactgaatga

SEQ ID NO: 54353 - DNA, 402 bp, Glycine max
  Peptide Sequence Number=SeqID_171131
atggcttccaagagtattgcatgcattgttcttctctccctcaacctccttttctttaccatggttagccccaacaccattgccccttcccctgcgatacaaccaccaccaccgccaccatcaccgccactaccacaccatggaaatagaaaagcagcatgtgcggacctgcggggtgatcattttggttcctttgtctttgccatcacctgcaacttaggtttttgttctgtacttgaagccgagttacgggcaatttatcacggcttaaagataattcgggacaaagctattgttgtggagtctgattcctccttagcggttcaaatgctgaatgatggttgcagtaggcagcactctagttacttgcttgctaataaggttgtcagtttggtgagctag

SEQ ID NO: 54354 - DNA, 1038 bp, Glycine max
  Peptide Sequence Number=SeqID_171132
gagttctctggtctttgttccttggtttcttcactctccgagagcattttgtgcactactgggttgaaaatgtatttggtggagagcaaaggaggtgccataacatgcatgttcttggctcttttcttcttggggacatggcctgctcttttgactatgttagaaaggcgtggtcgtcttcctcagcatacctaccttgattactcaatcaccaatttcttgtctgctttactcattgcttttacacttggtgggataggcaagggcactcatgatcagccaaatttcttagttcaacttgctcaggataattggccctccgttctttttgcaatggggggtggtctgttccttagccttgggaatctgtcaagccaatatgcatttgcttttgttgggctatctgttactgaagtgatcacggcaagcataactgttgttataggcacaaccttgaattactttttggatgacaaaatcaacaaagctgagatccttttcccaggagttggttgctttttgattgcagtttttctaggctctgctgttcattcatctaatgctgctgataataaagcaaagctcagcaatttcaccggtgattataaagatggagacatcagctcttccaaggagggggatataggtgagaagatctcatgtggttcaatatgtgagattattgtgtttgacaatgtcgaagcaggaactgcagtttttctcgtggagcttgaggaaaaaagagctattaaggcagactcagatggcagagtctgggccttgttggctggtctactttgtgggtttgggaatggtcttcaatttatgggtggtcaagcagcaggatatgcagcagcagatgcagtccaggcacttccacttgtaagcactttttggggcgtgattctgtttggagagtacaggaaatcatcaagaagaacatatatactgctagggagtatgttgtttatgtttatagtggctgttgctgtgctaatggcatcatcagggcaaagaaacagcactgccaaggaataa

SEQ ID NO: 54355 - DNA, 420 bp, Glycine max
  Peptide Sequence Number=SeqID_171133
atggcgagcgagtcctatggatactactgtcttcatcacaatggggttagcctcaatacactggcctatatgctagcagttgcggatgaacataagacctatattggccctaaggcattgatgcatgcttcacataaggaggagatctttggacccaacttcacccgtgctctccttccagctaaagactcaaactcttggtatcccatcagtctccagacaaatgcctctctctactctggtgtggccatagtttctggtgccttaaaacccatgatgatattgaaatcatctagggagtgtcatatggcgcatgtgcctcgggatggacttgagcaagtggagaaggaggcagtggtggtagtgatgactaatgatgatgagaggaggatgaaaaatcgagcacatgttgacgtctag

SEQ ID NO: 54356 - DNA, 597 bp, Glycine max
  Peptide Sequence Number=SeqID_171134
atggaggattatcttctcacaacaagagaagccttgatgtttcatgtcaagagaatcatgaagaggacacttaaccaggtggaggatgaagtagctacttctggacttggacaacatattcaagctttatctaagcaaattgagactttaatgaatgcccaatccctattccaagttcctaactccacacctttctaccatacttatgatagagatccttgcacacttccttctcaaattgaaactagttcaaagaaggaagacacgaaggctatcatgacaagaaacaagaaggttgaagaggttcttattggagagaacatggtaccagacaaagaggtagaggaaagggagtgtactgacatctcccaaggcacgtattcctttcactcaaagggcttgagggaacttgaacccactaatatcccccttcaccttgcagactgttctatggtccatcctagaagggtgatagaggatgtgctggcaacattcctaagtgtaggggtgattgatcctattgagagagttcttattcatgaggactttgaatgggcaatgagccttgatgaagaggaaatactgatgcttttttaa

SEQ ID NO: 54357 - DNA, 432 bp, Glycine max
  Peptide Sequence Number=SeqID_171135
atgcgaaacaaggaagccacccggattactccaacccttactcgttcctactacgatttgggaagacctttcgctggatttcatcatgggattgccactgtcacatggcttcttcgccattctcgtcatcatagaccatttctcgaatggggctcacttcagagctctgccacccaaaaatgggacacatctagtactcctccaactcagaaagtgctagttcaatggctcgaattagctttggaggacaccacttgggaggattgggattccctgcgtgacacttacaaccttaaggacaatgttgttttcccagagaagggtgttgatagcaatagagcccaaagggagagtgtagaagcaaagcttcatgatgaatcaagattgattcaaagatgttttgatgataacaaagatgataacaaaagatga

SEQ ID NO: 54358 - DNA, 588 bp, Glycine max
  Peptide Sequence Number=SeqID_171136
atggctatttgggctatttgcaaattccagttgcttaaagagatcaaggagtgcattgttttgggtcacaaggtgtcccatgttgccattgaggttaaccttgctaaagtgaaagtgattgcaagattgcctcccctaaatcgtgtgagagatgaggctacttttgagttttataatgagtttctaagggcagtcaattttctcaaggagaggttgctcatgtgtgatgccagtgattcagttgtaggggcagttttagggaaaaggaaaaataaggcatcacctgtttcacaatctgcagatgatgggataatcaaagagaattttcctgatataagtctcttaattgttgctaatatttcaagagcaccttggtatgctgacattgtcaactatttggcatgcaagggtgggttctactggcctaccatctatgtagatgctcatgcatttgtggcagcttatgatagatgccaactcataggggctttgtctaggaagatggaaatgccccaaaacaacatacctgtgattgaactgcttaattgggtggaagctgtggaacttcccaataattcttcttgttag

SEQ ID NO: 54359 - DNA, 132 bp, Glycine max
  Peptide Sequence Number=SeqID_171137
atgaagttgggcatgattagagttagaaagtggccacctgtggtggaaacacgagatagtgcatccaccgtggcattaccggaaccaggcgagttaggcgtcagtgagccaattgaactgatccttccgtaa

SEQ ID NO: 54360 - DNA, 486 bp, Glycine max
  Peptide Sequence Number=SeqID_171138
atggcatcaagaaagagagcgagaactgaggtcatcctttcatcatccaacccatttccttcgacagcagccatggaaccagatgcccaacaagcacattctttaattcctatgttgcaaagcttattcaggggacagttgatgatcgtatacaaccagcaggagttggctcacaacaggccaatcatatctatggagcagtttctggaaaaagtggcatggcttgaagctcagctccctctggaaagatcccataaggttgttcctcccggaactgtaccagctaggactaagccgacatcagctgagccacaacctcctgtagtagatccacctacttctccagaacttgagacattgtctcctccggcaccacctctgataatcatccccgatgactcagctgatgaagccgctgctcctcctgattcaccatcttgcaacatagacgatggttctgacttttctaactggatggactgctga

SEQ ID NO: 54361 - DNA, 138 bp, Glycine max
  Peptide Sequence Number=SeqID_171139
atgcggtaccaagcccatgactgcaatagtatggcacaaccacccataactcgatcaaccttcgatgatgtctgtcatagttctctgtacaggccatggtgtgcgcaagatgctaaggaaccatgtattgtatggtaa

SEQ ID NO: 54362 - DNA, 267 bp, Glycine max
  Peptide Sequence Number=SeqID_171140
atggctctacctaaagaaattgcgattgtcatttaccaccatgctcacattgcagacgactcggttcagggatcagtgtacacatgtgcgaacccaatatttctatacaatccacaattgaattatgccgaattatatactgttactgaccttattcctcaaccacaaccaccgtctccccaaccattgtgtccacaactacaactaccgcatccacaacaattaacatacaacaacctggaccttaatgatccagtcttcatataa

SEQ ID NO: 54363 - DNA, 318 bp, Glycine max
  Peptide Sequence Number=SeqID_171141
atggtcggcaagtgtgatggtcttaatgatgatcctacacttttggctgtattgaccgcatcttttggtgtaaccggttattccttaccttgggatcaaattggttattgggcagtcaaaattgtaacaggcgtacccgatgctattcctgtaataggatcgtctttggtagagttattacgcggaagttccagtaatgagccaagctcaagccttgcgtattcaactcaagccgagctcaagtctagtaaagtttggcttggctcggctcatttccacccctacatgcagggtcgtgcaagatgcaaggcaaattag

SEQ ID NO: 54364 - DNA, 229 bp, Glycine max
  Peptide Sequence Number=SeqID_171142
atgaacccgggtatagggccccttttttactcaaacccgtgggtgcttagaatgcagtgtaaaaatgcggaaaagatagcagcgagcgaggcgaggctcacgggtgcgctttccaaaggaggaaagatgcgcggagtcgccaccaacgaaggtattagcacctctcatgtcgacaaaagcagggctattgctcctatgtaccctccatcgaagaggaaatcagacctac

SEQ ID NO: 54365 - DNA, 306 bp, Glycine max
  Peptide Sequence Number=SeqID_171143
atgctccaaccatatgagatcaacataggcttaaaggagtactcaaacccgttgacccccaaggccaacactccgaagagttcgtcagggtctctccctcctagttcaggaattaatgaagcattgagcttaatccggattttggttgtggacttaaagagggaaaataaagcaatgtttaccttagcgagtttgggaagtgctgattttcaccctctcgctatgccaatctactggcttagcgagccatccgctgagcgcaacactcctcgactgagcgcaaggaagaatctagaagaaggatga

SEQ ID NO: 54366 - DNA, 198 bp, Glycine max
  Peptide Sequence Number=SeqID_171144
atgattcagtatagatttcaaagacaagcaaaagtggctcgtggcggtcaccgatggtcagtggtggtggaggttgggggtgttggtggaggatttaggggaagagaaggagaaagaaatggctcttttatgctactggacgtatttgtagtctgcaacacttgcccaggtgaaatttcgctcacctgggcgagctga

SEQ ID NO: 54367 - DNA, 372 bp, Glycine max
  Peptide Sequence Number=SeqID_171145
atgatttcagaatggttggagaccactaaacaattcgagttttatgcttctcgtctcaatttaatagccaaggtccagggagttgatgtggcagagaagtacacaaagaatgttccagactatttcagaggtgaattactgtacagaacgcttttagcaaactgtgtccgctctggcaacatggaaaaaacagaggaagtttttggaaaaatgataagtttaggtttgccgaccactatctatactttgaatcagatgatcattctgtacaaaaagtgtgacagaagaaagatacctggtatattatcctttattaagaaggacagtttgactccatctcatcttaaggattctgatagccaccagaggtga

SEQ ID NO: 54368 - DNA, 1005 bp, Glycine max
  Peptide Sequence Number=SeqID_171146
atgaacgacattcaagtgtggaacaacgccgcgttcgacgaccgcggcggcaacggcaacggcaacggcaatggcaacgaagacaactccttcttcccgatgaagacttctcggtcttcctccgagtgcaccaaagaaaacctgagcccgcccgcacccaataattcctccaagaaaaacatcaccgccacaaataaaaaccccaagggttacggtttcggttccgacgataacaacaacaataacaggaacattgacgacgagatcgaagaaatcgagcgcaagatccatcgtctcaccacgcgcctcgacgcgctccgcctggagaaggcgaagcgggggaagcgcgtggtgatgggcagagtcgtccccgcgaagttcatggagccgaggccaaacgccgtcatttcaagaaaacccgaagaaacgccgaagacgaaggttagggttaataacgataatgcgtggcggcgagggatgagtcttggaccaaatgagattgctgcggcgacgccggccaccgccttgcagagtcgccggaaatcgtgctactggaagattccggagatcagcgaggaatcgagggcgaaaaccaccgttgggagagtgaagaagaaagaggaaaatttggtggttcaggttcaggggaagaagctgtttgagaaggagaaagcgaaatcggtgtgtgagagtagcaagaaggggagggtggtggcgagtaggtataatagtgatgtgaggaagaggtcgttaccggagggagggagtgagattagggttaagaagacgtgggagattccgaagaatggcagagaagaggcgacagcgggggcagtggtgcttccgaagattaagacgacgaagtgtgtgaatgaaagtcccagagattccggtgcagcgaaaagagttgctgagttggttggaaagaggccttatttcagcactgatgagaaagatgtttgtcagattctgaattttgctgaagaggaagaagaaagccaatga

SEQ ID NO: 54369 - DNA, 414 bp, Glycine max
  Peptide Sequence Number=SeqID_171147
atgtgggacacattagcttcgacatatgaaggatcatcacaggtaaaatgcaacaagctcatcttgttgacatctcattggaacttaaaggttcatgagcaagaacttcaacaagatgaaggattcaaaaaggggaagtcatcgactctaacaacacaaaaagcaacaatatcctcaacttgcaaggaatcctcatctagatctgcgtccaaaagctcatccaaagctgtcaacattgatacacctcatgatgatgagtccaatgatgaaggctcagacaaagatgatcaattagccttcatctcaaggaagataaggaacatgtggaagaaaaggagtggatcaaactggaaaggatccaagaaaccacatagagaaagaaaggacagggagaaaagatccttcatatgctag

SEQ ID NO: 54370 - DNA, 474 bp, Glycine max
  Peptide Sequence Number=SeqID_171148
atgaagagtctcaaagcaacgaaaaaggattgcaaagacatgcttatgatcttctccgcctgtagtagttgtctctctgaaatcttcgacctcatcaacgatgacgatttaaagtcttctgatgaagaagacctcgaccgcttcaaagcaacaaagcaaggaattctcgacgaagatgactttaaatcttcatcgttgacgaggtcgaagatttcagagagacaactactgcaggcgaaaaaggatttcaaaggaattctcaacgtagcagtccatgttgtcgctcttcaacccaacgaacaatatgtagagtacttctccatcgtcaacgagatcatccactggatgaagcaattctcaatcgcgctgccatcctctgccgcgagacgcaccatccatctgcaacgcctccttctcctccaccatcagagatgttggatggtcaacaaggctcatcgctcaaaccaaatctga

SEQ ID NO: 54371 - DNA, 138 bp, Glycine max
  Peptide Sequence Number=SeqID_171149
atgggggcatgccacattgctcccattctcttgcaatttatgtctaaacatgcgcccaccaagtgctcggtgaaatgccccaatgacggacagcataggagattcaaaataggtgcccaaatgcaattccaagcttag

SEQ ID NO: 54372 - DNA, 481 bp, Glycine max
  Peptide Sequence Number=SeqID_171150
ctacatgctcgctcaactcaagcctccttcttattctgcttcaagttctgatttggcttcttctactactgatgcggataatgcttcttctttgcctactaaagctgctaagcaaaagtccctcctttcactttcatctgatattaagctagcaactgactcaccaacggattcaggaaccgaaactgcaacaggaacagaaacttctgcagcttaccttactttttctgcggattcaccaactctagcttacagcaactctagcttatccggatcaccaacagattcagaaacttattctgttgatgctgctactgccgattctgattcctcttcttctgcttcttccggagagagggagactagaagagcttacctctggcaccgggctttctttctatcttctggctggaatttccgagcttttgaaataatagctgtggcactctctttcttccatagagaaggaacttatccttag

SEQ ID NO: 54373 - DNA, 456 bp, Glycine max
  Peptide Sequence Number=SeqID_171151
atgcaccatatacctttgtcgcaacctacctttcggcgggagggcaacgtgagactcacaggtgcatcttccaagaaaggaaaatgcacggagtcgccaccaacgtttattcgaggaaaacgtcggaaaaaccggaaaggctttcgaaagtccatgttaaccaataaaggcaaagatgaccgtttaaggcgttggaccttaaaacgacttttaggtgatttttatggacaaagattgatttgggaaaagagggaggtggttgccgctcagctcgcccaggcgagctgggttgcttccaccagaaggcaccgccttctgttggaacaccctagaaggcccaaaactttacggattgtgcgacaatgctcccttttgacttccggcatgccgctgaacttcacggattacctaacaatgggtgttaagtacctcgaagcggtcaagcaaaggttgtag

SEQ ID NO: 54374 - DNA, 213 bp, Glycine max
  Peptide Sequence Number=SeqID_171152
atgcgtggggtattaataccttcctcgtgggtaaaaacaattcccgaacctttcacacttaaagttcatagaccgcccctttttcggtttttccgatgtttgcctcaaataaaagttggtggggactccgcgcgttttcttcccatggaagacgcacccgtgagccctcgcgtcgccctcccgccgaagggtaggttgcgacccctaggataa

SEQ ID NO: 54375 - DNA, 296 bp, Glycine max
  Peptide Sequence Number=SeqID_171153
atgggattgaggcttcagtcctcactttgtgctttaaaccatgtgcagcttttgataacactaagccttttcgctcaatccgtgggatgccccaagcgcttaattaaaactgaacctgatcagctttcaaatcgtcttaggcagtggtcaaatgctagaatggggctaaaagcagaaaccaatcaaggtaaaacgatcgtcgccacatgcccagcactggacaagcaggaagcgcagctgagggacaacctagtatcctttaaactcccagtaattattgttaaggtgtctttaag

SEQ ID NO: 54376 - DNA, 207 bp, Glycine max
  Peptide Sequence Number=SeqID_171154
atgatttttgtgagccaagccccaatacaagccaataaagtccttagtgatccacctgaagaggaaaacaccagccttgtgaggaaagtaaggcaagccagatgtgatcaagattccaaaggactgactaaccgcttgtgtgttttatgctttcattttgagatgttgccagatgcggaaaggaccactggaagaaggaggaactaa

SEQ ID NO: 54377 - DNA, 653 bp, Glycine max
  Peptide Sequence Number=SeqID_171155
gcacttgctaaagaaattcgagaatttagaagccccacagatggggagacaaggatgttttatgaaatagtggttgcgcccagctatacagagaagggacttgagattctctgtggaaagtctaagactctaaggattcttgaagcgaaaaagaatgaagctggaaagctttcactcagacaagttggtggaggatggttagctcaggattcagatgacttaaccccacatgacatcaagttcaacgtagtctctgagaaggctccacaggatgatgagcttcgtgatgcagagtttgcatggttgtgtgtgaagcatgtcaaaagcaatgctattgtgatagctaagaacaattgcatgttaggtatgggaagtgggcaaccaaaccgtgtcgagagtttgagaatagcaatgaggaaagctggagatgatgttaaaggagcagccttggtcagtgatgccttcttcccatttgttgtggagaggggaagagaatttcagggtaaagatggtgccctttggccagggatatatcttaatttgttaacagcttggaaagatgctgtggaagaagcatgtgaaagcggaattggtgttattgcagaaccaggtgggagtatcagagaccaggatgccatagactgttgtaacaa

SEQ ID NO: 54378 - DNA, 837 bp, Glycine max
  Peptide Sequence Number=SeqID_171156
atgttttggcctttttcacagcttgatggtcgtgtcaaaactttgcaccctaacatacatgggggtatccttgcccgaagggaccaaaaacatcacattgacgccctcagtgctcatgggattgtgaacctgtacccattttacgataaagtcacatcagctggaggcgttgaatttgaggatggaattgaaaatattgacatcggtggtcccgccatgattagagctgctgcaaagaaccacaaggatgttttggtagtggttgatacagaagactaccctgcccttctggaatttcttaaaagaaaccaggatgatcaaaagttcaggctaaagctcgcatggaaagcttttcaacatgttgcttcctatgattctgcagtatctgagtggttgtggaagcagagtgtgggagatttacttgttagcattttggtaacagataaattcccacctagcttgacagtgcctctttcactcaaaagttctctccgttatggtgaaaatcctcatcaaaaagctgcattctatattgacaaaagcatttctgaggttaatgctggtggaattgctacagccatccaacaccatggaaaggagatgtcatataataactacttggatgctgatgctgcttggaactgtgtatgcgagtttaggaaccccacgtgtgtagtggtgaagcatactaatccatgtggggtagcatcgcgtgatgatattcttgaagcctacagactagctgttaaagctgatcccgtgagtgcatttggtggaattgtagctttcaatgtggaaattgacgagatacaggcactttccctacttaccttttaa

SEQ ID NO: 54379 - DNA, 318 bp, Glycine max
  Peptide Sequence Number=SeqID_171157
atgtgtaagaaggagcatgaatcttccaaagagtacgcccaatggtggagggatttggcagctcaagtagtgcccccaatgatggagagggagatgataacaatgatagtagacacgttaccggtgttctactatgagaagatggtgggttacatgcctttaagctttgcaaatttagtgtttgcttgcaaaaggatcaaagtgggtctgagaagaggcaaatttgattatcctgctttgatgaataggaagcccggggaaaatggagagaataagaaggagggagaaacccatgttgtgactgcagttcctacatga

SEQ ID NO: 54380 - DNA, 180 bp, Glycine max
  Peptide Sequence Number=SeqID_171158
atggccaatttaaaggatatgagccatcaaatgcatctagttgtagctcaggggggcatatggaagggggagattggccataaaagaagaaatgggtggggaatggctatgggtggtggtgaaaggcacataactagtgggaaatggctatgggttttgatgatcatcttgggcagctaa

SEQ ID NO: 54381 - DNA, 273 bp, Glycine max
  Peptide Sequence Number=SeqID_171159
atggcaagccttcttgtcctcactttacccatatttccagaattattcatgttggaaatagatgcctctataacgcttgttggagttgtgttgtctcaaaaaggtcatcctcgtgccttcttcagtaaaaaatgtcatctccaagccttttcgatttacattagggagataagagactcccttatttgcttccctttcctcactagtactagatttgatctctaccttatatcagtgctttgccacctcaaaaatagggaaggaaatacttag

SEQ ID NO: 54382 - DNA, 483 bp, Glycine max
  Peptide Sequence Number=SeqID_171160
atgcagatgtccatctcttcaaagcgtgtgtccatcctatccaagcggtcatcaaagtgtgctcgaaggcttcgtaactctgtgagaatggcattcagaagcacaaaagagtcatgtcatggaggtgaagggatatgctcatcgataggctgtggctgggcatctttcttcacccaagagccatccaattccttacgaccattcggcaggcatcaagacttgaaaaatcaaatttccagtcatcaacaatggtgccctcaaaagaactccaaatcaagatacttagggtctaaaattaaacgagaagagaaatgggaagagcaccatatacactattcgtatgatgaaaacaacatagaggatgacaaggaggaagaaattggtgtcggcggtgctctggtggctccgggacgtggtgttcctgttcccacagtggaggtggatgaacccttgcgcttcttggatgattatgccatttggtga

SEQ ID NO: 54383 - DNA, 258 bp, Glycine max
  Peptide Sequence Number=SeqID_171161
atggctgttggttcgacggccctagaggacggagatggttcgagtccgacggcggcgaatgatgctcagatgtgtgttgtgttcgtttcgtgccctttgccccgttcattctcgttaaggtttaagttgcaaccaacaacctggccgcgtcacaccggatttcggcaagccgatgacttgatggatccaattactgaatggaactggttggttcactcgatcacgatcgaaccgatccaatcgatcggatccatctga

SEQ ID NO: 54384 - DNA, 486 bp, Glycine max
  Peptide Sequence Number=SeqID_171162
atggaacatgcagatgctcattttctttggaaactacaccttcatacatctagacaaccaacaaatgttgttatccagtcatatgctcaaagtatgcatgtttcagatcctataattcaatctttgttggttcaagttggattttctgatgttgcaaagcttggacattttaaaatcagcaatgttttggtaactactttggtagaaaggtggaggcctgagtcacacaacaagtttcatcttgcaattggtgaatgcacaataactttggaagatgttgttcttcaactgggtttacaagtcgatagaaaagcagttattgaccaaacttattttgaatgggaaaaaatgtgcgcaaaatatctaggtgtcattcccccaaaggttgcactagtgggatcaacgttgaaacttaagtgtttaaaagaaaatatatttcctctcccaaaagaatccacaaaaacaacatttagcaacccattgtag

SEQ ID NO: 54385 - DNA, 534 bp, Glycine max
  Peptide Sequence Number=SeqID_171163
atggccgacgacaagttttgtggtggacgtgaatctcatgttgcgaagacaagaaggaagaaccatgagtcagtttatactgtgcgaggcttattgaagtgcaagaaaatctatgtggagcaccttattggtattcctatacttgatgaagagttgcccaaaggtagaagaaatttttttgtacaaatgaaagatgttgaagttgttgtcattgatgatgttgcgggtgataaggatgatgcgcaggtagttggtaaggatagcaaagaagaggttgttgagttagaaggtgctggtgaggatatgaaaatgaagaatgtagcaaaaccacctacacaaccaaagaaatccaagaaggatgcaacatttaagtctagacctgaggaatcatctacatcagcacagagagttccaattgctcacgtagttgttgttgttccaactccaagtgtagagtcagtagctcaagttccacctcaaagtaatcaatcagctacttcggttccctcaagaatcaataggtcccgtgtgtga

SEQ ID NO: 54386 - DNA, 352 bp, Glycine max
  Peptide Sequence Number=SeqID_171164
gtttggctccattatagccggggcattgcaatctaagttattcgccaaaagggaaaaaactggagaaaataggactgcactaagaaaaaacaaacacaagcgtggttcgttttctttccagggtgggatgcagacactgacagatacattgtgcaaagagcttggcaaagacgaccttaaattaaatgaaaaggttttgacattagcttatggtcatgatggaagttcctcttcacaaaactggtctattactagtgcttctaaccaaagtacacaagatgttgatgcagtaatcatgacgatgtatctactgcaaattttgcatgaatatgttaatatgactaaaaagtaa

SEQ ID NO: 54387 - DNA, 147 bp, Glycine max
  Peptide Sequence Number=SeqID_171165
atggcatatgcaccattcaaccttcgtccaaatagtaatattaatggaaaaataacaagagacaaaaattgggctttaaggaggacagtatcaagagcaggaataggcggacacaagaacaagaacaaggttgcggtgataacatag

SEQ ID NO: 54388 - DNA, 441 bp, Glycine max
  Peptide Sequence Number=SeqID_171166
atggggatatggaacatatggaaaacagtgccggaaggaataagaggagatttcaccgacgaggattggccaaagaaggaggtagaaaaggaaaaggaggaggtgttagtggtggaggttgagtatgatatgactgaggatgtgaagtttgatgtgtttatcaacgaccaaggtgacgatgagataggacccgaggattcggagtttgcgggaagctttatgatattggctcattcacatggccaccaaagcaagaggacaacaaattccttcagaatggcaataatggatctgttgaaagacttgcgagcacaagacgatcaaagtattgtggtcacactggctccaagatatgggaacaagcccgtcacaattaaggtcataaagataaagcttgtacctctggtggagtatgtgtggtgtgagacctttaatttttaa

SEQ ID NO: 54389 - DNA, 207 bp, Glycine max
  Peptide Sequence Number=SeqID_171167
atgcaggcgattccggctccatgcccgcaagttgctaaggacgagtttttaccgcaacacattgacctcagcttggcgattccagctccatgtccgcaagttgctgaggacgagtttttaccgcagcacattgacctcagggagatcaccagcatagatacagatttaaatgtcttgaagaagaggatagagacgctgcatttgtaa

SEQ ID NO: 54390 - DNA, 252 bp, Glycine max
  Peptide Sequence Number=SeqID_171168
atgaagctgaaaaacaatgtccaagttgagcagcatctaggtgaaagtgatagtagaagcaatattaacttggttagagaaagtttaagtgatccaactttgaatgcatttgatattgacaacttggttttgaatgacaatgttaaatatcacttctcaaccaaagaagagcttctagatgatggaaataaagatgatggtggtggtggtgatattgaagatgatttaattagaggattgatgaacatttga

SEQ ID NO: 54391 - DNA, 225 bp, Glycine max
  Peptide Sequence Number=SeqID_171169
atgacaaaagctagggttttgccaaaaccggtggcagcattgacgttgacatccttaaagctgcagagcagaggaatggtggcgactttgacgggggtgcagaacttgaagccagagtgtgcgggagaggaagaggaggccaaggagaaggatggtgcagaggaagaagaagcgaaggagaaagagataggggatggaaatcgaagaggatgtggtgggatgtag

SEQ ID NO: 54392 - DNA, 366 bp, Glycine max
  Peptide Sequence Number=SeqID_171170
atgggaatggataaccttgagagctatacaagtgactacactgcacaagtcttggtggggtactgcgtggtagctaaaagaagaaagggtttgttgaactacatgctttttctaagactgactccgaccctgcccaacacatttattaattttgcttctccaattgtggatgtgccttatcatattttcttcttggcaactgttattgggctgatacctgctgcctatgtcacagtcaaggctgggttggctcttggagagttacaatccgtgggtgatctctatgatttcaactcaattgctactttgtttctcattggtgtagtttcagtcacacccacactaatgagcaagaacgaatcatag

SEQ ID NO: 54393 - DNA, 381 bp, Glycine max
  Peptide Sequence Number=SeqID_171171
atgcaaaaagaaaagctacgatcaatcagaaagaaaaagggatatactcagcaacaaattgctgatatcattgctacggatgtttccaattacagcagaaaagaaagtggagatgtaaaaatcgtaagggctgaatgggaaaagattgctaatttcctcgatgttactatggaggacatttatgaagaagatgacgcccaaattgttgtcaataatgatcatccagtatttaacgacagttctgcatcgggagtgtatcaatataacaacaatacgattccactttccattgttgaaaaccttcaggaatatatttctttattaaaagccgagaaccagaaattacaggcagaaataaaaacgctgaaagcaagaaagtaa

SEQ ID NO: 54394 - DNA, 234 bp, Glycine max
  Peptide Sequence Number=SeqID_171172
atgacggaaaccgtttgtacggataaccgcttgggtatctccgtacgtcacctaacttcatgggtcatgataacaaaaggtggggtggtcgacaaaagcggggcttttgctcttacgtacatcattgtggccatttgctctttcatggcctccatgttagccttcatctactcttgcacctcatctactccatccattactctacctctagcatgggttcggacatggggttga

SEQ ID NO: 54395 - DNA, 579 bp, Glycine max
  Peptide Sequence Number=SeqID_171173
atggtacgggttacaaacagaacagacatgcgccaactgaggggaataactagtcaaggtgcgacacacgccaaagatggcggcaaaagacctgtattattacccgaaacaaacaacaaacaaaacattatgaagcgtattggtctatcagctgttcccgaagttctatctaaaatagaacagaactacgatgtatttactataactgataaatttcgtaatctgtctttgaaagatagcagtgctagttcaagtaatcatagttttctttctactctgactcctactgcatctcttttagaaagatttaagattcgtactaatccatcggcgtttactcgtaatgttattgaaatgactaaagcaccattttttgatataaagaaccctattattaatttaaccgaaaaggcaaacaattatatgatgtcgattggctttcgctttatgccaggacaaggggaattcttaataaaagatctccgagctcctgataccttagtgggtttaagaaagttaaaagacagcctaggcttatcgttaaccaaaggtagtcttaacagccaatccattacttaa

SEQ ID NO: 54396 - DNA, 468 bp, Glycine max
  Peptide Sequence Number=SeqID_171174
atgactacattagtttctgcgtgtcaatgggctcgcttgcctctagctgatgaaagccggaagacgctgacatctccgggaagggtgcagatgaccacattggtctctgcgtgtcaacgggctcgcttgcctctagctgacggaagtctcgtccggaagatgctgacatctccgggaagggtgcagatgaccacattggtctctgagtgtcaatgggctcgcttgcctctagatgtcgaaagtcgtaagacgctgatatctctgggaagggtgcagatgaccacattggcctctgctagtgcggataaccataaggtgtctccgcatgctaccggactcactggtcatgatagcaggatggggtggttgacaaaagcgtctctaccgaaagatgttgacctctctagaaagggtgcaaatgaccacattggcctctgcttgtcaatcggacttggggtcttcgaatga

SEQ ID NO: 54397 - DNA, 333 bp, Glycine max
  Peptide Sequence Number=SeqID_171175
atgaacgtcatccttgttaatttcgcgttcttcgcgtttctcttccccttgctgtgggagatcgaagtcgccgtcactgcctccatcatcatcatcctcgcctaccgcttcttcgctgcacggaccggatacgccgagggagaacaacaagagaatcaggagggaacagaaacaccaccgacgtggcgaatgcgatggggacgtcggttggatccggcgccctcacgctccgaaggggattcttgtcgcgaacgtgttcaatgggaaggattctttgctcttcgccgggttgctctcttctctcgccgctggtggcacttggatgaatcttag

SEQ ID NO: 54398 - DNA, 423 bp, Glycine max
  Peptide Sequence Number=SeqID_171176
atgagtgtatatgccagtggtgtttcagttctaatgcctggagatgagattcctacatttattgcgcatcctgctccatgttatccggaacgaatttcttggccttctcatcagcataacaacacattaccttgttcctcttccaacaccctccctactactactatcaaccaagtggtcaatttgcgccttcatcatgatgcctttgttgacgtcgtcgaaggtgttcgcggaagcactgagttcggaggcgagccattggtggtggtggccgcggcagtggcggtggcggtgggtggagtttcgttttgttggcgtttggctttgccgctttggtgggtgtcacagagagacatggtcgccggagaagagtgtagagaagttgccggaggaggagaggatgaggatgtggttgggattaag

SEQ ID NO: 54399 - DNA, 489 bp, Glycine max
  Peptide Sequence Number=SeqID_171177
atggtgatgcccttcgacctatgcaacgcaccgtccactttccaggcaaccatgaatgagctccttcggcctttcctcctccgcttcattgtcgtgttcttcgacgacattctcgtatacagccccatcttcgaggatcaccttggccaccttcgcacggtgtttgactacccttccaagatagaagctatggtgaattggcctacacccatgacaacccaatctttgcgtggttttttgggtttaacggacttctaccgcaagttcatccgtgattatgctgcctttgcggcgctgttaacttcactcctccagaaggataatttccattggggcgaggattctcaacttgcgtttgactctcttaagcgtgccatgacccaggcaccagtgctagctctgccagatttttcccgtccattcacactcgaaacggacgcctccggcacggccatgggcatcgtactaatgcaaggtggtcacccctag

SEQ ID NO: 54400 - DNA, 1205 bp, Glycine max
  Peptide Sequence Number=SeqID_171178
atgctgttttcacgacatcttgctcggtcatcaatatctaatggaagccctgccgaagatccaacttcgaaaaccatgaagcagaaccaagttcgtcaaggagttcgtcgatggagcaccagtgaagagaacagactgttgctcaatcggataaggcttgaggatagcatttcattcacctgcttctcaatctcggtgttctgggggttggaacaaatgggagtattggtgaaggagggtggtgatagctgggtatgggtgggtgatggttgtaggttgaggctggggaggatggtgggtgatagaaatgtgaaagaaggcagaggccgaatgagttttcatcaggcgtcggagttggatcgaggagacgtccgcggggattgtcagggcgtcaacacggaggagaatggagtggccattgacgtagaattgcatggtgagggtggcatagtctgtgacgatgaggccgagttgcttaagccattgaatgtcgagaatgatgtcggcgtcgttgataggaagaacatgaaggagtggtctgggaagaagggagttgtaggtacttgcgactcgggactggataaaattgtgggtactcccgccgtcgatgagaaccgtgacgcgggaatggttcacaacaccgaacaagcggagggcctcgggggtggaagttcccgagagggcattgtagcttatctgggcaggggtggggttcggggaaggtgtggggtcgtcaggatcggggtcatcctcatcgacgatgatcagaaagaagagtgcctagcatttgtgggacgattggcagggggtggtctggttgtggccgaggttggtgggttgtggatggatggcggggtgttggtgaggtttggcgttggtaggatgggtgagctgggggcttgtacctcgcgttgcaatttcggcaagagaccagagatgaaacaactaagtaagcaggagggcgagaggccgatgatgcggtttgctaagcgctcaaactcggcttgcagaagggacgtccatgacgtgatgaagccattgcgggtgatggaggtgggaggggtagaggtgagggaggtggctggtgttggagttgcaggagctgcaactgctcttggatggagtccaggcgtagggaaaagtcgtggtgggtctgggttaagtggagaaccacttcttacaaacgatttgtggttttggagcgg

SEQ ID NO: 54401 - DNA, 393 bp, Glycine max
  Peptide Sequence Number=SeqID_171179
atggaagccagtggcagtgacactgccgctaccaccacttccgaccacagtgacaaggagaatgtccctcctcctcctcctcctcctcctcctccaccatgtagcagtaacaccaacgagaccaagactagtagtaagacccagattcccctcatcgttcccacgtctttcaagaaaaagaagcgcagcaagcggaagcccaagagggtgcctctcgctgacatcactagcctcttcgataattccgccaccaccactactactacggttactccttcccaagaatcccaacagcaacagcaacaacaacaacaacaacaacaaagtggagcttctgctcttcctaggaggtcgcctcgtagctccaaaacattaaggatgggtttcagatag

SEQ ID NO: 54402 - DNA, 516 bp, Glycine max
  Peptide Sequence Number=SeqID_171180
atgcctaaaatttctcttcgtcaagcacatttcttcaagatcaagggagttttcaccgacgatttccccggaaatcctcctgtggtgtataacttcacagggacacaaccatcaaatttgaagaccatgaaaggcacaagggtctatagacttgcttacaattccacagttcaattggtcttgcaagatactggaatgataacacctgagaaccatcctattcatctccatggcttcaacttttttgtggttggtaggggacaagggaatttcaaccccacaaaagaccccaagaaatttaaccttgtagatcctgtggagagaaatacagttggagtcccggctggggggtggactgctattagattcagggctgacaatccaggtgtctggtttatgcattgccacttggaaattcatacaacatggggactgaagatggcttttgttgtggacaacggtaaaggaccaaatgaatctttattaccacctccaactgacctacccaagtgttga

SEQ ID NO: 54403 - DNA, 282 bp, Glycine max
  Peptide Sequence Number=SeqID_171181
atgccacgaaaaagaggttacttcataggaaggctttttcatgtaccactgtcttctggtgaacttttttacttgagtcttttactcaacacaattgagggacctgaaagttacagccaagtccgaattgtggacggtgttgaatatccttcagttagggattcatgttacaagttaggacttctaaatgatgaaaaagaatttattgatgcaattaaagaagcttcactttgggatactggtcattgtttacgtgcattgtttgttaatgttgttgtctaa

SEQ ID NO: 54404 - DNA, 730 bp, Glycine max
  Peptide Sequence Number=SeqID_171182
atgggttgttgtgtgagtagtagtcacaaaacctcaacctcatcactagcaaaattccatgatccaccaaaacctctcactaaaccttcagaaagcaatagtactgtagaggagacagtgaaggaagtgctcttggaaaccccgacaacctttgccaaatcaaaaccacaaaagccacaccaaaacacaaactttcacaagtttatggaagaaaaaagcaaggttgagaagagggcattgacattgtccatttacaaagccgaagacaccaccacctcagaagaagtttgcagcttgagcagaaccgtgtccagagctacttcaatcaccgaccagagagaagaaatgcgcaaaagggtatatagatctcatcccaaattgcagaaaaatcgttcctttcccggtgaaagaagagagagaacggtggtgcatggtgcaaggaacaataataatgttgggtctgtgaggttggttcagtgcagagaccaaacgagtcagaaaattggtaacggcggaacgggtcgccggagagatgccgccgagaattctctccggcggtcaaggtcgcaggccaccgtcgccggcgccggagcagctaggcccgtcatgggtcggagcccatatgtgagaaaacctaaccggtccactgcgagtataggaatcggaacggcggagaacggtggccggaaaacggagaaaccggcgacgacggagaaatggccttatgcgg

SEQ ID NO: 54405 - DNA, 446 bp, Glycine max
  Peptide Sequence Number=SeqID_171183
tgcctccggttggtagccgggctccgagacattactaccacggctattatcgacccgagcccaaagaaggaaaagaacgaactaaagcgaggagttcattggccatacatagtgaatggggatggggtattcgaaatgaatggagaagttgtggaacatgcaaaaccacatattggatcactctagtgcagcacaaagctgctgacgtcgagccggctcctatgccgctagttatgccctgcttggtccttcggcatggtggaggtctcatagctcgtcatgagcatcgagctaagagtcctggagtgcctgtcaagggtgctaacgcataccccaggggaggatggcactactggcaaagatcattcggccagtgtcgggggagcacaacatcggtaggaaagggagccaggatggtggaagagccagggggccgggtcatttga

SEQ ID NO: 54406 - DNA, 369 bp, Glycine max
  Peptide Sequence Number=SeqID_171184
acttatcaaggtaatccttgtggcgtctaccctgacttatcttccttcactggaagtggcgtctacccagacttatcttccttcaccggaagtggcgtctacccagacttatcttccttcaccggaagtggcgtctaccctgacttatcttccttcaccggaagtggcgtcatccaaaagctctacagcctgtatcaagcgatccgccccgtaagattcacatcactaatgtcggtagataaatatcaatcggggctactaacgaccaatgtccgctattgtttttttctattccatcccccgataatatttgcacgatgtctattaggaaatattcgatcgtcgtcatccggtgaatcttctttttag

SEQ ID NO: 54407 - DNA, 287 bp, Glycine max
  Peptide Sequence Number=SeqID_171185
atggccggttacatttcattacttcagatttacgagcactttccatcggtccatcggtgtgtcgttgatgatggttatgctgaggctagcccacgtgcttgtaggtggcttacgggtaaggcccagatgatggggattaagggagccccatacagagcacgtattgatgccctgacagtgaccgactttgggtacattcagatcgttcctccgccaccggttcgtgattcgttgacaggggagctctgtgtagttcctgggcaggtggtcccagacaacatggagtg

SEQ ID NO: 54408 - DNA, 282 bp, Glycine max
  Peptide Sequence Number=SeqID_171186
atgacgaagcggttgttaaggagattgaaagcacgaggaacgagaaaacaaggtgctgtagttgtagttggtgagattctgattgatttttcaatcgagaagaggaaaagagtggaaactaggaactttttgaatttcgttttagaagaggaagagaaaagtatcaacaacaatcatgacgcgagagggaatagccagagcccagagagaaaagttctttccttttcgtccatagcaatggccaccatgctcctaatctcacacccatccaaggaccagtag

SEQ ID NO: 54409 - DNA, 1713 bp, Glycine max
  Peptide Sequence Number=SeqID_171187
atgggttggtctaattcggagttgaattcgcaaattttaatcttgtctatgctgattttcactgcaagtttctgtgttggggacactgacccacttgatgttgcggcaatcaatagtttgtacgtggctcttggctcaccactccttgagggatggaaagccacaggaggagatccttgtttggagcaatgggaaggtgtgagttgtgtcttctccaacattactgcattacggctgggaggcatggatttaagtggaaagctgggaactaatttggatttcccatccatcatagaaatgtcactatcatcaaatcagttaaatggaagcattccagatgccttatccttgttaactcaattgtcagacttgtcattaaaagataaccatctgaatggacaaatcccaaatgcatttctagaactcactggtttgatgaatttggatctgtctggcaacaacttgagtggtaagctgccgccctcaatgggaaatttgtcttctcttatcacactaaacttgcagaacaatcaactttctgggaccctttttgttttgcaggacctccctcttcaggatctgaacatagagaacaatatattctctgggccaattcccccagagttgttgagtatccctaatttcagaaaagatggaaatccatttaatactactatcattccatcacctccagctgctttcccagcacctgctgctatggctccttccccagaaaaatcaccttggaaaatggcacataatccctctgataccataaaagcaccaatacctgcaattgctgggagatctttcaaaactacaaaattagtttggattgttggtgcaggctttttgatatttattgcattaggagtctgtcttctaatgctgtggtgctttaagagaagacaggaaaacaagaaatataagaaacacaacacgaatatgtatacaagatctttgcataaacgtacatgcagtaactccccttttgaagcaactaatgatgaggagaaagaatggagttccaaacttccacccctgcagccagcaccaccacatcatatcccaatcattcctggagagaatttaataatcaatccagctatatctacccaagcagctgaaagacaaattgtcacaaattccattaaagtttatactgttgcatcacttcagcagtacacaaatagtttttcccaagaaaattatattggggaaggcatgcttggccctgtttacagggctgaactccctgatggaaagttactggcagttaggaagatgaatactactgcttctatggggcaaaatcatgaacagtttcttcaattagttttcagtatctccaaaattcaacatgctaatattgttaagcttatgggctactgtgctgagtatagtcaacgactacttgtacatgagtattgcaataatggtaccctacatgaagcattgcatacagatgataaacttcagattaaactttcatgggatgatcgcattcaggtgtcacttggagctgcaagagctttggaattgagacctatcaatttggtatcaagagccaggtttcgatctaaacggtggatggtggttacgagacacatcatggagaacagaatcgatacgatggaagagcgattggggaacgtggaagcgacggtggtagaaatccgtcaactgctgcgggaacagaacgagagaccttga

SEQ ID NO: 54410 - DNA, 783 bp, Glycine max
  Peptide Sequence Number=SeqID_171188
atggcagcgtttggtattcaaatcatgctattgctggcagctttcttgcttccactatctgtggaagctatggtggtgcaaaagaataccacaagattgggttcaaccaagcccattgttaccataaatggaaagttcccaggtcccaccatctatgcaagggaagatgacactgttctggttaaggtagtcaaccaggtcaagtacaatgtcagcatccattggcatggggtgagacaattgagaacaggttgggctgatgggccagcatacataacccagtgtccaattctaccgagccaggcctatgtctacaactttactcttacaggccagagaggcacactttggtggcatgcacatatcctctggcttagggccactgtccatggtgccttggtcatcttgcccaagcttggagttccttacccttttcccaaaccaaatatggaacaagttatcatattgagtgaatggtggaaatcagatactgaggctgtaataaatgaagctttgaaatctggtttggctccaaatgcctctgatgctcacacaatcaacggccatccaggacctatccaaggctatgcttcacaaggaggatataagttggatgttcaaccaggaaagacctacttgctaagaatcatcaatgctgcactcaatgaagagctcttctttaaaattgctgggcatgaactcactgttgttgaggttgatgcagtttacacaaaacctttgaaaactgataccattgtcatagcacctggccaaaccacaaat

SEQ ID NO: 54411 - DNA, 213 bp, Glycine max
  Peptide Sequence Number=SeqID_171189
atggtcatcattttgcctaaggaaaatgttgtcatctgtgttttgaaagaacttgacgatactccacaaagtaaatccaaggttgctgctaggtggattattgttaaatatttcaatgatgctagaccattgaaaccagagagattgaaggcgcttcgcatccggtgggcaacctattatttgaaagttaaaaatgaaacaattagtatttag

SEQ ID NO: 54412 - DNA, 246 bp, Glycine max
  Peptide Sequence Number=SeqID_171190
atggaggccagtgacattgctactatcacaatcgaccatagtaacaaggagaatgtccctccagcatgtaacaccaacaaagtcaagaacaagaatcacaacaagccaaagccgaacagggtgcctctaactgacatcactaatctcttcaacaattctgctacagctaccttcactcttgcccaccaacaacaaaatatagtttctgcacttcctgggacgacattgaggatgggatttagatag

SEQ ID NO: 54413 - DNA, 246 bp, Glycine max
  Peptide Sequence Number=SeqID_171191
atgacccaaagaataacgcagaggttggaagaactacatgtgaattcgtgtcaatgtagatgtcagggtgccattgaagaaaggaaagaaggtcaggaagccaggagtagattggagaggaggtcacaagtcaaaaggaggggggcacaaatgagagcctgcaaggagagaagaaaaggaaatgtgatgggccaattgctagtattgatgctacggatttgggtcaaacagacgaagcctgaataa

SEQ ID NO: 54414 - DNA, 159 bp, Glycine max
  Peptide Sequence Number=SeqID_171192
atgccatcgagacacgtgttgcctgagtctcgggtgccacccagtgtagacttagtggatctcgtgttaaaggacgagggagaggctttggaggaggacacatctttcgagaaggatccgtcgatggatgaggaggacctcgtcaaggagtctttctag

SEQ ID NO: 54415 - DNA, 564 bp, Glycine max
  misc_feature (20)..(20): n is a, c, g, or t
  Peptide Sequence Number=SeqID_171193
atggataaggagggtcgtgncggtggccttgcagtgttatggaggaagtctatcccttgctctatcatgagtttcagtcagaatttcatcaatatgttgggtgaacctagtcttgcaaaagtggtgaatcaaagttgggagaatatggaagagtcagatcttattgataagttaaagggttgtgctgatgatctggagatttggggaagagatttaaaacgaggtttagggatgaaatcgacaagtgtaagagagaatagatggactttcattagggccaagatgcagaattgcaatccttttaacccaagaagagaattattggaagtatattctggctcgaggatggaaacgctaatacgaagttcttctatacatgggtttcgtttagtagaaaggtttttcaggcttgtcctaagtggccgaaagatgttagtcatctccaagtgcatctcaaaggagcaatctgcttttgtggaagggaggtccattatagatagcgtgcttattgccattgagatcatccaccatttgaaatgcaagcacaatgaaaagatgaggtaa

SEQ ID NO: 54416 - DNA, 447 bp, Glycine max
  Peptide Sequence Number=SeqID_171194
atggcggttctccagcgacagaccggatatgaaacaactaagaaggaaagggagcggaagactgaagattcgattcaccagcctctcaaattcggtcaaggcttctttgggatcatcatagaatgtgggtatggaataagactccaaagcctacaagaattcggaccaggaagtgatgaatccattacggaacatccactggtaccaactcaatgcagggccatccaagtagaaggacgcgagcgtaatacattcttcctccgcccattgggttgttgccatcaagcgaggaacgtccagcttgaccggagagcattggatggggtgagagctggaaatggaagcagagttagtgttggcaggatgattgaggtggtcgagaatggagtcgactttgctggcgagttcagagtagtggagacacaggcgggaaatgacctcctctag

SEQ ID NO: 54417 - DNA, 849 bp, Glycine max
  Peptide Sequence Number=SeqID_171195
atgaatgtatgtccttactggtacctgtatttccagaaatccaaaattgaaaagcaggtgtctgaattgctctcattgaggatgatacaggttagccaaagtccgttctggtcaccagtgcttctggtcaagaaaaaagacggcaattggcgtatgtgcgtcgactatcatgccttgaatgccatcactgtctgtgatcgatttctgatgccgacaattgatgaattactggatgaccttggtcaaccctcatggttttcgaaattggacttacgccaagggttccatcaaattgtcacggccaaggaggacattgagaaaatagcttttaggatgcatcagggtcattataaatatcgcgtcatgccattcgttctgtgtaacacaccttccatgtttcaagcaatgatgaatgtcctgctacaaccatttttgcgtcgctttgtcgtcgtctttatcgatgatattttgggatacgacattgctatcccactcacctcccttttgtgcaaaaatgattttaattggacttctgactcccaacttgcatttgaaaagctcaaacaagcaatgaaacaagcccttgttttatcacttcctaattttgagcttccattcgtcgttgagaccgatgcatcaggaaccacaatgggtgtcgtccttatgcaacaaggccatcccttggcatttttcagcaaaccttttggcccgcgtttactatgctcctcaacctatgttcgggaacttcacgccattgtcactgcagttaaaaaatggcggcaatatttactgggccatacctttatgattctcactgaccataagagcttaaaggaccttatctcctag

SEQ ID NO: 54418 - DNA, 655 bp, Glycine max
  Peptide Sequence Number=SeqID_171196
atggagcacagaagatgtgccctaagcaaacgttacgatgaatatggggacttaccggtcacgacaggcgcgagctccactgcacggaatgaatgttggcgagggaccgcgaggtttgagggagacctcgagagcttgaggtttgaggcaacaaaggttgagggagagaggggttacgagtttaattcgaaaagtcaacatattcctggcaccatagtggattatgctgccagtaaaaaaaattcacaagttcatcagatgtcgctttctgcatgtcctgacaccattaagtgtgaactatgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccacccc

SEQ ID NO: 54419 - DNA, 582 bp, Glycine max
  Peptide Sequence Number=SeqID_171197
atgacaagcctcagtgccacaacaaaacctacagaagttcaatcaccatcagttacaaaggctgttctgcctacaagaataacaattttggtcaagaagattgagtgggaagagaggagcagcaaggttgcgtcggaatttataataagattgggaaatgcaaggcacaagaatttagtcagattgttggggttttgccacaacccgcatctagtctatcttttgtatgattacttgcctaatgggaacttggctgagaaaatggaaatgaaatgggattgggctgcaaaattcagaacagtagttggaattgctagaggactttgcttccttcaccatgaatgttacccagctatacctcatggtgacaaaagggccagcaacattgtatttgatgaaaatatggaaccccatttggcagaatttgggttcaagcaagtattgaggtggagcaaaggctcatcacccaccacaaataagtgggaaatagggacaaagaactcaaaagcatttgcattgaacaataatactcaattagtaaacgacttaacagagaaaggagaatttgagtgccccaattag

SEQ ID NO: 54420 - DNA, 366 bp, Glycine max
  Peptide Sequence Number=SeqID_171198
atggaactgaatttggacaagagagtttcgattgcgggaatggtgcttggcgggtttgaagctgggccgggtttggtggtggatagcacacaaaggtggaacatggcggaagtggagtgggtctgtattgaagggttatctctgggaagatgtgagtgcagtcgaggatggacccgttgccaaccaaaacatgaaatgaggtggtgggttcagaccgtgacgcgggaatggtttatgtatccaaaaagtttaaaggttcccggggtggggaggcctaaaagggcgttgaggctaatatggggtgtgggtgagggagggtcaatggtggggaaagtgtttgggttgaaaggagggggaggaccatag

SEQ ID NO: 54421 - DNA, 507 bp, Glycine max
  Peptide Sequence Number=SeqID_171199
atgactttttacgccggttttaaaataaccgacatagtggtccctaatataatgggtgtggttggtgatgtatgtagaggcttcgaggagaaaagtggtgcagaactcgctgcggatatatctgctgctgatgacagtatgacagaatacactaattgtttgacaaatggaattctagaggcatactcagggatctttgaaggatttaaagctggaaatctgtacaatccaatggaagagagaagaacattggaggaatctcacaaatggttgtggaaagaggaaaagaaaagaaggttgaatgttgacagagaaagagagagagggagagaaggaattgtagcaacggataacgaattggtggaaataataataaagaagggtgagggttacttacgtagacaaagtgagtgctccaagaaagagagaggaatggactgcaacggaggtgcagcggaggacggaggtgacggcaagcagagaactaaagatgcgaggctgcaatga

SEQ ID NO: 54422 - DNA, 375 bp, Glycine max
  Peptide Sequence Number=SeqID_171200
atgtgttatttgtgtttggatcctgtgatgatctggaactttgtgtttgtgggagcaaatgataggtggatggctatggagaacctcatgctaaaggacggtgtcacaaaatgtgtgccgctaaggcggaagagttctcgccaaaatgagctgatgaagggccccgaaatgaacgcccttcgagaagcaatccaccacaaccaagactacggtaaacctgccggtaggacactgagtggtggccttagattgttggcaggtggtgcagtcgcggatgaacttcttaacatcacaatgcatattggcctaataaaaattggaatggatgcggtgggtagtcttggcaatgcccaaatgtccaccaatgggtgttga

SEQ ID NO: 54423 - DNA, 522 bp, Glycine max
  Peptide Sequence Number=SeqID_171201
atgacgacattggtgagccaggtagaatacatgacctctctaataaaattggctttgaggagtttttctacttcttctctgactgcttggcgtcgttcttttcccatattcatcttcttcttagatactggtttggtctggggacaaatggcgagcttgtggcatataatgctgggtggattcccagcatgtcagatggctgccacgaaaataggttcgtgttcctatgtagacagtccaggcttggcctggagaccctttatccacgctcatgacttgagtgtcgtcacctgttgtggggtgaggcctagcagacttcctagtggaaggatagggtgccaccttcaggctttcagcgtagcactgtcatgccttcttttgatttgccttgaccgtcacgatctcccccgtcagggtagggaacttcattttaagatgcggtgtggagatagtggctctgagctcattgagcgttttcttaccaatcaaagcaaagtacgaggcatctacgtcaacaattaa

SEQ ID NO: 54424 - DNA, 474 bp, Glycine max
  Peptide Sequence Number=SeqID_171202
atgtcgaagctatcgatggaccttggaggaagtctaccataccaagttaatgtcgtccctttgaggaaaacatccaaatgtttgtctggattagaggttccatcgtactgctctaggctgagtggtttccaacctaatggtatggcagcctccatgattgtgttggggtatgattcccccttgagtgcgcttaggcaatgtgttagaagagtgctcgtcgccctagaggcattctacacaagcctccatccgatcatgttgttggagagtatcaatatccatcatggttgttggaggaggattggagccttggaaaagggtttcgcgtatgaggccagaccgcgtgctaaccatgggggaaaagagaggttgtgggataagctttaccacggtcccaaggtgggcgccaaatgtacttaccaaaatccggagctagcacacgtcaagttggatgtggccaaggtggactcctag

SEQ ID NO: 54425 - DNA, 1611 bp, Glycine max
  Peptide Sequence Number=SeqID_171203
atgccaatgtacgcaaagtttatgaaagatatcttaaccaaaaagggaaagtacattgataatgagagcatagttgtagaaggaaactacaacattgcaatcaagcgcatcctaccgcaaaaatttaaagatcctgagagtgtgactatcccatgctccataggaatgatttcagtaggaaaagctctcattgacttagggtcgagtatcaacttagtgcctctctgcatatgcagaagattgggaaatttgaaggatgtccttgtgaaagtcaaacaattcactttctcgacggactttgttatcatggacattaaggaggacacccatattctcataattttaggccaacctttcatgctcactacaaactgtgtagtgaacatggggaacgacaacatggagatgagtgtaaaggaccaaaaggctatgtttcaattatgttgttgcgcgctaagcgtgcacatagcatttttcctacgcgctaagcccaaatatctctctgtcagaatttttatgctaattgggcttagtgcgagattacttgctaagcgtgcacttcctgttggtgttgagcgtccatctgtgcgcttagtgccccagtccactatggcttctaaaaaatgtagagcttccacatcacaagctaggccacaggagcccaagccaaaatgggactccaccaggaacgtacaactggcctactctgattatgatgagtttctagagaagctcgagcagaggcattgggataggaaagtcaccaggattcttgagaagaacatagatttggccttagaaaaggagttttactccaacgtttatgatcatgaagatagctcacctaaacaatgcaaggtccgagggaaggtcatcaagttcaatgctcaaacattgaacaccttcctagaaacaccggtggttcttcaggagggagaaaggaaacttgccttctctcagtttctttacagctaccccgaccaccaggccattaaggccaagctctacctaccaggaggtcgattcattctaaacaccgagaaggatatgactaccctagctcagacatggggtgttctctcatactccaacctcgttcatacctcccacacctctgacctcagcatggaccgagcctgccttatttatgaagatggacatggacttggggcccaagaaggctctggggagagccacataggaggtccctccaacaccacaaccttatatttctgcattgactcctccttcgccactgccactatctcaggtgctttcataacccatgttgtagagcattcaccacggctagttcttgatcatccaggcattgtagtagatcgggacaacactccacctgcccattttgatgccagaggaattccttcagagcttgctgctactgctaaagagcccactactatcattgttgaggagtctcctgaagttgctattgctgaggaggagcctactgtcgccactactgttgatggattgacaagtttatcaactgtcattcttgatgagcctattcctactgagtaccctactgctgctattgtggagcctggacttcgtgaagactatattgctgatatctcaacgacttag

SEQ ID NO: 54426 - DNA, 246 bp, Glycine max
  Peptide Sequence Number=SeqID_171204
atgtggaaagctacatggaactccgttacacatgttagtcctccatgtcagttctggcacaggagcacggacgttccgcccttagcagtcaggctctcaattaacagtctcactttagagttgacccccgttataatggactctggtagtcttcatggtggaaaattcgatgataccctcagcctaaggaatgaggaaggtacctacaaaagggacaaggactcccatgctcaagtaagagtttaa

SEQ ID NO: 54427 - DNA, 1086 bp, Glycine max
  Peptide Sequence Number=SeqID_171205
atgggtgacttcgcttggaggccactagtgaagcaagccggacttgctggtgggactgtgccaccatctgttgcgattcctcctgctagagaagggggtcaacctactattgaggttagccctactgttgaagttgttgaggtctcccccaatgtttcttcatttcttttggttaataggaagcgagatgacggggctagggtgtcaggccagaagaagtcgaggggttgccccttgagtttgctaggctcgccttcagctccattggccattgaggctcctgctcttattgttgcaatccctactcctactcctccacctcctcctcttgtgtctgttcaagggttgctcctattgctgaatgctccagaagtgtcgactccttcttttttagcttttccagttcctccctcggttgtgttggcgtcggcatttccttccacctcttcgcaccccagtatgagctacaagcttgagcagaagaccccggttggctttgtgtcaacctttgataaaaatcttatcagtcagctagggtccagaatgccattgattcagccaaggcaccaacaggatctaaacaaggtggcatccttggaggctgaggtttccaaatggaggtccactgcttgtatagtctggagagtagatcaccctaaggtagctaatgccactgtcacctttgctgaagctgtgaaggagaaaaatgagttgactaatagggtggaaaataacatggtggagttgggcgggcttgccaaagtggttgccgaccttgaggctcggttgaaggagttagagtctaggctggaggagtccgagctgcgggcgtccaaggagagggatgccaacaaagagcttgaagatgagctactgatgtacaagaaggagtttgtggagcagcatttaaagagatttaataaggccgtcgttgagttcttcgtcaaggatcttgacttgggtctttttgaccctttcaaggacgtgaagaatagtattctacttgatgagaaagatattgcagttaaggaggaggccagcgaggagcaggatgctaaggagcaaggcgatgatgccaatgtttag

SEQ ID NO: 54428 - DNA, 198 bp, Glycine max
  Peptide Sequence Number=SeqID_171206
atgaaaaagaggcaggtggtcgtgaagcgagattacgccacgtcatcaccagcggtggggaatattcgatacggggagtgccagaagaatcatgcggcgaacacgggagtgccggtgaaggaacaaatgcggcgcttacgtgtgcggcttgcggctgccacaggaactttcacaagagggaagtactgcacggcgtaa

SEQ ID NO: 54429 - DNA, 375 bp, Glycine max
  Peptide Sequence Number=SeqID_171207
atggacgagttgcgcgaacgagccaagggttacatcctgatggaggagatgtctaagttcagaaatgatgtccgacaaactggacaaaaatgtgacaagaaggaaggaggtagcaagaccaaatcccacaagtcggacaagaggcacaactcagacaagcgccagccactcccaaaagggcccaaaggccgaacaataatccaatatgagcgagaatcggaggacactaagaagattagcataggaattatgacgctaacagtagaagggacaaaacacaagatcaagggagacagagacaccatctgcaaagacgcgagtgacaacctctgcaagaacatgaaaatgagcccacctagcaaattagaggcgtaa

SEQ ID NO: 54430 - DNA, 945 bp, Glycine max
  Peptide Sequence Number=SeqID_171208
atgaagttccctaccctgacgggggagatcgtgacggtggcaccctatccttccactaggaagtctgctaggcctcaccccacaacaggtgacgacactcaagtcatgagcgtggataaagggtctccaggccaagcctggactgtctacctagcaagcctagatgatgtattcgatgtagattcgtgcaacgacaatgctgacagaggcccaaagcctattgaggaactcttcaaattggacctcaccaaccatgaagacaaacacataactgatgacctacataggaacacgaacctattttcgtggcagccatctgacatgctgggaatccacccagcattatatgccacaagctcgccatttgtccccagaccaaaccaaggtcatgtattctacctggctcaccaatgtcgtcatggtcaaaaaggcggatgtgcactgactacactgatcttaatagggcttacccccaaggatgcatatccttttcccaacatcaataggctagtcgatggagcatccaagttccaagtactaagcttcctgcatgcctactctggatacaatcagatctggatacacgccccagacgaagagaaaatgaaattcatcactaaggatgctaacttctgctataggggtcggaagaggcaagttcccgggctttatgatcacacattggggaatagaagccaatcacgacaaatgcatagacatactagagatgcacagtcctaccaacgtctaggaagtctagaagctgaatggctaggagtacccatactcctatatctcttaatagctggtgaggccgttagctcagccctcgtaaaagagcaagggaagcaccagttcctcatctacttcactagccatatactccatgacgccgagaagcactaccaaatgatagagaaggttgcgctagcattcatcacctag

SEQ ID NO: 54431 - DNA, 486 bp, Glycine max
  Peptide Sequence Number=SeqID_171209
atgggagctgaaggagggaatgcttgtcctcacactagccatacaaccctggacttgtcttcaagaattgatagctcacctatctctaaaagcccctactcttccaaaagaagaaaaaaggagaactggaccaaaaggaataacctagagaatggatgggggaagaatacgaatgaatacaccatagacatgtttgatgttgaaaggcatgaggagcctccaccaccaacaccatctcaaagtaaagaactagaaaggacaagcccacaatgggtcagtaacatgtgcacatttgagaaggtgacaaaggacaaggactcgtgcttgtcaatcagacatggacttccattgaagaccatgcgtgtagggggcactactcccatattgttcttactcacacacccaaccattacccatatcttcatgtcctgcagaagccaaaatttcgttatcctcttgaaacgattccagtacctagcaatgtga

SEQ ID NO: 54432 - DNA, 855 bp, Glycine max
  Peptide Sequence Number=SeqID_171210
atggggaatagacatattgggaccactgccaaaggccccaggagtagtcaagtatttactagtcactatcgactactttaccaagtggatcgaggcaagaccactgcaagaaatcacagccaacgaggtggagaagttcacctggaaatacctcatatgcagacagggaccaacgaaactcctttccaactcatatatggcacaaactccatgatccccatcgaagtcggggaaccgtcgacaaagagaatgttgttccaacaacaacaaaataaagaaaacataagggtagaacttgagacaatgaacaaagtgcaggaggtggccagaatcgaagaagaggctaccaagctccaagcatcaaggaaatacaataccaagcttggtcccaactgggaaagcccatttagggtcatagcaagcctaggcaacgaagcctatagactacaggagctagatggtaaagcaattccaagaacatggaacggtaccaatctaaagttctacttcagtgaacctgctgctcatcaaacccaaggtccacccttggtgagtctcacaggctcatcaaacctaagatccacccttggagagtctcacttctccaaaggctcgtcaaacccaaggtccatccttggtgagtctcgcttctccaaaggcttgacaaacccaaggttcgtccttggtcactccttgggaactacgaagaccatagttaaaagtccaagttccacaaggcaaaccaactaccaccagaatggtcagcaagaccttcaactaggtggaagtcatattaactgctcacaagcatcaggggaaaagctcagcaaagcaaaaagaagcctcaccggatga

SEQ ID NO: 54433 - DNA, 1128 bp, Glycine max
  Peptide Sequence Number=SeqID_171211
atgtctactatttctgattctacgttgggcataggaggaagtgactctgggggttccattcagcaacccatggtagagcgggaagtggttctcataggagattctttgtcggaggagaggttgatgaacttcaaaaatgtgggtgagggtagcttcgagccacgcgctgggataaaatctcccctggcttctatggaggatcaatcttcccttgttacgacaatcatgtgcctgcccccttgggagaatccagtgactgacgaggctgtaggaaaagatgattgtggtgaagttagggtttctagttctcctcacggcaaagtgaaagatgacgttttgaagtatcatttgttggtaacatcacccttgagtgtagatgccttatggtgtcaacttgagttgacaaaacctggggatgcccataagatgaccttagtggtctgcagagaagatgagtaccccattatgtgtcctgcccctgatggaataatggacgactttgcatggcggcctttagtgaagcaggttggacttgttgatggtgacgtgccccctcccctagtcagtgtcaatgaaccctctaaagggggaggagattcgattgaggctaggttgacccatccaggactgctaatgctgtcgaggttacacttggtgtgccttttcctacaactaccaagaggaaacgcagtaaagcggttggagcaaccagactatgcaagaagtcaaaggcttcctttattctttgagcccttagcaagccacaggactattgctgctatagctaacgtctctaatcctattgctcctccacctttatccacccaagtggtttctgtatctcttccatctgcaccagccatttttgctccttcctctgtcatgttttctcctgtttcttttgttgcaccatcgctacttagtgcagggctaacaatgataggtgttgttacaagcatgcctcatcttccctctgttgtgccacctttagctcccattgtcctaaattcagagatgccttcttcctcttctcagaatggaagcaagcataaagaggctatgaacagaattgcttccttggaggaggaagttgccaagtggagggtcactgcgaggatagtatggtga

SEQ ID NO: 54434 - DNA, 1047 bp, Glycine max
  Peptide Sequence Number=SeqID_171212
atgagtgagctggcgatccggtatctccagcagaccacccacgatttccagacggtgggcatcgacggcacgtcgtgcagcgatgcgcgcatctgcgatctgccgggccttgacggcatgaatctgccaccgctggacgaagagtcgcaggcggatctcgacgatccttacgtgttccacgtcccggatggcaacgccacgctggcgcgcctgatggcgcgcaaactgatcccgacggtggcgccggccggccaagacatggacgacgtggtgctggccaaattcgactacggccagctcgatcggccggaatcgccggtgaagcatgcgtttgaacagcaccgggctgcatgcggccaacgtcggcgacaaggtggaagtcacctacatgaccggcgagaagatgaccaaggtgcgcgccgggcaggtggtgatggccggctacaacatgatgatcccatacctggtgccggagatgtcgcacgagcagcaggaggcgctgaagcagaacgtcaagtcgccgctggtgtacagcaaggtggtgatccgcaactggcaaccgttcatcaagctgggcgtgcacgagatctattcgccggccgcgcccacccgcgcgatccggatcggccgatcggcctgcatatggtgtacgtgccgacgctgccgggcagcggcctcagcccgcgcgagcagtcgcgcaaagggcgcgcgctgctgctgggcacgccgttcgaggtgcacgagcagatgatccgcgaacagctgcagggcatgctgggcgaggccggtttcgaccatcagcgcgacattcaggcgatcaccgtcaaccgctggtcgcacggttactcctacttcctcaacggactgtttgacgacgaagacgaggccacgaaaatcatcgaaacggcgcggcagccgatcggcaagatcgttatcgccaactccgatgccgactggagcccgtacgccaactcggcgatcgatcaggcgtggcgcgcggtgaatgaactggcctacggcaaggttgccgccaaggagggagcatga

SEQ ID NO: 54435 - DNA, 1542 bp, Glycine max
  Peptide Sequence Number=SeqID_171213
atggaggtgctcaagggcatctcgctgcaggcgcatcagggcgatgttatttcaattctcggtgccagcggctcgggcaaaagtaccttgctgcgctgcatcaatctgctggaaacgccggatgccggcgtggtgagcgtcggcggcgaaaccattgaaatgaagcgccacgcgcgcggccatcagctggcggcgaatcctaagcagattgaacgcctgcgctcgcggctgggcatggtgtttcaaagcttcaatctgtggtcgcacatgacggtgctgcagaacgtgattgaaggtccgcactatgtgctgaagcgcgacaaaaagagttgtatcgcccaggcagagcagttgctggatcgcgtcgggctgcttaaccgcaaggatttttatccggcgcagctctccggcggccagcagcagcgtgtggcaattgcccgtgcgctggcgatggatccggaagtgatgctgtttgatgagccaacctcggcgctcgacccggaactggtcggcgaggtgctcaaggtgatgcgcagcctggcggaagaggggcgcaccatgctggtggtgacgcacgagatgggcttcgcgcgcaacgtctctaatcgcgtggtgtttatgcatcagggcaacattgattgcgagggcacgccggaagcgatgtttggcgccagcggttcatcgcgctttaagcagtttatctccagccatcagagccatcacgcggagcagccagcgctggtacaggtagcgcgacataacgccgaactgacgctgagcgccgccgcctggcagcgcattgcgcgcggtcgcgagatcgtcgaacagatcgttgccagcggtcagattgcctatggcatcaacaccgggctgggggcgctatgtaacatcaccctgccagaagaccagctcagccagctgtcacgcaatacgttgctgagccacgcctgcggcgtcggtccgctgctgacgcgcgagcagacgcgcgccattctgtgtgcggccatcgccaactacagccacggcaaatccggcgtttcggtggcgctggtgcagcatctgctggcgctgctcaatcagcagatcacgccgcaggtgccgtcgcagggttcagtcggttatctcacccacatggcgcatatcgggctggcgctgattggcgtgggcgacgttgagtaccagcaacaggtgatgccggcggagcaggcgctgcggctggctggcttgcagccgtatcgccccggtgccaaagagggcctgagcctggtcaacggtacgccgtgcatgaccgggctgagctgtctggcgctggacgatgcggcgcggctgctggattgcgcggatgtcaccggcgcgatgagcttcgaagcgctgcgcggtcagctggcggcgtttgatgccgaggtgattgcgctgaaagccagtcccggcatgcagcacagcggccagcgtctgcgtgcgctgctgagcgacagcccgctgctggcagcgagctgcggcatacgcacccaggatgcgctcagcctgcgttcgatgccgcat

SEQ ID NO: 54436 - DNA, 567 bp, Glycine max
  Peptide Sequence Number=SeqID_171214
atggctgatcaaggagatctttatgaaagggatggaattgttttggataggagcaaaagggataaaagcagagtttcaaacccattaatgaaatgggcactactaactacaacttctgaggataaaatgcaaaagtatggtcggtccaaagttggatctcgtgtggttccatatcatgaagatcagagtgaagactcagttcctgtcagttttgtctctaaagatctccaaaggaatggtaaagagagtgaagattcagaagcagcagtcaagtctactcaatctactgtagttgatggaaggaaggatgaaataccttcgtttccaactgatgttgcaatgaaatctcacttgcattttggagagcttgtaactgtaaacgtacaaaggcttggtatgtccctttcattgacccttgatgccatgtcattcaatatgattggggtcaggcacatgttcgatgaaattgattatgtcctaaaaggaaaaaatactgactgctttgcttctctttactgttggtcagcaatatacacatttaagtgttgtaagtacaaggataattaa

SEQ ID NO: 54437 - DNA, 375 bp, Glycine max
  Peptide Sequence Number=SeqID_171215
atgtcgccacacgggggcgacatggatgggggtgaaaaaaggaaagagagggatggggtttctcttgcttttggcatagcgggccccggcgggaggcccgcacgacgggctattagctcagtggaggatagatgggcgattcaggtgagatccaatgtagatccaactttctcttcactcgtgggatccgggcgatccgggggggaccaccacggctcctctcttctcgagaattcatacatcccttatcagtatatggacagttatctctcgagcacaggtttaggtttggcctcaatggaaaaaaacggagcacctaacaacgtatcttcacagaccaagaactacgagatcgcccctttcattctggggtga

SEQ ID NO: 54438 - DNA, 249 bp, Glycine max
  Peptide Sequence Number=SeqID_171216
atggatgaggtgaacaataacagaccatcaactgaaaccaaaggaaggaaaaatgaacacgagtgtcttagcatttatttcacaaggtatttttcaagaccacataacgaaagagcaagggaacttcaccgaacgacgatagtgacaaaggtaagagtaacgcagagttgcagttggcgacagcgtcaacagcacgacggtgaggtcacgacacgagatgagctacaacgagtttatggcgtgacctag

SEQ ID NO: 54439 - DNA, 243 bp, Glycine max
  Peptide Sequence Number=SeqID_171217
atggtggtaagcccacaatatgctggggagttcttccttccacaagcctttggatttgtcaagtttaatgtgcaaggctttaagggtgaccttgttcactacttcagcttggccgtttgtctgagaatgctcgatagaggtttaggctttgaattgaatgtctttgttagttacaatgggacagtggagtccatacctgcatatgaggtgcttctaagtaattttttctacttcgttagctga

SEQ ID NO: 54440 - DNA, 273 bp, Glycine max
  Peptide Sequence Number=SeqID_171218
atgcatcatataccaaggaaagacaacactagggcagactttttctccaagcttgcaagcaccaagaagattagacacctcaagactatcatccaggaaacactccaagcaccgatgatagacactgatgagatgaaaatgaagcacaacgttggaaaagaaaggccaattactgcgtcatccccttactcaaggaatctatggcctccacataggggggtgttccctagcaaccatggtagtatgtgttggctactgttggtcgacacttaa

SEQ ID NO: 54441 - DNA, 342 bp, Glycine max
  Peptide Sequence Number=SeqID_171219
atgaagctctcggtgttgcaacagacttacctcacgcgttgggggaacagcttcagaggattggcgcagttggatttgtccggcgacagtgttgtgaagtctctgacggcgattttttggctggtaatccacggcgtctgttgcctcatcagcttggttctcagcttccgcttctcgcgccttgtcttcttcttcctcttctccaccagcctctacaccgcgccttttcggagcggttcgaaaatctcggctccgcatgacgtacctccagcggtgaaccggacggcgacgacagtggcgagcacggcgagccgcatggtggtcgggtggcacgggatctga

SEQ ID NO: 54442 - DNA, 228 bp, Glycine max
  Peptide Sequence Number=SeqID_171220
atgaagttcgacaggctggacaaaattaagcactacaggtacaatcgcaaccatggtcacaacaccgaagactgttgggccctcaaagacaagattgaggaacttatacaagcgggttacctagcccagaaaaaattgaatgagctcagagccatagtcttgacaccacacctcaaaatgaagtaccctaccttgacgggagaaattgtcactgtcaaggcaaactag

SEQ ID NO: 54443 - DNA, 243 bp, Glycine max
  Peptide Sequence Number=SeqID_171221
atggaggtcaacctacaactaggttggaaaccgctcaacctggagcattacgacgggaccaccaacccagacgagtatttgaatacgttcctcactcaggctaacctctacactaatgacaacgcgatcttatgtcgagtcttccctatgtcccttaggagatccatattgatgtggtatgaaggactccctccccggtctattgatagtttcgacacccttgtcagtcacttcagcttttaa

SEQ ID NO: 54444 - DNA, 243 bp, Glycine max
  Peptide Sequence Number=SeqID_171222
atggtggcattggagagggagtacagtgctggggagcgatcggtgaagggggagggtgcggaggtcagaccaggagagaaacttgaggaggacgtggtagcgaaggacatcaacgaaggcggccagggagaggtgatcattgacggcgaggtaggagttggggacggtgagaatggagagggaggagcggttcgagagatctgcggcgagggacatggcaaagacgatgagagaggtgaataa

SEQ ID NO: 54445 - DNA, 213 bp, Glycine max
  Peptide Sequence Number=SeqID_171223
atgcacgagtactgcaccttccagttttgccccgcctccctcgctttcgagccccgctccctcccggttttcatggccactacaacaccttttcccccaattccaacctttgttgttgttgagtggttagggttagctttcacaaaggaggggccagcttggaagaaggtagtgttcagggttttgggatcggcggaaaaggaggaagaatag

SEQ ID NO: 54446 - DNA, 320 bp, Glycine max
  Peptide Sequence Number=SeqID_171224
tcaagtagcgacaggttggaattgggggaaaaggtgttgtagtggccatgaaaaccgggagggagcggggctcgaaagcgagggaggcggggcaaaactggaaggtgcagtactcgtgcatgtggatgtgggagtggtggtggtcgaaaaggggagacgaggaggaggaagatgcaaggaggaaaaaaaagggggtggaggagggagtggagagccaattgaggagaggggaggaggtggggagagaggaggggaggatagtgttgatggagtcgtggaaggaaggggaggtgaggaagctaatgacggtggcgaggagg

SEQ ID NO: 54447 - DNA, 141 bp, Glycine max
  Peptide Sequence Number=SeqID_171225
atggagttcaacgggggtgggggtcacaacccactctttgaggattcacctagtgagtctggtagtagggccgccactgtgagatatgggctaatctccaatgacactcacgaagcaagatgcaagtacaaggctgtgtaa

SEQ ID NO: 54448 - DNA, 765 bp, Glycine max
  Peptide Sequence Number=SeqID_171226
atggcttcattaaaagctttaattcttctgaaacccaatccccgttttcattttgaccttgtaagactaaattggaagaatttcaaattctcacaaaaaatagagaaattaaaattctccatccagtctcaggcacgctctctcttcctctcagccactctctcatgccacacatgctctctcttcctctcagccactctcacgcacacgacgctagcgctctctctccctctctgcacactagctctctctcttcctctcagtcactctcacgcaccacacgtagcgttctctcacaagtttactaacactttagtattgagacttgacaccatctttgtccttccctatattgttgttgtcatccaggttcggttggcagtgtctcttcttgcggatggtctggctgttgctgggcaggcaattcttgcgggcgcatttgctaataaggattttgacaaggccacagcaactgcgtcacgagttctgcagagacatacattatgcaaatgtgacgcgctatttgttatactgcacatgggtttggttttaggattggcacttgcattcattcttggaacaggattgcactttggtgctaaaatatttacacaagatgctaatgtccaccacctcattcaaattgggatcccgaattggaacgggatcaggaccttgggagttcctaaggagctcatgactgcacatggcagacaccatagttatagcttcatattaggcctaggtttcagtggtgtttgctga

SEQ ID NO: 54449 - DNA, 412 bp, Glycine max
  Peptide Sequence Number=SeqID_171227
atgacatctgaggcggcacgccaaattattaataggactgattccctagaagaggagtccgcacaaggtagctttgtagctcatagacgtcaggatgtattgactactgccattaggcgaccagagcaccctggatgtcaggttctaaggagaggtgcatttcttcttcggattcaggataaggggcacacatctaagctgaaacttgagtgcgagatcttcaatcttctttgcgaactcttcgtcagagaaaggctccaacctagcactgcaagcccttctccaactccacctgcacatgaggataatgaagaagaagctatagggaatgaggaagaacgtgttatggaccattgcaacaagttctctggggagattctggcgagcctcgggtttgagcggcgctacctag

SEQ ID NO: 54450 - DNA, 624 bp, Glycine max
  Peptide Sequence Number=SeqID_171228
atggctcaacagaaactaaatgggcttgagaagcagaaagaggaaatgatgaagttgaattccccacaataccttctccaatggattcaagaggctatgaataagacagaagtggaatatgaaattctgcatcagcaagtccttgacagagagattgacattggagttgggaaaattagatggggaatggttagggctcgttcatctaaacctttgagagtgggagaagctatgccatcagacacagatccctactatggaaaatgttctaatcatctcgatgaaaaagaaaatgttagcagtgggcataacaaagacgacaagaactttagtgcactaacccccgagttaaccccagagttagaaatccataaggatgactatagggtagatagtttgacagagattaaaggtgaaaaagaaaatgttatcagtgggcacgagaaagaggacaagaactttagtgcactaacccctgagttaacccccgagatagaaatccaaaaggatgactataaggttatttgtcctcctgaagctgccattcctgttcgtgttcgagttggagttcgcaccaattcccgttcgagttggtgttcgagtatgtgttggagtttgagttag

SEQ ID NO: 54451 - DNA, 153 bp, Glycine max
  Peptide Sequence Number=SeqID_171229
atgacaatggcttttgatatattgaaattggagctaggtttccaagcagctcaagatcaaggtcaaggcaaacagttctcattggtccaaccaatagagtctagctcaactagacacaagccagaaagcattatattcccaaaggagttatga

SEQ ID NO: 54452 - DNA, 411 bp, Glycine max
  Peptide Sequence Number=SeqID_171230
aaggaaggaagaatcaggattctatcttcatgcgaaggatgtcccatgagaggagtgccatcagacgaaagcatcacgcctttcatcgcacgaggtttcagtgaccacaacgcgagggacagagagcttaggggaagcagtaatgggatcatcggcggctatcataagtggctgagagtccgaacacaaggactggattggctcccaaatctaaagactgtgagtgacgatgaggttaaagcttcggaagaaagtgatgaggtacaagccctaaaggcagagcttgaaagagcctgggtagtcgaagagaagttcaaggcagcaatagtgagctcaagttccgaagaggtgaaaggaatcatcacgggtcaaaggcatgatcttgaaggacgagctaaaggcttgccttag

SEQ ID NO: 54453 - DNA, 220 bp, Glycine max
  Peptide Sequence Number=SeqID_171231
atgggagctcatacactcatgattgagaagagcataaaaaatagtgaagagaagatgaaggcattgacatgtgttttggaaaccaaccatcacgaatggagagaggcagaaagaaaggtcaaaggaagtgaaatcttatttctctcctctttcaaggaaatcaaagtgcacgggagagaagtttctatggagaaaggtacaagtcttcctatagagaaag

SEQ ID NO: 54454 - DNA, 219 bp, Glycine max
  Peptide Sequence Number=SeqID_171232
atgacagaaaagtgttttctctcactcatagccatcacgaatggagagaggcagaaagaaaggtcaaaggaagtgaaatcttatttctctcctctttcaaggaaatcaaagtgcacgggagagaagttcctatggagaaaggtacaagtcttcctatggagaaagtgttgtagatctttttgtcctcttagcaatgcttttggtcccatgtcactttga

SEQ ID NO: 54455 - DNA, 825 bp, Glycine max
  Peptide Sequence Number=SeqID_171233
atggcttcggagcctatggttggaggagatgacgaagccagagagaaacagagattcggggagagaaaggtttacacgaggaggaaagtaaagaaagaccctaacgccgttgcttccaccactgaaaataacggcaccgccacttccaccgttaccaatgacaacagtgtcagtaatagcaccgttcagaagagcaacactggtgaggccgctgaggccaagagcaaaggtgataatgtttcgacacaggctctggcacagcctgttgtactgccggaggatggaaatttggctcagcctcaagtggtttcgggattagaggatgggaatttggggcagccacaactggaggatcagaatatggttcagactgaagtgggttcaggattagaggatgggaataaggctcagccgcgaggggaggatcagaatatggcacagacgcaagagggatcaagattggagaatgagaatagggctcagccgcaaggggaggatcagaatttggcacagacgcaagtgaattcaagattggaggatggggatacggctcaactacaattggaggatcagaatatggttcaatctcagtcagaggatcagaatatggttcaacctcaatcagaggatcagaatatggttcatcctcaatctgaggatcagaatatggctcaacctcaatctgaggatcagaatacggctcagccacgattgggggatcagaatacggctcagctgcaaggaaattcaaaattggaagatgagaatatggctcagccgcaagtgagttcaagatcagaggacgcgaatacagctcagccgcaa

SEQ ID NO: 54456 - DNA, 117 bp, Glycine max
  Peptide Sequence Number=SeqID_171234
atggcgagggacgtggcatggcgcgtgtgccacacgctaggttgggagggggctttcggtctagctggtgctcggaaggttcacacactcgccctcgtagcgggtggagagtgttaa

SEQ ID NO: 54457 - DNA, 1308 bp, Glycine max
  Peptide Sequence Number=SeqID_171235
atgttggagaatagtcaagggatctgtgaaactgttgagaaggagaagagaacacctaaagcaaaccaattttatcgtaactcagagttcttgcttgcgaaagacaaatttccacccgcagagagtaacaagaagtcgaaattgaattggaagaagcaaggtgggggagaaatgggacatggttttgggatgggatctaagtttttcaaaagctgtagttcactgcttgaaaaattgatgaaacacaagcatggttgggtgtttaatgctcctgttgatgttgaggctcttggtttgcatgattattttactattatcactcatccaatggacttgggaactgtgaagtctaggctgaacaagaattggtacaaatcaccaaaggaatttgcagaggatgtgagactcacttttcgtaatgccatgacatataatcctccgggacaagatgttcatataatggccgagcagttatcaaagatatttgaggacagatgggctataattgagtcggattacaatcgggagatgagatatggctttgattatggggctgttgcccctgcactatcacctttgtctagaagggtttctgcatttacaccaccacctcttgatatgagaaggattttgaatagatcagaatcaatgacacagactccaagactcatgagcattactccatcaagtagaaccccagctccaaaaaagccaaaggcaaaagatcctcataaaagagacatgacatttgaggaaaagcaaaaactaagcactaaccttcagagcttgccttcagagaagcttgatgctattgtacaaatcattaagaagagaaattcagcacttaatcaacatgacgatgaaattgaagtggacattgatagtgtggatgctgagactctctgggagcttgatagatttgttaccaactataagaaaagtttgagcaaaaacaaaaggaaggctgaacttgctcaagctagagcagaagctttgcagcagaatgccatccagaagagtcaggcaccagctatggcagagattccaaaagaaacactaacaggtgaacttctaagaatcaggatgaaaggaatcttccccaacccttgcctgcgcaaaggggaaatcaagcagataatgggagtaggtcaagcagttcaagcagctccagcagtgattctggatcttcttcaagtgattctgatagtgacagttcctcagcatctggatctgaggcagggtcgcaagggacctgaatgtgctccgtcagcacttctccctttccattctgaagaggaatgtttgtag

SEQ ID NO: 54458 - DNA, 1146 bp, Glycine max
  Peptide Sequence Number=SeqID_171236
atggaagataagtcacctaggcaggtgagggtcagaggtcatctggtcaaatttgatgaggacacgcttaatacattcttgaagacccctgtcatcattcaggagggagagacattatcagcttattctagatttgcactctggaggcctgatcctcaagagttagctgctaagctctgcatcccagggagggggtttgagctaaatgttgatggtcagcctctgaagatcctcaggaagaacatgaccacactcgctcagacttggagtgttctttcttactccaacttggtccctacctcccacacttctgatatcacattggatcgggccaagttgatttgtggcattatcatgaagatggacatgaatctggctttgtgtaaagctagaggagtcatatcagattccagatcattggagagccttagccctgccattaacttggcatatataaagaagaactgttggaatctagatgatccaacagtgacattcagagggccaaggaaggccaggggcaagagatctgaggctccccttacttcaacaacaccagatgcttctgctccttcttcatccattttaccagatcatttagcaccttcttcttctactccagctactcctactccatctcctgctcagataccagttctagctctttcttcctctggaccatcagatttttcctttacaccaaagatgctatatgcgatgatacagagcctacaccgagggcatgcaattatcatgcagagcttccagagcttgggcctgccatctatcatgggcatggaggaatttcactctcaggtggcttggccaggagtccagccttctccttctggagggggtgggacctccacagcccaagagcctgagcaggcagcagaggagccaattttagcagagtatgagctcactcctcttgagccattttcttttgctgcagatacatctatggctcaagaggaggagatttctccagatcacatgccagagccatcccctgcacctatatctgaggacaccatgccatcagcactagccatggagccagagcagtccattcttcaggatgtactagctgctccagtgctggatttaaatgaagatcagccacaagatgagcaagatgtttaa

SEQ ID NO: 54459 - DNA, 273 bp, Glycine max
  Peptide Sequence Number=SeqID_171237
atggggtgtaccgatggccccgaaatctaccctaaggctcatgagaaccctagggccttctcttgcatctttggcccaatcttcttggagtcttctatccaatgcccttgggggagcctccacggagggcaggtcattataatgcagagtctccatagctcaggcctgccatctattatgagcacaaatgatgatgtgaacctgactaggagcggatcatttgatacaggctacggagttttggatgacgccacttccagtgaaggaagataa

SEQ ID NO: 54460 - DNA, 189 bp, Glycine max
  Peptide Sequence Number=SeqID_171238
atgaggccacttgatccaacattgagcttcagtgagctccttcaatggagattttcagccatggagttgcagcgaaagataaaggagaagagcctaggtagcttccttgaaaagcttcctttagaagcttctttgagaagtttccttgagaagttagaacttagctacacacacccctctaatagctaa

SEQ ID NO: 54461 - DNA, 369 bp, Glycine max
  Peptide Sequence Number=SeqID_171239
atgactctaaagaaaaagatgaaggaaacaatgaaaattctcaagataatggagttagagcaaataatgaacttccaaaagaatggaaagcctcaagagatcatcccctcgacaacattattggtgatatatcaaaaggggttagtagcaaaatggtataatcaagaagagggaatagactatgaagaaacatatgctccagttgcaagattagaagccattagaatgctcttagcatatgcatccataatgaattttaagctctatcaaatggatgttaaaagtgcttttctaaatggtttaattcaagaagaagtatatgttgaacaaccttcaggttttgaaaacaatttcagatttagaaaatga

SEQ ID NO: 54462 - DNA, 672 bp, Glycine max
  Peptide Sequence Number=SeqID_171240
gtcgactctagaggatcccacagaggactacacctttttgccttcatagggctgcacgcccttgcctttagtggactacacgtcctcctcttcagaggactacacgtcctcgcatttataggactacacgccctcgccttcagaggactacacatcctcgccttcagaggactacacgttctcgccttcagagggctacacgccctcaccttcagaggattacatgtccttaccttcagaggactgcaagcccttgccttcagagggctacacgtcctcgccttcagaggactatacgtcctctcctttagagggctacacgtgctcacctttagagggctacacatcctcatctttagagggttgcacgccctcgccatcaggggactacacgtcctctccttcagaggactacacgtcctcaccttaagaggactacatttcctcatcttcaaaggactacacgtccttgccttcagagggctacacgccctcaccttcagagggttgcactccctcgccttcatagggctagacgccctcacctttagaggactacacgtcctcgccttcagaggactacacgtcctcgccttcagaggactacacgtcctcgccttcaaaggatttcacatcctcgcttttagagggcttcatattctacgcctttag

SEQ ID NO: 54463 - DNA, 288 bp, Glycine max
  Peptide Sequence Number=SeqID_171241
atgctgcacacgccggaaggcagcctggtggatgtgctgctgcatcgcgtcggtcatcatacggtagtggatattgtcgataacggccccggcatgccggagtcgtttattgagcgcgccttcgatcgctttacccgctcgccggatgtccaggcgcagggcagcggcttaggattatcgatcgtgcgcagcgtggcgcagaagcatcagatgcaggtggcgctgtcgaattgccttaacccgcagggtgaagtgtgtggcctgcaggtgcgcgttaccctaccgtaa

SEQ ID NO: 54464 - DNA, 249 bp, Glycine max
  Peptide Sequence Number=SeqID_171242
atgaaagataagaggactgaggaagaatatctagaaaaacaaaagaaaaagaaggatagtaaggccttgtcttcaaaggccaaggggaaggaaaaagaggaaaaggattcctccaagacagatgttaagaaggaaaaccattttgcaacaaaaggtcatatcaaaatagcactcattcttcaagggaaacatcccttagcactgccatacctcttaaggttgaggtattatgatgcatcaaatccctaa

SEQ ID NO: 54465 - DNA, 261 bp, Glycine max
  Peptide Sequence Number=SeqID_171243
atggataaagaagttaaggacttagtgcatgaggcaactaaggtagaacaaaaactcaagagaaagggtgttattagaaggagctcttctaactttaattctccaagttggaaggacaaaaacaaggagggaaatacttcttcaagcaattccattgttgtacctcaaaggactcaaattaagtcctatgggtcccctaaaaagataaggagtagtgagataaaatgcttcaagtgtttgggaaaaggtcacaatttctaa

SEQ ID NO: 54466 - DNA, 297 bp, Glycine max
  Peptide Sequence Number=SeqID_171244
atgtattgtgttaatttggtggttgattttaaattttggattgactttggtctccatgaagggagttgttgggcattctccacggttggtgcagtggaaggaatcaatcaaattgtaacgggcaacctcacctctctgtctgagcaagaattggtggattgtgacagaggctataacatggggtgcaatggaggtctcatggattatgcttttgagtttattgtgcaaaatggaggcattgacacggaagaagattacccttatcatgcaaaggataatacatgtgatccaaacagg

SEQ ID NO: 54467 - DNA, 663 bp, Glycine max
  Peptide Sequence Number=SeqID_171245
aaaaatgctcgggttgttaccattgatggatatgaagatgtcccaaccaatgatgagaaatctttgatgaaggctgttgcaaaccaacctgtcagtgttgccattgaagctggtggcatggaatttcaactttatcaatcgggtgttttcactggccgatgtgggacaaacctagaccatggtgttgtagcagttgggtatggaacagaaaacggcactgattactggctagtgaggaactcatggggctcagcatggggggagaatggttacatcaagctagagagaaatgtgcaaaatactgagactggcaagtgtggaattgcaatagaggcatcataccctatcaagaatggtgctaaccctccaaaccctggtccttctcctccatctcctgcaacaccttcaattgtttgtgatgagtactactcttgcaactctggaaccacatgttgctgcctctttgagtacagagggttctgctttggatggggatgttgccctattgagtctgcaacatgttgccctgaccagaccagttgttgccctcctgatttccctttctgtgatgattctggatcttgcctattggtaatttaccctctctttcattggctttgctataaatcttactatcaaacaattatgataccagaatgctag

SEQ ID NO: 54468 - DNA, 144 bp, Glycine max
  Peptide Sequence Number=SeqID_171246
atgaagaacgaggagccaagcttctttactgttgatggcattctcaaaaatcatgaacaagatgggttctggtcataccgtacaacattatgctgccttggggagagacaaggtaaaggcctagagcggcagcagcagctttga

SEQ ID NO: 54469 - DNA, 1468 bp, Glycine max
  Peptide Sequence Number=SeqID_171247
atgaagcctttcccatgtgtcaaggacttcaacttgttgtttggcatcgttgcgaagatgaaacactacacaactgcaatttcgctaatcaaacacatgtcttatattggtgtcaaaccgaatgtccccactcacaatatcgtcattaattgtctctgccgtttgaaccacaccgtgtttggcttctctgttttggggcttatgttcaaaattggtgtggaacctagcatcgtgacttttaccaccattgttaatgggctttgcgtagaaggaaatgttgctcaagcaattaggtttgttgaccatttgaaagatatgggctatgaatctgacagatatacccgtggagcaataattaatggattgtgtaaagttggtcattcatccgctgcactctcgtatctcaagaagatggaagaacaaaattgcaatttggatgttacagcttacaacgcagttgtggatggtctttgcaaggatgggatggtatttgaggcctgggatttgttctcacaaatgacaggcaaaggtattcaacctgatcttttcacctataattgcttaattcatggcctttgtaactttgatagatggaaagaggctgcacctctattggctaacatgatgagaaagggaatcatgccagatgtgcaaactttcaatgttataggtggcagatttttgaaaacagggatgatttctagggctaaaagcatattcagtttcatggggcatatggggattgaacatgatgttgtcacctatagttcaataattggtgttcattgtatgctaaatcaaatgaaggatgccatggaagtatttgatttgatgattcgcaagggctgcttaccaaacattgtaacttatacttcattaatccatggatggtgtgaaattaaaaacatgaataaggccatgtatttcttgggtgaaatggtaaataatggactagatccaaacattgtcacatggaacacacttattggggggttttgcaaagcaggaaaaccagtagccgcaaaagaattgtttttcgtaatgcacaagcacgggcaacttcccgatctccaaacttgtgctattatattggatggcctatttaagtgtcattttcattctgaggcaatgtcattgtttagggagttggagaagatgaattcagatcttgatattataatttacagtattattttgaatggaatgtgtagttctggaaaactgaatgatgcactggaactcttttcttatctgtcaagtaaaggcgtcaaaattgatgttgttacttataacataatgattaatggtctatgtaaagaaggactgttggatgatgccgaagacttattgatgaaaatggaagagaatggttgtcccccagatgagtgcacttataatgtctttgtccaaggattgctgcgaagatatgaaatttcaaagtcaacaaaataccttatgtttatgaaag

SEQ ID NO: 54470 - DNA, 402 bp, Glycine max
  Peptide Sequence Number=SeqID_171248
atgtctcattcattttcacatcattcacgtactcaaggatcaaaacacaatatcattaaatcaatcaatacacaagcattatgcaacagatacactaatactcaatcctatatgcaatgtggtaccatgtcagtgaaaaacctcgtcgggcacctaggagtacatgacaagacaaaccacacactaggagaccagtcagggtcacgctgttttgcaagaatgttccaaccatgcgggatcggcacagacttaaaggagcactcaaaccaggtatatttacccttaagacctagactccgaagagtctgtcagggcttatccctcctgattcaggtccaacccaaaaaatattttagcacacagactctatttgtgaactgtacgaaacacacgactccttaa

SEQ ID NO: 54471 - DNA, 1483 bp, Glycine max
  Peptide Sequence Number=SeqID_171249
atgagattccctcttcttcgatactttgctttgtcttctaatcccacgcactttcttcttcacccatcacattcttcttcaactttctccacctacgtcagagatagtgacaatcataatcataataacgcctctataaatacaagaagagctcaattccttgattccatgagaaatgtgaaatctgtagacgttgctttggatttctaccacaaaatggtcacaatgaagcctttcccatgtgtcaaggacttcaacttgttgtttggcatcgttgcgaagatgaaacactacacaactgcaatttcgctaatcaaacacatgtcttatattggtgtcaaaccgaatgtctccactcacaatatcgtcattaattgtctctgccgtttgaaccacaccgtgtttggcttctctgttttggggcttatgttcaaaattggtgtggaacctagcatcgtgacttttaccaccattgttaatgggctttgcgtagaaggaaatgttgctcaagcaattaggtttgttgaccatttgaaagatatgggctatgaatctgacagatatacccgtggagcaataattaatggattgtgtaaagttggtcattcatccgctgcactctcgtatctcaagaagatggaagaacaaaattgcaatttggatgttacagcttacagtgcagttgtggatggtctttgcaaggatgggatggtatttgaggccttggatttattctcacaaatgacaggcaaaggtattcaaccgaatcttttcacctataattgcttaattcatggcctttgtaactttgatagatggaaagaggctgcacctctattggctaacatgatgagaaagggaatcatgccagatgtgcaaacttttaatgttatagctggcagatttttgaaaacagggatgatttctagggctaaaagcatattcagtttcatggggcatatggggattgaacataatgttgtcacctataattcaataattggtgctcattgtatgttaaatcaaatgaaggatgccatggaagtatttgatttgatgattcgcaagggctgcttaccaaacattgtaacttataattcattaatccatggatggtgtgaaactaaaaacatgaataaggccatgtatttcttgggtgaaatggtaaataatggactagatccagatgttgtcacatggagcactcttattggggggttttgcaaagcagggaaaccagtagccgcaaaagaattgtttttcgtaatgcacaagcacgggcaacttcccgatctccaaacttgtgctattatattggatggcctatttaagtgtcattttcattctgaggcaatgtcattgtttagggagttggagaagatgaattcagatcttgatattataatttacagtattattttgaatggaatgtgtagttctggaaaactgaatgatgcactggaactcttttcttatctgtcaa

SEQ ID NO: 54472 - DNA, 1179 bp, Glycine max
  Peptide Sequence Number=SeqID_171250
atggtccttattgaagattttaattgtgccctccaggaaaacctacttattcagggtcatatgtacctctttgtcaacttcatttgtttctactcaaacatatttggatatgagacaaagaaaataatcccattccctgaagtcacgagtgtaaggagggcaaagacggctgggctctttcccaatgccattgagattcttgctggaaacaagaagtacttctttgcatccttcctatcccgtgatgaagctttcaggattattaatgagggatggtcgcgacagggcaatggagccatagcaattatggaacagaagccttgcccttgcatatgcaaagaggctgtttccggatctgaacccatgacggtcaccaaggcacaactttgtctccatgaatcaatgtctgagtccagcagccaagagaatggatttgtagctgttgaaaatgtcaaaagttctgatataactgacaacggatcactttctactgatctgagcaaagatacgacgcttacatccattgttggggatgatcctgtatcgacggcagattcagagaagcaatgcagtgtaaaacaggttgctgaacctgaactgaataatgatgccccaagtgctgcaagtgtgagttggaagtggaacgaggaggatattgatgccccatcaaataatctgatggatttgaacttattttctaaaaatgcagttcttgaagcatatacatgtgttgcagattcagtgtttccgattttctcaaagtttagaatttacacattgcagatgaaggttgaagacttctttaggtacttattctcagatgatgctctaaattttcttgagtcttttcgccaaaagtgtggtgataaagactttaggtgttctccgtggcatcctcaagagaaatttggggccatacttccgcatcatattcttcagcactattcttcagcagggtcaaaggcttctaacagaagatggaaaatgtggtggctagcagttacaaattctatttggaagctcagaaacgaaatgatatttcataatcaatcctttgatatcactaagctggcagatagtactcttttccttttgtggacttggttgagggaatgggaaagggacttcaaggttcctttccattgttggtcttcagcaatgcctatagtctttatttaa

SEQ ID NO: 54473 - DNA, 327 bp, Glycine max
  Peptide Sequence Number=SeqID_171251
atggcaccttttgagaccttttataggaggcattgtagatcactaaagcctagattggtaagtctagatctaattcaagaagttattgagaaggtcaagattctagagagggtggggcaagtggcttatcgcttagccctcctacttgatctatcaggggttcatccagatttccatgtgtcgatgcttcaaaagtatgttcatgatccatttcatattattcagtaccactcgatgcaacttgatgagaatgtaagctatatagaacaaccagtgcctatagtggacaaacgcgtgaagcgtttatgttctaaggatgttgtgtaa

SEQ ID NO: 54474 - DNA, 1545 bp, Glycine max
  Peptide Sequence Number=SeqID_171252
atgaaggaagggtcatggatgaggctgcaggaaccatcacttgttacacctgggacttgtactgtgttgtttccattgttgggaaaaggagggatgggtgatgaggtgatggagttgttcagaaacttgccatctaccaaggagttcagagatgttcatgtttataatgccacaatttcaggtcttctgtcttgtggcagatggaaaatacctgttgggcttgcttggtcttatgtttgtcggtatgaagatgcttggaaggtgtatgagtcaatggaaacagagaatattcatcctgatcatatgacatgttctattatggttaccattatgagagaacttggccatagtgcaaaagatgcatggcaattttttgagaaaatgaacagaaaaggggtcagatggagtgaagaagtcctagttgcattaataaagtcattttgtgttgagggtctgaggaggcaagctctcatcatccaatccaagatggagaaaacaggggtttcttcaaatgcaattgtgttcaacactctgatggatgcattttgtaaatccaaccacatagaagcagccgaaggcctttttgttgagatgaaagctaaatgtattaaacctactgcagctacctacaacatcctaatgcatgcatacagtagaagaatgcaacctaagattgtagaaaagttactggaagaaatgcaggatgttggcttgaagccaaatgccacatcatatacttgtctaatcagtgcatatggtaagcaaaagaatatgactgacatggctgcagcagatgcattcttgaagatgaagaaagttggtataaaacccacattacattcttatacagcactgatccatgcatattcggttagtggcttgcacgagaaagcttatacagcatttgaaaacatgcaaagcgaaggtattaaaccttccatagaaacctacactactttactagatgtgtttaggcgtgcaggtgatgcccaaacattaatgaaaatatggaagttgatgatgagtgagaaagttgaaggaacaggggttacattcaacattcttgttgatggttttgctaaacaaggtctctacatggaagcaagagaagtaatatctgaatttggaaaagttggattgcaaccaacagtggtgacttacaatatgccgatcaatgcatatgcacgaggagggcaaccctcgaagctgccacaactaatgaaagagatggcagttcttaaattaaaaccagattctataacttattcaactatgatatttgcctttgtccgagttcgagattttaggcgggcatttctttatcacaagcagatgattaagagtgggcagatgatggatggcagttcataccagacgcatcaggcccttctggagaccagacctgcacggaaaaacaaggtttggagttccttgcttggtatgattaaaagtaaaatgagtgtgaaagtgaggaggcagaaagatgagttttggaagttcaagaaaagacaagtaagaaaaaatagttctgatgttagtgtatag

SEQ ID NO: 54475 - DNA, 954 bp, Glycine max
  Peptide Sequence Number=SeqID_171253
atggaacggttcttcccccacaaaactctccaagactttcaccatcaaggcttcctcttcctctgtcctcatcacaaggtactttccttttcccatcatcatcatcatcatccacctctttctttcacacttattattctttctccttattcccagatctggtgcccgctttacccatgtttggagaagggttttccaagcagtgtgactgcagattatgttccttttcaaatatgggacttattgcagggcctgtcgacgtatataaggactatgctttctacccaggctctcctgagtgctattggggttggggagaaatcagctacagttattggtgccacttttcagggatcaaatcttgatagcaatgcaaaaatgtggcgattggttgcagatcttatgaatgacctaggaatgctaatggacctcatttctccattgtttccatcagcttttgtatttgttgtttgcttaggaagcatatcaagatctttcactggtgttgcaagtggtgccactagagcagctttgactcagcattttgctcttcaggataatgctgcagatatatctgcaaaggaaggaagtcaagaaactgtggccacaatgattggcatggcactgggaatgcttgttgctcgccttaccattgggcacccactagccatttggttttcttttttatctttgaccgtgtttcatatgtatgcaaactaccgagctgttcggtgccttgcattgaactcattaaaccctgaaaggagctctattcttttgcagcatttcatggagactggccaagttctctcccctaaacaggtctcttctcaggagcatgttttacccatacagttcatttcatggagctcaaagaaagctaattgtctgcataagaaagtatgtttaggcatgaggatttcttcattcgataacatggaaatatttgcctga

SEQ ID NO: 54476 - DNA, 564 bp, Glycine max
  Peptide Sequence Number=SeqID_171254
atggaggatggttcacacatctatctattactctatgtggatgacatgctcatagcatctcaaaatttgttgacaattcaaaagctaaagtcattactcaatagtgaatttgagatgaaagagatgggagttgctaaaaagtttttgggcatggagatcaagagagttcgagaagctatttttgtgtcaaaaggaatacattcagaaagtgctaaatcgttttgggatggcatccgcaaaactaatgtggatgcaacaagatttgtgattgggtatacgtttatgattgacaactctcttgtcagttggaaggcaacacttcatcccacagtaactttatcctctacagaggtagaatacatggttataacagaagcaacaaaggaaaggatttggctgaagggtctagttagcaatcttgggtttccacaggaaaagactatcattttatatgacaatctgagtgtaatctacttagtcatggatcaagtctatcatgagaagactaagcacattgacattagataccacttcattcgttctaagaagagagttgaagtctag

SEQ ID NO: 54477 - DNA, 606 bp, Glycine max
  Peptide Sequence Number=SeqID_171255
atgccaatctccccctgcaaaagtatcggttggtctgtgtcgtcccgacatggggatcgcacccacaagacacccagtggacccgaaaaagtcgaacagggccctggggtttccagctctggttacgggcctctatcagtcctacagggtgcccgtaccccccggcaaggtcacgtcatcatagttggccattgttttgcctccggatacgcattgcttgaccacaacaacgccataggcggttgtcataccctaatttcgtccggggacttttgctcgatgacgtgcgaccattctttggtcctcgtgaggtgcttggcacccatcattaggcaatttgtgaaattccaggacatgccgaaaaaccaaaaagatattgatgcacaatcccacccaggcccatttgggccctccagaagattcctccagaaggcggttgcttctggaggaagcaaccctgctcgcctgggcgagctgggcggcaaccacctcccctattttgctataaataggggaggaagtgaagaagaaaggggtccagcccctgaggcacttttctctctttcgaatttgcttggaaaaatcgtttccgtgaagaaaatctaa

SEQ ID NO: 54478 - DNA, 453 bp, Glycine max
  Peptide Sequence Number=SeqID_171256
atgactaggtctaagttacttaatcagattaggtgtggttcatttgttaataaccatcagttaaaatttgcggggcaatcagctagggttaggaggaatattactttccctcgaacaacagcagttgatgttgcatcgttgactagcttacagggaggcaaatcaagattctcagggcttgcactggtcacagccaagagcggtgatgttgataccctatctgtagaggcaacttatattcttcatatttgcagctattcaaatgcgagcggtgagcaacgagaatgcaaactcgtttgctcggctggtttagccgccggcgtttcagcaagtcagccgagctttacatggtccgtaagcagtaccggcgtgcttctggctacttcagttggatctatgagcgcaatcttcaccttctatatccaaataattgggaatatattgcctttttaa

SEQ ID NO: 54479 - DNA, 726 bp, Glycine max
  Peptide Sequence Number=SeqID_171257
atggaaaccgggtcgagttcggagttcttagataggggaaaggctatgagggatggcactggcaagagacatgatgttagtgatgcaaaagttgagccctttgtgccaagaagtgatcacaatcctaaagagttgaagtcatgggcaaagagaactgggtttgtgtctgattactctggggaagctgggactagtgctaatgagaattttgatagtgttgggtttgatgtgaagagtgttgatgatcagagagaaggagggtcctctcccacgatagagattgatccggtgctggggttggcaaggcctaatcgggacaatgagattgagccggtttttgtgtccaagcatcgagtcataaggggtgagaatgatagagttttgaggtcaaaggatgtgtggaatggagcagtggggagccaaaaccagagaaggaaaattggggatgagcctggtttggctttggctggtgatggtgacaagaaagttgggttaagagggaatggtgatgctaatggaatgacggtgagcacgaatcatgatagtaatagccatggagtttctgcggttgctcctttgccagagcagaagaaggaagaggaaggggtagctgaaggagatgttaaggtgaatctgtttccggagggggaggaatcttctggaagagagtggcagggatcatctggattgaagtacagtatcacagaaaatccgggtcttggttag

SEQ ID NO: 54480 - DNA, 189 bp, Glycine max
  Peptide Sequence Number=SeqID_171258
atgttgaaggtgtttggatgtccgacatattatcatgcaagtgaaatttatggcaaaccgaaaaaattactagctgagttgcggacaatgtcgctttcttcaagacgttttgtggcactgcaaaaaattgtgcaagcaaactatcaaccacgaagtcctcaggataaaacagtccagatcactgtataa

SEQ ID NO: 54481 - DNA, 1869 bp, Glycine max
  Peptide Sequence Number=SeqID_171259
atggaggatgataatgggttcaagattgccagcatgagagataagataaattgtatagattggctagagagaatgttctttgataaaaccattgacacccaacatagaagttcttgcgcaccatcatcatcttcaacaaatttcgagccgtatcttaaccaaaacgaatggaaatttagtttccaagaaattgaaaattatgcgcaggagttaatgtctttaaatttggaggaaggaagttctggccaagacaaccatgtttcccactttaacccagttgagccatatgtcaaagaacgtaacagttcgaataacatgagtgccgcagaaaatattgacatactcaaagataaagtgaatgaagcttacagaaccatccaattaaaaaggaaagaagacgaggccaattgggagagacatgaaaaagctgaatgggctatttatttgtgtaaccgtcgggaagaagaacttgaatatctaataaaggaagaagtgacaagaaaggaagaactgaggaaggatctggatgcagaaaaagaacaatttcacaaaattaaaatggatattgaggatagcaagaaaaagcttagtttagtggcagagcaacaatcagagctcctaaacaggcttcatatttacacattggcagtgccacaagctgaaaccaaactagggaaggcattggctgaaaagacagagatgcttatggagatggatggtctaaggaaacaaaggaatgcaatgaatagaagcattgaattttttcagagaaaaagatgccacaagaatgagtgtaggctgatagaaaagggttgtggtttgagggagtacacaaaggaggagatcaccttagccacccaaaacttttcagagcaaatgaggttgaaatcggatgggaattggaccaatgtgtacagaggacaaattaatcattccactgttgcaatcaagatgctcaatcatgttcctgacttgtcccaactagatttccaagccaaggtgaggaatcttggtaaaattcggcaacctcatctggttgctatgttgggcttttgctctgagcccaaatgcttagtattggaatacatgaacaatggcagcttggaagaaatgctattttgcaagagcaaaaaccgggtcttaagttggcgtgattgcataaggatagccatagaagtttgctcagggttgggctttctaaatgcagctcagcccaagcccattgttcattgtcatccttctccatccaaaatcctcctagattgcaatcttgttgcaaaaataacaggttttgggcttcatgggtgcagtgaagagtgtaatgataattcatcagatatgaaggcaataggggttttattgcaaaatctattgaatggaagaagaaatttggtgacaatggatacagaggcttgttttgatgagattggtgagcaatggccatttgatgtggcaagagatgttatgggcttagctatgcggtgcatgtccatgaattgtgagcccaatggagaaatgagcataacaagagtcgtggaggagctcaatgagatcagaaaaaagggtgatgacatggttgctagggaaggatggaggaatataaatgggggaaacgtacatggacaagattctacccatgtgcctagtgttttcatttgccctatccttcagagaataatgaaaaatccacatatagcagcagatggattttcttatgagctagaagcaatagaagagtggttgcaatcggggcatgacatatcacccaaaaacctgaagctgaagcacaaattacttacccctaatcataccctccgttccctaattgaggactggcaaggcaagagatcagctaaagttgcaaattaa

SEQ ID NO: 54482 - DNA, 1263 bp, Glycine max
  Peptide Sequence Number=SeqID_171260
atgggtggaacagataacgatactgctaatgtaatttcgacaatgctgtttctttctggcatcacaacgatactgcattcctactttggcacccgactacctttagttcaagggagctcatttgtgtatttggcaccggcattggttatcataaatgctgaagaatttcgaaatcttacacatcacaaatttaggcacataatgagggaactccagggagctataattgttggctcaatattccaatgtatcctgggacttagtggtttgatgtctcttcttctcaggataatcaacccaattgtggtggctccaactgttgctgctgtaggtttagcattcttcagctacggctttccacaagctggaacatgcatagaaattagcattccgcagatagcattagttctattattcacactggttcccttgagtgttacattaacttggatatatgcgtcctttttaacagctgggggagcttataactacaaaggatgcaatcccaatatcccaagttcaaacattttgactgatgcatgcagaaagcatgcttataccatgaaacattgcaggactgatatatccaacgcactgttaacttctgcatggctcagaattccttaccctttacagtggggttttcctattttccattttaggacttgcataatcatgaccgtagtgtcgctggttgcctctgtggattcagttggaacttatcattctgcatcactgcaagtcaatttgaggcctccaactccaggagttgtgagccgaggaattgcattggagggtttctgtagtatattggctggtctttggggttccggaactggatcaaccaccttgacagaaaatgttcacacaattgacacaacaaaggtggcaagtcggagggtggtggaacttggagcagctttcatgattctcttctcctttatgggaaaagtgggtgctcttattgcttccattccacagggcttggctgcttctgtactgtgtttcatttgggctcttatagcagctttgggcctttcaaacttacagtatggtcaatgtaccagcttcaggaacatgacaatagttggtgtttcgtttttccttggtctatcaatccctgcctattttcaacaatacaagcctcaaaccagtctgatactgcctgcttacctggtaccttatggggctgcatctagtggaccattccattctggcaataaacaaatgtgtagacatggatatcctaacgtggatgaatga

SEQ ID NO: 54483 - DNA, 165 bp, Glycine max
  Peptide Sequence Number=SeqID_171261
atgaaggatgacgccgacgaggagaggcagttcttgggtggcgagtggtggattgtgatcagagaatgggccggtacacatgtccatgaagcctctgaaagacatgggtcgcctcctagccatctactcccatatacgtcgaatacaagatcatcaaagacatga

SEQ ID NO: 54484 - DNA, 201 bp, Glycine max
  Peptide Sequence Number=SeqID_171262
atgcatatggcttctaggaaaaggaaagccacaacttccaggcctcaacctcactatgatactcacatattcacctctgaggatgcttggaaccgctacgatgacaacgttcttggccggaacatccttccggaaaggaacgtgaagctttttgtcacagagtttgatgagttcaggatagagctaatcagaagaaactaa

SEQ ID NO: 54485 - DNA, 99 bp, Glycine max
  Peptide Sequence Number=SeqID_171263
gcgtgcttagcacgagtaagtgaagattggcttagcaccattctcgtcctaagcgcagaagagacaatcttctcactgaacgagctgatgacgcgttga

SEQ ID NO: 54486 - DNA, 327 bp, Glycine max
  Peptide Sequence Number=SeqID_171264
atggcatgtccaatagattttgggttgaccaatgggttcccaatcatggtgactagagtctcagatgcaactgattctcttttcaagtgcatttgggatgggcttccaacaaattgtagtagacacacgagaggcttgacaatgtcctacttatgcccttcctgcaacaataatccagaatccatcactcatagcctttgtgattgtcacattgtggggcaagtctggaatatcattacagtctcaatggataggcaagcaatagtgggtggagtggtcaatgtagaagcaaggcttcatggtgaatgtgattcaaaggtgttttga

SEQ ID NO: 54487 - DNA, 291 bp, Glycine max
  Peptide Sequence Number=SeqID_171265
atgtctaaacttagaccaattaaagcactaatgaaacccattatactttcttatgtaaacattcattcagcgtttgaggaaaacctacagtgtttgaagagttacttgtacgacgacctaacatgcactttcgattggaaaaagggtttaagggagaaagtggttcaccatcgatgggaaaaggggtttcaaggagaaattatgtggttcactatggatgggaaaatgggtttcagggagagagtatatacgtatagcattgcgggtttggagtcagggacaagagactaa

SEQ ID NO: 54488 - DNA, 219 bp, Glycine max
  Peptide Sequence Number=SeqID_171266
atggtccacgggaggctattggagattataatgttgtgcttcataagcatgaacaaagaagaaatcacactagatcctttcttggaagcatggaagcctttcaaatggagacttaaatctagggaagcttctattttccttctctctaaatgcaagtcaaattataatcccgtgttagtgcattttaagaggatccttagggcgaacaaaagaaggtga

SEQ ID NO: 54489 - DNA, 192 bp, Glycine max
  Peptide Sequence Number=SeqID_171267
gaatgtctataccacaacaagaagaaaaagctatggttcttgaacaatggttgctctaagcatatgactagagataaaagaaaattccttagccttgaaaagagaaatgatggagggtatgttgcctttggagataatagaaaagtcttcatcaaaggagttgataaaattggtaaaccaaactctgcttag

SEQ ID NO: 54490 - DNA, 753 bp, Glycine max
  Peptide Sequence Number=SeqID_171268
gaagttgagaggaggaattggcataaggagctcactaacttcttagagggaagcattgatgttgctattgttaaagaattttatgctaacctctatgaccctgaagacaaattgcttaagcaggtgagggtgcgagggcacctaattaaatttgatgctgacgccctcaacaccttcttgaagacaccagtggtcatagaggaaggggagagcttgccttcctactccgggtttgctaatctgaggcctgttcctcaagagcttgcagcccgtctatgtctccctgggagaggatttgagttgaatgcagacggcctgcctctaaagatcttgaggaagaatctgattactttagcccagacctggagtgttctatccatttcaaacttagccccgacatcccacacttctgaaattattttggatagggctaagttgatatacgagctcgtcatgaagatggatatgaacttggggtccctcttctcagctccttctacatcaactctttctacctctcctctccctccagcaccagcagctccagttctttcggatccttcttctcagagctccgagccttccttgtctatgctgcagagcctgcatcagggccagctcctgatcatgcagagtttgcaggatgtggtccaccaatggccggttatgagcgttgaagaatttcttcagcaggtgccctggccaagagtccagccttctcctttgggagggggtgaggcctccgtagcctag

SEQ ID NO: 54491 - DNA, 309 bp, Glycine max
  Peptide Sequence Number=SeqID_171269
atgctggcaaaggagaatgatgaactcaagatgaaacttaaagccttgattgaggataatagtaaactaattgaattgtatgaacaagctgctactgagaacaataatagaaatgttaataaaggggaggatggtcaagaaattggttccaagattgacaatggggagttcatgtccacctcaaatgcaataaacaatgaaactataactgatagaacgaacgcaggcagaaggtaccttagattgaacaacacacgatgctggcctctgtgttctgctggcaggaatgacgacctgcgattaaattag

SEQ ID NO: 54492 - DNA, 205 bp, Glycine max
  Peptide Sequence Number=SeqID_171270
gcaaaaaggagctattttgaagaagtgccaaaggagtgatcgtgctaagcgagctcaatgcgctcagcgcgtatcaatggctaagcccaacactagcatgcttatcgagcttagcgcgagattggcgcaaagctcaaattcacttactcgcattaagcgcgagagtggtgctaagcgtgatgtcgagatcaggaagcccttttaa

SEQ ID NO: 54493 - DNA, 918 bp, Glycine max
  Peptide Sequence Number=SeqID_171271
atgcttccatttgatttccggtgtgtcacggaaacttacggattgtgcatcaatattttttggttttctggcatgtcctggaatttcacaaattgcctaatgatgggtgccaagcacctcacaaggaccaaagaaaggtcgcatgtcatcaagcaaaggtccccggacgaaattagaaaagaagtatcccgtttgcgtggtctagttggtggaggagaaattcaggataatgacattttagttgtcagcttcccaggttctcctggatccttcaagtgggagggtgtgcaaggatcattcactccattaacctctgttaaaaggatatctcagaaaaaagactatgacattgcccttgttggggcctttagaagggaaaaggacaaagagatggaattacaggcactaagagatgaaattcaagcgtccatgaagctggtgagacaaagagaagatgagatacaaagtttgaagatgagactacgttttcgagaagctggaataaaaagattagaaacagttgcttctgagaagatctcagctgagacacacttgctaaaagaaaaagaggagcactcgaaggaaattgaggtcttgcgggcccaggtggatcggaataatgaagcaactagatttgctatggaaaatttgcagctaaaagaagaaattagaaggcatgttttattgatacagctaaaatacttttttgttgctttttttttattcatgtgcatgcaaaagttaaagtcattttgtatggaaggtgaacgagaacggatgagtgaacaaatcatggtattggaaaacaagttgttggaagcactagattggaaatttatgcatgaaacagatctgaaaaaaaattctgatttgatgatcgaagatgtacataatgatggtaatctcatctccaaacag

SEQ ID NO: 54494 - DNA, 351 bp, Glycine max
  Peptide Sequence Number=SeqID_171272
atgggtccaaaccaatgggtcaacctgatccaccacgggtgtgagcaagcgtgcttcgtcgcctcgacttctgtgactggttactctctctctctttcttctcacactcagacactccttcactcttcatacaatttcaaaatccctaatccatcctttacgctgcattattctcaaatgtgtgtgtttggcattctgcatttggctgtgttgaggcgtttggtttcctcagatgcctcatgtgagatgaggaagaaaaccatggatccctcctctgagaagaagttccgcggcgtccgacagcgactgtgggggaaatgggtggcggaggttcggaatctggcaagatga

SEQ ID NO: 54495 - DNA, 393 bp, Glycine max
  Peptide Sequence Number=SeqID_171273
atggcaattaggttggcccgttggtggctatcctggtcctcagggtccttatttcaggatcttgtgaccgaaagtgatcaattcagtattgaagaattcataccactgctgagggagcgcatgaatgtgttgaatccatatgttcgtcagtttttggtaggatggattactgtattggatagtgtcccatatattgatatgctggggtttcttcctgattttcttgatgtgctactcttgaagtctgtagattatggtcgcatggctgaaatcctggtacagagggcaggttctctagatgaattcactaggctaacaactatcacatggataaatgagtttgtcaagcttggtggagactgtgacaccctctacccctcacatatatactaa

SEQ ID NO: 54496 - DNA, 360 bp, Glycine max
  Peptide Sequence Number=SeqID_171274
atgaagaacactacactatgctaccctagttttacaatagacattaagcattcaaagaactgcaaagtcagcacgacttacctcaatcaaaatgagagcctgtcaccacgagtttcccaatccttgcagcagaaaccaaaaaaggtccttgggttaaccacgagttccccaaacagacctaggtattcaatagaacaacagagcttagacgaaacgtacctaggtaaggtggcgatggacaagaaaaagagagttgtcacggtcttcagtgcgatggagaagaacaagattagacgcagaacaagacaagttagacggagaagaagagagcacgagcaaaatacatcgcgcctgatataa

SEQ ID NO: 54497 - DNA, 189 bp, Glycine max
  Peptide Sequence Number=SeqID_171275
atgaggcaagacatgcttcaagcctttatgggtggttggcaatttcttttcgccctttcttctattctgagcacacttcacagggaagacagtggtattccaccttcaatctctcatctcaaagttgtagcttcaagtgagtatgtgggtgaagctctgtcccactcttccctatggttggatgcgtga

SEQ ID NO: 54498 - DNA, 556 bp, Glycine max
  Peptide Sequence Number=SeqID_171276
atgaaaatagctttggatgctgcaaaaggtctacagtatttgcatgacaaggcgaatcctccagtcatctaccacgacttaaaatcgtccaacatcttggtggacaaagagttcaatgcaaaactctctgatttaggactagcaaagttgggaccaacaggagacaagtctcatgtctcttcaagagtaatgggtacttatggatattgtgcacctgagtatcaaagaactggtcagctaactgcaaaatcagatgtgtacagctttggtgttgttttgcttgaattgatcactggaaggagagccattgataacacaagaccaacaagggagcaaaatctagttacttgggtgagtttctctattcatgttctgtgttataaatggagcaatttgaagtgtttgataattttgttgaaggtggcagtagcagccatgtgcctcaatgaggagccatcagtgaggcccttgatcagtgatgttgtcactgctcttacattccttgaaacagctccagggagacaacatatcacaggaattgcacctgcttaccatg

SEQ ID NO: 54499 - DNA, 207 bp, Glycine max
  Peptide Sequence Number=SeqID_171277
atggatatgtcaggtcattctcaccagtcagggtcacgctgttttgcgagaatgttccaatcatgtgagatcagcacaggcttaaaggagcactcaaaccgagtgaccctcaagacctatactccgaagagtccgtcagggtctctccttcctgattcaggtccaatccctaaaataattttttttgcacgcagacactgttcataa

SEQ ID NO: 54500 - DNA, 240 bp, Glycine max
  Peptide Sequence Number=SeqID_171278
atggcttcagaatcatcggctgactcaacgaagacaagtaccagttctgattcatcatcagctacaagcaagattcaatatccagttcacacaaaaccattaatcctacaattcactgtagtattccgcaaggatatggacatgatagaagtgccctctttttaccaccaacaatgggcaccagaataccctgagtttgtgaatttagatatgatggaacaatataccaaatcaggctaa

SEQ ID NO: 54501 - DNA, 285 bp, Glycine max
  Peptide Sequence Number=SeqID_171279
atggagatgcagcggaagacaaaggagaagagattcgacctatgcaattatttctggctgctgtatgatggttcattggtgttgttttcacattgtacgttattatctctacatgttctgcaatctgtgtcagtgacaacagacgatggcgcacttctaagggttccgttgccacccacaaagcgtctatcatctggtgaattgggtgatgaagcaatgagttgtgacatttcacccgtgcaagtttcctttagcaaactatcaagcccttctgcaactgaatga

SEQ ID NO: 54502 - DNA, 585 bp, Glycine max
  Peptide Sequence Number=SeqID_171280
atggggttgtacattctatgtcatcattctacatgcctagtggccttggggaaagtttacgatggggcatcgagcatacacaacgtgccttatttagatgatgtggtcaaggtaagtgttgaaaaagtttacaatggtaacgctcatgatgtttaccagaagccgcttgagttgttgtgggattccgagtgtcataaatggttgaacatatctatactacaattatggatgatgtttatggatgaatggagtacaaggttgggtcatggttcggtgtatggattccttgagcctcaatctatacacaattcaaaggatagacatgttgaatgtcaacaatacattgaaacatgggtgaaggaatcacaaaaagaggtctacctaggagtttacttgaattgtgcaatgaagacattgaagcctagtttagatggtaaatctaatcaagttgtacctaattggactgaagaaaagtgctttggtgatggaacaccgttagacatcgaaaccataataacaatttgcaagaaatgggcaacatattttttacaagttaaaacaatcaaattacaaaggtttagatga

SEQ ID NO: 54503 - DNA, 360 bp, Glycine max
  Peptide Sequence Number=SeqID_171281
atgtttgaattagttaattggaccttggctggaggaagtgttgcaaacataattcgaggattgagtaatgggtttggaatttctagtggaatcattgggggcgtgtgggggatgatgagcaagtgtgtttgtttggttgatgacttcggaaaccataccatgcgaccctgtctctctaatggtgtgaaagttcaggaagaggaattgaccaaagaggattttaaaggctccaagtggttggtgttaagatatgcaatacttaatttggaagttattcaagcagcaattcttttagcaaaacaggaaggtcttcttgtttccttggacttggccagctttgaggggaaccataagggatga

SEQ ID NO: 54504 - DNA, 1095 bp, Glycine max
  Peptide Sequence Number=SeqID_171282
atgacggacaataagagttctttccattcgtctcttgcggtttccaatataaggaaccatatctccatcactcttgaaatggataatagtgatcatcaaccttcgttttatcaggctcgatcgatgctcacacttgaggaagccggattggcaatgttggctgcctcacaatccatttatgactcaaatttctctcattcaaaccaacaacaacttcgagacagtctcagtgttcgtattcgtcgacctctcgctttgactgcggagaatgaggctcaacgtgcttatcctcggattttcggccgtgaagcttccgggattgtggaaagtgtgagagaaggtgcaaatgacatgaaagaagggaatttggtggtgccaattttcaatggggaatgcggggattgcaaatattgcaagtgcgagaagaccaacatgtgtgagagatttggggtggatcctatgaggaagcatgcgttgtcaagattcgcgttgatggcgatggtgacctcaatccctacattaaaagacttaccttactcagttgtggcgtatctacggcattttgccagaggatctccagacgacggtgaaaatgtgcatcgacggcctccagtcgcatcggtggcggtgaagcacttcgcggcagcgaaactctggctactagccaaaaaccgcgccgacaatcgcgttctgattgtgaatgactcgtggacgcaggaacacgctgtcaccgcactgttaaacctctctctccacgaggacaacaaaatgtcgataaccaatgctggagcagttaagtctctaatttatgttctaaaaactggaactgaaactttgaagcagaacgcggcgtgtgcactcttaagccttgcattggtggaagagaacaagggctcgatcggggctttcgatgcaataccgccgctggtttcttttcttttgaacggtttgagcagaggggagaaggacgtgctgacgacgctttataagctagaaggccatggtggtgctgaacagcctggtggggatttaggaagggaaggccatggaatgaatctcgcggctgagagatccgaccgagagagagatccgtag

SEQ ID NO: 54505 - DNA, 633 bp, Glycine max
  Peptide Sequence Number=SeqID_171283
atgacttcacattcatcatcggctacaagcaaggaccgatcaaactggttggcgacgatacggttttcagtcgtattccgtgtttccaagatatggcagccgatactttttttttctgatggcctaaaagagtttagaagaactcacgacattggcgacaatgtcatcatgcggttttttggtggtgacaaaaatattgcctttgaggtggatgtcattggacctatccttgggcagcaccgtccaaggtcggttctggcaaccaggaggcacatctttacagccaatccacccaattatgttcatacttgtcataccctaatttcgtccggggaccatccgtttgttgggatgcaaccctcgtttgaccacttcgaggtacttggcacccatcgttacgcaatccgtccacttgagccttccaagaagttccccctgaaggcggtaccttctggaggaagcaacctagctcgcctgagcgagctgggtggcaagcttctccctcttttttctataaatagggggaggagtgcagaacaaaaatgttcaacacttctggtatatgagaatcccttaaaattagtgagaagaattgtttctgtgaagaaaattcaagccgaggcgcttccgtaa

SEQ ID NO: 54506 - DNA, 312 bp, Glycine max
  Peptide Sequence Number=SeqID_171284
atggcaggtccagaggttgctattaggagcttgaattcaaatgataccaggggaaagaccattacttgcaaagctaccgtggcatatggtcctcgaggaccctttgtggtggaacgtgttcttgtccatcctcctcagaaaatggagcgccgttcagcccctttctttttcttctccatcaccatgtctcactcaaactctatcttttacactgctcttgctgtctccaacatcaagaatcatgtcccaatcattcttgagatggaaaatgtccaatacgtgacatgggctgaacttttcaaaccccgatga

SEQ ID NO: 54507 - DNA, 660 bp, Glycine max
  Peptide Sequence Number=SeqID_171285
atggtacatgatgacaatggaacagttccccatgcaaacactccgaatgatgaaatcaaatacatttctccatgtgaatctacttggaggatctttggttttccaatacatggtagaaaaccttctgtagagaggctacagttccatcttccaggccaacatagcgttctctaccaagaccatgatgatattaatgatctcctctctaacccaggcatttctgaatcaaaatttatagcttggatgaatacaaaccaggtttttgttgaaggtcaaagcctgacttattctgaatttgtaactaagttcgtgtataaccagaaacagagatgttggcaacttaggaaaaagggttatactactggcagacttcaatgggttcctccaactacaggggaattattttatttgaggatgatgctgactgtctgtagaggaccaatctcatttgaaaatatcagaacagttgatggtgttgaatattctacatatagagaagcatgttttgctatgggtttttcacaggatgatagagaattcattgttgcaatccaggaagcaaaagactggggctcagcaccttatctaaggaatctttttgtattattacttttgacaggtaccatgaacaaacctgaacaagtgtgggaaaaaacttga

SEQ ID NO: 54508 - DNA, 801 bp, Glycine max
  Peptide Sequence Number=SeqID_171286
atgccggagcatcacacacgccaagtgaccactgacaagctggaagaggcggataaaactctctcccaggataactccactctgaacaacaaaattgataccattcacgcatctctcatcgccaagattgaagctctttttgatcgcttcgccgccatagccgtcaattcccctccgccaccgcctccgatgccatcacactcttcatcttcttcccaccgccatcacatgaaattggaagtgccgcgctttgacggtcacgatcccctcggggaattcctgagaatgagaggctcacagtcgcctccttctacatggaaggccccgcgctatcctggtatcaatggatgtgccgcaacggcttcttcccgtcctgaccggcgatgctgcaggccctggaatcgcgttttgccccttccttctacgacgacccccagggcgcactgttcaaacttcagcaaaccgacacgctgtttcatctccggcttgattccggaactccgccgggaggtacaagcgctgcgtccgttatcccttccccacgccacggaactcgcgcgtctacaagaggataagctcttagaccgccgccgcggccaacgctcatcctccacccccttccccctaaaccagtgcctcctcagccctcaagctccaccagagtcccaatcaagcgtcttacctctgagggactcgcggtccgccgtgaacaagggctttgttaccactacgacgacttcgacactcctgcggatagcaaccctagcgaaacctcgcattccctcgtcgcagacttcgtga

SEQ ID NO: 54509 - DNA, 3156 bp, Glycine max
  Peptide Sequence Number=SeqID_171287
atggtgggtaacaggaatactctagaatgcgacactcagtcccttcagtggcttaagctactaggcccaattaccactgactaccagcacctcaccatgaccttttctcatttgggccgtaacatcaccctccgtgttgacgcacccccctcgttatcccctgcgtcagcccaccaactaaaacggctagcccagactcaaagcatatctgctctttaccacatcaccgcgttaccgttagacccttcttcctccccaggcaccgccacgacacccacccctgagcccataccccctcaaatcgcatccatcctcgaacgatttctcgccatcttcgcagagccctcatctttaccacctccccgtaatattcaacatcacatacatctcttccctcacaccgcgcctatcaacgtacggccctatcgttacccccattttcagaaatctgaaattgagaagcaaatctcagcaatgcttgccacaggggtgatccaacccagccacagtcccttttcttcacccatcctactcgtgaagaagaaggacgacacatggagatgctgtgtcgattaccgggctctaaacgcggtgatcgtcaaagacaaatttcccatgccaactatagacgaattactggatgatctgggcagagcttcgtggttttcgaagttggatttacgccaaggcttccaccagataagaatggccgaggaagacacgcacaaaacggcgtttcgaacccaccagggccattacgaatttctcgtgatgtcgttcggcctgtgtaaggcgccttccacgttccaagcggccatgaatgatgcccttcagcctttcctccaccgcttcatcgccgtgttcttcgacgatatattggtgtacagcccagacttaccttcccacgtgtcccacttggaagccgtcttatccaccctcgcagaacgcgaattcttgttgaagcattccaagtgctccttcgcacaacgcaagctcagctacctggggcacataatttcctctcagggtgtggctccagaccccgacaagattgtggcaatgctcgaatggcctccaccgacgtgtcccacctcccttcgcgggttcctgggattaacgggtttctaccgtaaattcgtcaagggctacgccgcaattgcagcacccctcaactcccttcttcgcaaggacaaattcgagtggtccccagacgcgcaccaagctttccggcagctgcaacaggctatgaccgaagcgctcgtgttggccaatcccaacttcctcatacccttcacacttgagacggatgcctcaggcacagccatgggtgcggtccttctacaggaaggtcacccaatagcatactacaacaaggccctctgccccaggctacaacgtgcctccgcctacgtccgggagctacacgccattacctctgcggtgcgcaagtggcgtcattacttgttgggaactttgttcataatcctaacggatcacaagagtttgaaagaccttatgtctcagacaatccagacaccggagcagcagacatacttgtttaaacttctgggttttggttacaccatcaactacaaaccaggcgccaccaatgtcgtcgccgatgtgctctcatgcattagtccggctgaggccacgtgccttactctgaccgtccctcactttctcttcttacaaaacttgcgtcaggttctgttactggagccccaatacgtggctctcctccaagacattcgcaatcatcccacggctcaccccgacatcaccacgcatcaagacctctttttcctgcacggccgtatttggatccccttcgcaaccccattcactcgggttttattagaggaattccactcttcgcctctcggtggtcatatcggagtcaagaagaccctccatcgactccgtcagaattttgattggccccaccttaaggaggacgtccgccgttatgtggcccaatgcgccacgtgtcagcagacgaagaagagtgcagggcttcttcaacctcttccaatccctgctcacgtctgggaagacttatcgttggacttcgtgacggggttgccactatctcaggggtacactgtgatcttggtcgtggttgaccttttctcgaaagcagcccatttcggtgctctacccacccatcacaccgcctacaaggtggcgattctattcctggacatgatcctatcttcgtcagcaatttctggcgcgagcttttcccggttgagtgacaccaagctccgtatgagcactgcctatcacctgcagacggacgggcagacggaggtgctcaatcgcacccttgagcagtacctccgtgcttacgttcatgaccacccatcacgatggtatcgtttcctctcactcgccgaatggtcctacaatacaaccttgcattccggcaccaggatgaccccattcgaggcagtctacgggaaacccccacctacggtggcccactatctccaaggtcaatcctcgaatgatgccgttgactcgctactcaccacgcgtctgcaagtacacgcccaattgacgcgccgccttcaacgagcgcaggaactcatgaaggttgctgccgataaacaccgccgcgatatatcttttgaggtgggtgtctgggtacacgtccgcctccgaccataccggcagacgtcgctggccccgacatattccaagctagccaagcggttttatggaccctttcagataacggcgcgcattggcccagtggcctataaactcatgttaccagcctcctcgcacgtccaccccattttccacgtgtctctcttgaagcttcaccaaggttctcccccggtttcaccggcaacgctccctgagcactccaccgataaccatcccattattcatcctttcgcaatcttggattggaaactggattcctcgtccaccccgccggtgaagcgtgtgctggtccagtgggatggtttacctccggaggaggcatcttgggaatcctgggatgagctacgcgttatccacaaccttgcggacaaggtcgttttcgacgaagggggtgttgatagtaacacagcaacagatcaacatcaacacattgatacaagcaggcccaagagagagtgtaagaaaccagcttacctgtag

SEQ ID NO: 54510 - DNA, 150 bp, Glycine max
  Peptide Sequence Number=SeqID_171288
atggtgaaaatgtggtttgggaggtggggcaaggaggtggaagcaacagtggaatcggtcatgatggtggaagtgattggtgatggcaatggtagcccttacaatggggttggaaactgtaatgtaaaggtagaggttaggagtcgttaa

SEQ ID NO: 54511 - DNA, 180 bp, Glycine max
  Peptide Sequence Number=SeqID_171289
atggatgttgcctctccaaatggtatctctagtgttgcgtggatgcagtcagcaatagttgttcaaagaaatcaaccattgacatggcacaagacttattttgatgctcccgaaggagatgaaccattggcattggatatggagggtatgggaaaaggtcaaatatggatcaatggatag

SEQ ID NO: 54512 - DNA, 501 bp, Glycine max
  Peptide Sequence Number=SeqID_171290
aagaagaagaagaagaaaggcaaaggtggcaagaagagtaaagttaatcctaaggacatctacaattactgcaaagaaccgggtcattggaattgttttaatcatatgcgtccacacaaacattggtttgtgacatatgagaagaagtatggtggtaatgccctcatgggtaacgatgctcctgagcttaagaaaaatcatgtatatgtgagtctcatagatttgaaaggtttttcttgtttggttgaaggctctgtctctgttgtttcacaatctataagcgatgcgtccaatggctcatctgataattctttgtggcatttatgtgtgagccacatgagtgaaaaaggtttagatattctgaacaagcgatgcttatttggaaatcataaggtggaatctcttcagttttgtgagcactgtctctgggaagaagcatcgaacaatgttcctaaaggctatgcacacaatgaaggccatgttggattgcatccattctaa

SEQ ID NO: 54513 - DNA, 942 bp, Glycine max
  Peptide Sequence Number=SeqID_171291
atggattctgtccccaccattgttgaggtttcaagttccaagacatgtgatttgttgaagtcaatctcagcattgaaagtagagctagtagaaaatgtggcatccaaactatttgttcaatgctttcggcagaagggacttataaagatctacaggcacttgctaaattatcgaaaaaatgtattcaatctttgtagcttgcctaatctagaaggactaacatataggcaaataagacatagatttcctgaagctgttgtatgtggtctttaccggagtgggaaaatatacttccacccaaacgatggtgaaattcggcagcaaactgacaaaataaacacttgcaatggcttctattgtcataaatttactccaaatagaccctataagcctatgatttggatagaggcttggagtggctggtttacagaatttggaggggatatatacgagcatgctattgtccttggtgtgaaaaatgaggatcaagatgcttttgaaagggatttcttccagttgaagccttattatacagatgcctgcaatcgacttccaccatctcctcaggagtacccaattctgggtctcaacctgttgagattacttgtgcagaataggattgctgaattccatactgagttggaattgctttcatctgctgctcttgagaatccttgcattaagcatgttgtggagttggaacaatcttttatggaaggggcttacaaacgtgccttgagtgcacgacagacagtgccacatgatacatacgtttattttatggatcttttggcagagactgtcagagatgaaatagctggttgcagtgagaaggcctatgactatctttcaattaaggatgctaagcaaatgttactgttctcctcagaccaggaactccttgaatatattaaagaggtgagcattgttatgaccccttaa

SEQ ID NO: 54514 - DNA, 423 bp, Glycine max
  Peptide Sequence Number=SeqID_171292
atgcatatgaaaagcgggatacattgtacatctgcacaagcttcaatgagaagtctccctatccaattgttgtgcttcaaacaggaaaaaagtttgctcttcaacaaaatagtgatgaacctgatttggcagaagcagaactggatgatagtctttgcctccgtgctttatcagctttttccaagtaatgttgatgagattggtgtttggtccctgcaaggaataagaaaccatccagagaaaaatgttgtcaatctcaatctaaaaatgaatctcaatccattgtcattgaagcatcagattctccagtcaattcatctagagtccttagggatgatgggtctcaaagtttcaacattggatccatcggacagtgttctcttccacctccatatcatgaggcaaaactttagcagattctaa

SEQ ID NO: 54515 - DNA, 162 bp, Glycine max
  Peptide Sequence Number=SeqID_171293
atgcctcacaatggaacattgtgtcccgacgtccttcagcacaaggttcctttaagcacttcacctagccatctgttcccccgaacacaaggttcacgatcatcacagaatccaaacacaaacaacaaaccaggagtgatttatcacattcctaactactag

SEQ ID NO: 54516 - DNA, 177 bp, Glycine max
  Peptide Sequence Number=SeqID_171294
atgtctacggagggagaaatatgcatcgcaggaagacagtacaaatggaggcttcaatcactcctgaatctctctaatgtttggaaaccctatcagagcaatcagagaaaaaaattgaagaatctcaggaaattgctagagatgccgctatcgctgttggaagacacggatccttag

SEQ ID NO: 54517 - DNA, 480 bp, Glycine max
  Peptide Sequence Number=SeqID_171295
atgaattttgatgctcactatatgcttactgagaggaataaggaaaacccagttgagaggtccccatctagagacgcttacaagaagcaacttgcagaatgcttgaacattaatcggtccagaatctttgccttcaagaacaagtcacttgctttggtcgacttaatccctcatcaaatctctcttccctaccaatgggacaataaactcgccaatcctcttcgatatattcctcagactcgtaagaagactttggatgcttctgatattttgaatgactattatctcaatttactggactggggaagcgacaatgttcttgcaattgcccttgaaaactcagtgtacttgtggaatgcagccaattgttctacttcagaactttttacatttgatgatgaaaatggttgtcacatctattgttgggctcttgatggatggcgttttgttgttggtttgtgtaacagccgtaacttttaa

SEQ ID NO: 54518 - DNA, 555 bp, Glycine max
  Peptide Sequence Number=SeqID_171296
atggccctgcgggttcatttctcaatagtttccatagcggttttggctctatgcacttctgcagattacttttcggctaattttagctatgctggtccaaatggacctgagtactggggaagcttgagtccatcttatgcagcatgctcacatgggaaatctcagagtcctgtggaacttatgaagactgatattgtcatcaacaagcagttgaagaatctaaacagaaactaccttcctaccaatgccacacttgttgacaacatattcaacattgggctccatctagtccacctgaccgaagataattacaacatagcagttgtggcagtgctctacaaattgggtgatccagaccctctcatatcccagtttgaagacaagttggttgatttagagaaggagattcgtgcaggcaataaggatgcccaaattgcaattggcacctttgatgtagaagagataaacagaagcagccataggtattatagatatgttggctctcttaccactccaccgtgcaaagagggtgtcacttggaacattctaggcaag

SEQ ID NO: 54519 - DNA, 996 bp, Glycine max
  Peptide Sequence Number=SeqID_171297
atgacatcaaaaagggaaagggaagcgggtgatagagtagaggatgaagggcttgataatgagtcgaaaaggcagaggctggatgaggattcttccccctctcctcctcctgtctccgttgcaaatcctctttctgggttggccaataattatgctgacattgatgaggaggaagatgatgttagaagggaaaggggttctgtaaatgagaggagcaatgatgggtcccatcataatgggcataataaatatggagaggctgatgatagtgatgaagaagatgacgattcacacgaacaatttactggaagaaatcgccaggttgaggttcggaaggactgtccttatcttgatactgttaatagacaggttttggatttcgactttgaaaaattctgttctgtctccctgtcaaatttaaatgtgtatgcatgtttggtttgcgggaagtattaccaagggagagggaagaagtctcatgcatatacacatagtctggaagcaggacaccacgtctatatcaatctccgcactgaaaaagtctactgtcttcctgatggttatgaaattaatgatccttcattagatgacattcgtcatgtcttaaatccaaggcttgagccttggcttggactctttgtggatagattcactgcaaaagaagttgaacaacttgacaaaaataagcagtggtctagggctcttgatggttctagttaccttcccggaatggtgggacttaataatatcaaggagactgattttgtgaatgtaacaattcaatccctaatgagagttacccccttgagaaatttttttcttatccctgaaaattatcaacactgcaaatctccacttgttcatcgatttggtgaactcactaggaaaatctggcatgcacggaactttaaaggacaggtcagtccacacgagtttctacaagctgtgatgaaagccagtaaaaaaaggtttcggataggtgcacaatctgacccg

SEQ ID NO: 54520 - DNA, 366 bp, Glycine max
  Peptide Sequence Number=SeqID_171298
atgggggagggatgttgtacgcagccttacccttgcatatgcaaagaggctgtttccggattcgaacccatgaccaacaggaaaaagagagagaagcctgtgctgcagaagggggttggttggactgttgtattacaccataagggtagaaagaaaactagggactctgaaagtggaatcgctgttgtgtcggttgcccaagctcctgtggaaaataaaatggccaaaaagaagcataaaggagttggactagatttttatgttcaaataaaagaagtccagagaaatggtatgaccacctttttttatgatgtttggccatctttttatcctgaaaattgtagtgttaaagcaattagtcaataa

SEQ ID NO: 54521 - DNA, 456 bp, Glycine max
  Peptide Sequence Number=SeqID_171299
atgggcctctgccagtcattcggggttcctgtcacacctagtaaggtgatccggccgccgatcacccgagccttcattgagaagtattgcatgcctaggcaggcgcagggtgatgcgccacaggccgcaggcgcactaccgccacctcatcaggctaatcccaccgggtcattaggcatggagcggtatctacagcacttggttcgccaacaggcggccaaccaccgggggcaggtacagatacatgagtgtctctaccagctcagcctcagtcaacagggccagggttttgctccttttgcatgccctactccagatcagtttagggctgaggttgcatggcccagagattggcccgaggaccagacagaggaggcacttgcaggagctcccgacgatgcagaggacgcccgcatggatgaggagatgacacccctgtcgaccataaaaagataa

SEQ ID NO: 54522 - DNA, 417 bp, Glycine max
  Peptide Sequence Number=SeqID_171300
atgaaagtgtgggtaatttatttcaagattagtggtgattgttatagtagtgatgtgagtagcaacagtagtaatagggatatcagtggtggtcacgatgacagtgacgataatggtggtggtggaggtgacattagtagtggtgacgatatcaatggtgatgtgatgttggtggtgacaattagtggtgatggtgatgaaggtggtattagtggtggtggtggtggccacgacggtgatagtggtggtagcaatgccggtggcgatggtggtgatggcgagggtggtggagtgcttgaggtggcggtaatggaggtggtattgttggcagtggtggtggtgaacatgatggtgatggtggtagcaatttgtggtgacagtggcagcagtgttggtggttgtcaattatggcaatga

SEQ ID NO: 54523 - DNA, 420 bp, Glycine max
  Peptide Sequence Number=SeqID_171301
atgtgcacaggcgtgtttgctcatgtgcctgagtgtgtgggatgtgttgagggtttaatggaacctggaatttataagagtagagtggagcaaagctgtgggtccttgtttgtaggggtggagaagataacagtgagcgactctgctcttgttgaagaagctgtcttgttgactcagtcaggagtggatgatgattcgacgttctctagagtcagtatccgtagcggggacagggttggcattccaatcgcgggaaggaacaacaaagccatctcttctttcctttctcttcagctcaatggacaggcttacggaaagaccagatgcagaatagcggatattgattggcgaagcataagggtgggctttgtgggagttgggcgagatgcaagactttttcctcaaggagttagagcataa

SEQ ID NO: 54524 - DNA, 345 bp, Glycine max
  Peptide Sequence Number=SeqID_171302
atggctgacaacatattccttcctatcactactacaaaagcgacattcaaagatggttctaatggacattcaaagacggttgtggaactatctttgaagccaacaacgataaaagtgttgacgaacgatgacagttatggcattattcatagtctccttttactctctatgcagggtagaccattaaaagttttgaaggctttggataagaaatcagtagatgacaaggaactggagaaagcgaaaaatgaggttcatgaccatcgcaatctttacttggcaaaggagggacttattcttgagggagctacaactgctgaaagggttttagccagcgacatgtga

SEQ ID NO: 54525 - DNA, 786 bp, Glycine max
  Peptide Sequence Number=SeqID_171303
atggtaacactgtcccatgacatgatacacaaagagattgaagtttatgcagatgatatgatcacaaagtctagaatagagaacgaacacatagtcaatttgcataagttgttcaagtggttacgtaagtacaagttaagattgaatctgatggaagcttgcttgtggagcttctatggaggctggatctttgagcttcaatggggtcctttaatgggagtaggattgcatcagaatcctaggaaatgcatatttggagtgaagtctggaaagaaacttggttttgttgttagccataaagggatagaagtggatctggacaaagtgaaagcaatcctagagatgccagagccatgtacagagaagcaaaatcagttagtcaagtggggtgatgactaccagatggcatttgagaaaattaagcagtgtttggtgaaccctcttgtacttgtgccactagtacccggaaggtctctcattttgtacatgatggtgttagatgagtcaatgggatgtgtgttagggaaacacgatgaatcaggaagaaaagacacaccacttgaggcagtatatgttgaactacactacttgtttgatattgtttatgtcactcagaaggcagttaaagggagcgctctggccaatcacttggctcaacaacccataaatgattatcagcccatgcatcctgaatcccctgatgaggatatcatggccatatttgatgaagagagtgaggttgaagacaaagataagttgactttagcagtgatagagatagcatag

SEQ ID NO: 54526 - DNA, 2022 bp, Glycine max
  Peptide Sequence Number=SeqID_171304
atgaactccaaaagcttctcctcatcaaatccaagccacaacaaaaataattacccatcatgggttctcttcaccacactcttactctcatctctatccctcacagtttctaatccaaggattaccgaggcagggctctactgtggcactagcaaggcccctctgaaggccaactacatccccagcttcatcaaggagatggagagcctctcgcagctcgtcaccagcaacaactggggcacacactctgtaaaaatatcaggctcaggctcatccattcccatttacggcttcgcgcaatgcttccgcgacctctcccacaccgactgcctcctctgctatgccgcgagccgcaccaggctcccccgctgcctcccttccgtctcggcccgcatctacctcgacggctgcttcctccgctatgacaactacagcttctattcggaaggcaccgatccttcgagggacgcggtgaactgcaccggggtggctgctggtgatgaggctgagagggtggagcttcaggagagagttggaagagtggtggataatgtggttaacattgctgagcgtgatggtaatggttttggtgtgggagaggttgagggggtttatgctttggctcagtgctggaacactcttgggagtggcgggtgcagagagtgcttgaggaaagctgggagggaggtgaaggggtgcttgcccaagaaggaagggagggccttgaatgctggctgttatttgaggtattccacgcagaagttttataatgaggatggtgatgcaggtggtggaaatgggttcttaagaagaagaggagtcatagtagcagaagtgttagcagcagctgcagttataatgctcgctctctctgcctcctatgcagctttcacaaaattttcaaagataaaaaaagaaaacaataatctcggtcagatttcctcttccataagcaaatctagcttgaattacaagtacgaaactcttgagaaggccacagattatttcaactcctcgagaaaagtaggccaaggtggagctggttcagttttcaaaggtattctcccaaatgggaaagttgtagctgttaagagattgatcttcaataacaggcaatgggtggatgagttcttcaatgaagtgaatttgatcagcggaattgaacacaagaatcttgtcaaactattgggttgtagcattgaaggccctgagagcctccttgtgtatgagtacttacccaaaaagagtttagaccaatttatctttgaaaaaaacagaactcagattctaaactggaagcagcggtttaacatcattctaggaacggcagaagggcttgcatatcttcatgaaggcactaaaataagaatcatccatagagacatcaaaagcagcaatgttcttctggacgagaatctcactcccaagattgcagatttcggccttgcccggtgttttggtggtgataagtcacatttgagcactggaattgctggaacactaggttacatggctcctgagtacctaattcgaggacaacttacagataaagctgatgtctatagttatggagtacttgttctggagattgtgagtggcaggaggaataatgtcttcagagaggactctggctcgcttctacaaacagcttggaaactataccgatcaaacacattaaccgaagctgttgatccttccttgggagatgattttcctccatcggaagcatcaagggtgcttcaaattggattgctttgcacacaagcttcagcttccctaagaccatctatgtcccaagttgtttacatgctaagtaatacaaatttagatgttcccacaccaaatcaacccccatttttgaacactggaatgcttgactcagatagttccattaagtcttatagcactaacagcttcatatccaatgccttgaagaagattggagtgtcctacagctactcagagtcctcacgaaattcagatgggccatcaagaagtgaagaatcaattatccaagtttga

SEQ ID NO: 54527 - DNA, 2160 bp, Glycine max
  Peptide Sequence Number=SeqID_171305
atgtgggaaaattacaatgtagacctttgtagccttcctccatctgcacatgtgagccttaagtgtgagggtaattcagtaactgagcttaaaattataggagatagagctgtgaaggttgacaagttcaatggacctgcagttcccaatcatacactgtcactgagcttctccattgattcttttgtcaccacattgacgaggttaaccaacttaagggtccttagattggtgtccttggggatttgggggccacttcctgataaaattcataggctgtctttgcttgaagttttggatatgagtttaaatttcttatatggttcagtgccaccaagaatgtctacaatggtcaagcttcatacactgacactagatggcaatggtttgaacagcacaatgcctgattggtttgattctttaactaatctaagtgtattgagtttgaagagtaaccacttaaagggttcattcccttcttcactatgcaaaattaggagtcttgttgatatttccttgtcccacaatgagttgtctggtggattgcctgatctcattgctctctctggtctacatgtacttgatttaagagaaaatcatttagattctgaactgccactgatgcctaaagcagtggtcacaattttgcttagcaaaaattctttttcaggtgagataccaaatcagtttagtgaattgggccatcttcagcatctagatctttcatcaaatcatctcagtaagatgcccccatcttccttgttctctttgccaaacattagctatttgaatttagccagcaatgagctaagtggatcccttccacagaaactaaactgtggcagcaaacttgggtttgtggatatctctagtaacaagttaaatgctggacttccttcttgcttggccaatacatcgggtaaaagagttattaaatatggtggaaactgtttatctattgattctcaacctcagcggcaagggacttattgtaaagaatccagtttgggaaagaagaacttctggaaatggaaaatagctgcagcagttgccatgattattgtaattgttcttgtactttctgcttttggagtttttttttatagaaaatatcattcaagggagatgtataggcatcagatgttgcctaaggctgttcaagataactcaataacaggagtttcatctgaagtccttgccagtgctagattcgtttctcaagtagtgaagctagggacacaagctactcctacatgtagacaattttcaattgaagagttgaaggaagtcacaagaaactttgatttgtcaacttatattggcgaaggctccttaggaaagctgtacaaaggtaaactagagaatggaacctatgtggtgataagatgtgtggctctgtcaaagaaatgctcaatacaaaatcttaaagctcggttggatttactctcaaagctgaaccatccaaatttggttagccttttgggtcattgtgttgatggtgatggacaagatgattctagtggcctcaaacttcatcttgtttatgagtatgtgctgaatgggagctatcgtacccatctgtcagaattttcatcagacaagggactgaagtggtctgatagattatcaattttaattggagttgccaaagctgtgcactttttacatactggagttataccgggttgttttagaaaccagttaaagacaaacaatattttacttgatgagcatcacattcccaaactaagtgactatggtatgtccatgattgctgaggagatcgaataccttgaggcaaagggagagtatccaaaatcatgccaaagagaaaaattagaagatgatgtctacaatttcgggttgatactgtttgagtctcttgttggacccatagcaagcaagaaaggagagaaatattttcttgatgaaaagacatcctttgacagtcaagatggcagaattaaaatagtggatccagtagtgttaaccacttgctgtccagagtcattatcaattgcaatatctatcacaaccaaatgcatatccccagaatcctcagctcctccttcttttgaggatgtcttatggaacttacagtatgcagctcaagtccaagccacagcagatgcagaacaaaaatcagattctacatcctaa

SEQ ID NO: 54528 - DNA, 750 bp, Glycine max
  Peptide Sequence Number=SeqID_171306
atggatttgataggcattcctaagaccgccttccacactcactatgggcattatgagtacaacgttatgtcgtttggcttgtgtaatgacccatccaatttccaggcaacaatgaacgatttatttcaccctttcattcgtaagtttgtcctcgtctttttttatgatatacttgtttatagtcagaattttgatgagcatcttaaacactttgagtgtgtccttcaaactttacaccaagggaaattctttgttaagcttcctaaatgtgtgtttaggaagcgatggattgattactttaaacatatcatgtcaactaatggagtggaaccaaaaccattgaaaatccaagctatgctggattggtcagtacccacttcacttaaatctctgcgaggatttctcaaactcacaggattttattggtatttcattaagaactacacgcaattggcatctccactaactcacctcctttgcaaagaccggttcaagtggtcctctaacactcaggctgcttttgataggcctaaaggggccatgactcgagctccaatattagctctactgaattttggaattccattcgtactagagacaaattcttctgacactggaatggatgctttgtctcaagtgaatgaaaaacctgcagaggctctttggatccttaccatgccccattttcgattcctagatgatcttaagaaggaattaagtggtaatgtcgagtttgtggctctgctctag

SEQ ID NO: 54529 - DNA, 382 bp, Glycine max
  Peptide Sequence Number=SeqID_171307
atgggaggagggtcatttgaaatgatggaagtgagattgggaggaacagggtcgttttgggattcgtcatctgaagcaatcaggaggaagaatttggccttgcatttgtgcttcttaaaagtggttttcgggggagccggaagtaatggagagcttcgtcaggtcgtcctagaacaagggtacgaatcgcatttccagggcctgaaggaagccagttcaagaagagatctggtcattgcgataaatccattgaaaccaactcagagcggtgcagttgaggtagaacgatgtgacctagagtccttcatcgttgggggtgccatgggagttgaagtgagagataacctcgtcgattttggagtggagggagctctgggtcgag

SEQ ID NO: 54530 - DNA, 570 bp, Glycine max
  Peptide Sequence Number=SeqID_171308
atggctttggatttcatcactggattgcttgtgtatcaaggggctactgtgatcctcaccgtgcttcatggctttcctaaaagtataatttccaacagagatccaatcttcatgagtcgcttctggcaagagctcttcaagctcaatgggaccaagttgcgcatgagcacaacttatcatcctcagagcaatggccgaactaaagttctgaaccaagtgctccagcagtatttaagagcattcatttataaccaactatctcaatggggcaaatttctaagcttgactgagtggtgttataatacaacgtgccactctaccacccagatgactccatatgaagtaacttatggtaagcctccctcgagcatccctcaatatttgcctggaacctcctcagtagaggtagtcaatttcctccaagcttcacgtcaagaggtatttcagcttcttaggaagaagcttgagcgcacccaagaacaaatgaaaaaggttgttgatgctcatcgcagggacactactttcgttgtcggcgattgggtctacgttaagttacgtccctatcgttag

SEQ ID NO: 54531 - DNA, 870 bp, Glycine max
  Peptide Sequence Number=SeqID_171309
atgaaaggaaagaacaggagaagtggtggtgttgtccatatggaatacctcattcacattcaggagattaagccttggcccccatcacaatctctcagatcgcttcgttctgtgttgatacaatgggagaatggtgatcgctcttcagggtctactggtgttgtttcaccttcgcttggtcctaattctgctcctggtgaggcaaaactcgagtttaatgagtcatttaggcttcctgtaactctgtcaagggatatgtctattcgaaatagtactgctgctgtgttccagaagaattgtttggagtttcacttgcatgaaactcgaagagataagaccactaaagggcagttgctggggactgccatcatagacttggcagattgtggtgtacttagagagaccttgagcattcgtacgccattgaactgccagaggaactacagaaacacagatcagccacttttgttcattcaaattgagcctgttgaaaagagtcgccctaagtcctccttgaaggacagcttgacaaagggaaataatggcagtgaatctgtatcagcattgatgaatggagagtatgctgaggaagctgagatcacctcttttactgatgacgatgtttcctctcattcatctgtggccgcagtcactacttcctcggagtctagtgcgtgtatgccccccgaacatgaagaggaaggaaactgtcaggggcatgaattgagtgatttgggtggtagggaggttgcggccccagggacaaatggaccagctcaaaacagtggtagcaatgacaaggagcatgaacatcccttgacctcagacacaagagttgagaagttgaatgtgatggaacatgatacataa

SEQ ID NO: 54532 - DNA, 1191 bp, Glycine max
  Peptide Sequence Number=SeqID_171310
aatggaccagctcaaaacagtggtagcaatgacaaggagcatgagcatcccttgacctcagagacaagagttgagaagttgaatgtgatggaacaagatgcatatgagagactggagaggagttcttcctatgtgtcatctatggatgtgtcctctgaagtcgggagtccagtaaatggtcatacctctattacaagcactcccaatcatagatcagcaacaaccccaaagcaggttgcttctttgaatgctgattcttcttccccaaccttggaggaaaattctaagagcaggtccagaatcagtgatgatgaaaatttggatcaggagagttgtgaaaaagttgccaattgtagaaatatgagtacagttgtacaaagaaacaataacgaaagtgattttgacatttattctagcaacactacgtctctagacagtaattacctcgtggacacgaatccaagctttggtttggaaaccaaagacaaattaagtgagagttgtgaggaagttgacaaaagccgtgtgctggaggggggaagtgataactattacagttccattcaagatcagcatggaaatgaaatgtttcattctgataagcaatatcatgtagaagatgaatcagtggcagaaggttcaaaagatcaagttttattgagtagcaattcatattcttttggtgggtcagataatggtatgaaaggcaatgttctgaaaaatgaaagattgaagaatgtgaggtctgtaaggtcatcagcagactcagttaggaatattgggtcacttggtaacaatcatctcattgaggtaaaggaaaatggtgttaatggagatgcccaaaataatggagcgaacattcgaagcagtgacagaaaagatgccaaggtttatccaagggaagccagaaatgccattttagacaacaagattgagcacttggaaaacaagataaagatgcttgaaggagagttaagagaagctgctgctattgaggctgctttatattcagtagttgctgagcatggaagctccatgagtaaggttcatgccccagctcggcgcctttcaaggctgtaccttcatgcttgtaaagaaaattttcaagcaagaagggctggggcagctaaaagtgctgtttctgggttagtccttgttgcaaaggcatgtggaaatgatgtcccaaggtaa

SEQ ID NO: 54533 - DNA, 591 bp, Glycine max
  Peptide Sequence Number=SeqID_171311
atggcccaaggatttgagccattgcacgcccaaaacgacattagcaccggaaattggcagaacatagaggtgaagcacaacccaagctcacagtgtgaggctatctcgtcaggcttcaggcacttcacagctagttgtgatgggcgaacaggcgacggaaagaggggtactggcaaagaggaagaattgcgggtgcgtgaaagggagtggagtgggtggtcgagggtgggcgcggacacgacgcgtggcattggtctagaactttctcttcctagagtcacgcgagacccgcggcctagacaagggtcaacggttgcagagcctgcacttcacgatcatcgatggggtcgtcataaggggattgggcaaatcgtgtctgtaacgcttgtagaaaaaccggccaggagtaccatggtattcaaaaaattggttgatcttaaagatccaaccaagaaggagaagtggaatgagggtgaggaacaaccagaatgggtggtggggcgagtgaggacatcctcaagcttactaaaggagtgtgatggagggttggagtccgccattgcaatgaaagcaccagttgataggtgctga

SEQ ID NO: 54534 - DNA, 1815 bp, Glycine max
  Peptide Sequence Number=SeqID_171312
atgtattcagcaatgatgatgatgatgatgcgaagaagctcttgtgttcatggattccctcttcttcgatactttgcttcgtcttctaattccaaaccctttcttcttcacccatcgcattcttcttcaactttctccttcgttagtgacagtgatacaagcagagctcaattccttgattccatgagaaatgcgaaatctgtagacgttgctttggatttctaccacaaaatggtcacaatgaagcctttcccatgtgtcaaggacttcaacttgttgtttagcatcgttgcgaagatgaaacactacacaactgcaatttcgctaatcaaacacatgtcttatattggtgtcaaaccgactgtccacactctcaatatcgtcattaattgtctctgccgtttgagccacgccgtgtttggcttctctgttttggggcttatgttcaaaattggtgtggaacctagcatcgtgacttttaacaccattgttaatgggctttgcgtagaaggaaatgttgctcaagcaattaggtttgttgaccatttgaaagatatgggctatgaatctgacagctatacctgtggagcaataactaatggattgtgtaaagttggtcattcatccgctgcactctcgtatctcaagaagatggaagaaaaaaattgcaatttggatgttacagcttacagcggagttgtggatggtctttgcaaggatgggatggtatttgaggccttgaatttgttctcacaaatgacaggcaaaggtattcaacctgatcttttcacctataattgcttaattcatggcctttgtaactttgatagatggaaagaggctgcacctctattggctaacatgatgagaaagggaatcatgccagatgtgcaaacttttaatgttattgctggcagatttttcaaaacagggatgatttctagggctaaaagcatattcagtttcatggtgcatatggggattgaacatgatgttgtcacctatacatcaataattggtgctcattgtatgctaaatcaaatgaaggatgccatggaagtatttgatttgatgattagcaagggctgcttaccgaacattgtaacttatacttcattaatccatggatggtgtgaaactaaaaacatgaataaggccatgtatttcttgggtgaaatggtaaataatggactagatccaaatgttgtcacatggagcactcttattgggggggtttgcaaagcagggaaaccagtagctgcaaaagaattgtttttagtaatgcacaagcacgggcaacttcccaatctccaaacttgtgctattatattggatggcctatttaagtgtaattttcattctgaggcaatgtcattgtttagggagttggagaagatgaattgggatcttaatattataatttacaatattattttggatggaatgtgtagttctggaaaactgaatgatgcactggaactcttttcttatctgtcaagtaaaggcgtcaaaattgatgttgttacttataacataatgattaaaggtctatgtaaagaaggactgttggatgatgccgaagacttattgatgaaaatggaagagaatggttgtcccccaaatgagtgcacttataatgtctttgtccaaggattgctgcgaagatatcaaatttcaaagtcaacaaaataccttatgtttatgaaagataaaggatttcaggcagatgctaccaccaccaaatttcttatcaactacttctctgctaacaaagaaaacagggcattggaagtgtttttgcagaaatttgtttga

SEQ ID NO: 54535 - DNA, 2034 bp, Glycine max
  Peptide Sequence Number=SeqID_171313
atggcgttcagaatacaccatggacattatgaatttaaggtaatgccattcgggtgttgcaatgccccgtcatccttccaggccaccatgaacctgctcttcgggccttatctctggcaattcatcattgtcttcttcgatgacatcttgattcaggtcgaatatcttggacatattgtctcccataaaggcgtggaaccggtggctgcgaaggtggcgaccgtccaacaatggccaataccgcgctcaaccaaggctctaagaagcttattgggacttgtaggattttatcgtaggtttatcaagaactatgccaccattgcagctcccctcgtaaaggtgaccactatagatccattccaatggacaactcaagctcagaccgcctttgagcacctcaaagtcgccttatcgacaactccgatgctagctctttcggattatgatggtccttttacagtggagtctgatgctttaggggtaggcatgggcgcgatcttgtcacagcacgaccaccccatcacattttttagcaagccttttagtcccaagcttttgcgtgcttcaacctatgtcagggagttgtgtgccattacgacggcagtgaagaaattgcgtcaatatctgttgggtagcagcttcacgatcatcaccgatcaccgtagcttgaaggaactgttgactcaggtgattcaaacacctgaacaacacatgtatttggccaagttgataggatacgattacgacatacagtatcgtttcggtaccagcaaccaagctacggatgccctgtccaggttacccgggccacagtccaccatgcatatgacactctctgtcctatgcttaaccttcctcgaggaactgcctcaacaacttaacgggaatgacgactgcagtcgccaacgtagagctatcctcgacttttcggtggaccaccctggtttctcagtaacacaggatctcgtcctttacaagggccgaatttggttgtgtcgtgacttgccgataattacaaccttgcttaataagtatcatgcaacgccaactgggggtcatgctagggtcacaaagactctggctcggctatctgaaaatttccattggcaaggaatcagggacgatgtcactcgcttcgtagcccaatggttagagtgtcaactcaccaaatacgaagccaagaaagccgtcggcctgctttgtcgtctttcggtcccacacagaccatgggaggacctttcactagatttcattttgggacttccgccatatcagggcaacacaatgatccttgttgttgttgatcagttctccaaaggaatacacctggggatgttaccgacgactcacacggcccatatggtagcttcactgttcttgaatatcgtggtcaaattgcatggagttccctggagcttggtctctgatcgcgatctgcttttcatcagtcatttctggcaggaactctttcgcctgagtggcaccctgttgcggatgagtacggggaccatcccttatgaaatcacctttggctggaaacctttctcgttcccggaatacattgtcggttcctccaacattgacacagtggatgagttgctaactgacagagatgccacctttgaagctattcgaaggaagctcgtaaaaatgcaggagagcatgaaaaaatttgcggatactaaacgcagggaggtcttagagaggattgatgaggtagcttatcgtttgcaactgtcggacgacattcgtatccaccctgtcttccattgctctgtgctgaaaccatttaaaggctcaccggaacaagctcaggaggtccagctaccaccacaagtgatcaatggccaaccaggtctatcacctgataagacattgtgggaggattggacccaattgtgcgagactcaccaccttgaggacaaggtgatcttccaagggtcggggagtgataggatatcagaaacagtgaacaaagcaccaggaacaggaaacaacaaggcaccagtaacaggaaatagagggtgtaagtag

SEQ ID NO: 54536 - DNA, 361 bp, Glycine max
  Peptide Sequence Number=SeqID_171314
atggtatctttggaagaacatgagaagggtaatggcctagaaaaaccaacaatagttgacaatgatggaaaaggtggcacatttgacagtaaggggagttttgtctctagacctgacaatataaggaaaggagaaaattttggggtaaaggttagtgctagaaagagtgcaggtcctaagcaggaaaaccttgttaatcaaaatggattacctcgatacgagaaagttaagaacctgatgagggagaaactccctagaaggggtgatggtaatgggcagataagcatggacttagagtgcctaggtaatgggcctagtattgggctgaatgagaataacaacacttccactatgagggatg

SEQ ID NO: 54537 - DNA, 324 bp, Glycine max
  Peptide Sequence Number=SeqID_171315
atggagtcgaaggccatgcctcttactttgaagtttggggaggatccaatgagtaggtgtaggaagaaggtcaagaataaggagtctagtgaagaaggtgaggctaatgccctagtggaggggactcagttgatttcatccgtggaggttgttgtatgctacgaggattataaccatgaatttttcgaagggccatggttgatagtggatcattaccctcattgtccaaaggtaagggttttgaagctccctattgagcttttcaatcaacagtgtttgtggcggattggtgcttccattggcactatgctcaaagttgattaa

SEQ ID NO: 54538 - DNA, 418 bp, Glycine max
  Peptide Sequence Number=SeqID_171316
atgggagggcagtctccaaaaagggctaaaaaggtgaaccctaaagttgttggcagaggtaaagggaaaaaggacattgttaagtggaacttaggaaccaaacaaagggaaactgccgcttgggtcgaggtgaaagtgttacgggtcggtggtgattgttgcggtggttgtttcgttgtcattggcattccagatcaatggatgtatgacagtataatgtttgaagaagttgatatggatgatcaaaatgaacaggaatgtggtgtgaatgagcagcatgtgtttggtacccgaaatgatgttttgcagagtggtgagtataggtgtaggaagaaagattttgttagaagggatattaggaccaggaaatgtgggagtcccttcaagcttcgtgggaaaccagtggttggagggcaag

SEQ ID NO: 54539 - DNA, 1035 bp, Glycine max
  Peptide Sequence Number=SeqID_171317
atgggtagatcaccttgttgtgacaaaaatggcctcaagaaaggaccatggacaccagaagaagaccagaaactctttgattacattcagaaacatgggtacggcaattggagagtactcccaaagaatgctggtttgcaaaggtgcggaaaaagctgtcggcttcgttggacaaactatctccgaccagatataaaacgaggtcgattcactttggaagaggaagagaccataatacaactacatagcattcttggcaacaagtggtcagctattgctactcgcttacccggaagaacagacaatgaaatcaagaattactggaacacccacattagaaaaaggcttctaaggatgggaatggaccctgtgacacataggccaaggcttgatcttttggacctatcttccatcctaagttcatctctctatggttcaacacaaatgaacatccaaagacttcttggcactcacacggtggtgaaccctgaggttctaaagttggcttcatcactcttcccctctcagcaacgcgaaaacatcaacatgtgtgcacaaaattgtgaagagaaccagctctgtgacccccaaattcagagccaaatccctcatgacttggctcaagaagcattgcctttcactcatgcacagttggttgaatccaatacgatgaacacatacccttcaattttccatgaatctggcttccaacaacattattctcaactaagtgatttgcattacaacggaattgatcataaaagctatgttcctcaattaccaagctatgattaccctccaatgtctgaatcctcaacttataacaattcctataataacagcaaccagaacttcagctacgcttcagttctttcaacgccttcttcaagtcccacaccgttgaattcgaactcgacgtttgtcaaggggagcagcagcactgaggatgagacagaaagctatgtcagtagcaacaacttgttgagatttgaaatcccagatatgctacgtatgaatgagtactcatataattaa

SEQ ID NO: 54540 - DNA, 186 bp, Glycine max
  Peptide Sequence Number=SeqID_171318
tctagcgttcatgcggtattggaatttgtgtcccctgaaaatgttactgagggtatccagttgattgatgaggtccgactattgcctgaagaccataaagcaaaagcagacctgctggaggtaaagaaaatggcgcttcatagcatgaatacagcaattaaagaaattcatgctcggacaaattaa

SEQ ID NO: 54541 - DNA, 1533 bp, Glycine max
  Peptide Sequence Number=SeqID_171319
atgattgctcaagcagtgagcctggctttgactcgttcttatttgctggttcctggttttttagcatttgctagtggaaagctagcattggctcagcaaaatggggcagacacagaattttacccatcacagaatgcattgtatatgcatgcacaagatgggtatggttacatgtttgcatttgtattcattgtagtggaaagccttgttttgttagtgagagctatctatctggccatattattctctccaagcatactgatggcgccacttgcagattattttggaccagaattcaggaaaatgtggctatcggttgttcatcgtacactagaaaaagcaggtccagcattcataaaatggggtcagtgggctgctacccggcctgatctgtttcctcgagatctatgtactaagcttgccgaacttcagacgaaagcacctcaacatagttttagctacacaaagaaaactattgaaagagcgtttggtcgaaaaatttctgagatttttgagaattttgaagaagtgcctgttgcatctggaagtattgcccaagtgcatcgtgcttctctaaaatatcgttaccctgggcagcaagcaaaacccctggtggttgctgtaaaagttagacatcctggtgtcggagaatctatcagaagggattttgctattatcaatttggtggcaaaatcttcaaagttcatccatgctcttaattggttaaggttggatgaaagtgttcaacagtttgcagttttcatgatgtctcaagttgaccttgcacgggaagctgctcacttgagccgcttcatttacaatttccgtcgatcgagggatgtctcttttcctaagcctgtctatccacttgtgcatcctgcagttttggtggaaacctatgaaaatggagaaagtgtatcacattatgtagatgagcttcaaggacatgaaaggattaaaagtgctcttgctcacattggtactaatgcacttttgaagatgcttctggtggacaacttcattcatgcagacatgcatcctggaaatatccttgtacggagcaagcctcacaaacgacttttcaaatcaaagccgcatgtaattttccttgacgtaggcatgactgctgaactctctggcagtgatcgggtaaatttattggaatttttcaaagctgttgctcaccgagatggtcggacagctgcagagtgcacactcaggttatcaaagcaacagaactgtccaaatccaaaggcctttgttgaggaaatggaagagtcgtttactttttggggtactccagaaggtgatctggtccatcctgccgagtgcatggagcaattgcttgagaaagttaggcgtcataaagttaatgttgatggcaatgtttgtactgtcttggtcaccaccttggttcttgagcgcaagcttgatcctgggtatgatgtgatgaatactctgcagacattgctgcttagagctgattgggcaaagtctctttcatacacaattgatgggctcatggccccttga

SEQ ID NO: 54542 - DNA, 651 bp, Glycine max
  Peptide Sequence Number=SeqID_171320
atgagcacagcctatcacccacagacccatggccagaccgaggtcatgaactgcatcctggagcaatatttgagatcattcgtccatactcaaccagcaaattggtttcgatacctcacactagcgaaatggtcctacaacacatcccttcattcaagctcggggtttactccgttcgaagtaatctacggcaagccaccaccagcactgcctcagtaccttcggggcacatccacaaatgaagttgttgactctctgatatcgcctcgccaggcgatccacgaaacgctccaacgccagttgagtaaggcacatgccaccatgaagaaactagcagataccaagcgcgaaataacacatcatggaccactcccttcgtccttgggtacatggccgctacagatcatcgcacagaaacatgtgcctcgtctgctttgcctcttggactcgaaactcgatgaatctacgtctccaccaacgcagttagtccttactcagtggttgggccaaccaccaaaagatacaacttgggaacgttggtcggagcttcgtgacacatacaaccttgaggacaaggtggtgtttgaggacagggttttgttagcaataatctgcatcaagggcccaatacaggtaggcctaaacggctaa

SEQ ID NO: 54543 - DNA, 717 bp, Glycine max
  Peptide Sequence Number=SeqID_171321
atggccttcagaacgcaccaaaggcactacgagtatcgcgtcatgttgttcagcctgtgtaacgcaccttctacttttcaggaagccatgaacaacctactgacctcgttcatgcgatgctttatagttgtgttttttgacgatattctagtgtatagtgattccttatcgtctcacatacaacaccttgaaactatttttcaaatgcttttgcagggtcaattctatctcaaacgcaccaaaggcctgttcgtgcaaacacaattggaatatttgggacacatcgtgtccggcaaaggagtcgaatctgagccatctaaaatccgcgccatggtgcagtggcccactccaacatcgtccaaggagcttagggcatttctcggcctcaccgggttttaccgaaagtttatcaagaattacgcatctatcgtcgcccctctaacctcactactatgtaaagacatgtgtatatggattgtaacttcacaatctgcttttgatcaactgaaggcagcaatgaccagcgcccctgtactggccctgccaaactttgtagagccattcaccatcgagaccgatgcctccggcatcgccatgggggctgttttaatgcagaagggtcaccccattgcgtttttcaataaaccttttggccctcgactgatccatgcttccacttactgtagaagcaagcttcatgatgatgaatcaagttga

SEQ ID NO: 54544 - DNA, 432 bp, Glycine max
  Peptide Sequence Number=SeqID_171322
atggggatttggtggaagccttgcctgagatccagcttggagaaccaggaagcatgccctacttcgttgagtaactcatctatcgtcaggatcgagaaacaatcacggacggttggatcagtcctgtcgagaggagttctgaaacttgcttttctatttcggacttctaaaagtgtggatagcggtagggtcatgttggaattggttgatcagcgcttcaatggctggtatcaggtgaggaagatgatgttgtgggtcgggtcgggttgtggttgtgaggcacaggcaatcccacctcttgcaatgaaccccaaaggaccttcctcctttgtgttcagtgattacaccaagaagcaaattccacttcttgcaatgaaccccaaaggacgttactcctttgtgtccagtgattcaaccaaggaacaaacttag

SEQ ID NO: 54545 - DNA, 372 bp, Glycine max
  Peptide Sequence Number=SeqID_171323
atggctcaatcaagggcaactgataaagaagttgaaactttgcaggcaattttgtcattgagaagtcctctgtggaaattttgggaaaggaatacatttgctcaattgggattgtctatctatgagaaaggaatatggcgggatgggttttcgtcatctctatggcttcaatttggccatgctagtattaagagtgttcaaagcctaattaaggaggattttttgcaagctaagttgggtaaaaactcaagcttcacatggcgtagcatctacacttcacgagtaatggttaaacaaggcatgagatggcgactgggaaacaaaaaagaatataaatgtttgccaagatccatggttgaggtccatcgataa

SEQ ID NO: 54546 - DNA, 576 bp, Glycine max
  Peptide Sequence Number=SeqID_171324
atggaagtttgggttacacaagtttcctatttcactcctcatcgaaatgttgcagttttcgatccacccactgatgatatgagatgttatgtgaagctactccatttgactgctatagtgcaaaaccaaattattaataagattttggtcgatggaggggctgcattcaacatcctgccaagatctatgttacgcaagttttgtaagagtgtagaggatttgatacctcacaacatagtggtgtcagatttttgtggaaaacccttagattctgaaagggaaaggcctacagtgtttctggtaatttcttcacaagccaatttctacatgttattggtaagggaatggatccacaaagtaggagcggttccatcattagtccatcaaaagttgttctttagcaatgaagatggaaaactcgagatggtaaaagcgaatcaatcatcgtatggaatttatgttgcctttgtaagtgaaggtgatcaagcaatgacaaggactgcttcgtttgaaatcaaagatttgttctatgtgaacaacaaattaggtgatgaaaaagacaagttcttttgttag

SEQ ID NO: 54547 - DNA, 1293 bp, Glycine max
  Peptide Sequence Number=SeqID_171325
atgtcctcaggattaaaaaagatgaaatctcaggatcctttagaagagattaacctgggtactaaaggaaatcaaaaaccgacttatgtaaatatgtttggactcaatagagaattggtggaacatagatttcctatctgtgaaggtaagaaactagtgaagcagacaccaagaagatttgctcctaatgtcgtggaggctatcaaagcaaagatagaaagagtactgaaagccaagtttattcaaactcaaggtgaattattgggtttcgttatccatcaaaagggaatcgaagtagataaaaataaggcaaattccattttggagacttcccctccaaagaataaaaaacaacttcaatcattattaggaaaatggacccttgcactagtagaattttcacatacctttgtaccattgaaagctattaaaggccaaattgtaacagatttcttggttgatcattcaaacgtagaaatattggaatgttacataggaataaaaccttggatattgtatttcgagggatcgaaacatgtcaatggtgctaggattggtgtcattttaatttctccaaataatacacttgtgaagatccttttcgaaatacaacctgtgtgttctaataatgaagcaggatatgagactttaatagttggtttggagacattattgaatttaggtgcaaaacacgttctgattagaggagattttgagttagtcattaatcaattaactcataaatttaaatacatcaagagtaacttgcagaaatacttttcatatgcaactaagttgttagctcaatttgaatggattgaatttgaacatgtgtttcgagagcaaaataaagaagctaatgatttggctcaaattgcatctagttatgagttgtataaaaagagtataaatggaatcttgttaaaatgtttggtagaatcagaagcttatatagttttgactgaaactcatggagaaatttgtggatctcaccaagctggtggaaagatgaagtggatgttatttcgacaaggttattattggccaactattttgaaggattgcattaattatgcaaaatcatgcgaggagtgccagaaacatggtcccatacaacaagttccagcaagtgagttacattcaataacaaaaccttgcccttttcaagggtggacattagatttaatgcgtcacttccatccaccttcttcgaagggacacaagtatatcttggttttagttgattatttcaccaaatgggtgcaagcaattctcttgaaaaatattgattaa

SEQ ID NO: 54548 - DNA, 381 bp, Glycine max
  Peptide Sequence Number=SeqID_171326
atggaggatgtgaagaaaattccttgggttaaatgggatacaatatgcctggaatgtggaggtcttgctataagagacatatctttctttgatgatgttttcttggcaaaatggaaatggagattgatggatgccgagggtgaactttggaaagaggacgtggtggaaagggggaaagagaatcaatgtggtgaaaagatcttggaaagaggtgggatttgggatggcgggggaaatggtttttatgagaatgcgaaggtgctagtaatctcgaagaggagctggtcaaaatcattcttcaaaagaattaatgtgacaagagatggtggaatcttgatgactgtgttgtttattttgtgcgttcgacatattctttcctaa

SEQ ID NO: 54549 - DNA, 309 bp, Glycine max
  Peptide Sequence Number=SeqID_171327
atgatatcttcagtggggaatgagaagaacatgctcaatgaaactaatcagaatttaaagaaggaacttcagtctctgatatttgaccttgaggagaagctgaaggaacaacagaaaattgaaggttccctaagatctgaggttgaaactctcaaagttcaggttgctgagaaatatgcattgcaaagtcagctagaggaaattgaagagaaactggcacaaactgaatctagactaaacgaagaggttggaagtgttcaagctgctgcttctacaatggaatcccagccttttcaagttggcagataa

SEQ ID NO: 54550 - DNA, 1341 bp, Glycine max
  Peptide Sequence Number=SeqID_171328
atgggggagtggagatcaaagagtttaacatgttccatgttcatagaagagatggaggtggaagatataccattggtgggtatgaagtacacttggtttagatccaatggacaagctaaaatccggttggatagattcctagtgtctaatacttggttggaccaatggtcgagagtgttgaattgttggttcctacatgaaggctttgcaaaatttgttgaggacgaatgggggaagattaatgtacatggatggggtgcttttgtgttaaaggagaagttgaagagaattaaagagaaaatgaaggagtggaacaagctttcttttggacacctacaagtgagaaggttagattttgaggaaaagatgagaattttggatctaaaatatgaggggaggaggaagtggaattttttgaatggtttgatggtggaaggaagaccaaagcttttcggtgttccttttaaaatgataaatcaacaagataatgcctttttgatagctccttttgaagaggaagaagtggtaaaggtggtatggtattgtgatgataacaagagtcccacactggatggctttaatttcaagtttatcaagaagttttgccatttggtgaaagcaaacccacaagagcttgatgagtttaggccaatttccttgattggatgcaaatacaaaattatatctaaaattctagcaagtagacttaaaaaggttttgaatgatgtaattgatgagagatggagagcttttatttgggggaggaatatgcttgatggggaattggtggcaaatgaggttgttgatgaagcaaagaagatgaagaaaggatgcatgattttcaaagtggactatgagaaagcatataactcaatttcttggttttccttgtttcacatgatggagttattgggagatccacttgcccttttccaatacctcattgcggcagaggaccttagtgggtggatgaggcaagcggtggtcgaaggtctttttgaaggttataaggttagatctttgaatgtggaggtcaaccaattgcaatttgcggatggtacactttttgttggagtgtcatcaactaagaacattcttgtccttaaagtcatccttagatgctttgaactagcatccaatctcaaggtaaacttccacaagagcaagtttaaaggggttaatatgcttgatgagtgcttgatgaggtatgcttttatactaaattgtaatgttaggcatattccgtttgattacttagggttgaaggtgtgggggaaccctaggaaggaaaggatgtgggatggttttttggagaacgtgaaaaagagtttgtctaaatga

SEQ ID NO: 54551 - DNA, 975 bp, Glycine max
  Peptide Sequence Number=SeqID_171329
atgccattcgcctttacagggctacacgtcctcaccttcagaggacaacaccttctcgccttcagaggactacatgccctcaccttgagagggctgcattcccttgccttcataggaatacacgtccttgccttcagaggactacacatcctcgcctgtagaaggctgcatgccctcgccttcagaagactacacgccctcgccttcagaagattgcacgtcctcaccatcagaggattacacagggctgcatgccctcgccttcaaaggctacacgccctcgccatgagaggactacatgtcctcacattcagagggctacacgtcctcgactttagagggctgcacgccctcgccattacaaggctacacgtcctcaccttcagaggactacacgtcctcaccttcataggagtcctcgccttccgaggactacacgtcctcaccttcagaggactacacgtcctcgctttcaaaggactacatgccctcgccttgagagggctgcatgccctcaccttcagaggaatacacgtcctcgccttcagagggctgcacatcctcactttcagagggctacacaccctcaccttcagaggactacacgtcctcgccttcagaggattacacgtcctcatcttcagagggctacaggactacatgtcctcgccttttgagggctgcacgccattcgccttcagagggctacacgccctcacttttcgaggactacacgtcctcccattcataggacaactaatcctcgccttccgaggactacacgtcctcaccttcagaggactacacgtcctcaccttcagaggactacatgtcctctccttgagaggcctgcatgccctcgccttcagaggactacacgtcctcacgttcagaggacaacacatcctcgccttcagaggactacacatcctcgcctatagaggactgcattccctcgccttcagaagactacag

SEQ ID NO: 54552 - DNA, 956 bp, Glycine max
  Peptide Sequence Number=SeqID_171330
atggatatcactcccgcaatccgcaatcacgtcgaagaccgtctcaccaaactggaaaaatggcagacccagctgataaacccgcatatcgtcttatccaaagaaccgcaggggtttgtcgccgacgctaccattaccacgccgaacggcccgctggtcgccagcgccaaacatgatgacatgtataccgccgttaacgagctgatcgccaagctggagcgccagctgaacaaggtgcagcacaaaggcgaagcgcgccgctgcaatgccagcgtgaaagacatcgtgccggaagtgagctctatgaatcccgagaatccgctgctggcgttacgcgataagatcagcgccgtcgatgccaggctgttaacgctgctggctgaacggcgcgcgctggccgttgaggtagcgcaggccaagctggccacccatcgcccgattcgtgacgtcgagcgcgaacgcgccctgctggaaaacctcatcgcgctgggtaaaaaacatcaactggatgcgcactacatcacgcgcctgttccagttagtgattgaggattcggtgctgacccagcaggcgctgctgcagaaaaacctgaatcatccacatgcgcacgcgccgcgcatcgccttcctcggcccaaaaggctcctattcgcaccttgccgcccgtaaatacgccacgcgccacttcgattcgatggtggaaatggggtgtctgaaattccacgacatcattcagcaggttgaaagcggtcaggcggattacgcggtgatgccgattgagaacaccagttccggctcgatcaatgatgtatacgatctgctgcagcaaacgtcgctgtcgatcgtcggcgagctgaccattcctatcgaacactgcgtgctggtcagcggtaataccgatttgcagcagattgaaaccgtgtatagccatccgcagccgttccagcagtgcagcca

SEQ ID NO: 54553 - DNA, 543 bp, Glycine max
  Peptide Sequence Number=SeqID_171331
atgcggcatcacggaggaaaatttacgatgagtgcaatcgttaagcgctgcagcgtcgccgccgttttggccatcgcggtgctgttaccgtcatttggcgagctgcaaacctcggaagccggtctcaggctgatcgccgatctcgaaggttgccgcctgtcgccttaccagtgcagcgccggggtgtggacgcagggcattgggcatactgccgacgtcatcccaggcaagacgatcgatgaacgcaaagccgctgtggatttggtcgacgatattcgccgcaccgaacgcggcatggccgcttgcctgccgcatacgctctcgcaacaaacctatgatgcggtgatcgccttcgccttcaacgtgggcatcagcgcagcctgccactctacgctggtcgcgctgctgcaacagcgccagtggcggcaggcctgcgatcagttgcctcgctggatttacgtaaacggaaagaaaaacaaagggctggaacagcgacgcgccacggaacgcgcactgtgcttgcagggtattgcctcatcatga

SEQ ID NO: 54554 - DNA, 147 bp, Glycine max
  Peptide Sequence Number=SeqID_171332
tgggacggaaggttcagaggcttcccgtccccggatggtgtaagtccttctcttactgttgaagaaagcgagaacggttctggagaaagtgcattcctaggcggtagctttccaagagagccctacggcagtggaatcggccgataa

SEQ ID NO: 54555 - DNA, 132 bp, Glycine max
  Peptide Sequence Number=SeqID_171333
atggggtggcacgacatggatctcaacggggtgtgcatggttgtgctagaggacgacgttggggtaggggagcacaatgcactggatgacaaggtgggggtggcaacgcacgagaactttctcctaatttag

SEQ ID NO: 54556 - DNA, 408 bp, Glycine max
  Peptide Sequence Number=SeqID_171334
atgtcgactgaacaatatcagtcgcggcttgtaatatatcgagaagctcgtaatctaaaacagaaactctatgcaaagtcaaacgacattaacgttttcctcgggtgttcgattgtgtaccttagtatatcgaggcgctcgaaattcagaacagaagctctgagcaaaatcaaaagacaaaaactttttactcggatgtccgattgtgtctcgtatgatgaggacatgaccaagagcaagggcaaggatccacttgaaggacttggaggacctatgacaagggctagagcaaggaaagccaaggaagctcttcaacaagtgctgtccatactatttgaatacaagcccaagtttcaaggagaaaagtccaaggttgtgagttgtatcatggcccaaatggaggactaa

SEQ ID NO: 54557 - DNA, 1270 bp, Glycine max
  Peptide Sequence Number=SeqID_171335
atgatgcagatcagctccaccataccagcacccaacctccacatgttccaaacgagacgcaccagtttccgatgccgtgcttctccgttgaacccaacaacctcgtcttctcctcaatccataaaatcggtctcagattccacccgcctgcacctctctaaccttgacaatctcctccagaagcaatcaccaacgacacagcccaaacaacaagaagaattgaccttagccgctacaattcaaaacaacaaaacaacgacaacggagaagaaaggaaagaacgttcttgaaggcctgaacctggcccgtctctggccggacatgaaagcaacggaggaaatgtcgccgcgccacctcaaccgcctccagcgcctcctctccaagaccgacgagtactcgccgcgaaacaccctcggcagcctgtggcgggagtaccacggcagccacgactggaaaggcatgctcgaccccctcgacgagaatctccgccgggaggtcgtccgctacggcgagttcgtgcaggccgcctaccactccttccactccaaccccgccatgtcagcggaggagccgccactcccccgccacatggtcttacccgacagatcttacaggatcacaaagtctctatatgccacgtcatcgatcgggttacccaaatgggttgatgacgtggcaccggatctggggtggatgagccagcgctccagctgggttgggtacgtggcagtctgcgacgacagaagagagattgtgcgtttggggaggagggacattgtgatctctcttcgtggaaccgccacgtgtctggaatgggtcgaaaacatgcgggctcagttgataaacatagatagtagtagtagtagtagaggaaagcccaaagtggagtgtgggtttttgagcctgtacaaaacccgagggagccacgtgcctagtttgaaagaatcggtaattgaagaagtgaagagactcatgaaactctaccaaggggaaacactaagcattacaatcacgggacatagcttaggtgcggcactcgccctactagtggcggatgatgtcagcatgtgcagcactgacgtcccgcccgtggctgttttttcgtttggtgggcccagagtaggtaaccgggccttcggagacaagcttgcggcccaaaatgtgaaagtgctgagaatcgtgaactcgcaggacgtgataactaaggttcctggaatgttggtgagtgaggaggtagagaagaaacttagaaactccaagcttggtgctg

SEQ ID NO: 54558 - DNA, 942 bp, Glycine max
  Peptide Sequence Number=SeqID_171336
atgggatcaaccaatggtaacttccctgcaaaccttcccattcttgacggcaaaaactggaacaagtggagtgtccagatgaaggtgatattcgcatatcaagaagtccaagaagtggttgatgaaggttatcctgcacttgtagaaggtgcaacaaaagcacaaagggctgtgcatcgtgaaaacaagaagaaagataataaggcttcgtttttcattcatcaatgcatagataatgcacactttgagaaaattgcttcagcaaagacctcacatgaagcttggaagattcttgagaagtgtaatgagggtgccgatcagtggaagaaagtgcgattacaaactctgagacgccaatatgagctgatgcagatgaacatgactgaaaaggtagcagagttttttaatcgtgtaatcaccttgacaaattcaatgaaagttgctggtgaaacggttacagatcaaatgattgttgaaaagattcttcgcactctgattcctaagtgtgatcatgttgttgtggcgatagaggaatcaaagaatcttgcaactctaaaagtagaagaattgcaaggttcattagaagcatatgaacaccgtatgctggaaaggcaaagtgatagatctcaggaccaggctcttcaagctcaaacttggaagagaggtggtatttctggtaaaaaaggcaatcgaggcagaggaagatccagagagtatagaagcaatcatggaagttctggaaaacaatctcagaacaatgaggaaaatgatcaatctgaatcttcttcaagaagaggaggatcacaaaattggcaaggaggtaagaagaaagttgatcgaagatttcttaggtgctttaattgtaacaagttggggcacttctcaagtgagtgcaaggcacctgctgattcaagaggaaaattcagtaatgaagccaatctt

SEQ ID NO: 54559 - DNA, 1143 bp, Glycine max
  Peptide Sequence Number=SeqID_171337
atgcagaatgagggactagattactcagaagtgtttgctcctgtagcaagaatggagacaataaggctattggtggctttggctagttggagaggatggaaactttggcagcttgatgttaagtctgcatttttgaatgggcctttggaagaagaggtttacattacacaacctcctgggtttgagcttaaagggagtgaggacaaggctcctagagcttggaacaaaagaattgatgcattcttaagcaaaactggtttcagaaaatgttctattgagcatggcttgtatgtgaagaaaagtgattctggtggaatattgcttatatgcttatatgtggatgatttactcatcactggaagtagtagcactgaaatagcagaaattaaaagatgtttgagcagtgagtttgaaatgaccgatctaggcaagttgtcatacttcctagtggaagcaaatttgaagcttggaagttgtgagcaggagacaaaggttgacaacactatgtttaggcagctggttggatgtttgaggttcttatgccatagcaggcctgaaatatcttttggtgtgagacttgttaacaggtatatgaagtctcctaggcaatctcatttagttgcagccaagagaattctcagatacctgaagggaacacttaatcatggagttttatttccaactcacttgccaaatcaaaaggaggatggtattctacatctagtagcatactctgactctgattggtgtggagatcgagtggataggcgcagtacaatgggttatgtgttcttccttggtgaagcaccattctcatggtcttccaagaagcaagatgttatggctttatcaacctgcgaggctgagtatatagcagcctgtagtgctgcttgtcaaggcttgtggattcagactttgattcaggacttggagttgaagactaaaggtgctattaagataatggtggacaacaagtctgctattaaccttgctaaaaatccagtttctcatggtagatcgaagcatatagaaactaagtatcatttcttaagagatcaagtcagtaaagagaagataaagctgcaacattgtggtactgatttgcaagttgctgatatattgactaaaccttttgaagattga

SEQ ID NO: 54560 - DNA, 1137 bp, Glycine max
  Peptide Sequence Number=SeqID_171338
atgttttatttacgattattaaggaggaagaagctaaacactttgtcaacctcatccgttattacactaagcgatcaaccaaccgtcactcttgccaccccaagtcaccgacatgtttccttacacacccatcaaaacgagtttaacgataacaacatcattgcctcgaacaaactcatcaccttcgttctgtgcggtgacatagattccgttgttcgtgtgtttaagaacatgaaagttaaatccaccgttgcgtggaactctatcctcgccgcttttgccaagaaatccggcaacttcgaatatgttcgccaactgtttgagaaaattcctcaaccaaacactgtttcttataacatcatgttggcgtgtcattggcaccattttggtgtccataatgcccttggcttgtttgacagcatgcccgtgaaggacattgcttcgtggagcaccatgatttcgggaaaaatgcgtctcctggagtgccatggtgtctggatatgtggcttgtggggatttggggagtatttttgtgctgcgcccgtgaggagtgtgatcacgtggactgacatgatcactgggtacatgaagtttgggagggtagaattggcagaaaggttgttccagcaaatgtcaatgaggatattggtgacatggaatactatgattgctgggtatgttaagaatgggagggcagaggatgggttaaggctattcaggacaatgttagaaactggggttaagcctaatgctttgagcttgactagtgtcttgttgggttgtagtaatttgtctgcattgcagctgggtaagcaagttcatcagttagtttgtaaatctcctttgagtagtgatacgacggcagggactttgttgtttagcatgtattccaagtgtggggatctaaaggatgcccggggattatttgttcggattccacggaaagatgttgtgttctggaatgcaatgatttctgaatatgctcaacatggggctggcgaaaaagctctttgtttatttgatgagatgaaaaatcgaggcatgaaaccagattggattacttttgttgcagtattgttagcatgtaaccacgcaggattggtggatcttgggtccaatattttaacacaatggtaa

SEQ ID NO: 54561 - DNA, 168 bp, Glycine max
  Peptide Sequence Number=SeqID_171339
atgggttctgctcctgcagggattactggtaagcttgataatgtgcagtcagacaatactactattgaattgatggagcaatgccggcaagctcttcaccttgaagttgatttgatcatcatacacagaaaggaatattgtgctagagattcagaaaagtgcgcttaa

SEQ ID NO: 54562 - DNA, 588 bp, Glycine max
  Peptide Sequence Number=SeqID_171340
cgattatttgttcaagcttttgctgattggagattctggtgtaggcaagtcatgtcttctcctgaggatgattcataccttgacagctatatcagtaccattggagtggactttaaaatccgcactgtggagcaggatgggaagactattaaacttcaaatttgggacactgcgggtcaggaacgtttccggacaatcactagcagctactatcgtggggctcatggcattattgttgtttatgatgtcactgaccaagagagcttcaacaatgttaagcagtggctgaatgaaattgaccgttatgcaagtgaaaatgttaacaagcttctagttggaaacaagtgtgatcttacggcaaataaagttgtgtcctctgagacagcaaaggcatttgctgatgaaattggaattcctttcatggaaactagtgctaaaaatgccaccaatgttgaacaggctttcatggccatggctgctgaaattaaaaacagaatggcaagccaaccagtgaacaatgccaggcctccaacagttcaaattcgaggacagccagtgaaccagaaggctggttgctgctcgacttag

SEQ ID NO: 54563 - DNA, 243 bp, Glycine max
  Peptide Sequence Number=SeqID_171341
atgatttctcttccttctatagctgagatgtacttagttgcagagtcacaatctccacaaactctcaagtttttgaacatccagattggaaccactagtggggtagctttagaagtccaaatgcaattgccaacttgtcactgccataaaagaagccgttctttcagatcctctcccaaatcatgcaaattcaagatcaggaacataaccagccagcttcattttcttctccaagtcatttag

SEQ ID NO: 54564 - DNA, 253 bp, Glycine max
  Peptide Sequence Number=SeqID_171342
atgtttcattctgcaaattctcttgcatcatgtggaaataatttatctaataatgaggcgaaaccgccaagaaatgtaaacaatttacatggtgatgaagatgaagatgatgatgatgatgatgattatcttgtgtctaactcatacattgaagagtctttagaagaagatgatagtgttgacggtatatctgattcagacgatgaagtcactgacatgattcaacaagtaagaattgtcacccaacagaaag

SEQ ID NO: 54565 - DNA, 474 bp, Glycine max
  Peptide Sequence Number=SeqID_171343
atgcccaagaatcttctatttttcgcacttggtcgtacaaggttatatattatggacaagctaagccaatatgaacgtctgttcaaccaatttgatgagaatggagatggcaagatatcggcgtcggagctctggcaatgtgtggaggccatgggcggggagttgtcggagaaggacgcggaggcggcagtggcattgatggactcggacggcgatgggctggtggggtttgatgattttctgaggtttgtggagggagggaaagaggaagagaaagaggatggcttgaaggaggcttttaagatgtatgagatggatgggagtggttgcatcacaccgaggagtcttaaaaggatgcttagtaggttaggtgaatctaggagcatagatgagtgtaaagttatgatagctagatttgatcttgatggagatggggtgcttactttcgatgaatttaaggtcatgatgttgtaa

SEQ ID NO: 54566 - DNA, 435 bp, Glycine max
  Peptide Sequence Number=SeqID_171344
atgaatcatcgtagggggtattctgctgttgtagttgtcaaggaatccatttatatgattggaggagttaaagtgtgcgagaacattgtagatacggaggagtataggaggacggagaggatggcggccatggagccgtggaggtatgagcttatcaagatgaatcattttaggggattatcacttggtattgttaagctattctctaagcagaggcattgcaatccttctttgcctccttgtaagttgatttttgtgcttctgttgggctgtcccctaattcttgagtgccacctttcacaattttcagcacctcttggaaccagagatgaccttgtgactaatttctcaaagttcttgccatcaagaagaggcatgttggccgggaaagaactattagagcctagaactcttgtcattgtgaaattcaagtga

SEQ ID NO: 54567 - DNA, 420 bp, Glycine max
  Peptide Sequence Number=SeqID_171345
atggagtctgaaggaatattggagaatggttgcatgtggagagtttgcaatggcagaaatatccatgtattgtgggataagtggattccaaacatccctggtgaacatattcttgaagatgaagaacaatatgttaaagaggatatgatggttcacaagatttttaatgaggaagcaggtttgtggaacaatgacttgcttgataatttgttttctcccccacatagtgacttgcatcaaagtaatcccgagaactttgaggaagaacacaagtacaagcctgggatgattgtcagcaactctcaaggggaagttatggatgttgcgacaaagttcttggagtcagagctcgggtccaaggttcgtgctgttctggagagagctacaggaggagttgagaaggctttacttggcgtttga

SEQ ID NO: 54568 - DNA, 279 bp, Glycine max
  Peptide Sequence Number=SeqID_171346
atgactatcgcaaataacattaagacatttatccccaagaccgaaaatgctaaagaatttatcaggaggaaacaaggcttaagatcaaggaaatcactcagtccattgtgtaaaccaccaagggaatcaaggcttaagattaaggctggaaagaaatttaccaagaagcatgataagggcaaaaagcaattaaagatcattgaagcattagtgcaaattcagaagaaagcatcaaagagcaataattgccacttctgtgggaaagctggacatttttag

SEQ ID NO: 54569 - DNA, 153 bp, Glycine max
  Peptide Sequence Number=SeqID_171347
atggaaaagccacgaaatgtatgcaagaggaaggaagaacagagggactactcaacgctctatttggagttttgtagtgtcctctacgccttgcacaaggcaaatagttcaagtaagcacaaaattcaaaaattagctacaattctcaattaa

SEQ ID NO: 54570 - DNA, 543 bp, Glycine max
  Peptide Sequence Number=SeqID_171348
atggtctatgggaaagcctgtcatttaccagtggaaatggaacataaggcatactgggccttaaaatttctagattttgatgatgttctatcggcgaagaagagaaagcttcagctcttagagctggaggagataaggttgaatgtttatgaattgtccaagttgtacaagcaaaaggtgaaagcttaccatgacaagaagctattgaagaagaatttccaaccaggccaggaagtcttacttttcaattcaagactcaatctatttccagtcaagttgaagtccaagtggtctggacctttcaccatcaaagaggtgaagccttatggagcagtggagttgatggatcctcaatcaaatactcctaagagaagttgggtagtgaacagtcaaaggttaaaactgtatcatggtggcagcattgaaagtgtagattttgttatagttgatactgctaggatagaagagtggaaaggagtgaacttcaggaatggggttgatcacaagtttgttggaaatctcgctggatcagataagtcttag

SEQ ID NO: 54571 - DNA, 726 bp, Glycine max
  Peptide Sequence Number=SeqID_171349
atgtggcttgtgaagcccctgagcttggacaagtgttgtccaaactgcttctatcaagttgttcgtgatagacatgtctttggcgtgtcaagtaagacgtgtgtggcacatgcacagtactcttgcatatgtgtcactaaaggagtggcacgtattggagacgtggtgcataaacctgtaggactcaccaagggaaaaccttgggttttgcgagccctttggagaatcgaccaaggaattgtccgacttgggttttgggcgccatgctcttgcatacatgtcacttcatggagtggcacacatggtgttgagctcttgcatatgtgtcacttcatggagtggcacatactagagatgttgtggtgtgctcttgcatacgtgtcactcgtggagtggcatgtactagagatgtggcatgctcttgcatacatgtcacttcatggagtgaaacacactagagacgttgtggtgtgctcttgcatacgtgtcactcatggagtggcacgtactggagacgactcattaagggtggacattgggtttgacaagcttataggccttactaagggtggaccttgggtttgtgcagcgcatgctcttgcatacatgtcacttcgtggagtggcatgtattggaaacatggtgcatttgggagaaacatggtacccatctaagctagatcttgacgagtattcaaaccattctttgtcttgccttaaatgttaa

SEQ ID NO: 54572 - DNA, 775 bp, Glycine max
  Peptide Sequence Number=SeqID_171350
atggttaaagtgatcctactcacattaggcctagtgctcaggtggttttggccaatagtgggccaagaaatattgaatggtgatgtagggggagggttccgaggaatacaaataacctccggtttttttcagatttggagagcatctggaataactagtgaattacaactctattgtaccgcaattggtgcattggtctttgcagccttaatgctttttgctggttggtttcattatcacaaagctgctccaaaattggcttggttccaagatgtagaatctatgttgaatcaccatttgacagggctcctggggttgggatctctttcttgggcaggacatcaaatacatgtatctttaccaattaaccaatttctaaatgctgcagtagatcccaaagagattccacttcctcatgaatttatcttgaatcgggatcttttggctcaactttatccgagttttgccgagggagcaactccctttttcaccttgaattggtcaaaatacgcagaatttcttacttttcgtggaggattagatccagtaactggaggtctatggctgaccgatattatacaccatcatttagctattgcaattcttttcttgatagcgggtcacatgtataggactaactggggtattggtcacagtataaaagacattttagaggcacataaaggtccatttacgggccagggtcataaaggtctatatgagatcctaacaacgtcatggcatgctcaattatctattaacctagctatgttag

SEQ ID NO: 54573 - DNA, 339 bp, Glycine max
  Peptide Sequence Number=SeqID_171351
atggccaaccatataattcacagcagagacaatggcaaaatcaccctggagagcatagagtctgccattaagaatctggaagtccaagtgggccaactcgcaaaacaattagcggataggccgtcaagtagctttactgcaaatactgagaagaatctgaaggaagaatgtaaagttgtaatgacaaggagcagaatggaaattcaggctgatgaaggtagagctgaagagaaggtggagggatataaacaacaactggcagctgagccggcactggaactagtttctgactttgttgaacttgaggaagttgtggaagatgaagatgaccaacagtag

SEQ ID NO: 54574 - DNA, 405 bp, Glycine max
  Peptide Sequence Number=SeqID_171352
atggtggataaggcagttggtggtcgtggtttggtgatatggtctgtgtttgtggtggttgaccattggtatatggtcaccaattccttaatgtttattcgcagtcgccaacattttgaatccacgctccattcacaaatcaaagattttgcttcagaaacgcctcaaaatgtattgggtgctgcatttgttggtttaaaatgggtgattaaagagccttcacttttgggattgagcaaattccagaggcttcttgtacatgcttctgattccaatttaaacgatggcttggaagttcatccaaaacaaagtcctagtgtgcccgttactacatttaatggggtgaaaccttttcatggtaaatcaagttccatctcttttagtggcttgacacataatctgtag

SEQ ID NO: 54575 - DNA, 486 bp, Glycine max
  Peptide Sequence Number=SeqID_171353
atgaagagaatgatggaaagtaacacgatcgccactagggccgccgctggggcagatcttacccatccctctgccacgaatcaagcacatcaagctgtcccgaacatggtaggacaagaaggagaggtgttgggtagcaccagtagcccacagatggagtataatagaaatgcttacccctacggcttaccccccaattatacgccacccaccatgcatgagaatgttcatcatgccattctcgttaccttcgagggtcaacaaacccagcctgcaggcggcccttgtgaagaacctcgggagcatgctcaagatgttgtcatccctccaaaattcaaggtgctagattttgatagatacaaggggaccacttgccccaaaaatcacatgaagatgtattgctggaaaatgggtgcatattctagggacgagaagccattgatgcatttcttccaagatagtttgaccagagcagtagtcatctag

SEQ ID NO: 54576 - DNA, 489 bp, Glycine max
  Peptide Sequence Number=SeqID_171354
atggtagcgggtgctggtgataatgattgtagttgtgatgacggtcatgacatttgtgacgaaaatgattatgattgtgatggtggtcatagtgataataggtgggatgatgcttattataatattgtggaaggatctccccatcaagatcacaaggatagctataaggctggatatgacactggttatcaacatggttatgaaaacactaaagttggtaatgctctttgggtcaagacagcaacagaagtttcaatgaggtccttcaatggtgattttccaccatgcagatgcagcagaaggcaaaggagaagaggaaatgggaagcaccatccactagggaataagccatggaagaaggagcttcaccatcaagaatgtgccttggataagaaccttgaaaaggatgctttaatggaggaaaagaaaaagagaaggggggagcacgaaattgaaggaataaaagagggagagaagtggaactttgaa

SEQ ID NO: 54577 - DNA, 588 bp, Glycine max
  Peptide Sequence Number=SeqID_171355
atggcttccatgatggaagccatgctaagcatgagaaggttaatacaagttaacgcagctgcatctgccgttgccagcatcgccgctgaggcggatccggtcctttcgtatgcaacgaatcatgcacaccaactcgccccggatatggtgggacgaggtggagacacattgaggagtaccggtggcctgcatctggggtataacagaaatgcttacccctacggcttaccccccccccccaatttcacaccgcccaccatgcacaataacatggatcatgctgttcccattaccttcaaaggtcagcttcctcagcctatagggggcgtccgcgaagagcctagagagcgtcgcaacctacccttcggcgggagagagacgcagggctcacaggatgcgtcttccaagggaggatggcgcgcagagtcgccaccaacgtttattcgaggaaaacgtcaaaaaattcaaaacgtgtggtctacgaactttaagtgtgaaaggttcaggagttgtttttatgcacggggaagggtgtttccctcgctcctacgtatcctcaattgcgatgaggaaatcagacctacgtag

SEQ ID NO: 54578 - DNA, 678 bp, Glycine max
  Peptide Sequence Number=SeqID_171356
atgagggatggtgagtaccctgacttccaggaggaggtagctcgcaggcgttgggcaccacttgtgacccctatggctaaatttgatccagagatagtcatggaattctatgccaacgtctggtccactgaagaaggagttcaggacatgcgctcatgggtgaggggccagtggatcccctttgacgcagatgccctcaaccaattcttgggccacccgttgatcttggaaaaaggtatggctcctatgaggcatcccttggacccaaagaagtccaacaaggccctagggtttccaactatgatcacgggcctctgccaattctacagagtgcccgttacacctagcaaggtcatccgacctcctatcaccagagccttcatcaagaagtactgcactcctaggcaggcacagggcgaggaaccccagcagcaggtagcagacgcaccgccgccacctcagcagtccacctcggctagtctacagagcgtggagcattacctgcggcatgtggtttgccagcaggcggccaaccaccagggacaggtgtggctgcatgagtacttctaccagtacactctcagccagcagggtcagggttccacccctttcatatgccctacttcggagcagtttggagctgcgattgcatggcctggagactggcccgatgcttag

SEQ ID NO: 54579 - DNA, 3348 bp, Glycine max
  Peptide Sequence Number=SeqID_171357
atgggggacatccctttatccctgaaccgttggccaaaccaacaccctgacatacatcatgtccagccttctgctatccagactcgtgagttcggtagcatgtggagatacccaagggttatccatacacacatttctgccatccatacccgtgagtcaggtggcaggcggagatacccgagtggttatccgtacaaacataattctgctatccagaaccatgacatgcgaagatacccaagggttatccgtacacacagttatgctacccaaactcgtgagttaggcggcaggcgaagatacctgagtggttatccgtacaaaaaaaattctgctttccagacccatgagtcaggtggtaggcggagatacccgagtggttatccttacaaacacagttctgatatgcagacccgtgagaggagatacctgagtggttatccatacaaacacagttctgctatcgaaacccgtgagtcaggcggcaggcggagatacctgagtggtcatccgtacaaaaaaggttctgctatccagactcgtgagtcaggtggcaggcggatattctcgagtggttgtccttacaaacacagttcttctatccaaacccgtgagttaggtggcaggtggagctacctaagggttatccgtacacacagttctggtaaccagacctgtgactcaggtggcaggcggagatacccgagtggttatccgtacaaacatagttctgctatccacacccgtgagtcaggtggcaagcggagatacccgagtggttatccgtacaaacacagttttgcaatccagaaccatgagtcaggtggaaggcggcaataccttagtggttatctgttcaaacacagttctgttatccagacccatgagtcaggtgacaggaggagatacccgagtggttatccttacaaacatagttatactatacagacccatgagtcaggtggcaggaggagatacctaagtggttatccatgcaaacacagttctgctatccaaacccgtgagtcaggcggcaggcggagatacccgagtggttatccatacaaaaaaggttctactatccaaattcgtgaatcaggtggcaggcggatattcccgagtggttatccttacaaacacagttcttctattcagacccgtgagttaggtgacaggtggagatacccaagggttatccatacacacagttctgctacccagacctgtgactcaggtggcaggcggagatacccaagtgggtttccgtacaagcacagttatgctatccagacccgtgagtcaggttgcaggccgagatacccgagtggttatccatacaaacacatttctgcaatccaaacccgtgggtcaggtggcaagtggagatacccgagtggtcatccatacaaacacagttctactatccaaacccgtgagtcaggtgttaggcggagatacctgagtggttatccgcagagatacccgagtggttatccgtacaaacacagttctgctatcctaacccgcgagtcaggaggcaggcagagatacctaatggttatccgtaaacacaattatggtatccagacccatgagtcaggtggcaggaagagatacccgagtgcttattcgtacaaacacagttttgctatccttacccgtgagtcacgtggaaggcggagatacccgagtagatatccttataaacacaattctgctatccagaaccatgagtcaggtgacaggcagagatacccgaagggtgatctgtggcaggcggtgataccgagtggttattcgagcaaacatagttctgctacccagacccgtgagtctggtggcacgcagagatacccaagtggttatccttacaaacacaattatgctatccagacccataactcaagtggcaagcggagatacccgagtggtagcatgcgtagatacccaagggttatccgtacacacagttctgttgttcagacccgtgagtcaggtggcaggctgagatacccgggtggttatccgtacaaaatagttcttctatccagacccatgaatcacgtggcaggcggagatacccgagtggctatccgtaaaaacatagttcttcaatccagacccgcccagatacccgagtggtcaggtggcaggcggagatacacaagtggttatccgtacaaacacagttctggtatcaatacccgtgagtcaggaggcagacggagatacctaagggttatccgtacacacaattctgctatccagacccgtcagccagagatacccaagggttatccgtacacacaattctactatctagacccttctgctatccagacccgtgtattaggtggaaggcgaagatacatgagtgggtatccgtacaaacacagttctgttatccagacccggaagtcaggtggtagccggagatacctgagtggttatccatacaaacactgttctgctatccagacccgtgagtcaggtggcaggaagagatacccaagggttatccgtacacacaattctgctatccagacccgtgagtcaggtagcatgcggagatacccaaggacacgtgagtcaggtggcaagctaagatactcgagcggttattcgtacaaacacagttctgttatccagacccgtgagtcaggtggccggcgaagattggcaagtgattatccttacaaacacagttctgctatccagacccacgagtcaggtggcaattctgctatccagacccgtgagtcaggtgacaggcgaagatacccgagtggttatccgtacaaacacatttctgttatccagacccgtaaatcaggtggcaggcggagatacctgagtggttatccgtacaaacactgttctactatccagactcatgagttaagtggcaggcagagatacccgagtggttatccgtacaaacataattcagctaccctggctcgtaagtccagtagcgtgcagagatacctaagggttatccgttcacagaattctgatatccctgctcgtgagtccggtagcttgcggagatacccagatagccttgtggttatccgtatacagacaattctactatcccaacccgtgagtcaggtggcatgcggagatacccgaggggttatccatgcacacaattttggtattatgactcgagagttcgatagcatgcggagatactttagggtcatccgtacacataaatccattattgcgactcaagagtctggtagcatgcagagacaccttttggttatctgcgcacttgcttttcattattccaaggctgtcaaagtccttttatcatcccgagacaagcaagtccagtga

SEQ ID NO: 54580 - DNA, 249 bp, Glycine max
  Peptide Sequence Number=SeqID_171358
atgacatgccatagggactctgccaactacaatggcttcacaaatggaagtctaagccacaactacattacaagtgatgcaatccacccaaggaagggacccatcacaagagccatggctaagagacaccaagaagattgggctagagatgcaggtgttgagaattttggcaagtgtaccaaatcgttctcaagtagtataactcggaagtccgaatattgtttccgcagggactttattgcactttga

SEQ ID NO: 54581 - DNA, 948 bp, Glycine max
  Peptide Sequence Number=SeqID_171359
cgtgatgtcgtgacatccggtacgacatctgtcattggtatcagaatttcatccttcacgaccagactaggtttcgactgcaccaacaacatggtcgaatacgaggcatgcgccctcgggatcgaagcagccattgacttcaatgtcaagtcattcaaggcttacaccaagaagttggccgagttcttcgatgatgtctctttccatcacatccctcgagaggaaaatcaaatggccgatccgcataaagacttgtcgtacattgagttcaaatgtcgcggcaagcctgcacattgttgtctaatagaagaagagaaagatggtgaaccttggtttttcgacatcaagcaatacgtcgaaatcaaggaatacccaccagaggctttcgacaacgacaaaagggctttaaggaggttggaggctgagagaatgatactggaagtccatgaaggctcctttggaacacacgttaatgggcatgccatggctaggaagattttgagggcgggctattactggctcactatggagagcgactgttgccatcacatgagaaaaagtcataagtttcaaacgtttgcgaacaacgtcaacgctcctcccatgcctttaaacgtcatggcggtgccatggcccttctccatgtggggaatagatgtcatcggggccatcgagcccaaagtttcaaacggacatcgcttcatcttggtggcaatcaactactttaccaaattggtcaaagccgcctcatactccagtgtcacgagaaatgtggtagtcagagggcaagcggctgaccgctatgagccacgggcgtctgtaccagaaacagggtcgttcgtcataaagaaagccttctccggaggagccctggtgctcgccaacatggatgacacagagttgctctcgcctgtgaacgccgatgtcatcaagcgatactacgcttga

SEQ ID NO: 54582 - DNA, 285 bp, Glycine max
  Peptide Sequence Number=SeqID_171360
atggcagaaaacaaaagcaagctagcaagccagttgcaacatcattttcagcctcattcaagtactctaagaattgcaaccaataatcatcctacagagtgtgtcacaacctacccttcggcgggagggcgacgcgtgactcgcgagatgcgtgttccacgaaaggaatacgagcggagtcgccaccaacgtttatttgaggaaaacgtcggaaaaaccggaaaagacgtgatctacgaacttgaaaggttcgggagttgtatttacgcacggggaaggtattag

SEQ ID NO: 54583 - DNA, 654 bp, Glycine max
  Peptide Sequence Number=SeqID_171361
atggccaaagtcctcatcaacaatggctcaagcttgaatgtgatgcccaagagtatgttggagaagctgcctttcgatgcctctcgcttgaggccaagctccatggtagttcaagcattcgatgggagccatagggaggtgaggggagagattgatctcccggtccagataggaccctacacttgtcaggttacctttcaagtgatggacataagccctacatacagctgtttgctgggccgaccatggatccattcggtaggagtagtacccttgacgcttcaccaaaaattgaaattcatggtggaggggcttttggtcatcgtttcaagagaggaggaccttcttgtaagctgcccatcctctatgccctatgtcgaagccacagaggaatctctggaaacagccttccaatcctttgagatggtgagtaatgcctctgtagaatcccttccaatgtgtcctcacatgcccaatgcggcaatcatgccgaggccaccagtggaggaggcccctccttgtcacctcaacaagagctttgtcagtgcaggcctgaggcgcaaaaaggaagttgccatggtgcacgatgaatccccatggggacatcctgactgggtgcaaccatgtcctcctggatttcagctagggaactag

SEQ ID NO: 54584 - DNA, 933 bp, Glycine max
  Peptide Sequence Number=SeqID_171362
atgcagagccctattgtgcccccgcccttcgacaagaatctcctcctccacgaaggtaaggtagttattggcggtaatgttgctgactatcccctcaaaatcttccacgaagatgtcttgggccatcctcctccgctgacacctcctttttgctggacccctctttcttctcgacgaacctccctgtcaggacgtcctcctccagagcgggggtcgcattgctggccagttcttcaacctcctaggcttttcccttggtactggtgggccgcgctagcaagtcagggaaagggggcaggtccgctgcctgatgccatgggagtgccttggggtttccccatctacggactgcatgtagacatgctggtcatccccgttccagtcattgacctcaagctggccaagatccatcatccgctgcagggaaccacgcctgcctcttgtagggcttcaaagataaacctcctcgaggtcatgccgtctcccaaacgattaggtcgttgtgacctacatatctccactgcattcatagtcggccctccgtggttggcaagcattgctcgatcgagtgccccagggtccctccgtggtacgcgcaggtggcattggggttataccacttcgggaagggagattggtaaatttttctcggggtcaccaccgccaaaaggccgaggctgggctggagccggagtcgaaggagggccccttggtggtggtgtgggtgcccttgtgtcgcaacctacccttcgacgggagggcgacgcggggctcacgggtgcgtcttccaagggaggaagtgtgaaaggttcgggagttgtatttacgcacgaggaaggtattagcacccaacgcgtttgtcacaagggacgggcttttgctcctaggtatcctcgattcgtgatgaggaactcagacctacgtagttcttga

SEQ ID NO: 54585 - DNA, 1074 bp, Glycine max
  Peptide Sequence Number=SeqID_171363
atgcaaaaattagggaaggtcggtgtatactgtcatatagagattgttgttttccctgtttacctcatggagctgatggtggcaagcgaaaataccgaagtggttatccgtacaaacacagttttgctaatccttacccgcgaaaatacgcaagtggttatccgtaaaaacacagttctgctaatcctggcctttgtatcaggtggcaggcggagatacccaagtggttatccgtacaaacacagttcggctaatcctgacccgcagaaatatcgcagtggttatctgtacaaacacagttatgctaatcctgacccaaatacccaagtggttatccgtacaaacacagttctgctaatcctgacccgtgagtcaggtgacaggcagaaatgcccacgtggttatccgtacaaacacagttatgctaatcctgaccctcgtgagtcaagtgcagacggtgataccgaagtggttattcgtacaaacacaattttgctagtcctgacccatgagccagttggcaggcggagatacccaagtggcggagatacccaagtggttatccgtaaaaacactattctgttaatcctaatctgtgagtcaggtggcggagatacccaagtgattatccgtacaaacacagttctgctaatcttgacccttgagtcaggtggcaggcggaaatacccaagtggttatccgtacaaacacaattctgctaatcctaacccacttcaattgctcgctttagaaagcttaacacccatcgtcgcgagttctgtgatgaaacttcctgaggaggccaccagcttgccgaggcaagctgagctcgcccgggtgagctgggcggcaagcacctcgccccaatttgttgaaaacgggaagcttcttgaggaagccaccaactcgcctgggcgagctgggcgacaacctcctccccattttgtctataaaaaggggaagaaggctgagtttcaaggacccctgacctctatgcttgattccgtgaaggttctttgccgttcttcgtccgttcttcgttcgttcttcggtcttcaaccgataagtttttga

SEQ ID NO: 54586 - DNA, 633 bp, Glycine max
  Peptide Sequence Number=SeqID_171364
atgatgggggaaatgtgcgaggagtttaaaatccaacatcacaattccacgccctaccaaccaaagatgaacaaaaccgtggaagcagccaataagaatattaagaaaattattcagaagatgacagtgtcgtacaaagattggcatgagatgtttccttttgccctgcatgggtaccgaacctcggtacgaacttctactggggcaacaccgtactccttggtttatgggatggaagcggtactctcgtttgaggtagaggtcccttcccagaagatactagcggaatcgggcctagaagagtcagagtgggctcaaacacgccacgaccaactcaaccttattgaaggtaagcgtttaacggccatgagccatgggcacctgtatcaacaaaggatgaagaacgcgttcgacaagaaggtgcgcccgcgcaagttccatgagggggaccttgtgctgaaaaaggtgtcccacaatgttaaagatagtcgagggaagtgggccccgaactacgaaggaccttttgttgtaaaaagggctttctccaaaggagccctagtgctcacaaacatggatggcgaggagctaccttcacctgtgaactccgatcttgtcaagcgatactacgcttag

SEQ ID NO: 54587 - DNA, 2070 bp, Glycine max
  Peptide Sequence Number=SeqID_171365
atgggcacagtagaaatgatcattgcatttcacatgaaggctttggtctttttcctttggctgtttgtcccctcattgggcaaagacttgctaagctgtgagacaacttcacctgatgcctctggctaccattgcattgaaaatgtgtcacagaaccaatgtgagacatttgcactctttttaacaaactcttactactcctctctctccaacctcacctcttatttgggactaaacaagtttgtcatagcacaagcaaatggtttctctgcagacactgagttcctctcccaggatcagcctctactggtacctattcattgtaaatgcataggtggcttctctcaggctgagttaaccaaaactaccgtcaaaggagagagcttctatggcattgctcaatcactagagggattgacaacttgcaaggctattagggacaacaaccctggtgtgtcaccttggaatcttgatgacaaagtgagattggttgttccattgagatgttcctgcccattttcatctcaagttagaccacaaccaaagcttctgctttcttatccagtaagtgaaggtgatactatttccaatttggcctcaaagttcaatattactaaagaagctattgtttatgctaataacatatcatcacaaggccttaggactagaagtagtcttgcaccctttacctctattctcattccacttaatggtaagcctatcattggtcctttggttaagcccaaggaacccgattctggcaatcaaacaaccagcatcccagtgacaagtccacacaagaaatcaccaatgtggaagactgaattgtgcattggcctagctggggttgcacttggagtctgcattgcttttgctgccgcctttttcttcatcagattgaaacacaagaaggaggaagagaattcatgcaaagaaggggacttggagctgcaatatctgaaccaaagtgtgagaaccacctcaactagtgacaagaaagtttcatttgaagggtctcaggatgctcttgatgtgaaaatcgtggacgccctgccgcggaagttgttgctggatacatacaccattgaagatgtgagaaaagcaactgaagatttcagctcaagcaatcacattgaagggtcagtgtatcacggtcgtctgaacgggaagaacatggcaatcaaagggacaaaggcagaagtagtgtcaaagatagatcttggccttttccatgatgcacttcaccatcatcccaacatactcaggcttcttggaactagcatgttagagggggagcagcaagaagagtcatttttagtttttgagtatgccaaaaatggttcattgaaagattggctccatggtggattagccatcaagaaccaattcattgcttcctgctactgtttcctgacttggagccaaaggctcaggatctgccttgatgtggccggtgccttgcagtatatgcaccatgttatgaatccaagctatgtgcatagaaatgtaaagagcaggaacatctttttggatgaagaatttggtgccaagatagggaattttggtatggcaggttgtgttgagaatgacactgaggaccctcaattctattccaccaaccctgcctcttggagtcttggttatttggcacctgaatatgtgcaccaaggtgtaatttccccaagtgttgatatctttgcttatggggtggttttgttggaagttttgtccggtcaaacacctataagcaggcccaatgagaagggagaaggaagcatttggcttacagataaaatcaggtccattttggtgtcagaaaatgtgaatgaactaagggattggatagacagtgcattgggggagaactattcatttgatgcagctgtgacacttgccaacattgcaagagcttgtgtggaggaagattcctctttgagaccaagtgcaagggaaattgttgagaagctatcaagattggtggaggaattaccacaaggggaaaatgacatgttaatgtgtgaaagctctagcaaacctctggtgaaggcagtggaaaacaatgttgaataa

SEQ ID NO: 54588 - DNA, 561 bp, Glycine max
  Peptide Sequence Number=SeqID_171366
atggttacaaatcctcttgattatgttgagcccttggcaaaagctggtgcttctggttttacatttcatgtagagacatcaaaagcggtaaagttgtgccttggtgacttgttggtcatgggttcgaatccggaaacagcctctttgcatatgcaagggactggagataactgggaagaacttatccaaagaatcaagtcacatggcatgactcctggtgtagcattaaagcctgggacccccattgaagaggtttatcctctggtggaagccggaaatcctgtggaaatggttcttgtgatgactgtagaaccgggattcggaggacaaaaatttatgccagagatgatggataaagtacgtatacttaggaagaagtatccatcacttgacatagaggttgatggtggtttagggccttcaaccatagatgtggccgcatcagcaggggcaaactgcattgttgctggaagttcagtgtttggtgcccctgagccagttcaagtaatatccttactaaggaattctgttgagaaagcccagcaaaccttgatacagtaa

SEQ ID NO: 54589 - DNA, 903 bp, Glycine max
  Peptide Sequence Number=SeqID_171367
caccgtcagtggaacaagaacctcacgcgccaaatggagaaccacatcgatatggaactagttaaggagttttactccaacccatatgatctagaagaccgttcccccaggcagtgcaaagtgagggggaatactataaagtttgacgctgctacactgaactcattcttggagaccccagtgggggctccttggaagctactgagaaatgacctgaccaccctcgctcagacctggagtgtcatttcttactccaaccttgctcccacttctcatacctctgaccttaatatggacagagcaagaggagttgtgtccgattctttgacattcaagtctttgagcctgaccattaatttggcttacatttggaagaactattggaaccttgaggatccctctatcacatttccagggtcctgcaaggccaaggcctgggctccattagatgcaccagctccacctccagcaccatctctagtcggtccttccatgtccaacaatgaccagatcgtcccgatgctgcaaagtattcatcatggacttttcctggtgatgcagagcatgcaaaacttatcccaacagcaaccaatcatgtctatgcaggagtatttagagcaggaggatgaggaggctgttgaggataccctagaggctcaggaggctaagaaggatacaagtgcagcagaggcggatgtggacactgattatgtaacagacggctcgctcagcgaggcagattggctaagcgaggctcatccgcttagcgaggaagtcagctcactaagcgagtacaaaatcctagagaatgttgagtcagaaagcagcatgtttagcgtgcagccagcccgtccagcgaggatgttgtctcttctcgtgcttagtgcgtccaagcctgcttag

SEQ ID NO: 54590 - DNA, 219 bp, Glycine max
  Peptide Sequence Number=SeqID_171368
atgacatctaatacccactgcaaagaggtgagcaccgtgattttccagggagagatccctacagtacaatttgtagtgaatggaacccaatataacatggggtactttctagtagatggttgtcgcaacctacccttcggcgggagggcgacgcgtgactcgcgggatgcgtgttccacgaaaggaatacgcgcggagtcgccaccaacgtttatttga

SEQ ID NO: 54591 - DNA, 168 bp, Glycine max
  Peptide Sequence Number=SeqID_171369
atgttggaaatcaaaaagaggtccaacgcctttaatgatcaccttttaagtaaaaaagaatcacttgataagaaagaactacgtaggtctgatttcctcatcgcaattgaggaatacgtaggagcaaagggaaacacccttgtcgaccacaaaaagagaaaaatataa

SEQ ID NO: 54592 - DNA, 327 bp, Glycine max
  Peptide Sequence Number=SeqID_171370
atggtgggttacacaccttcaagttttacagatttggtcttcgccagcaaaaggatcgaagtgggtctgaaaagaggcaaattaggtcatcctgctttgataaaaacaggggcaaatgaagaggatgagaatgagggagaaacccatgccgtggctgccattcctatatggccaaccataaccctagccaaggttcatcaacctccatttctccgagaatacgacttgaacgcaacgtgtgcttgtcacggagaagccctggggcgttccattgagcattgtagggctctgaagcataaggtgcaaggtctaattgatgctggctga

SEQ ID NO: 54593 - DNA, 312 bp, Glycine max
  Peptide Sequence Number=SeqID_171371
atgaccctttcatcatggcagaacaagctaaacaggccgatggctactccacccagctttcctcctcttcctcctcctactgaagcagcatcacaatcactgtctaccttgaagcggacaagaaaagccacacggctaagatcattggcgactagaccagttggggcagacagaccgatggtccacgttgatcctgcaactgggaaggccgacggtccccacaagaagaaattaagaacatatttggggattgtcgctcgtgataaggtcgatgtaacatacgagaattggaaggaagtccttgctgcttag

SEQ ID NO: 54594 - DNA, 1430 bp, Glycine max
  Peptide Sequence Number=SeqID_171372
ggctacacaatctcgccttcagaggactacccgtcctcgccttcagagggctgcgcatcctcactttgggtactcgtaccctcaccttcagaggactacatgtcctcaccttcagagggcgacacaccctcaccttcaaagggctgcacgccctcgcctttagaggactgcacgtcctcaccttcagaggactgcacgtcctcacctttagagggttgcacgtcctcaccttgggtactcgtaccctcaccttcacaggactacacatcctcgccttcagagggcgacacacccttaccttcagagggctgcacgcccttgcctttagaggactaaacatcctcaccttcagagggctgcacgccctcgcctttgtagggctacacgtcctcgccttcggtgggctgcacgccctcaccttcagaggactacatgtcctcctcttcagagggctaaatgccctcgccttcagagggctacacgccctcaccttcagaggactacacaccctcgccttcagagggctacacatcctcctcttcagaggactacatgtcctcgcctttagaggactggacgtcctcaccttcagagggctacgcgccctcacctttagaggactatatgtcctccccttgaaaggactacacgtcctcgccttcggagggctacacgccctcaccttcagaggactacacgtcctccctttcagagtgctacacgtcctcgcctttagaggcctgcatgctgtcgccttcagaggcctgcacgtcgtcgtcttgaaagggcgacacgtcctcgacttcggagagctgcacgccccctcgcgtttagagggctacgcgtcctcactttcagccagtagtttccttttatcagctcctgggccacccccaccccctgatcctggaggagggccaactttgcaagcacaaccagaggaggaggctaacgcgcagctactgtgcatactagggcaagatttcacctgtgctgctgcaaagagacgagtgcggatcatgcacaccaacatgaccactcttacacagatatggatgacgttgctacttagcaacatttcgtccagcgaccataatgccgatctccccctgcggaagcataagttgacacccagtggacccggaggagttgaacagggccctggggttttcagctctggttatgggtctctgtcaatcctaccgggtgcccgtcccccccagcaagggatcgcgcccgcaagacacctagtggacccggagaagtccaatagggtcctggggtttccagctctgattacgggcctttgtcaattctacggggtgcccgtcgcccccaacaaggtcatcaggccccctattaactgggctttcatcaagaagtactgcaccccccaggcaggcgcagggcgagacaccacagcagcttag

SEQ ID NO: 54595 - DNA, 148 bp, Glycine max
  Peptide Sequence Number=SeqID_171373
atggccggtaaactgactgtcatcgtggcccagcggctgccattccgtgacgctggcgcgcagataacgctcatccgcccccggcagcagcggatagcgcaccgggatctggcaaatctgctcgctgccatcaaccagctgcacgcgc

SEQ ID NO: 54596 - DNA, 2063 bp, Glycine max
  Peptide Sequence Number=SeqID_171374
atgagccgtgataacagctcgcacaacgacggctatgcccagctgcatggcggtttccgcgcgcgtaaaaatcgcgacgcgctaaccgcgcgcgacaagctgcaatcctcgttactcgatcgtctgactgacaacgcgccggacaagcagagcgaagccagcaacactacgctgatttcccacagcacgctgcgccgccacgtgctgcgcgatctgcagtggctgttcaacaccatcaacaacgaagcccagcaggatctcagcgcctttggtgaagtgcaacgctcggtgtggaattttggcgtggcgccgctggccggacagaacatctccgacatcgaatggcaggatatgcagcgcaaaatgaccgatgccattctgcactttgagccgcgcattctgccgcaggggctgcaggtacgctgcgtcagcgatctgaagtcgctcagcctgcacaacgtgttatcaattgagatcaaaggccgcctgtggttaatcatggacagcaaactgctcgactactacaaccgcgaactggcctatctgcgtgagctgggcgcggagttcgctgcgcgctatccgaaagtcgccgggcggctggggatgcgcggcatcgaagttgccgacccttatgttgagcggctgatggagggctttgctttcctcacgtcgcgcgtgcagctcaaaatggacgccgaattcccgcgcttttcgcagcggctgctggagatgattgcgccgtcttatctgtcacctacgccgtcgatggcgattgcacagctcacgccggacagccgcaaaggcgacatcagcaatggcttccacgtgccgcgcggcaccatgatggagagccagcacctgaaaaaaagcggcgtcacctgcagctacaccacggcgcacgatgtcacgctgcatccgctgcgcatcagcgacgtttcactcggcggcgtgccgggcgatctgccgctgggcgaactgaagctcagcggtcgcggtgccgccagcgcgctgcgcgtgcgtatcgcctgcgaaggcatttcgtcgctcagccagttgaatgtcgccgatttaatgctgtatctcagcggcccggacattcaggcacagaaactgctggagctgctgatgcagcaccgcgtcggcatcgtgctgcaatcggttgaacagaaaccgctgcgccaggtgctgccggatgactcgctacagcaggaaggctttgcgccagagcaggcgctgctgccggacgatctgcgtaacttcgacggctaccggctgctgcaggagtattttgcctttccggcgcgcttccagttcatcagcctgagccagctggcaccgtttctgcgccgctgcgataacgcgcaggaattcgacattatcatcctgctggataaggctgacagcgcgctggaaagcgtggtggacagcagccatctggcgctgcactgcacgccggtaatcaacctgtttcccaaaacggccgagcgcctgaaggtcagcgacagccagcacgaatatcatctggtggtggataacatccggccgctggactacgaagtgcactcggtgcagcggctgttcgccaccgttgagggcaagcgcgaagagcagttattccgcccgttctggagcaccttcagcggcgacgacggcgattacggtgcctatttctcgctgcgccgcgagcagcgtacgctgtctgagcaggcgcagcgttacggcacgcgcaccggctatatcggctcggaagtgtttttgtcgctggtggatgaacatcacacgccgtggcgcgacgacatgcgctacctgtcggcagacgtgctctgcaccagccgcgatctgccgctgatgctgttgcagcaggagcagggcaatttcgtcatgccggattcgatcccggtcggtcagctgaaattgtgtaaaggcccgacgccgccgcgtccggcgctggccgaagggctctccgcgtggcgtctgatcagccacctgcagatgaactacctgagcctgatggacagcagcgacggtcagggcgctgccgcgctgcgccagctgctgagcct

SEQ ID NO: 54597 - DNA, 384 bp, Glycine max
  Peptide Sequence Number=SeqID_171375
atgcacctttactctttcttttatgcttcaaattctggccagggagaagtagagcaagagaagtttgattcatatgatgtacatttctatgcaccatcaagggaagagatagaagaagaggtgagaaaagaagggtcattgaagttggagaggctagagatgtttgaaatggacaagagtcacaatgagcatggaagtgatgagagctatggcacacaggttgctgtggcagttagggccattcaagaatcaatgatctcacaccactttggagaagggatcttggaaagtttgtttcagaattttgcaaagttggtagatgaagaaatggctaaggaggatattagaccaatctcttttgttctggttctcagaaaaatatga

SEQ ID NO: 54598 - DNA, 723 bp, Glycine max
  Peptide Sequence Number=SeqID_171376
aagaaggaatctgataaagtgaagcacataatcatacaaacagttgaggagctttaccttgcaaccactccaaagagcataggcattgctgatttgggatgttcctctggaccaaacaccctatcaatcatcaaagacatctttcaggccatccaaggcacaagccaaaggatcatgcaccactccacagagttcagggtgtacttcaatgatcttccaacaaatgacttcaattcaatcttcaaggccctcccagagttccaaaagttgcttaggcaagacaggaaaaatgggttcccttccattttcatgggaggctaccctggctcattttatggaagactgttcccaaacagttacttgcactttgtccactcctccttcagtcttcactggctttcaagggttcctccatcactctatgatgagcacaaaaggccattgaacaaagggtgtgtttacatttgtgaatcaagccctgaagtggtgtctcaagcatactatcaacaattccaagaagatttttccttgttccttaggtcaaggtcagaagaactagtagtaggtggaagaatggtgctgatatttttggggagaaggggcccagaacatgttgacagaggcaactctttcttctgggagattctttcccgttcatttgctattctagtctcacaggcgaaaaatgatttattagatactacttatgtggaagttctgtaa

SEQ ID NO: 54599 - DNA, 845 bp, Glycine max
  Peptide Sequence Number=SeqID_171377
gtgaagagaacaatttagtgcgaagagagtggaacaaagaggagaaacaaacaagcagtcgaagagggaaagcgaaagctaaaggaagagaaaaagctgaaaccaaagagggtggatgtgaggaacaaggaagaggaagagaagaaaatgaacaatctaatctggaagatatttcctactacgagagagcaaaagaagcagcaagtgaagctgccaaagagagaaacaagcaggcaaataaggaaaaatatgccacaagacaaaagggtcaacaatgcaatcttaaaatagaaaatgagacacaagacaatggaaagaaagattatggtggagccaaggacaccataaccactgtggaccacattactacaccacttgatgtaaagaccaatcttaaatcagaagatatgacacaagacaatggccagaagggttatggtggagcaaagggcaccattggttctgtggaccacatcactacaccacttgctgtaaaggccaatcttaaatcagaagatgtgacacaagacaatgaccagaagggttatggtggagcaaaagacaccattggttctgtggaccacatcactacaccacttgttgtaaaggccaatcttaaatcagaagatgtgacacaagacaatggccacaagggttatggtggagcaaaggacaccattggttatgtggaccacatcactacaccacttgctgtaaaggccaatcttaaatcagaagatgtgacacaagacaatggcccgaagggttatggtggagcaaaggacaccattggttctgtggaccacatcactacaccacttgctgtaaaggccaatcttaaataa

SEQ ID NO: 54600 - DNA, 1557 bp, Glycine max
  Peptide Sequence Number=SeqID_171378
ttggcttctgatagagccaggtctgggaatatagttaaagacaaagaggttgaagaaagaagaagagggagagaaagtggtggtggtgttcagcatgtgaggaagtttgaaacaaaaggtgaagagaagaagcgtttaggggaagaggctgaactcgagggaataacaagagtggtggtggaaagagagtgcaacaaagaggagaaacaaagaagcatgccaagagggaatgtagaggcacagaaagcaagatcaatggagagaactagagaggaagctaaaggaagagaacaaactgaaaccaaaggccaaatcatgaagggtggtggtgaggaacaaggaagaagaagagaagaaaataaacaatccaacctagaagagatctctaagtacagtgaagctcaacagaaaacaatgaaagcaattgaaggtgctaaggagagatacgagagagcacaacaagaagcaagtgaagcatccaaagagagaaatggtcaggcaaatgagggggctgaagaaggcagaagagaaagtggtggtgatgttcatggtgtggctaagtttgaaacaaaaggtgaagagaagaaggattcggtgggaaaagcagaactcgagggaagaacaagagtggtggtgagaagagactggaacaaagaggagaaacaaagatgcaaaccaagatgggaagtagaagtagagaaagcaagaccaatggaaaaaactgaagaggaagctagaacagaacaagctggaaccaaaggtcaaatcaagaagatgactggatcagtctggctacaagaccttgaaaaaggaataagccctgatacttcttttttagttagagctttcaattttttgtgcagagctgaagctcaagagaaggttaaggagagaaatgagagagcaaaaaaagcagcaaatgaagttgccaaagagagaaacaagcagacaacaaagggaaaagatgtcacaagagagaagggtcaacaaggcaaacttaaaacagaaaatgggacacaagacaatgcagcaaatgaagttgccaaagagagaaacaagcagacaacaaagggaaaagatgacaccattcgtagtgtggaccacattactacaccacttgctggaaagaccaaagttactgctagcaccactgctcagtatgttgaagagaaatcagcacaagccaaaaatgctacagtaggatcaatggagaaaactacagaggatgctaaaggaagagaaaaagctggaaccaaaggtcaaatcaagaagggttgtgatgaggaacaaggaagaacaagagaaaaaacaggagaagaaaacaaacaatccaacctagaagagatttctaagcacaaagctgaagctcaacaaaaagcaatgaatgcaattgaaggtgctaaggagagatacgagagagcaaaaacaaaaacaacaagtaaagcttccaaagagagaaacgtgaaggcaaatgagggggctgaaggaggaagaagagaagcagaaagtggtgggggtgttcatcatgtggctaagtttgaagagaagaaaacttca

SEQ ID NO: 54601 - DNA, 168 bp, Glycine max
  Peptide Sequence Number=SeqID_171379
atggtagatggttatgaccatggggccttggacttgttcatcgttgtggcattcgttggtgttgggatcatcctcggcaattgcattgtcaactttgttgaggccacgcaccactccaccgctaatcaacatgcatcgagaaggaaggttgatacaattatgaaatga

SEQ ID NO: 54602 - DNA, 773 bp, Glycine max
  Peptide Sequence Number=SeqID_171380
atgggtttgccattagtacatgctctgttcttgactctgtttctgctctgcctccaaacaaaagcagaggattttggtgcaaccaggaagctcgcaggaacatgcaatttgttcagtggaaaatgggtctatgatgcttcaaatcctctctatgacccttctacttgccccttcatagatccacagttcaattgccaaaagcatggtcgctcagataaactgtaccaaaaatataggtggatgccattttcttgtcccttgccaaggttcaatggattgaactttttgcagagatatagtgggaagaagattatgtttgtcggcgactccttgagcttgaaccagttcaattcattggcatgtatgcttcatgcttgggtgccaaaatctaggagcactttcagccagagggatgctctctccaaagtggcatttgaggactatgggcttgagttgtatttgtaccgcacagcatatttagtggaccttgatcgtgagaaagttggaagagttttgaagcttgactctatcaagaacggtgactcttggatggggatggacgtgttggtcttcaacacgtggcactggtggacccacaccggaagttctcaaccgtgggactatgttcaggtgaataataagttgttcaaagacatgaaccgttttcttgcgtactataaagggctaacaacttgggctaagtgggttcagagaaacgtcaatccagcaaaaaccaaggtcttcttcttaggaatttctcctgtgcattacca

SEQ ID NO: 54603 - DNA, 363 bp, Glycine max
  Peptide Sequence Number=SeqID_171381
ggtgatgctccacaggcatcaggcgcgccaccaccacctcatcaggctggcccggatgggtcgtttgacgtggagcagtatttacggcatttggttcgccagcaggcggccaaccaccgggcacacgtacagacccatgattgtctttaccagctgagcctcagcatgcagagccagggcttcgcttctttttcatgccctactccagaccagttcagggcagaggtcgcatggcccggggattggcccgaggcccaagcaggagaggcacccccaggggctcccgacgatggagaggaggcccacgaggacgaggagatggctgatttgcttgacttcttgggagggagtggagctacatga

SEQ ID NO: 54604 - DNA, 465 bp, Glycine max
  Peptide Sequence Number=SeqID_171382
atgcaacttcaacaagtagagaagtcaaggaattcattggaagtgtttggctccccaatattgagtagcaggagcaagtcttcgagctttgataaaaagttggcaaagacctcttcctcttcttgggatgttgctcctaaaattgaagaaactaacttctcagcaatttctggtggaaactacaatgatgttgatagtgatgcaagttcaaactttaatgtaaatattgattcggagaagaaaaagaatagtttgggcataaaaattgctgctgggatagcaactgttgcttctgctttagcaatatctgcaataatcattttcctgatttctagaagaaatatgaaataccagaagaagattttcaggaaacgaatgtcaatagagatggatggctatagaaccatgaaattccatttcttaacacaaaatgatgtccacttaatcatgaggaactatgtttaa

SEQ ID NO: 54605 - DNA, 234 bp, Glycine max
  Peptide Sequence Number=SeqID_171383
atgaatcatttatggaataaaagaggttattgcatgtcgagggcaaggtgtgctatgacttttttccactttactggatcttctagagtagttgttgaaagctcagggcttgaacctaatcataatctagcagaaccaactgtgaacttccaggctaaccatgatgttcctatggttggaacaacagttcaacataaaggtcctattaatgttataatgtccaacccagtttag

SEQ ID NO: 54606 - DNA, 231 bp, Glycine max
  Peptide Sequence Number=SeqID_171384
atggctcacacttcttccaccataaaccctcgatttctatctccgtcttcgtctcactctcctcgtcctcctcctcctccttctccaccaccatgcacctcattccgacaatgccgaagccctaccggagcggactccctcctcctcctccctcgagttctgctagtccatgccggtgaatgtgccgcttataccgatgagaagacaccaccaccgtcgcttacgtcctaa

SEQ ID NO: 54607 - DNA, 246 bp, Glycine max
  Peptide Sequence Number=SeqID_171385
atgagacagaaggctactactcttgaaaggacaccacaggttactgtagatccaccttcaccaatggtggatctatcttatcctcagcaggcagcaaaccctcctactctagtgcttgagatgccagatgaccctgccacaccagtcctgagactgactagcactcctccagtcactcctgtgttacaatttacagatgaggaggacactcaggatcaagacacccagcagcaggaccagtcataa

SEQ ID NO: 54608 - DNA, 144 bp, Glycine max
  Peptide Sequence Number=SeqID_171386
atgtatttcaaaggccaatatccggaaacacaaaagaacagcctaaattatgtggcattggcctcacaaagtttcactgcccaacaatttatagtccattggttgaagttaaacattaatagcaccgtggcggtgcaagacctg

SEQ ID NO: 54609 - DNA, 153 bp, Glycine max
  Peptide Sequence Number=SeqID_171387
atgacaaagaatgagatgaaacttactggagtagtcattatggtcatgcttgtgatgggctttgtagaagctgattttaattctccatttgtgcaaattgagtcaaacaatgctcatggtcgtgcggtgtacgtggtagattcttgcttgtaa

SEQ ID NO: 54610 - DNA, 201 bp, Glycine max
  Peptide Sequence Number=SeqID_171388
atgacaattgaacaagctcaagaggttgctcttgtgtgtataaagaacaagctcaagaggttgctcaagaggttggcattaacagatccacttaaactgttacaagaacacaataagggtaagggaaacttcactaaggagaagaagcacagagttgtcacgatgcttgagttaaatatgagataccctagccatgtttag

SEQ ID NO: 54611 - DNA, 237 bp, Glycine max
  Peptide Sequence Number=SeqID_171389
atgggacacacatggttgggttcattagtgatttttatgacaatttcggccgtacaagcccaactcaaaactgggttttactcctcttcgtgcccaaacgcagaagccacagttcgatccactgttgaatcctacttcaataaagatcctacaattgctcctggcctgctccgacttcatttccatgattgctttgtcgaggtttgctactttgatcttcatctttcactcacataa

SEQ ID NO: 54612 - DNA, 594 bp, Glycine max
  Peptide Sequence Number=SeqID_171390
atgagtgatggtccaagttggtcagtacctactggaagaagagatgggagggtttctttatcctctcaggcctcaaacttgccttctccacttgactctatttctgtccaaaggaaaaaatttgctgacaaaggcatggatgaccacgaccttgtcaccttagttggggcacacaccataggccaaacagaatgcagattcttcagttaccgcttatataatttcaccaccactggcaattcagatccaaccatagaccaaaacttcttaggccaacttaaaaccctgtgtcccaatataggagatggcttgagaagggtatctttggacaaagatagtccagccaaatttgatgttagtttcttcaaaaatgtacgtgatggtaatgcggttctagagtcagaccaaaggctgtggggagactctaatacacaaagcatagtgcagagttacgctgggaatataagagggttattggggattagatttgattatgaatttcgaaaggctatggttaaattgggtggtgtagaggtaaagaccggttcacaaggagagattagaaaggtgtgctcaaaagttaatagatattaa

SEQ ID NO: 54613 - DNA, 489 bp, Glycine max
  Peptide Sequence Number=SeqID_171391
atgcctctgcccttggggggtattcaatttggaatctctgtgtggctcatgttgattgcatgggtcagagtatccttgcaagatcgggtaaccctgaagcgtgatcagcagtcctgtctcgatgagaatgttgttgatgacaactcaaggctttatgaagactggctgaaggcaaagagactcagaaagaaaaaagtccagaggaagtttctagagaataagaaagatgatttcaagtccaagtctatgaaatcctttggacggattgtccattggatttgcatgcactttgtgctgcctagagttggaacctttcaacgaccttttggagtctccctagatggtgaactcgttgataatgatgttttatcttgggatgccaagaatgttgttgctttgaagttgtctccacaacctggtatggagaaagcttgcatgttttctgatgaagaggaggatcaaaacaaggacttcatcaaaagtagttag

SEQ ID NO: 54614 - DNA, 141 bp, Glycine max
  Peptide Sequence Number=SeqID_171392
atggaagaggagagtggtgacttggccttaatgcagtgctttctttcagtgaaggacttatcacttatgtatcatctagacacagtgaattcccacaaaggagagaaacaagatgtacgggcagtgggaggcagctgttaa

SEQ ID NO: 54615 - DNA, 173 bp, Glycine max
  Peptide Sequence Number=SeqID_171393
atgcggggttaccttatggttacccgcacctttcgtcaaccaggggaaaacgagcccgttgatgctcgaagactaacatcgtcttctgcaccttttgtcgtcctgacccgtgaacttagtcaggtgacatgcggggttactttatggttacccgcacctttcgtcaaccaggg

SEQ ID NO: 54616 - DNA, 241 bp, Glycine max
  Peptide Sequence Number=SeqID_171394
atggtgattttcagccatggagctgcagcggaagataaaggagaaaaggagaggcttcaccgccaagagagtgccttggataagaagcttagagaggaagcttcaatggaggaagaagatgagagagagagagagagtggtgttacacatgtatctactcacacccctccaatagctaagttcacccccatgccaaaatacatgaaaatacaatgggaagcttccttgagaaccaaagaag

SEQ ID NO: 54617 - DNA, 309 bp, Glycine max
  Peptide Sequence Number=SeqID_171395
atggacaagctcaaaaggcttagagaagggagtatgagtgttgaagagtataggcaacaaacggaactactccttttgagagttgggcttagggaggagaaaagaacaagtattgctaggatccttagtggacttaatatggaagtgagggacaaggttgagcttcttccatatagggacctagatgacctagtccaactttgcatgacgaaagaccaaggtcaaggcatcttaggggctgcaccttctaagcccaaagatgataaggggaagacaatagaaaagcaaccccctaaggctagtatgtaa

SEQ ID NO: 54618 - DNA, 192 bp, Glycine max
  Peptide Sequence Number=SeqID_171396
atggatccacaacaaaagtttctaaggaaaggttggccatcttttggcgacaacaaactcgaggagaagaaggagagcaaggttttgaagttttatgtggaatttgttttcatgggtcatggaagttgcaacaatcatgttaattgctttgagaaatacagaagtagttgtcatggctcatctagcgtctaa

SEQ ID NO: 54619 - DNA, 864 bp, Glycine max
  Peptide Sequence Number=SeqID_171397
atggatctcactaggatgtctgaagtgtgtacttttttaagggatagatgtcgaagtgatcctttgtgggaactccacatgaagcaaaaatggggtggagtcattggtgatgttgcttacaaggagtggctatggcacatcacaacaccaaaggagaaaggaattaaccaattgaatcaacacaacaatcaaaatggatcaatgggacctttcagtggtacttggcctatgttatacctcaggtcatatcttgaagattgtagttatcttaattcctcatcattggcaaatagcttcatgatggctttgtatttctctctagagaatggcaatttctggtttccagctcaaatctacaggggattgtattttcgtgacgccttagttagatatgattccaaaactgataactttcaagcaagacaacaaaatgcaggctggaaaataatggggaacaacatccaatgggataagctgagagctcccccagttgatacccttccatctgttagatacgtctctgattgcttacaagacttaaaaccaggagatcatattgagctccaatggaagtcaagtagagatattccttatgattggtggtatgctgttattggtcacatggaatcatgtaatgaaaacgaaaacttctgccgctgtcgttactctgagacactgatcgtggagttcgagcaataccctcttggatctagaatgagacgagtaaagctgctaaaaaatggggatcaatgtgaagaatcaactggatgctatggaggaattagaaagctttatagtgaggaggagattcaaagatgggagaatatcttgtcacggggcatggccggaacaagagtaaaataa

SEQ ID NO: 54620 - DNA, 1368 bp, Glycine max
  Peptide Sequence Number=SeqID_171398
atgtatgaaaatactatgaggtcttctggtgcggatctgacagctgctatggtaccattgttgaagctgttatgcttgacagtcatagggctgcttcttgcaaacccaacaatgcaattcattcccaaagctacatttaagcttcttagtaaacttgtgtttgcattgttcttgccatgccttatatttactgagctaggtgaaagcattactcttgaaaactttgtggattggtggtttatccctgttaatgtgctggtgagtactgctcttggttgcttactcgggttcttagtggtgatcatatgccacccacctccagagttaaccagatttaccattataatgacgggatttggtaacactggaaatctcctgcttgctgtagttggatctgtttgccatactaaagataatccatttgggaagcattgcaacactagaggggtggcatatgtttctttatctcaatgggtttctgttatccttgtatacactcttgtttatcatatgatggaacctcctatggagtattatgaggttgttgaggaaggggccgaaattgagcaagagcggacactgaacgatatcagtagaccactccttgtagaagctgagtggcctggcattgaggagaaagagactgaacattctaagactccctttattgccgggatctttaaaagcatctcgggtgtttcctcatccaatattcctgagcttgaagtcacagcagaaagtggtgggactagtagtccaaagtccattagatgtttggctgaacctagagttgtcaggaggattagaattgttgctgaacaaactcccattcagcacattcttcaacccccaacaatcgcctctctattggctatcatcattggcacagtgcctcagctgaaagctgtgttcttcggatacgatgctccattatctttcattacagacagtttggagattttagctggggcaatggtaccttcggtgatgcttatattggggggtatgcttgctgaaggaccaaatgagtctaaacttgggcttaaaactactattggtattacttttgcaaggctcctggtgcttcctgtcctgggaattgggattgtggcattgtcagataagctaaatttcctagttgagaatgatgctatgtttagatttgtgcttttgctacagtacactacgccaagtgctattttattgggagcaattgccagcttaaggggatatgcagttagtgaagcctcagctcttctcttctggcagcatgtgtttgctcttttctctttttcctttttcactgtatttgattggcttgacgtttttgcgaggttagacgactgttgccactgtattgtcctctag

SEQ ID NO: 54621 - DNA, 588 bp, Glycine max
  Peptide Sequence Number=SeqID_171399
atgggtgaagtagaggaggtgcaagagcatatgaaggccgacatagaggccatgaaagtgcaaatggccacaatgatggaggccaatatgagcatgaaggagataatggaggtcaatgcggctgttgctaagtatgaacgaccccatgatgtgcaaattcaaaacgagcacgccttcctgccatatggcttgcctcccaactatacaccacccaatgtggcgtacactcccaatgagaatgtcaataaatccactcccatactcattaaaagccaacaaccccaaactaatcatgcacatgtctctcaaaccatgggggagacacatgaaattccccaccacaatctagtcgacttcgagccttgcctcagatatgccactgaagggcaagcagttggtggtatacccctgcaaaacactttggagggccctcagtatcgcccccaaccacaacccttgcattccacaccgggtataaaccctcatgctatggcagaaatgggagagttggatcatctagaggaaaggcttagggacattgaaggaggcgaagattatgcctttgctaacctagaagagttgttccta

SEQ ID NO: 54622 - DNA, 105 bp, Glycine max
  Peptide Sequence Number=SeqID_171400
atggcagggttttcaaaggttgtttcccagggggcagatgcagaccaaatttccataagccattctcttgtcctgggttatggagaattcgtccctaacagttaa

SEQ ID NO: 54623 - DNA, 435 bp, Glycine max
  Peptide Sequence Number=SeqID_171401
atgacggagaaagagatgatcacaataatagtagacacgttaccgatattctactatgagaaaatggtgggttacacgccttcaaacttcaccaatttggttttcaccagcgaaaggattgaagtgggtctaagaagtggcaagtttgattatcctgctttgatgaatgagaaagctggggcatatagagaggatgagaaggaggaaggaacccatgctatgactgccgttcctacatggaaaaatttcccaccagctcaacaatgtcattacttagccaatatcagcccttctcattacccaccacccaatcaaccacaaaggccatccccaaatcagccacaaagccagtctgccgcacatccaatgccaaacaccgcccttaacacaaaccaaagcaccaaccagggagggaattttccagcgaaacaacat

SEQ ID NO: 54624 - DNA, 312 bp, Glycine max
  Peptide Sequence Number=SeqID_171402
atggcgagaaataggctaagggtagtcaaaaatctcgggcgcaagatttggattgaagtaaaaaaaatagaaaatgggatagtcggaataccaaggaggcatttggaggaaaagacgaaggcgttggcagatcaaggtaaatgggcttcattcattgatgtcttggcactattggtatttggagttgtcctctttccaaatatggatgggctagtggacttagcggcgatcgatgccttccttacttgtcaccatagcaaggagagtccagtcattgctgtcttggccaatgcctatgacacctttgactga

SEQ ID NO: 54625 - DNA, 471 bp, Glycine max
  Peptide Sequence Number=SeqID_171403
atggaaagaaggaagagccggggttttgtctcatgtgagggattctcgaatgtacccttgatgggaacaaggggttgtatcaattataatcttgtccttgccataagacaacttgactaccccatgagaggagcaccgttggaagaaagcatcacacctttcatcacatggggtttcagtgaccccaatgcgaggatacttcaaagagtccacaaagcatggagggcggtgcaaaaaaaagacaaggagcttagaggaagccgcaatgggatcaacgtgagctatcataagtggctgaaggctcagatgcaagagttggattggctcctaaaggtaaaggtttcaagtgaggaaggggctaaaatccctgaggagagtgaggaggtgcaagccttaaaggtggaacttgaaagagcacaagtggtcaaggaaaagttcaagacgacatccatcaaggtctggaaagagtga

SEQ ID NO: 54626 - DNA, 234 bp, Glycine max
  Peptide Sequence Number=SeqID_171404
atggctccgaaaaagctcccagccaagagatccaggaaggatgttgctagaaagggttctagtgcggccccacaggcagatgtggactttgatagacacaggttctggagtgaggaacaccagcaacgatttgaggccattaaaggtgtaaaagcaagcttcatgatgatgaatcaagttgattcaagtagttttgatgataacaaagatgatgacaaaaagcccaaagaatga

SEQ ID NO: 54627 - DNA, 1722 bp, Glycine max
  Peptide Sequence Number=SeqID_171405
gcggcgttctccagcgtgaacgatcaaacgcaggagagtctgaccagcatccgcatgatcaaagcctttggcctggaagatcatcagtcgagccagtttgccgatatcgccagcgacaccggccgcaaaaatctgcacgtggcgcgcgtcgatgcgcgcttcgacccgatcatctacatcgccgtcggcttctctaacctgctggcgattggcggtggcggctggatggtgtggcacggctctctgacgctcgggcagctcaccagtttcgtcatgtacttagggctgatgatttggccgatgctggcgctggcgtggatgattaacatcgttgagcgcggcagcgcggcgtggagccgcattcgcgcgctgctggcggaagcgccggcggtagaggacggcaatcagctactgccagcggaagcgggcgtgctgcaggtggcgatccgcgccttccactatccggcgagcagcgcgccggtgctgagcaacgtgcatttccagctacaaccggggcagatgcttgggctgtgcgggcctaccggctgcggcaaaagcacgctgctgagcctgattcagcgccattttgatatcgatcagggcgagatttgctatcacgccattccgctgccgcagctgcggctggacagctggcgcagccggctggcggtggtcagccagacgccgttcctgttttccgataccgttgcgaataacctggcgctgggccgcccggaggcaacgcaggaagagattgagcgcgtggcgcagatggcctgcgtgcacgatgacattctgcgtctgccgcaggggtacgcgaccgaagtgggcgagcgcggtgtcatgctctctggcgggcagaaacagcgcatcgccattgcgcgtgcgctgttgctcaacgctgagattctgatcctcgacgatgcgctgtcggcggttgatggccgtaccgaacatgaaatcctgcataacctgcgccagtggggcaaaggacgcacgctgatcattagcgcgcatcggctgtcggcgctgactgaagccagcgagattctggtattgcagcagggcgcagtggcacagcgcggcgatcacgatacgctggcggcgcagccgggctggacgaggcagaacagggagccgaccatggctaaatcgcaacgcttatggccaacgctgaaacgcctgctggcctacggtaaaccgtggcgcaaatcgctgtggctggccgtcggcatgctgtggatcgctgccgctgccgaagtcaccggtccggtgctgctgctggcagcgggtctgcactatttccaggcgctgctgtttaaccgcgcggcgattggtgtcgtgcagcagctgcgcgtcgatgtgatgaatgcggcgctgcgccagccgctcagtgccttcgacacccagccgcgctgcgctgattggcgcgatgctggtggcgatgtttgcactcgactggcgtatggcgctggtggcgctggtgattttcccgctggtgttaacggtgatgctgatctatcagcgctacagcacgccgattgcgcgccgcgcgcgctttggcgagcgcatgggcgaagccagccgatcgcactatctggcgcggatggagacgctgcggctggacggctttttgctgcgtccgctgctcagcctgttttctgcactgatattgtgcggtctgctaatgctgttcagctttgctacgccgggcgtgtttga

SEQ ID NO: 54628 - DNA, 141 bp, Glycine max
  Peptide Sequence Number=SeqID_171406
atggctagggttgccctcggggctcaagggtttagcgatgaagagtgccaagcaaaaggatctcgtcgaaagacctcctctgcctatctctcccgcaagagaggactcgttatggcgcacctctttttagcaatcttgtga

SEQ ID NO: 54629 - DNA, 438 bp, Glycine max
  Peptide Sequence Number=SeqID_171407
atgccaatctccccctgcagatgtatcagttgggatcgcgcccacaagacgcccagtggacccgaagaagtccaacagggccctggggtttccagctctggttacgggcctctggatcgcacccacaagacgcccagtggacccgaagaagtccaacagggccctggggtttccaactctgattacgggcctctgtcagtcctacagggtgcccattcccccagcgaggaatcacacccacaaagacactcagtggacccagagaagtccaacaggggcctggggtttccagctctggttacgggtctccgtagtcctacagggtgcctgttccccccggcaaggtcacatcatcatgacataggtaaggattgcgcctgcaagacacccagtggacccgaagaagtccaacagggtcttggagttgtcaagctctaa

SEQ ID NO: 54630 - DNA, 825 bp, Glycine max
  Peptide Sequence Number=SeqID_171408
atgaccagaaggcttcttgccggttcattggcattcgaatgccgcatcatgcactacttgattgtgcgcatcctactccctagatcttccaaccttgcacaggtttatgaggaagatttgataatcatgtgggttttcttaaccggtcgtcaaatcgactgggtccatcttgtgagatatcgcatgcataaggcattgcaatcaaatgctccactctcatatccccatctgattaccttgtttctacaacattttaatgtccctcttgactctgagccatttgtcaaagtcaagagatccttctctatcggtgcaaatgtagtctcttccttcggataccgcaaagagagggatggctcttgggtgaagaaggatgctccagtacaggccgctgaagaccgttctccatcaccacattctgagagagatgactcttcgtctcttatgcacagcattcttgacagactggatggactccacacctttgtcggagagcgctttgactcgctggacagccatattgatgccatggatgcacgatttgcagggatggatacacgtatcatcaagcttgaaaaggatgattctcatcatcaaaaagggggagattatggaagcaatgacttccaagattattttgatgatgccaaagaatcaagagttaagcaagttccaaagaatcaggagtcaaaaagcttcaagaatcaagtttcaagattcaagattcaagaacaatcaagtttcaagaatctagattcaagaacaatcaagatcaagattcaagactcaatattcaagaatcaagagaagactcaatcaagataa

SEQ ID NO: 54631 - DNA, 216 bp, Glycine max
  Peptide Sequence Number=SeqID_171409
atggcgaatggatatacccaagtgattatccgtacaaagacaacatctgttgatcctgacccatgcgccaggtggcaggcggatataccccaagtggttatccgtacaaagacaacatttgttgatcctgacccatgcgtcagggggcaagcggatatacccaagcggacatacccaagtgattgtccatacaagtacaacatctgccgatcttga

SEQ ID NO: 54632 - DNA, 456 bp, Glycine max
  Peptide Sequence Number=SeqID_171410
atgagtaggagggcgcggcggtcgctgcaaaacccagggcgcgagcccgggcggagcggtcgtcggtgcagatcttggtgcctgcccaccctggaaacggctcagccggaggtagggtccagcggctggaagagcaccgcacgtcgcgtggtgtccggtgcgcccccggcggcccttgaaaatccggaggaccgagtgcctcccacgcccggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactggtacggacaaggggatccgactgtttaa

SEQ ID NO: 54633 - DNA, 255 bp, Glycine max
  Peptide Sequence Number=SeqID_171411
atgtgccctttatcattcaggaacaacaagttaggtggtaaacgcgcagagacagattctgcgccctttatcattcaggagcagcgagtcgagtggaacaacaagttgggtggtaaacgcgcagagacagattctacgccctttgtcattcggggacagttccgctggcagggaggttcattggccgaatggtgtttcgctcgaacgaaattagtgtcttatctttacttcccttttatctccaataaaagacaa

SEQ ID NO: 54634 - DNA, 972 bp, Glycine max
  Peptide Sequence Number=SeqID_171412
atgtcttccagaaaaagaaagagcattggtgcaaggcccacagctcaatatgacacaagaaggttccactccttcgaggcttggaccagatattcggataatgaactaggaagacatatactagctgagaggaaggtagaaatataccatacggagttagatgagttcaaggctgaattggagaggcgtaacttccataagcgcctcaccaatttagctgatagtagcatcgacctagccttggtaaaggagttttatgccaacctctacagtcccgaggggccttcaccaaaacaagtcagaatccgaggccgagtgataagaattgatgcagacagcctcaacaccttcttggagacacctgtggtactcgctgagggagaatccttacccgcttacttcagatactgcaggatgcccactgatataagagagattgaggctgctttgtgtatacccaaccgagggtctgttttaaatgctgaaggccatcctgggaagatcctcaggaaagatctaacaactcttgctcaggagctttcatccatggccagatcacgtctatggcccagtctaaactcctttagacttgggttccctactcttatcaaagctctatgtaggtccagaggggttgcttctgacagcccgatcttcgaacgcttgagcccgatcattaacttggcctatattaggaagaactgttggaaccatgctgatctgacagttactattagaggggctaggagagcgagggcaaggccagctgaggctccttccacatctgcagctcctcctccagcacgtacctcagcagcttcttctaccccatcttctgcagactttcaacgtcttgaagctatgcttcgaagcatacatcaagggcagatttttttattacaaagtttacagctggtagcacctctagactctattccttctgtagagcagtttaatgagagggtagcctga

SEQ ID NO: 54635 - DNA, 309 bp, Glycine max
  Peptide Sequence Number=SeqID_171413
atgttggtggcgactccgcgcgtattcctttcttggaagacgcatcccgcgagtctcgcatcgccctaccgccgaagggtagtgtcttaccctaatttcgtccggggacctttgcttgatgacatgcgacctttctttggtccttgtgagcacccaggcccacttgggcccttaagaatattcctccagaaggctgttgcttctggaggaagcaacctggctcgcctgggcgagctgggcggcaaccacctcccctattttgctataaataggggaggaagtgagaaggaaaagggttcagccccttag

SEQ ID NO: 54636 - DNA, 549 bp, Glycine max
  Peptide Sequence Number=SeqID_171414
acctctgttattgtggaagagggggaatcactctgtgcttactccagatttgcactcctaaggcctgatcctcaggagttggctgctaagctctgtgtcccagggagaggattcgagcttaatgctgatgggaagcccctgaagattttgtggaagaacataaccaccttagctcaaacatggagtgttctttccttctctaacttgattcccacctcccacacttctgatgtcactcttgacaaggccatacccatttatggcattattatgaagatggatatgaatgcggggtacctcatttcccaccaaatctccctcactactcaggatgatacatctagacttgcattcccgaccttgattacaactttatgtaaggctaggagagttcagtctggctctagatccttggagagtctaagtcttactattaatttggcttacattaagaagaactgttggaatcttgatgatccaatagtcacattcagaggacccaagaaggccagagggaagagatatgaggccctttccacagcaccatga

SEQ ID NO: 54637 - DNA, 234 bp, Glycine max
  Peptide Sequence Number=SeqID_171415
atgtataagtgcctgagatgtgagtatcagcggtacaaagtgaaggatgatgacgagtgtagtagtgacaaaaactcaaagaagaggccccaaacaaaggtgttgtggtatcttcccatcattctaaggtttaagcatatgtttgctaatggagacgatgcaaatgaccttacatggcatgcaaatgggagaaactgcgatggaatgctccgtcatccaactgattcctcttag

SEQ ID NO: 54638 - DNA, 336 bp, Glycine max
  Peptide Sequence Number=SeqID_171416
tgttatggcacgttctctagacaagataaagagcatcgatggctcaaaagaaactcttaaactcagtgtgaggatcagttatctatggtttattggcatgcctaacaaatctgagcaagctgaaatggtgtttgtggcctccgatggtgatgagatccacgttgtttgtaaacaagaccaattgaaggagtgtgttctaggggacatcccttttagaaaatacaggtttgctagatttgcagatgttgtggatggccagtttgaacgtggactattggttgatgttattggtgttgtggaggaggttttcggcaagtttcaggaaaaggtagaagg

SEQ ID NO: 54639 - DNA, 144 bp, Glycine max
  Peptide Sequence Number=SeqID_171417
atgacactgaaggacagaggcgcgtcagcggcgccaaaaaggaacgcagcattcagacaatggcaccggctggcgagtaaccggagcggtgagccgtggcgagatcagaaaaaacgcgccgcaacagcgggtgcggcgcgttaa

SEQ ID NO: 54640 - DNA, 1065 bp, Glycine max
  Peptide Sequence Number=SeqID_171418
atgaatattacgcatgcctatgccgcacaggacgcgaaagccaaactcgccccgttcgattataagccgcgcgaactgcgcgctcatgatgtgcagattgaagtgttgtactgtggcgtctgccactcggacctgcaccaggcgcgcaacgaatggcgcaacaccgtattcccggtggtgccaggccatgaaatcgtgggtcgcgtcaccgccgttggcgcgcacacgcataaatataaagtgggcgatttagtcggtgtcggctgtatggtcgactcttgccgcagctgcccaagctgtcaggaaggactcgaacagtactgtgaaaacggctttgttggcacttacaacggccaggatcgtgaaaccggcgccatcacctacggcggctactccaccagcatggtggtggatgaaagttttgtgctgcgcgtaccggaaaacctccatctggcgggcgttgcgccgctgctgtgcgccggtatcaccacctattccccgctgcgtcactggaatgtcggtcccggtaaaaaagtcggtatcgttggtctgggcggcctcggccatatgggcgtgaagatcgcgcatgcgatgggtgcgcacgtggtgctgttcaccacttcaccgtcaaaaattgaagatggcaaacgcctcggcgctgacgaagtggtgatttcgaaagatgctgaccagatggcacaacataccaacagcttcgacttcatcttaaataccgtcgccgcgcagcacgatctcaacccgtttatcgccctgctgaagcgcgacggcaacatgacgctggtcggcgcgccggagcacgatcacccggcaccgcaggtgtttaacctgatcctcaagcgtcgcagcattgccggttcactgattggcggtatcgccgaaacccaggagatgctggatttctgcggcaagcacggtatcacttcggatatcgagctgatcgctatgaaccagattaacgatgcctacgagcgcatgctgaaaagcgacgtgaagtatcgcttcgtgattgatatcaacaccctgcgtgaagagtctgcggcttaa

SEQ ID NO: 54641 - DNA, 378 bp, Glycine max
  Peptide Sequence Number=SeqID_171419
atggggtcaaacactttcttaagtttgaagatcccagtcaatgagaagcatgagactggagtctttaaggccgttgcaaagacaatggacacatccagattaccatctcggacattagctattcctgctagcctagtcaaaaagggtagcaaaggcttaaagatactagtatggcataagccaattaagctagtagaacatattagttttatgtatataagattcaaccaggattttgtaggctttgatggttgtttgttagatccagaaacaaagtcaaaaggaagggcaaaatggtcatttttcaagatttcagacatccactcgcctaggctagcttccagctcgcatgggctaataagatttcttcagccataa

SEQ ID NO: 54642 - DNA, 306 bp, Glycine max
  Peptide Sequence Number=SeqID_171420
atgacttcaaggactacaatgccatcgccatggaggttcagtcgtgcactaccgcttcctcgccatcacgtgccactgcgagcagaaatagaacttgaagaggctggattggcgagtttcgaaccagaggagacaaccacaaacaacacaaacaagatgttgacaaccatgggcaacgaatcagactatgagaaccagtcgatgcttggtcgtgctggaatgccccaatatgactcatatggtgagggaataattgttatcgaccataatgagttgccgtattacctctctcttattgaatgttag

SEQ ID NO: 54643 - DNA, 972 bp, Glycine max
  Peptide Sequence Number=SeqID_171421
atgaatagtgaacaagacctggaacaagggggatcgtggggagcaggcgatgagcatgaagacgttgtcggcggcagggttcatgtatggcgcgcgccagggctcgacggagaagccgttgccgcgggttccgaggacgaggttgtcgcaggtggacatgtggggctcgtggagcgtgagggcctggtaggcgtagtcgatctcgaggaccctgtaggagccggagctcacgtggaacatgagaacgtcgttcatgcagaagaggaggtcgcggaagccggggtggccgcaaccgtattggagtgcgaacgggtagtcgatgggattaagtatgctgagagaatgaggtacagtgcggagagtaatgagggcatgaaaggaaaattgaaaggaatagtgctactccgtgcaactcaatctctgtctcagtctcagaagtacccaagaaacgattcctcggcgcggcaaccaagcatcttctacaacttccatttccattccgttgattttgccgtgcctccgatcatggaagttcctgacaactcagaagccaccgttccatataattctccaagtctagctggaacagttaactggggcacagcaactgttgttggagtatttgctggcatgttatatggcggtagcaaggaggcagctgcttctgttgatgcagaagttatgttgaaacttgggagcactgaagacaaacgtgagcaatatcgattgatgagagatgcaatggagaaacgattcattcgagttacacggggctcaatagttggaggggtacgtcttggaatgttcactgctgcattttatggcatacgaaatctgctcgctgagaagagaggtgttcatgatgtttttaatgatgttggagctggatcagcgactgcttcagcttttggtttaatcagtaagaaatcatacacttactgtacattctatattgttacctgggccggatga

SEQ ID NO: 54644 - DNA, 894 bp, Glycine max
  Peptide Sequence Number=SeqID_171422
atgccctcattactctccgcactgtacctcattctctcagcatacttaatccctttatgtttgagccaccccaacacatgccgctcatattgcggcaacataaccatcgactacccgttcgcactccaatacggttgcggccaccccggcttccgcgacctcctcttctgcatgaacgacgttctcatgttccacgtgagctccggctcctacagggtcctcgagatcgactacgcctaccaggccctcacgctccacgagccccacatgtccacctgcgacaacctcgtcctcggaacccgcggcaacggcttctccgtcgagccctggcgcgcgccatacatgaaccctgccgccgacaacgtcttcatgctcatcgcctgctccccacgatcccccttgttccagggcttccccgggaagcacctcccctgccgcaacgtctctggcatgggctgcgaggactactacgcctgcccggcctgggagatgttgggccacaagagattgggctcagcctcgttctttgggtcaggcccacccgagtgctgtgctgttccgtacgaggctattagggggattaaccttacgaagcttgagtgcgaagggtatagcagtgcctatagtgtggctccgctgaaagttgatgggcctggtgggtggtcctatgggatccgcgtcaggtattccgtgcaagggaatgatgagttctgtggggcgtgtgaggccactgctggcacgtgtggatatggctccgatgggattagacagttggcgtatcgtcaggagcaagggttatatgtacgagggattattgacgtatgtgctagcgtgggtgacaaccaaccagatttcaaaagtgtggtatattatgtgagactgggtcatgaataa

SEQ ID NO: 54645 - DNA, 612 bp, Glycine max
  Peptide Sequence Number=SeqID_171423
atgcatggatgttaccaacatcttaaaaaagctagtggtgataaggttggaaatgtagatggagatgcagaacaaggaatttatgatgcttctacacccccacagggttctaatccatcaaaccatgagaaaggtttaggagctccacaagaacatcttgttcgccaacctgcaagcacctggggttatatctttcaaatattattccagatgattgcaggcgctgtaatgctcacagattgtgtgttttggttcataattgttccgttcctaaccatcaaagattacaacataaatttgctaataatcagtatgcacaccatcaatgctgttttcctaataggcgatacggctttaaactccttgaggttcccttggtttcgaataggatacttttgcatgtggacaatcacatacgtccttttccagtggattgttcatgctatagttaaactctggtggccatacccttttcttgatttgtcatccccgtatgctccactatgtgcctctaagttacttttccatggcattgctgcatattccgtgctatggcatattcgctttgataatgaagctgaagcacagcgtgttgtcgacgcggtaccctga

SEQ ID NO: 54646 - DNA, 1717 bp, Glycine max
  Peptide Sequence Number=SeqID_171424
atgcctgtaaatccatggaccctcttcttcttatgcatttcccttcttctacttccattccattttttgctagctgctgcagtgaaccaacaaggggaagctcttctatcatggaagagaaccctgaatggatccttggaggtattgagtaactgggacccagttcaagacaccccatgtagctggtatggggtgagttgcaacttcaagaacgaagtagtacaattggatctgaggtatgtggatttgcttggaagactccccactaatttcacctcattgctttccttaaccagtttgatcttcaccggaaccaacctcactggttcaatcccgaaagaaataggtgaacttgtggaactcggctacttggacttgagtgacaatgccttgagtggtgaaatcccaagtgagctatgttacttgcccaaactcgaggaactccatctcaactccaacgacctcgtggggtccattccagttgcaattgggaacctcacgaagttgcagaagcttatcctctacgacaatcaactcggcggcaaaattcccggcaccatcgggaaccttaagagccttcaagtgataagagcaggtggaaacaagaacctggaaggccttttaccacaagaaattggcaattgttccagtttggtcatgttgggtcttgctgaaactagcctttcaggttctctacctccaactcttggccttttgaagaaccttgaaaccattgccatttacacttccctactctcaggtgaaataccacctgaacttgggtactgcacagggctccaaaacatatatctttacgagaactccctcactggatccataccaagcaagttgggaaaccttaagaacctcgaaaaccttctcctgtggcagaacaacctagttggcaccatccctccagagattggaaactgcgagatgttgtcagtgattgacgtgtcaatgaactcactaaccggaagcatacccaaaacattcgggaacttgacatcactgcaagagcttcaactaagtgtgaaccagatttcaggggagattcctggagaattgggcaagtgccagcaactcacgcatgtggaactcgacaacaatctcatcacgggtactataccctccgaattgggaaaccttgcgaatctaacactgttgttcttatggcacaacaagctgcaaggtagcattccctcttcgctttccaattgtcaaaacctagaggctattgatctgtcgcagaatggattaatgggtcccatacccaaggggatattccagctcaagaacctcaacaagctcttgcttctctccaacaatctctcggggaaaatcccttctgagattgggaattgttcctccctaattcgattccgagccaacgacaacaacatcaccgggagcattccctcgcagattgggaatctcaataatttgaatttcctagacctagggaacaatcgcatttccggagttatcccggtggagatctccggctgccggaatctcgcttttctcgacgtacattccaacttcctcgccggaaacttgccggagagtttgagccggcttaattcgcttcagtttctcgatgcgtccgataacatgatcgaaggtaccctaaatcctaccctcggcgaactcgcggcactctccaagctcgttctcgcgaagaatcgaatctccggctcaattccgagtcaactcg

SEQ ID NO: 54647 - DNA, 339 bp, Glycine max
  Peptide Sequence Number=SeqID_171425
atgctttcatggctagttaggggtttcaagtggcgacacgacttgaaggtttggctattgccactgctcgtggttgttctcattgctaccaccatattcaatggcagaccactgcacctttaccaaagtcatgaggttgacactacgatggtcactcgtgaaaagggaagacaaaacaatctcatgactctctatgatactctgttcactcaagtaagaataaatatgagggttaaggttttggatgagacgaatggaagaagggaatggggacaaagtggtgacaagtttatgatagtagtgtggtttgtgttggtggtggtgactcgtgtttgttga

SEQ ID NO: 54648 - DNA, 300 bp, Glycine max
  Peptide Sequence Number=SeqID_171426
atggtatcatgtgaaaagtgtcatccctctgttgctacatggtggattggaaataatcttcctatcttgatctatgaaacaacttccttctccttttaccgagttccttctctgatcaagggtgaggcacctgaaaatgaattcaatgctaaagtcttggatcttcttcatcaatggagtccttctattcttgaagttcaatggcagcagaatggagaaggaagaaagatgattggagacgctacttcaaggagaagatcagtcaagcataagctcaccactataggaagccatggataa

SEQ ID NO: 54649 - DNA, 276 bp, Glycine max
  Peptide Sequence Number=SeqID_171427
atggtgaagaaagcaactggaaaatggaggatgtgtgtggattatactgacctcaacaaggcatgtcccaaagatgcttacccttttcctaacattgataaactagttgatggagcatgtgggttcaaattgcttagcttcttggaaggttactcaggcgataatcagatcaagatgtatccacatgaccaagaaaagacaaccttcatcgctactgaagccaaattctgctacaaattgtattctaaccctaatgtcttaggtgaaagagtctag

SEQ ID NO: 54650 - DNA, 180 bp, Glycine max
  Peptide Sequence Number=SeqID_171428
atgacaaaactaaagatccagatgaacaccttgaagagtacattatgcagaggaaaaaattataaccttaatggttatagaggaaaaggaagaggtgcccgtaaaggtggtttcataggaggatatgctagtggatgcaacaacaaaaatcaacaagcaactaacgaaggcaatccttaa

SEQ ID NO: 54651 - DNA, 372 bp, Glycine max
  Peptide Sequence Number=SeqID_171429
atggagtccccaatctcaatctgcgacactgagatccctcttcaaatgcagagcatcgatgctttcaccgcttcttacgtcaaatccctccattccctcagagccacagcgcaagaaaccgctcgatgtcaagttcaactagacgaggttaaatctaaactcagagagaccgaggatgatttcgtcaaagcacttgcggtcaagacccgcaaagaggccaagcgaatggctttgatggatgctattgcttctgcaaaggctagagttgaagacctcaatgcatctattcaggagcagcgaaccaaaaagcaagaatatgctgcatttatatctcaacaatctctcggtaatactcctccttctctaagttaa

SEQ ID NO: 54652 - DNA, 423 bp, Glycine max
  Peptide Sequence Number=SeqID_171430
atgaaacggaggacagatgattttatagggaacagggacgtgccaggggccccaccactagtggaagtgcctgctaggctaccactagtggtcgcgcctggctccctaccactactggtagcgcctggcagggaggcactactggtagcgcctggcaggcagacacgaccacccctgtcacatcgtcctgtccagtcaagccacgtgtcgcgttctggtggaacgcgctcctcagcaaccaacattggcattgcatcaggccaaataatcatgtgtgctggcttgcgaaggcaggtatgttttctctgctggagtcagacttcaaatgaatcattatcgataatatggcatacagtgctggctcgtgaaggaaatattgtgaatctgagtggaatgaagtcatcaagtttggcattgatatag

SEQ ID NO: 54653 - DNA, 318 bp, Glycine max
  Peptide Sequence Number=SeqID_171431
atggctccgaaaaagctttccgcaaagagatctaggagggacgccgcagctgaaggaaccagcgccattcccgagtttgatagttgtcgcaacctacccttttgcgggcgagcgaggcgaggatcacgggtcgacaaaagtggggctcttgctcctacgtaccctccatcgaagaggaaatcaaacctacgtagttctttattacgggtgaatcaagcgattctttttacttggaaggtgatcattttaaggcgttggaccttaaaaatgatccatttacttgtgatttttgtggacgagcttgactttgcgagttga

SEQ ID NO: 54654 - DNA, 264 bp, Glycine max
  Peptide Sequence Number=SeqID_171432
atggcttggaggaatttgttcaaacctaagaatgttggagagttagggttgaggatggctaaagatgtgaaccgtgcatttataatgaagtgtgggtgggagctttgtaccaaaagagatttcttgtgggtgcaaattatttgttccaagtacgactatggtgaatctatttttcctcacatagatcaaaataggacaaggtctaatttatggaaagggaattgtgagattgccagcttttcggagagtgcttgggtgtgttga

SEQ ID NO: 54655 - DNA, 558 bp, Glycine max
  Peptide Sequence Number=SeqID_171433
atgtttgctattggtaagctcactaatgttcttcaaagtgttatcccgcattgggaaggtccgaagagaactcaggttttacggtggaaaatggcctctaatgcacttttaacgaatgatcagaggcttgctaggcacttgaacatggatgcaacttgcttgaggtgtaaggggatttatgaaaatattgatcatatttttcgattttgcctaactagcaaggttgtttggtattttctttttccggcgtccaagcataaggaattttttcacaaagataccaacgcgtggatgttgcagaatatcaagggtacaaatttagtaaaagggagaagctggtgtcttattttcggtatttctattgatatcatttggcaaaataggaaccaatccatttttgaagggcttatttcccatccttctgatagggtcaaacatattttggctaaagtagaggttgttcacgaaatcttgaagcagtctatgaagttcaatagtcctggaaggatagtgaagcataaaggtggggttcgttggaattcgccccctcatggctaa

SEQ ID NO: 54656 - DNA, 1251 bp, Glycine max
  Peptide Sequence Number=SeqID_171434
atggcttcccctcctcatttcgacgacgtaagccccaacatttttcacccctcgccacttgctttctcacgcgcaatttgcttaacattttccatttcttctcaaacgcaggactttgattttggaggcggttttagcggaacgcaatcaggtaataagaggccatctcccgactatgacgaggatgaatatgaaaatgatccttttggacacaagaaggccaaatcaaaagctgaagaagcggcttctggtgtgaccacaggaatgattttgtctcttcgtgaaagtcttcagaactgtaaggacatgcttgctacatgccaaaatgaacttgaggctgcaaaatctgagattcagaagtggcattcttcatttcaaaatgaaccttttatatctgctgggaccactccagcaccgaaatcggtgattaattatcttcaagctctgaaatcatctgaagagtctttaagagagcagcttgaaaaagcaaagaaaaaggaagctgcattcattgtcacatttgccaaacgggaacaagagatagcagagttgaagtgtgctgctatgcaagcattattgcgtctcaggtttgtgatgcggctaaaattctggcacaatggagtggcagcaatccgctcctatggtggttacttggcgagtcctggtgcagcggtaaagttgtgccttggtgacttgttggtcatgggttcgaatccggaaacagcctctttgcatatgcaaggggcgagccctggtgcagcggtaaagttgtgccttggtgacttgttggtcatgggttcgaatccggaaacagcctctttgcatatgcaaggatttgtaatgaccctgctactgactctggggactgatcctgctgggatattctttgctaacgctaggaggttgttactagatccagcagttcatgaagagttcacacgattgaaggataaaaaagtaaaggagttgcaagataacattgctgctgtaaactttactccccaaagcaagatggggaagatgctgatggctaaatgtagaaccctacaggaggaaaatgaggagattgggaatcaagcttctgagggcaaggtgttaatgttgcaagataaattagaagagaaggatcaggagatccaaagactaaaagatgaattacaaccaaaaagcctcgtcgtggaggacgagaaaacagatccagcatctaataggaattatgatgaaacgatacctactgaagccgctaagtag

SEQ ID NO: 54657 - DNA, 1035 bp, Glycine max
  Peptide Sequence Number=SeqID_171435
atgaaggcaacacttcgatacttagcaggccttgctgggccaagtggtttcggctcaaattcaacagctgagcaagtcactgaagattgctgttccttgctcccttcaaatctaaccgctctcatcactgcattaccctctgatcttccagaagctgatcagcacgagtgtggtgcgacttctggtattggagctgaaacagctagagtgttagcaaagagaggagtgagggttgtgattggtgccagggacttgagaaaggccaaggaagtgagagagaaaatccaaaaggagagtcctcatgctgaggttattctgttggagattgatcttagctcttttgcttctgtacagagattttgttcagagtttttagctttggaactgccccttaatattctcataaacaatgcaggaatgtactctcaaaacttggagttctccgaagagaaaattgaaatgacatttgctacaaattacttaggacattttttgctaacgaaaatgctactagagaaaataatagatacagcaaagaagacaggcattcaaggaagaattataaacgtttcttctgtgattcatagctgggtgaaaagatcttgtttttctttcaacgacatgctctgtggaaaaaattacaatggcacacgcgcatatgctcagtcaaaattggccacaattctgcatgtgaaggaggtagccagacagctgaaggaaaggaatgcaaatgtaactattaatgcagtgcatccaggcattgtgaagacgggaattattagagcccataagggcttaataacggattccctttttttcattgcgtcgaagctactgaaatcgatatcacagggtgcatcaacgacgtgttatgttgctctaagcggacaaacagatggaatgagtgggaaatattttacagattgtaacgagagtaactgctcaagtctagcaaatgacgaatcagaagccagaaagctatggaacgacacccatgccttgcttcacaaacggctacgtcaagcaacaaattga

SEQ ID NO: 54658 - DNA, 2319 bp, Glycine max
  Peptide Sequence Number=SeqID_171436
atggcgccaagcctaaccgccaagcaagaagcggcgcttctcaacgctaatccacacttatccataaaactccaatcctcaactttcttcgctaacaaccacccaatcctcacccaagtcccacctaacataacaacaaccactccaccgccccacgatgcttccaccacccccgccggatgcttcgtcggtttctccgccgacgaggcacgcagccggcacgtgatctccctcggcaaactgaggggtatcagattcacgagcattttccgcttcaagctctggtggagcacccactggtccggcagcaacggccgcgacgtggagaacgaaacccaaatgatgatcctccaaaacgacgccgtcgagggccgaccctacgtcctcctcctcccactcctcgaaggacccttccgagcctcgctccaacccggcctccacgacgacgtggacatctgcatggagagcggctccgcacgtgtcaccaagtcacgcttccgaacctccgtctacatgcacgtgcacgacgatccttttactctaatcgacgaagcgctgaaagtaatccgagtctatctgggaacgtttaggttaatggaagagaaaaccgtgccggggattattgacaagttcgggtggtgcacgtgggacgcgttttaccttaacgtgcacccggagggggtgcgggaaggaattaagggcctggtggagggagggtgtcctccggggttggtactgatcgacgacggttggcaaacattttgccgtgacgacgaaaccgtgagcgacggggggagtttaaattgctctgtgccgggggagcagatgctgaataggttgataaaatttgaagagaatggcaagtttaaggagtataagtgtgggagggagggtaataagggtatgggtgcgtttgtgagggagttgaaggaggaatttagtgggttggagtatgtatatgtgtggcatgcgttttgtgggtactggggaggggttaggcctaaggtgccggggatgccggaggccacggtggttccgaccaagttgtctcccggagcggagatgactatgacggaccaggcggtggtgaagatcatggagattggggtggggttggtgccaccgcatcgggcgcatgagttgtacgaggggcttcactctcatctggaatcggtgggaattgatggtgtcaagattgatgtcacgcatattctagagatgctatcggaggaatatggtggtcgtgtcgaactcgctaaagcatattacaaagcactcactgcttccgtgaggaagcatttcaaaggcaatggtgtcatttcaagcatgcagcagtgcaatgatttcatgttccttggtacggaaaccatatcacttggacgagtcggtgatgatttttggtgcacggacccagctggagatccaaacggtacctattggctgcaagggtgtcacatggtgcactgtgcttacaacagcttgtggatgggaaatttcatacacccagattgggacatgttccaatctgatcatgcttgtgccgaattccacgctgcttctagagccatttctggtggaccaatttatgtaagcgactctgttggaaaacacaacttcaagttgcttaagaagcttgttctacctgatggctccattttgcggtgtcaacattatgcacttcccacccgagactgcttatttgtagatcctttacatgatgggaaaacaatgctcaaaatttggaacctcaataaatgttccggggttttgggtctgttcaattgccaaggaggaggttggtgccctgttactaggcgaaacaagagtagctctgactattcacactccgtgacttgctttgcaagtcctcaagacattgaatggggcaaagggaagcacccagtttgcatcaaaggggtggacgtatttgctgtgtacatgtttaaggacgacaagttgaagctgctgaagtacacagagagtgtagaagtttctcttgagccttttagttgtgagcttttgaccgtttctccagtggtgatcttacccagaaaatcaatccaatttgccccaattggattggtaaacatgctcaactctgggggctctattatgtcattggaatttgatcaacaggaaaatttggcgaggattggggtgagaggacatggggaaatgagggtatttgcatcagagaagccagagagtgtcaagattgatggagaatctgtggaatttgattatgttgatagaaccgtgaggctccaagtctcgtggccttgttcttcgaggttgtccgtagtcgagtatttgttctga

SEQ ID NO: 54659 - DNA, 585 bp, Glycine max
  Peptide Sequence Number=SeqID_171437
atggcatcatccagctcttacaactctccatgtgctgcctgcaagttcttgaggaggaaatgcatgccaggatgcatctttgcaccttactttccaccagaagagcctcaaaagttcgcaaacgtccacaaaatctttggagccagcaacgtgacgaagctcctcaacgagcttctccctcaccagagggaggatgcagtgaactccctcgcctatgaggcagaggcacgcgtgagggacccagtttatggctgtgtaggagccatctcattcctgcagagacaagtccaaaggctccaaaaggagcttgatgctgcaaacgctgatctgctacgctattcttacactgacatcactccaacctctctttctgtgccaccaggacttgcttcatttcaccaagtaccccaaaggcagtttagtgcaagatttggtaacgaagcaagtgggttttatcgccaccaatctgctgctactgctttttcctttccttatgctcttccttggactgatacctcctcggaggatatcagtgagggagcaggagcaggaggagccagggagttaggtagtctttttctttag

SEQ ID NO: 54660 - DNA, 897 bp, Glycine max
  Peptide Sequence Number=SeqID_171438
atggatataaaaagagctgacctgcctttattgatttcgctggatattcttctggaggaaaaaaatgtaaccaaggcggcgcagaggctcaatatcagccagcccgcgctctctacgcaattagccaggctgcgggtgttgttcgaggatccgttgcttgtaccggctgaagtcgggcgcggtatggtgctgactgagcgagctctaaaccttcagcataaattacgggcatccattaacgagcttaagtttgccgtcaatttcaaatccagttttgatccgctcacttcccgccgcaaattcaccattgcaaccaacgatagtgtgttcacgattctcggcctgccagtcttaaaaaaggtactttctcttaataatccagggctgcaaatttcatttgtgtcggtatttggcgtgaatgtgaaagaagacctggagaaaggtcatattgatctatacataggcgatatcaacaaaatgccagacagcctcaaggtcaggtatttaatgaaagacagctttatcatggcgcagaaaaaagggcatgcaagaggcacaaaaaaaccgacactcaatgaatattgccagttgtcccatgtcatcgtatctgcaaagggtgacttatccagctcaattgatcatttgttatccgagcagtcgcaaacccggaatatcgtggcttctgtgcccagttataaccagattgctttggtgctcaccaacagcgattgtgttgctaccttacctaagcagttactagaaaagtatcaagacacgttggatttgattgagctgccattcgctatcccagcctttgagctaggtatggcgtggcatgctaagtctcaagaggatgaggcgatggtttggttgaggcagcagtttgtgagtgtctaa

SEQ ID NO: 54661 - DNA, 275 bp, Glycine max
  Peptide Sequence Number=SeqID_171439
atgtcgaatcactcatccccgcaaatcccactatccaaagccagacaaaacctgattatctttgccctctccattggcgcatttgccatcggcttaagcgaattttgcagcatgggcttgctgctggaaatcagccgtggattaggcgtatcagaatctcaagttggtgcttccatcagcatttatgctttaggtgttgtggtgggcgcaccgttgctggcgatctttggtgctggtcttaaaagaaaaaacttactgcttgtgctcgcatttat

SEQ ID NO: 54662 - DNA, 591 bp, Glycine max
  Peptide Sequence Number=SeqID_171440
atggcaaaacaaataggggtgacatgcggtacagaccaagaaagcatcattgacaagatttgggccatggagaacagagacaggaaagaggagatgaagagagagcaaattgacaacacaatgtgccaagctatatggggagatactgatgtgagctgggaaatgcagcttgctttaaatacaacaggtggattactgtgtctttggagtgagaaaagtttcaaagtggaaagaaagaaagggtgggcgtatccagaggagggggtggaggataggctcatcactgaattcaatgactggatagtggatctcaaagttgtagagccaccatgtgtggggagaaaatacacgtggttcagaccaaatgggacaactaaaagtaaattggctataacatttgtctccactgaatggttcactaaatggccaacaagtactgtggaagcaattccttccaagattattttgatgatgccaaagaatcaagagtcaagcaagttccagagaatcaagagtcaagcaagtttcaagaatcaagatcaagattcaagaataatcaagatcaagattaaagattcaagattcaagtaa

SEQ ID NO: 54663 - DNA, 212 bp, Glycine max
  Peptide Sequence Number=SeqID_171441
gtggtgtctcgctaagcgagacatatgcgcttagtgagcaacatcttctaagcgagacatcagcttgcttaacgagtcaagagaatctggaagagaatctgctacgcatgcacgtgcccaacgcgccatcagcttgcccagcgagtcatttgtctcttctgacacttagcgcgcctgacgcgctaagccaaaattcacttactcatgattag

SEQ ID NO: 54664 - DNA, 1173 bp, Glycine max
  Peptide Sequence Number=SeqID_171442
atgaagcacggacaccccagtcccttgccatgtccgatgttcgacacgcatccgtgtcagtgtccgataccaacacgacactcgtactacgttctatattgtggacattacaggtgtccccgtgtcggtgtcgtgtccgtgtccgtgtccgtgtccgtgtctcttagcttaattgcattggttgcgttatttgggacgaggtacaagtacatgctcggccaaaccaattatatccttggctgttcttatgatcttgtgtatttacctcgtttattaagcttgggttgtgctgaccttaatttctcagatagtacacgcgtgctgtatgttgacattgatgttcaccatggtgatggtgttgaggaggccttttacaccactgatagagtgatgacagtgtctttccataagtttggggactttttccctggcacaggacacgtcaaggacattggggtgggatcaggaaagaattatgcagtcaatgtcccattaaatgacggaatggatgatgagagtttccgtagtctgtttcgaaccatcattcaaaaagtcatggaggtctatcaaccagaggcagttgttctacaatgtggagctgattcattgtctggggacaggttgggttgcttcaacttgtctgtgagaggtcatgcagattgccttcgttttcttagatcgttcaatgttcctttaatggtcttgggtgggggtggatatacaattcggaatgttgcccgttgttggtgttatgagacagcagtggcagtaggagtggagcctgataataagttgccttataatgaatattatgaatattttggcccagattatactctctatgtcgatccaagcaacatggagaacctaaacacacccaaggatatggaaaaaataaggaacacactactagaacagatttctcaacttccccatgctcccggtgtaccttttcagacaacaccacctaccttacaacttccggaagaggcagaagaggacatggatagaagacctaaacttcgcaaatgggatggtgaagattatgattctgatcctgatgaaggtggaaaggctaattccaagtttccaaacgtcactgcccatatgagggacattacagatgaaatggaagaagagaaaccagaagtgcatccatcatcttgttgttga

SEQ ID NO: 54665 - DNA, 165 bp, Glycine max
  Peptide Sequence Number=SeqID_171443
atgtttgtattgaacaatgccttgaaaggatttgacgatactccacaaagtaaatccaaggctactgttaggtggattgttgttaaaacaaaaaggaagtactgcatgcgagtattatgtcatgcaccagatgtcaactataatcttaggaagtttcaagaataa

SEQ ID NO: 54666 - DNA, 886 bp, Glycine max
  Peptide Sequence Number=SeqID_171444
cttacaagaacttggtgagctagatctctcatacaataacttccgtggtaagataccttctgagcttggtaactgctcaaaactactcaagctttctctccatcacaataatctctctggtgaaatcccccaagagattggaaacctcacttccctcaatgtcctcaatttgcaaagaaacagcttctctggcataattcctccgacaattcagcgatgcacaaagctgtatgagctcaggctctcagaaaacttgttaacaggtgctataccagttgagctaggagggctagctgagttgcaagtgatattggacttgagtaaaaatctcttcactggtgagattccaccatctctaggaaacctcatgaagctagagagactcaacctctctttcaaccaacttgaaggaaaagttcctccttcacttggcagactcacaagcctgcacgtgctgaatctctcaaacaaccaccttgaaggccagattccttcaatattttcaggattcccactaagctcattcctgaacaataacggcttgtgtggcccacctttgagttcgtgctccgaatccacggcacaggggaaaatgcagctatcaaacacacaagtggcagtaatcattgtggccattgtctttacttccacagtgatatgcttagtgatgctgtatataatgctcaggatctggtgcaactggagaaaagtggcaatttcaagtgcagagggtggtggcactgttgctcacaagaccaggaatggagagtattggaatatgaattcctttgggttcattccttcaccagataagcagaattcagcagcaacaacaacttcattctacaatctcaaaatggaaaccatggaaaatacaagtatgtaa

SEQ ID NO: 54667 - DNA, 1866 bp, Glycine max
  Peptide Sequence Number=SeqID_171445
atgggttccatttggatgtgccatttctttctgttattgtccatacttggtactacctttattgcaactacggccaataatgcaacagattcctactggcttcacagaattaaatcagaacttgtagatccatttggtgcccttagcaactggtcttcaacaactcaagtctgcaactggaatggaataacatgtgcagttgatcaggaacatattataggcctgaatctgtctggttcaggaatatcaggttccatttcagctgagttaagtcacttcacttctcttcgaacacttgatttgtcttcaaattcactttctggctccatcccttcagagctgggtcagcttcaaaatctaagaatattgcaactacactcaaatgatctctccggaaatattccttcagagattggtaacttgaggaagttgcaagttcttagaataggagacaacatgttgacaggtgaaattccacctagtgttgccaatatgagtgaattgacagtgttgactctaggctactgccacttgaatggaagcataccctttggaattggtaaattgaagcatctaatatcacttgatttgcagatgaacagccttagtggccccatacctgaagaaattcaaggctgcgaagagctccaaaactttgcagcatcaaacaacatgcttgaaggagacttaccttcctctatggggtctcttaaatctttgaaaattctgaatctggtcaataacagtttatctggatcaattcctacagctttgagccatctttctaacttgacatacctgaatttgcttggaaacaaactacatggagagattccttctgagcttaatagtctgattcagttgcagaagcttgacttgtccaaaaacaacctttctggatcaatacctctccttaatgtaaaattgcaaagtcttgaaactcttgttttgtctgataatgctctgacaggtagcattccaagtaacttctgcctcagaggttcaaagcttcagcagcttttcttggctagaaacatgctctctggcaagtttcccttggagttactcaactgctcctcaatccaacagttggacctttctgataacagctttgaaggagaacttccttccagcttggacaaactgcagaacctcacagatcttgtgctcaacaacaacagttttgttggatctttacctcctgaaattggcaacattagtagcttggaaagtcttttcctatttggtaacttcttcaaaggtaaaattccgttggagattggaaggctgcagagattgagctccatttacctctatgacaaccagatttctggacccataccaagggagttaacaaactgcacaagcttaaaggaagtcgacttctttggaaatcacttcacagggccaattccagaaactataggtaagctcaagggtttggttgttcttcatcttaggcagaatgacttgtctggtccaatcccaccaagcatgggatactgtaaaagccttcagatattggccttagcagataacatgttgtctggttccattccacccactttcagttacctctcagaactcactaaaattaccctttacaataactcctttgaaggacctatccctcattcactctcttccctcaaaagcctcaaaatcataaacttttcacacaacaagttcagtggaagtttctttcctctcactggttcaaattccctgacccttctggacctgactaacaacagcttctcaggtcccatcccttccactctaaccaattctagaaacctcagccgtctcagacttggagaaaattatctcacaggaagcattccttctgaatttggccaccttact

SEQ ID NO: 54668 - DNA, 1002 bp, Glycine max
  Peptide Sequence Number=SeqID_171446
ttgaggttaccgcagtttgtcaacaagcaaagtgttgctcacctgaccatttctgatcaagacaaatcatatgggcatctacttggagtaccaaagttaagagcaaggctccagaaaccgcagactgcgctttttgttggttctgaggatcactcacaaatcagttgtctccaaagaactcctaaagacatctttccaattggcaactcatgttttcatatatcaggaaagaatggaagaaagccagttgtctcattctgtaaccgtccatttaacagagataatgaagtcatttcatcaaattcaaaaaggactcggatcagcatatcatcgcttatggtcccttatgtcctagttgcttctttcctttatcctcaacttattttacctgaagtaatccctaaaacttctggaaactcatcattaacaattttcctcctattattcttcacggaagcaactttctattatggagttgcggtttttcttcttatgctagaccgtttaatgagacccaaacaactggatctttctgcaaacaacagtaatactctgagcctacaattggaacagcgaatgtcttttgatattgccctggttgtgcctagactggttagtattgcaattccgttggtcacaatgggtttgacctggccatggactggccctgtagttcctgcaactatttttccatacctggttggtatagtggtccaattcaaatatgagcagattgcaagatattggaagtcaccatcatgggttgctattccttttatctttcatgcatatagattgcaccaaatacatcgagcagcaaaatttctaacagttatatcatttcaagttaagaaggggtatagcaaactgcctgtagccaggggttctttgtcaacaactacaaatgcctttcgtatccttattgtgatttggatttggtctttctcaagcttcctcatgagattcctaacttctgcttctgcttctacaactaagcagtga

SEQ ID NO: 54669 - DNA, 306 bp, Glycine max
  Peptide Sequence Number=SeqID_171447
atggcagttctaatttcccccctcgaaatacgttttttgttatcttcgtttcctcggaatgaatcgccgatgaattatagttgtaagaggaaacgagagtgtaccggatacaactggaaaatccgtcgcctcggagaaaccctagagaagcaattgcagaaaggtgagaagagagaaagggtgtggagtgaggttgagagagggagatctgcgggtgttagaagcgatgggtttcggatcggagaggaagagaagggttcattcgccagagagagaaataaaagagctgaaagacgtaacagttga

SEQ ID NO: 54670 - DNA, 1179 bp, Glycine max
  Peptide Sequence Number=SeqID_171448
atggctgccataatcgattgctcctcttcctctcctttcggttacttccaactcaacacaaatcccaaggtacgcacctcgctctctctatctctatctttcatctcaaaattgagtgttgtgcttactttgcgttacgatgaagcttttcttgctaatactgttttcttgttgaggttatcgcagtttgtcaaccagcaaaatgctgctcacctgacaagtaaagacaaatcatatgggcatatatttggagtaccaaagttaagatcaaggcttcagacaccccagactgcgcttgttgttggctctgaggatcattcacatatcagtggtctccaaagagctactaaagacacctttcagattggaaactcaagttttcatatatctggaaatgatggaaagccagcagtctcattctgtaaccgtccatttagcagagataatgaagtcatttcatcagattcagaatggattcggaacaccttatcatggtttattggccctgttgtccttgttgcttctttttgttttcctctaatctgtttgcctaaaatgatcagtaacatttttggaagcacggtatcaaaagctctcctcctatcattctcacaagaagcaattttctattgtggagttgctgtttttcttcttctactagaccatttaatgagacccaaacaactggatccttctgcaaacaaaagtgatactctgagcctacaattgggaaaggaatacttctattctattgcttccatgatgattagacagcttggtatcacaattccaatggtcacattgggtttgacctggccatggaatggccatgtaattcctgtaactcttgctccatacatggttggtgtatttgtccaatccgcatttgagatgcttgcactgtattggaagtcaccatcatggcctgctattccttttatctttcatgtatatagattgcaccaaatacataaagcaacactttcgctaacatttctgttatatgacctcgcggaagctgagaaggtctatagcaaactgcctttaacccccagtacttggttaggactcacaaccgttcttcagatccttcttgtgatttggatttggtctttctcaagcttcctcgtgaaattcatacgttctgcttcttcaaccaagagtgatgcagatgcctag

SEQ ID NO: 54671 - DNA, 207 bp, Glycine max
  Peptide Sequence Number=SeqID_171449
atgggatggggtgaagtttccttactgcttgatctattttttatgttgatgattttacaaggatgtgacactttggaatcactcaagttcatagcagcagcaatagctagttctttgcattgctccctatcaagttctccgccaatccagagcaagaaaggcacgtatagttttgtgcaaaagttgataccagacaaggatgtctga

SEQ ID NO: 54672 - DNA, 756 bp, Glycine max
  Peptide Sequence Number=SeqID_171450
atgccttctttcactagtggttctttgttcttatataagattgcttgccagcaagttgcaaaagggaagaaaaaagatcttttctttttctatagattccagcacaacagattagacattttaaaggtaatctacttcttgaatattgagttctcgaagaggcactggcggatcaccttggaacttaaccggggacctgctccagggaccatggttgttaacacgggaatggtcattggaattcgtgagaaattcaggttggcgccttctgcgaactggaacaacctgccagattgtgaaatacgtattcttccatcactcgagacaatcctgttcgagctgggtaaaattatcctgggtgatgaagttctccctccatcatttatgagcattgagaagcatgtcacggatgacacaaactttacatgtgaacttccatcaatctcttgtgaaaacaataacttgacgctaaacacattaaaaaaacagttagaagtggaaacatttgttgagctgaatgcaaacggtgaacacccccttctattgcattacaaagactgtggggatagtgaaattggaagagttgtgattcaggctgctaaagagcgaaaatataagaccataagcataattgatgacaaaccagtaactcttgatatcattgaagaattaaaagcacttggtggagatattgtaccagaaagtcatactaagacttggtatggtaggggtcctaaagcagtggatattgtctag

SEQ ID NO: 54673 - DNA, 189 bp, Glycine max
  Peptide Sequence Number=SeqID_171451
atggcgtcattcttgtttgcgcacaacttgatagaaatcttgttgacgaagtttctgtatcgttgctgttgtcagtggcgtgtggaaggaggtctgaatagagatttgggcagttggatttctggtgcggtgagtatttggtcgaggttggggtggcggcgtggtggtcatgcatcgttgcagcttgag

SEQ ID NO: 54674 - DNA, 252 bp, Glycine max
  Peptide Sequence Number=SeqID_171452
atgaccaccacgccgccaccccaacctcgaccaaatactcaccgcaccagaaatccaactgcccaaatctctattcagaccttaagctgcaaaatctactcctcctcaacagcgttgacatcctctctctctttagacctcaagctgcagaacctccttccacacgccactgacaacagcaacgatacagaaacttcgtcaacaagatttctatcaagttgtgcgcaaacaagaatgacgccatcgttttga

SEQ ID NO: 54675 - DNA, 852 bp, Glycine max
  Peptide Sequence Number=SeqID_171453
atgggggatgggtgtgtacctgcaaaaaagacactcagactctcagtcattaaggaatctaccagcgtcaatatagatcccggtcaacacccaccggagttcaattcaaaagtcgtgaaagatgctcttcaaactggaaaaggatatgtacatgactttctagatatcaatggccaacccgtgctcgtggtggttggatcaaagcatattcctcaagcactggaccctgcagacgacgagaggctctgtgttttcttaattgagaaggcattgagtaagtttccaactgggaaagaacaaatacttacaatagttgatctcagaggtttcagtacagaaaatgctgatcttaaattcttgacattcttgttcgatatattctactattactatcccaagcgattggctcaagtcctatttgtagatgcaccttttgtttttaagccaatttggcagctagtcaagcccatgttaaaatcatatgcttctctggaggtatttgcctttagaagggtatctctactggtggtagctgaccatgcattttcaacttctgaatttgtggttgagggttcatgtcttagacccttcccattaggctcaggtctctatgctgccctgtcttcactttcttctgccccccgattttattttacaggacatagtgctcagctcctgttgggaagaataccatctggacgtaatactgaagagacaagttcatattccgagaagactggtcttgtgttttccatgcgaggagcaaaatttcatattcagtttattgcttccgttttggcatttcatcttaatatgcttaccaatatctattgtacaagcggtacaaactaa

SEQ ID NO: 54676 - DNA, 270 bp, Glycine max
  Peptide Sequence Number=SeqID_171454
atggctcataaaatttgcattagtcattttggttatgctgctattgtttctgggttgattttgggaaactcaatgcgtcgtcgtattacaccgtggttgtggattgtggaggcactggaacacgctttggagcctttgattgtgtgggcagagcatctggtgccgcgagaaatgcaagggaaaactcctgtttttgtcttggctactgctgagttgaggaggctccccagggaggaggcgagccgggtcttgggggacgtcgaggctgtt

SEQ ID NO: 54677 - DNA, 570 bp, Glycine max
  Peptide Sequence Number=SeqID_171455
atgccatcaacagtgagggatcacgggattgttcgaaggatggcaagtcttcctcgaagcataatgggagggatttcaagagcaatgggggatggaatgggctttataggaagaggaagaagaagaaatcagcacacaaatattcctttgcagcctcaagaccatcatgttccacaaccacatgaggagagggctaagcaggaagaaaagatccgagctgaccgtaggctcagagaagaacaagatgctgcatatcttgcagctttacaaattgacaagagagaggagagagttcagaagctggcggaagctcacaacaacagaaattatgggaaattgattaacaattcgatgaatgtcactaaacagaacagcaaagtgaatgagttcaataaagaaaagggagacaagggagttgctagtaaaggaagcgagtctcagcccacacagatactcataaggtttccaaacggtgaaagaagagagcatactttcctttacacaaacaaaatccagtccattttctcatacattgattcattaggtttgccagggattggaaactgctga

SEQ ID NO: 54678 - DNA, 234 bp, Glycine max
  Peptide Sequence Number=SeqID_171456
atgtccattggatttaatgatgaaatatgggcaatttcagctcatcagtgggctaagcgcgcatccaccgctaagcaaagcttcagcgcgcttagcgcgatagaagaatctggtagggtatcatcatcaaggtcgcgcgctaagcacgagatcagtgcactaagcgcaacagttgttttcagccaagctcagcgcatgactggtactaagcttaaatccacttactcgcactaa

SEQ ID NO: 54679 - DNA, 1608 bp, Glycine max
  Peptide Sequence Number=SeqID_171457
atgaagaagggatattcagtttccttgacaaaacaacaacataagaaagagccattttttgcagttcatcacacaagaaaacaacaccaatgcatccaagcaaatcatgatgccacagaagaaacaagctcacagcaaaatcaatattccctcaaattggctctttcttccacttcccaaaatactactctactactgcctgcttttgttactttgctgctacttgttacctcaattggcacagcattctctcaccccaccattgtctccaattcttcttcacctttgccaccagcactctctcactccaatgctaataaccaaactttgagacctgctgcagtgctgcaaaagttgaggagaatcagaactcatctcgacaagatcaacaagcctgctgttaaaacaatcaaggcattttcctttgctttgctttctgtgacaatgacgccaccactgcattttccttctactgattcaagtccagatggggatttgattgattgtgttttgtctcatcagcaacctgcgtttgatcatcctcagctcaaagggcaaagaccattggatccaccagaaaggccaaagggacacaccaatggagaaacagtcgtagagagctttcagctttggactgattctggtgaagcatgccctgaaggaactgttccaatcagaagaacaactgaacaagattttctacgagcaagctctgttagaagatttggaagaaaaccaagaaatgtacggagggactcaacaggcattggtcatgagcatgcagttgtttctgtaaatggagatcaatactttggagcaaaagcaagcataaacgtgtggacgcctagcgtaactgatccatacgaattcagtttgtcacagatatgggttattgctggatcgtttggtaatgatctaaataccatagaagctggatggcaggcatgtccaatgtccatatatacttgtccaaaaattcacattcatctattttttttagtactaaatattgtgaaggtgttgaagaaagtaagccctgagctatatggagacaactatcctaggttcttcacttattggacaacggatgcatatcaagcaacaggatgctacaacttactatgttcaggatttgtccaaaccaacaacagaatagcaataggggctgcaatctcaccaagatccatctataatggcagacaatttgatattggattaatggtttggaaggacccaaagcatggacattggtggctggagtttgggtcggggctactagttgggtactggccagcatacttgttcagtcacttgagaaaccatgcaagcatggtgcaatttggaggggaaattgtgaattctcgttcaaggggctaccacactggcactcaaatgggtagtggccattttgctggagaagggtttagaaaagcagcatattttagaaacttacaagttgttgattgggacaataatttgcttcctctatcaaatattcaccagttggctgaccattccaattgctatgacataagggtgggatcaaacaatgtttggggaacttacttttattatggaggtcctggaaggaatgtgagatgtccatga

SEQ ID NO: 54680 - DNA, 1347 bp, Glycine max
  Peptide Sequence Number=SeqID_171458
atggaggacagaaaagccaacacaatctctgtaatatcagtgattgcactgatcatcctcatcatcgtcgctcgtgtttccttgaagctctcgcgtgccttcttcctcatatgtggcgcttctattgctgtgatcctcgctgtcttttcttgtgcactcataaggcaccgttacaaccacagaaggaggttgttggagtcacagttgaagacagaagggagagagcttcgaatagagtacagtttcctaagaaaagttgctggtgttcccacaaagtatcgtttcaaggagcttgaagaagcaacggatggttttcaagcacttttaggaaaagggtcctctgcttcggtcttcaaaggcattctcaacgatggaacttcggttgcggtgaaacgaatcgacggcgaggagcgaggggagaaagaattcagatcagaagttgcagccattgcaagtgtgcatcatgtcaacctcgtacgtatgtttggttattgtaacgctccaacagcacctaggtaccttgtttatgagtacatcccaaacgggtccttggattgttggatttttcccttaagggaaaatcatacacgtaaaggagggtgtttaccgtggaacttgaggcaaaaggtagctattgatgttgcaagagggttgtcttatcttcaccatgattgtaggaggagggttttgcatcttgatgtgaagccagagaatatactcttggatgagaattacaaggctcttgttgctgattttggtctctcaacgcttgttggaaaggatgtgagtcaggttatgacaacaatgagagggacaagagggtacttggctcctgagtggcttttggaaagaggggtgtcagaaaaaactgatgtttacagctatgggatggttctgttggagatcattggagggagaaggaatgtgtcgagggtagaggatccgagggacaggaccaagaaaaagtgggagttttttcccaagattgtgaatgagaaagtgagggaagggaaattcatggagattgtggatcgtaggttggtggagcgtgggagtgttgttgaggagagtgaggttactaggttggtgtatattgcattgtggtgcatacaagagaagccaaggttgaggcctagcatggcacaagtggttgacatgcttgaagggcgtgtgagggtggatgaaccacctggttcaagaatgattcttgttgatttgcttgctgttgatgaagatcctgcagatcatagaaatttggcaaggttgttgacatctgtgtccagccatgtggattgtacatctacttactctttgggaaccacaaacactattttatctggtagatag

SEQ ID NO: 54681 - DNA, 2274 bp, Glycine max
  Peptide Sequence Number=SeqID_171459
atgagattcgtaattacgaagaatcccattaatcttctcaactctcagggttcgcttgttcttttccgtgttccttctgttgctcgcaattttcttcacccttcgagctcgaaatggactccacgtagctccaatcccctcaggttttcgttttcttcattgagagtttcagtttcgtgcgcttcttcgtcctcgactgtgtacggaggttgggacgatctcggcagttcagacgcgcccggtgaatccaacgcgctgcgcaattttctggtttctatcggaatcgatgataggaagaacgttttcgtgttcctcttgggcctcgtttgtgcgttggcgatttctagggttaaggtttcttctatcgtcattcttcctgcttccgcgttggttttcgccgttggtttctcggtagggtttttccgaactggaacgttcggggaggtgagggccggtgggagtaagaggagggaaaaggaagagaattcgaattcgaagctgtcttcggagaaattgaggagtttggtggaattttttgacgagcttgatgttgtggtcgatagcttgaagagtgatgtacaaagtgctattagggataataagattcgagtgggtgatttttatggttatgttgaagtcaccgataagattaaaatttcagctaagaatgctaggaatgttgttagggctttgattgataatgaggacaaccataagaatggtagaagaaagaaacaagttggagaaagtgggcaccagattttacagtcttttagcagtttgtttggggaaaatttgtttagctccaattctaccaaagtcagagaaaatgttaagcaagaggcagtggatagaacgttggatcaaactcgaggaagtggtaatgttcctctagttgaagacagggctttgaatttggttgatgatcgtatgggaaatagtaaattggatttggatacttctcaagactcatctactaactctgttttggatatgaacagaaatggaagaataagaactactcctgagggagaaaatgttggcttagtggacattcggagaagcactaataaattctttgatgataaagagtatagtgacaggaacaaaggattgaggttcacaaataatcacagtttctctttgaagatggattccagtagcataacagacatgtgggaatcccaaaacagtctgcttgattctgagagctttaaagtcagaacaaaacacatggaaagtgagtcctcttttttgcgtgagcagctgctcgatggaggtcatgagactttcaggtctgctcactacaagagggagggtggatctaacaggtctcagtataacgatgatacggtgaattacgatgataatcaccatcttgcagatgatttgtctgcacacgagaatgaatcatctacaaagatttcagatgatatgatgtttgataggtatcttgctgaagcaacagaccttctaaaacaagcgaaagagtttataaaaggtaggcagggtgaagagcaggctgaaatcatgttatacaggtctgcaaacttactatccaaggctgtggagttgaagcccatgagtttgttggctgtaggccagttaggaaacacttaccttcttcatggagaattgaagttgaagattagtcgtgaattgagaactcttctttctgggagcatccaaccatcatctgtaaaacatactagaatattgaagggactgaggaataaagtcaattgtaaagaagaagttgtgccatttcttattgatgtttgtgaagagtgtgaagagctactagtagaggcaggaagaaagtataggctggcattgtcagttgattcaaatgatgtgagagcactgtataattggggtcttgctctttctttccgaggccaattgatagcagatattggtccgggtgctgcttttgaggctgaaagagtgttcttggctgcaattgacaagttcgatgctatgctgttaaagggcaatgtttatgcaccagatggtgcaactagagaatattatgctgacagattctccataaaagtatatagccttctatcagttccatggaccgttagaatattaaaggtcatagagcatcagcgatctcgcttaaggccgggaagtagtaaagagaaggtaaagttactgcagcaagcaaaaaggctatatgaagatgcccttgatatgaactccaataatgtgcaagtgaaagacgccttatcctcgtgtcttgccgagcttaattatcgacagttttag

SEQ ID NO: 54682 - DNA, 645 bp, Glycine max
  Peptide Sequence Number=SeqID_171460
atgaacccacttgccaaggtcaagagcaccaagggaagcacaagccggaagaacgcccaagaacgttacatcattgggctttacgtttttttctctaatcatgagctcaaacagcaccaaggcttcctcgtacaaactcaagtagcaataaccaccaatcatagtattctacaaaatcatatctttttcctcaatcccatcaaacaactcacgcgtggtgtcaatttcaccacacttggaatacaaatcaacgagtgcattaacaagctgaagattcttaccaagcccgcgatctctaacccaagaaaagatccatttccccatctcaagcgaccccaaatggccacaagcggaaagaacactcagcatcgtgctctgattcggcgacacgtcagcctcccgcatgcgtgtaaagcaagccagggcttcctcaaagcgaccactttggacatacccagcaatcatggcatccatgaaaccacatccttggcgggaatttcgtcgaaaaggcgtcgagcgtcatccgcgtggccctcggagacatacccagtaataatagcagtgaaagacacggcgactctcagagtaattttatcaaacatcaagcacgcatcccgtaactccccaacttgggaatacatgtga

SEQ ID NO: 54683 - DNA, 492 bp, Glycine max
  Peptide Sequence Number=SeqID_171461
atgaatctaaggccattggggccattggttaggatggctgcagttatatttggtggagtagccactttgaacttggcttctgctgctaccatcaaagtgcttcggtttgcatctgagaagaaacgggaaaaagttgcgttgccctgttgggtttgtagagggaaggggttttatatatgcaaactgtgcaacgggaacgccaccatatcttggtccccaatgttcgaccctattgcagttaacccctgcgtttgtcctacttgcgaagaggataactgtacattattgacaacatgtatggttggctctgttttgcttcagataccaccctttgaaactgatgttcttgcggaaggtgattttggccattttgataagaccctcacgggaatttcatcaaagccaaaacattattcgcaccaagaattccaacaccaaaagaagaaaggcatgggtactctccaaagcgatagactggattcatcatcttaa

SEQ ID NO: 54684 - DNA, 1473 bp, Glycine max
  Peptide Sequence Number=SeqID_171462
atgttatcagctgcacccagcatgaatactaacacctctgtgatcaccgccatcaccaccacacgggacgaacccgactatgacagcagctcctcctcgattacggtaccggaatcaagcaggagctggatgaccaacctcagcttcggcagccggcgccgccggagctcggtctccgtctgctcctccaccgcggagagcccgcacgcaaagccccacaaggcgaaccatgctgcatgggaggcgatgcggcggctcaggcgggacaaggggcaggtggggctggaccacttccggctgttgcgccggctggggagcggcgacatcgggaacgtgtacctttgccagataaggaaccccattgtggggttgccgcagtgcttctatgccatgaaagtggttgacagagaggcacttgctataaggaagaagctgcagagagcggagatggagaaggagattctggccatgcttgatcaccctttcttgcctactttgtatactgagtttgacgcttctcattactcttgcttgctcatggagttctgccccggtggagacttgtatgctgctcgccaacgccagcccgggaagcgcttttccatagcatcctctaagttttatgcggctgagacactattggcactggagtatcttcacatgatgggaatagtgtacagggatttgaagccagagaatgttcttgtgagggaggatggacacattatgcttacagattttgatctatcgctgaaatgtgacgttgttcccaagctgttaaggagcaagaccagattagaacgcagcatcaagagtacaaagagatccatgccagcctgcactgcccccatgcagcctgtgctgtcatgtttcttgtcatcatcaaggaagaaaaagaaagccactgtgacaacagttataagggaaaatgttgaggtggaagaaaatgatccagagctggtggctgagcccattgatgccaagtccaagtcatttgtggggacacatgagtacttggcaccagaagtgattctgggccaaggacatgggagtgcagtggattggtggacatttggggtgttcttgtatgagatgttatatggtagaacacccttcaaaggtgaaaacaatgagaaaactctcgtcaacattttgaagcagcccttggctttccctagaattgtagttggcaccagcaaggagtttgaagagatggtgaacgttcaagaccttataagcaagttgttggtgaagaatcctagtaagagaattggaagcctcatgggttctgttgagatcaaaaggcatgagttcttcaaaggtgtaaattgggccttaattagagcagttaggccccctgaggtccctagtgaaatgaacaaacttaggagtagggttttgctgccaaaactaagcaaaacagatagggatcagccttatcagcttagaagtcatcattttgaatacttctaa

SEQ ID NO: 54685 - DNA, 2271 bp, Glycine max
  Peptide Sequence Number=SeqID_171463
atgagtttctctgaccatattccatccttcatgatgtcaccgccgtcattttccacagacacggatgccattgaagtgaggcttcaatttccaatgaacaacgaatcgttggagccacattcaccacaggatcgacccccttcgttcaagagggcaaggacctgtgataacagcctctccaatgcaatggcatgccctccaaggatgattcagcaccctgcagttaacaaaggaacgagccacattttcttcaagacccgcatctgtgcaaagttcagagttggtgcttgtagaaacggcgagaactgcaattttgcacatgggcttgaggacatgaggcagccgccaccaaattggcaagagcttgttgggttgcgcggtgaggagcggccaccgatggcgggggattgggatgatgaccagaaaatcatacacaagatgaagctgtgcaagaagtattacaatggggaggaatgcccctatggtgataagtgtagttttcttcatgaagaccctgccaggttcagggatgattcggtgaggtacagggagagcacatctataagcattggaactaatggatcccccaagtcctatggtgatgcctctaataatttagaaagcaatagggctgtgaatactggcttaaatgttttccgggggaatgttaaatctacctattggaagactaaactgtgcatcaagtttgagacaacaggccactgcccctttggggatgactgtcactttgctcatgggcaagcagagttacaagttcctggtggtcgcactgaggcagaaactgcaggtgtcaatccaatctcaactaaagctaccattccaaccttaccaagagctacatcagtttcttctaatgatgcacctcctagccacagagcaagtgtacctccagcaaacgaaaaggaacgagataagaagtatttactgaagtggaaaggacacaagaagatcaaccgaatttatggtgactggcttgacgatttgccgctcgttcacaacttgccagctctcgaagctctcaacgcgcgaattagcctaaacaacactcactcttctccctccccgagcttcaaggtgctgcctttcagaaatgggaggcccttggcttcttcatcggccggtaccggcgactcgccgccgatttgggatctgggttggctcggcttggacgatctcaggggtattttcgagaattcaggtgcccagttgagcgtggacttgttggtgtatctgaattcgagttcagaggacgacgccgtttactgggcaatcgatgtttctgataaagtacctgaattgggtagcaacaacgcggcggggttgtgttttgtggagcttcgaacgctcatggtggctacagactggtcggatttgcaactgatgggaaacttggctattgctggtcatgctaaggcactgctggaatggcataatttttcacgattttgtggccattgtggagagaaaacagtcccaatggaagctgggagacggaagaaatgttcaaatgattcatgcaagaagaggatatatccacgtgttgacccagtggtcattatgctcgttattgatagagagaatgaccgtgctctattggctaaacgaccgatgcgtatagctcgattgtatacctgcttatcaggtttcacagagccaggagaaagcttggaggaagctgtaagaagagaaacatgggaagagactggtattgaagtgggagaagttgtttaccacagttctcagccatggcctgttgcaccaaatagcattccatgtcagctgatggttgggttctttgcatatgcaaaatcccttgaaataactgtggacaagacagagttagaagatgctcagtggttcagtagagaagatgtaagaaaagcattgacgtttgctaaatacaagcaagcccaaagaactgcagcagagaaggttgagcaaatgtgtaagggactagaaaagaatcgaagcttggcttcagatctcaatgtggagagtgctgatgaacaacacgcttcaatagttgttcctggaccctttgcgatagcctatcaccttatttcttcttgggccttctcagatcaaaatgtagtaaatgaccatctgctttctgttatggtttcatgctgtttctttgataaccttgcaattgatcttaatcttgtagtattaccagagttcttgaggattcctttatgcaaggacagtgtggaatctttgttggatgttccatcttggagaggtggttga

SEQ ID NO: 54686 - DNA, 957 bp, Glycine max
  Peptide Sequence Number=SeqID_171464
atgtctgtgcagacaatgaatcaccctccatttcttactggtgatgcctttagaaagaggactcagactcggtgcagagggagagcaaattcaagcacagctttgcagttatcttctgatgagagtggaaactatgcagaaccatgtacttcccttctaagccaaccaaacactattggtgttataggaggggtatcacttctatcaactctgattttcttggagaaacttgcttgttggggttcaagaaatggtaaagaatgtccaccttttgttgtttccagtgatcctgcgttgagcaaaatgctttcattacgcggtcccctcccttcagcaaggaccagatttgatcgtatcaaattgaatcaggaccttgtgattgagaatttgcggtgcaaaaggaactttcttcagcagtctggagctcggggtttggccatgccttgccatctctcacatgcgtggcacagtgaaatttctgaggatagttcactaccctttcttcatgttggtgattgtgtggccatggaactcaagaacgccaagttgaagccaattcatgctgctggtattgtgaggattggactgctgacaactgattcaaattttgtagctagttattaccaggagaggcttcaaagtcagggattcgaagtagtgttgctagacaaagcaaccgaagaacatgtattggttcctgcaatggaggcattgtacagaaaggacatagaaggggcaaggaatttattgaggattgcaatccatgttcttttggttagggcagtgaacttggtgcttctggcatctgatgatttgctaggggttctccctcacaatgatcctcttctaaggaaatgtatagaccccatggatgctttggccaggtcaactatacactgggcagaaacaatggtaaagaatttctcctttgtcacagcacctttccttgatagatag

SEQ ID NO: 54687 - DNA, 405 bp, Glycine max
  Peptide Sequence Number=SeqID_171465
atgagctggtctggaggagattggatgtgtggtgtttgtgaacacataaatttcaagaagagggaagcatgccagagttgtggataccccaagtatggtggccatgacccttcaacctacagatacaacaagactgaagcattagcaggggactggttctgcaactgtggagctcacaactatgccagtagatcaagctgctatagatgtggtgcaatcaaagactattactcttctggagaatatggatctgacactttcccccctggatggaagaatggagactggctttgcccaagactgagaagaaatttcagaaggcctggaatgtcaatcatttcccccaacatctttcttctccaaacaacattccatcttactttctctacgtcaagctctagataa

SEQ ID NO: 54688 - DNA, 819 bp, Glycine max
  Peptide Sequence Number=SeqID_171466
atgtggagtcaaatcatctgtataactgcagggctccattgggacaagatgctgaaggaaaaccaaaatttgtcatacgcccgcttcatttgttttttcagtgcacttatttttctgtttgccactgatagccttagtatgattaatcagtacagcttttcagaatgcttgttaaggtacactcctatttcagatccagaatcaaatggctattttgatttgctaatcaaggtatatcctgaagggaaaatgagccagcattttgcaagcttaaaaccgggtgatgttgttgaagtgaaagggcccattgaaaagctcagatatactcctaatatgaagaagcatattggcatgattgctggaggcacaggaattactcctatgcttcaggtaattgaagctatattgaggaatcctgatgacaaaactcagatatctttactttatgctaatgtctccccggatgacatactgcttaaacaaaagcttgacattcttgcaacaagccacccaaacttaaagatattctacactgtagataatccaacgaaaaattggagaggaggtgcaggttacatatcaaaggatgtggttgtgaaaggcttacccagtcctagtgatgatactctaatacttggggggggggggcaaaggttggacaaaggaggttcatgtcctgagttcaggaggatggtgtgtggacccccgggtatgatgaaagcaatatctggagaaaaggccaaggactggacacaaggagaggtttctggcatcctaaaagaggctggatacactgaacaaatggtatacaaattctga

SEQ ID NO: 54689 - DNA, 1158 bp, Glycine max
  Peptide Sequence Number=SeqID_171467
atggcaatggttgttggtggtcttccacgcgctgctccagtacttgctgaggatctcagcgtggaaattctgtcatggctccctgtcaaggttctcattcgattcaagtgcgtttccaagacttggaattccctcatctttcatcctatgttggttaaattgcaccttgaaaggtcctcgaaaaacacccacaccctattaaagttcatagacatcaaatgcgaaaactattacgcatatccctggggcgcattctgctccatacgctctttactcgagaacccctcatccactattgatgacggttgccactactttaaaaaagactgttacttttacgttggttcctgcaatggcttggtctgcttgcatgattattcttccgatgaacaatgggtccgattttggaacccggccacaaggatcatgtccgaggattcgccacacttacgtctccattccggctgttacaacgcaggacccaattctgtggagtggtttttagggtttgggtacgatgattggagtgacacgtacaaggtggtggtaatcctttccaatactaaaacacatgaaatggaggtgagtgttcactgcatgggtgacactgacacttgctggagaaatattttaacttgtccttggtttctcattctgggacaagttggacggtttgtgagtggcagtattaactggatcacttgcgggtctactgtcaatggattcttagttttttcatgcgatctaaagaacgagacatgcagatatttgtccgcgcctgatgctccttttgaaatccctatagctttgccttcacttggggttttgaagggttgcctttgtgcttcttttaatcaaaagagccattttgttgtttggataatgagggagtttggagttgagacgtcttggactcagttgctgaatgttagttatcaacatcttcaattgaatccaattcatggctatataaatattacgattttgtacgtgtctgaagatgaagatgtcttttttctggcaagccatcaagatgcggagtttattctttatgatcagaggaataacagaataagccgtactggagatttcaacaactgccacaaatcttcggcttcgtcttatgattatgttccaagcttggttttgccatattga

SEQ ID NO: 54690 - DNA, 1896 bp, Glycine max
  Peptide Sequence Number=SeqID_171468
atggacgatggcatgcaattgcaaatctcccttgacaagctaccaatcaagcgcttggattctattgaagaaaatggaattgaacgattcccacttgacgtggattacgatgagaagcggctctccctaattaggcgaattgacttcgcttgggctgttgagaaggatgaggagaagaagaagaagaagcagaagagctcaaaggagacctcagctccatggcaatggcagggcatggtagaaaatttgcagttggctcatcaggagctctctgtcatcatagatctcattaacactgttgaagcaaatgatgcagtaacagtggctagcatgacaagaccaaaactattaccaaatgaagctttgtctgacctggctgtatctgcagccaccaagctgcaatgttaccgtcatgttgggaaatatttcaagcaatctgccaaggcttttgaacaacaagttgctcgggaagctaggttttatggtgcccttatcaggttgcagcaaaattggaaggttaaacggcaacgacaggcagctattgttccagggaatgaaggcttcacctttgatctcttagataactcatatgaccaagcagctattattcgctcattgtctatgtccactgttcgagtcaatcatgatgcagctggaatgctggcaataaatgtgtctcctgatttatgccattctctccaatttggttttgttggtgcacaatcagatgatacctggagaaaatccaatgaaaacaaatcccacttttcaggtgagcataatttgggagaaatgggtgaagagtccttaagtgatgaagagtgtgttaagaaaacgaattcactccttcgtgaagtacatgaagcaattttcaatgaacaggtgtttgatctggtgaatcgagaagcatttaacacagttgcaggtgtcagtgtgactggaatacgggaaaactatttacaattaagcttaggtcaaggaacctctgtgtacttaacacttgtgtccaatagtcaagatcattctacagttgaagatgaactcaatgataatgtagaaaatgcaattttacctctggaatcatctgatggaatgaagcgtgaagccaaacagaacacctctaagaaagggcagttttctaattccatctgctatgagatttatattcaacagatttttcatgaacatatatttggaaaaggtgacgaaaaggcaatttcctctggaaatcgtttgtctggcgtacaggcaagggatggatccagtcttcttggtcatttttttaaatctttggctcacaggatattttcaactaaagttcttgcagagctggaaaatgtggtatgcaaggtcccatatctacagctaatttctaatcccacatggaattctcgggcttcgtcatggacactctacatggaggttccccaatctattcttcgtggtagccaaaccaaaacatcagattattacgagaaaaatgctgccaagcgtcagttttggactaaggtggtggtaaatgatgattgcatcaacgttaaagctgaagcagcatgcttattactgcaggttgctagccaaattattaattggctctatcaggaagctatgatggttgggataaaagtaaatcgagacttcttatgcctatctttggagctgaagcagggtgaaacacttggccttgttgcaagtgttgatccagaagatagtgaagagtgtatatcttggtggttggtcatggaggacagttttgctgaggagcaaaagcttcatatgagcatcacggatggtgcatctgaatataggaaattcctaggtcacttgtctcttgatttgttatacgcaacactgatcgacttggttggcttgtgcagtggtggaggcggccaatga

SEQ ID NO: 54691 - DNA, 276 bp, Glycine max
  Peptide Sequence Number=SeqID_171469
atgtgggaattctgcaaaaagaggctcaaaaagggtaaaaaagagtgctctgatgaggagcatggccgtatcaatcctctaattatacaactttgcaccagagagacttctgtacatacttctccggaaatgggcggcgcagtgggtatggttgtgtggcgcggtggtgacctgctggaatgcgcggcgaaaaagcgctgttggcgcgacggttcgcgactgaaacaggtggaagatcgggaacgggatgcggcggcggcgggagatcggaggtag

SEQ ID NO: 54692 - DNA, 1143 bp, Glycine max
  Peptide Sequence Number=SeqID_171470
atggggaaatggatcttttcttgggttagagatcgcgggcttggtaagaatcttcagcttgttaatgcactcgttgatttgtattccaatttgtacgaggaagccttggtgctgtttgagctcatgattagagaaaaaaacgtaaagcccaatgatgtaacgttcttgggcgttcttccggcttgtgcttcccttggtgctcttgaccttggcaagtgggttcatgcttatatagataaaaacttgaaaggcacggataatgtgaataatgtttctctttggactagtatcatcgacatgtatgcaaagtgtggctgtgttgaggtcgcggaacaagtgtttagaagcattgagctagctatgaatggacatgcagagagggctcttggccttttcaaagaaatgatcaatgaggggttccagcccgacgatatcacgtttgttggagtattgtctgcttgtactcaagctggtttggtggatcttggacacagatatttcagttcaatgaacaaggattacgggatatcaccaaaattgcaacactatggttgcatgatagatcttctggctagaagtggaaagtttgatgaagcaaaggttttgatgggaaatatggaaatggagccggatggagctatttggggttctctgcttaatgctcgtagggttcatggacaggttgaattcggtgaatatgttgcagaacgtctctttgaattggagccagaaaattccggggctttcgtgcttttgtcaaacatatatgcaggagctggcagatgggatgatgtagcaaggataagaactaagttaaatgacaaaggaatgaagaaagtagataggcttttggaggagactgggtttgtgcctgatacttctgaggtactctatgatatggatgaggagtggaaggaaggggctttgaatcaacacagcgagaagttggctattgctttcggtttgataagcacaaagccggggactacaattaggatcgtgaagaatcttcgtgtttgtccaaattgccattcggctactaagttaatatccaagatcttcaatagggaaataattgcaagagatagaaaccgttttcaccatttcaaagacgggttttgctcatgcaatgactgctggtga

SEQ ID NO: 54693 - DNA, 528 bp, Glycine max
  Peptide Sequence Number=SeqID_171471
atgagctggtctggaggagattggatgtgtggtgtttgcgagcatataaatttcaagaagagggaagcatgccagagttgtggataccccaagtatgggggtcctgacccttcaacctacagatacaacaggactgaagctttagcaggggactggttttgcaactgtggagctcacaacttcgcaagtcgatcaaactgcttcagatgtggctcaatgaaagatgattactcttcaggatatggcaacaactctggaggatatggatctgacactttccccccaggatggaagactggagactggctttgcccaagagaaagaggattattctcagtcttgcacataggcatgtatagtgacacgataagaaaaaaagacatggatgtggagtgcataactatgccagcaggacagaatgctatatatgcaaaatgccaagggattatggtggtgcagactgaaacaagaaatttcacaagacccgcaatatcactgatttctcccttggcgtctttcttttcctaa

SEQ ID NO: 54694 - DNA, 612 bp, Glycine max
  Peptide Sequence Number=SeqID_171472
atggctaaccaagacaagcaacacaagagagggttcatgtacatttacaaaggtggcacaggaaaccagagaaagaaagagttggagcatggtgtgggacaggagaagaagtcaaattcacgcagttggttgaacaggatttcaagaactcgaatttttaatgatggccacagagacttggacattggaacaagaggagaaggagaatttgttgaggcaaggaaatcaatgtcttgcttggatttaggaacaccagcaggagggtatgttgaggggagaaaatcggtgtctttcatagaagcggcagcatcaccagcagcagccataggaagcatagttgaggagggaagaaaatcagtgtcccacatcgagaagaactttgcagtagagggaatggttgaagcacgaaagtcggtgtcccacatcgaaacgttgtcctctgtgattgcgtatcttcaagttaaggttttggtctcggacatgccaaccttcatgcaagtgcatgcctttcgttgtgcgagaaggacatatgatagcttggagaagtttagcgcaaaactcatcgctcataacataaagaagtccttaagttatggtctggtaggagcatag

SEQ ID NO: 54695 - DNA, 360 bp, Glycine max
  Peptide Sequence Number=SeqID_171473
atgactgagttgcaaaggtcagtaacatcattcagaagacaagggtcttcgggattggtttgggatgacaaattcatcgctggaattgagaatcagaacaaacaagaaagtggtgatgatggatcaagtccctcgttgcagcgaagcagatcagcgggggcaccaccttatcggacggtcaacgttgcaccacaagccatggaccctccttctcccaagctagcaacttgtggcttctgtgctctctttcggaaaccggtttctgccaaacccaacaaatctaaaagacgtactagtgtttgggattgttggtgtttggcttttgctgctgaagtcaaacaagtggagaagatgaaataa

SEQ ID NO: 54696 - DNA, 636 bp, Glycine max
  Peptide Sequence Number=SeqID_171474
atgcagttatttgcatatgacactgtcaagaagcaattatctccgaaacctggagagcagcctataatcccaattcccccctcatcaattgcgggtgctgttgctggtgttagctctaccctatgtacataccctcttgaactactcaaaactcgcctcactgttcagagaggggtgtacaagaacttactcgacgcatttgtgaggatcgttcaagaggaaggtcctgcagaattgtataggggcctcgcccctagtctaattggtgtaatcccttatgctgcaacaaactactttgcttatgacacacttagaaaagcttacaagaaagctttcaaaaaggaggagattgggaatgtgatgactcttctaattggatcagctgctggtgcaatttcgagtagtgcaacatttccacttgaggtggctcgtaagcatatgcaagctggggctctaaatggaagacaatatgggaacatgcttcatgcacttgtgagtatacttgaaaaggaaggagttggtggcttgtatagaggtttgggaccaagttgcttaaaattggttcctgctgctgggatttctttcatgtgctacgaagcttgcaagaggatacttgttgaaaatgaacaagattaa

SEQ ID NO: 54697 - DNA, 189 bp, Glycine max
  Peptide Sequence Number=SeqID_171475
atgattttcatttatacaactatcttggtctggagtgctcgaaggttttcctttgctttgtggccaatatggagtttcttgacacttcctcttctgtttacactatttatggcttgcatggtggtaatcccttgcctcatttttgggacgctgcggcctcaatattacgatgagctccgtacagattaa

SEQ ID NO: 54698 - DNA, 354 bp, Glycine max
  Peptide Sequence Number=SeqID_171476
atgttacatgacgaatcaatctcctttgacatttgcatcacagcgatcactgtcaacgacgatgatttctcctttggagcgattgtcgatgtcaacttattttctgttggttgttgtgccaatgttgtggaagccattggtgaccatcgatatatgtttgttcatggttttagatttggttcaggatttggtgggtgtcgcaaagttgaagcggctaaacaattagttcctggtgttctcaaaatcattcccacaagtaatgaagatgatgtggagctgtcaagtagggcaatggttgtgggggtgtcggtagtggttgttgtggtggtgaccactagtaaacgacaatgggca

SEQ ID NO: 54699 - DNA, 1833 bp, Glycine max
  Peptide Sequence Number=SeqID_171477
atgctgtggtcttatgcctcgcactatgtccctccacaacaccgcactaacagcttccaaaccttaaccgatgattcaaccagccgtggtggcgctagaccacgtgacggtggccgcggtggttccggcagccgtgggttttctcgtccccgcattccttctaaccggttacccgtggaggaaccacaagacggcagcgacgctattaacttcgacgcgtacgagtcggtaccggtggaggcgagtgggaaggacgtgccaccgccggtgaacaccttcaatgaagcggacttggacgaaggtttaaagaggaacatcgaccgatgcaagtatgtgaaacccacgccggttcagcgccacgcgattcccatcgcgagtgcgggacgcgacctaatggcgtgcgcacagaccggttcgggcaaaacggcagcgttttgttttcccattatatctgggattttgaagggtcgttctctttctgggttttcatcaatgccggctcgtggtgccgctgttgcataccccactgcacttattctgtctcctaccagggagttatcatgccagatacgcgatgaagcgaataaatatgcgcatcaaactggagtgaaggttgttgttgcctacggtggggctcctattactcagcagctgcgccttatggagaaaggtgttgatatattggttgcaactcctgggcgtttggtggatattattgaaagagaaagggtttcgttgacaaagataaagtatcttgctttggatgaggctgatcgtatgttggacatgggttttgaacaccaaatacgcaagattgtggagcaaatgcagatgccctcgccaggtattaggcaaacattgttgtttagtgccacgtttcctaatgatatacagaagctagcatcggactttttatccaactacatattcctgtctgttggaagggttggatcgagtactgaactgattgtgcagaagattgagcttgtacaggatatggacaaaagggaccatcttattaatcatctgcgacgtcaaaaggtgcatggggcaaatgggaagcatgctttgactcttgtatttgttgaaaccaaaagaggagcggatgttttagaaggttggttgttgagaagtggcttttcagctgttgccatacatggtgacaaagttcaaatggaaagggaacgggctttaagatcattcaaatctggtttgactcccattttggttgcaactgatgttgcttcacggggattggatatcccgcatgtggctcatgttataaactttgacttgcctagagacattgataactacgtacatagaattggaagaacaggccgtgcaggcaaatctgggttagccactgccttcttcagcgacaagaatagccctattgcaaaggctcttattggactcttgcaggaagcaaaccaagaagttccatcttggctcaaccaatatgctactgagggttcatcatctggtgggggtggtcgtggctatgaagctcagcgttaccgcagtggcagttatggtggtcatgatttccggaatgtcactgaacctgaggtgcagaattacaactgctacaataccaatggcaatgcagttcagtttgtagagtcttacactgctgatgatgcctcttacgttgatacctcctatgacatccaaaactccaatatagattgctcttttgaatgtttacatatagcttcttccggcagttataatcacactgattcttgtgagttgaatggaggtggtggtagggttgaagaagatgggccacgcggttatgcatctattgttgccactggatgggattag

SEQ ID NO: 54700 - DNA, 369 bp, Glycine max
  Peptide Sequence Number=SeqID_171478
atggatcctaaggacaacaagaaccacgtgctgtggacaaatgtttggctagcagctattaggacaatttgggatcagaggaacaatctggtgtttaatgggggacaaatattgtgtaagatggaactggtggagctgattaagtttcgagcgtggcagtggaataaagctaaagtgaaggacttgcatgcttcattgtacgagtggtcttcaaattcttatcaatatgaagcagctgtgacgtttttatggaagaagggtgaaggttttatttggggtgatctcgccaatttggaaggtgtgaaaatccctcaattatggttatgcacgtgtacatgtgctggctggaatttgattggctaccgatga

SEQ ID NO: 54701 - DNA, 1680 bp, Glycine max
  Peptide Sequence Number=SeqID_171479
atgattgcatatgaggaaggagacaaaccaagtggaatactaaccaaagcatggattgaaatcgtggagaggctctccaccatggggattgcagtgaacctggtaacatacatgatctcaatcatgcatctgccaagctcaactgcagccaacactgtgactgactttatgggcacatcatttctcctgtgtttgctgggaggttttctagcagattccttccttggcagatacaagacaattggaatctttgcttcaatacaaacactgggtactgctacattagcaatctcaacaaaattgccagggctacgtccaccaccttgccatgctaacagtgacagctgcaaacaagccaacggattccaaatgggaatcttgtacttgtcactgtaccttattgcactaggaactggtggcctcaagtccagtgtttcaggatttggttctgaccaattcgatgagaaagatgagaaggagaaatcgcaaatggcctattttttcaacaggtttttcttcttcatcagttttggaactctggcagctgtcacagtacttgtctatctgcaagatgaagtgagtcgcagcttggcgtatggaatatgttctgtctctatgatcatagccattatcgtgttcttatcaggaactaaaagatacagatacaagaggagtttggggagccccattgtccacattttccaagttattgctgcatcaataaagaaaagaaagatgcaactcccatacaatgttggttctttgtatgaggacactcccgaggcttcaagaatagagcacaccgaacagttccgtttcttggagaaagcagccattgtggcagaagatgattttgagacaaatttatgtggttctggaccaaacccatggaaattatgctcactaacaagggtagaggaggtgaaaatgatggtgagacttctgccagtgtgggccacaaccatcatattttggaccatttacgcacagttgatcaccttttcagttgagcaagcctccaccatggaaaggaatattgggagtttccaaatccctgcaggctctgtcacagtcttttttgtggctgcaatactaatcactctggctgtctatgaccgactcatcatgcccctttggaaaaagtggaacggcaaaccaggtttcactgacctacaaaggatagcaattgggcttgtattttccatttttggaatggcggctgcttctgtatgcgagaggaaacggttatccgttgcaaaaagtgttagtggcggcaaccaagcaacaacaacacttcctataagcgttttccttctgatcccacagttcttcttggtgggttctggtgaagcattcatatacacaggccaacttgatttcttcataacacggtcaccaaaaggaatgaaaaccatgagcactggtctctttctcacaactttgtctctcggtttcttcttcagcagtttccttgtctcggttgttaagaaagttactgggacaagagatgggcaagggtggctagcagacagcataaacaagggcaggctcgatttgttctatgcactgcttaccatacttagtttctttggttcaaacctaagaaacctaaacaaccagctgctatgcaaatggggccagttaatgggtccacagcagaggaaaagtgctgaaggctga

SEQ ID NO: 54702 - DNA, 1694 bp, Glycine max
  Peptide Sequence Number=SeqID_171480
cactcggcatcggcgtgctcatgggctatgcgccgcggtccgacccgcaggagtacctcgacctcgcccggctggccgcggccgcccacgcccccacgttcacgcacgtgcgcgagctgatcgaggccgacccgcgcaccccgatcgacggctcggaggagctcgtgcgcgccgccgcggagaccggagccgcgatgcaccactgccacgtgaacagcacgtctctgcggcacgtcgaccgcgtgctcgcccttctcgatcgcagtcgcgccgcgggctcgcgggtcacggtggaggcctacccctacggcgcggggagcaccgcgatcggcgccttcttcctcgccccggagaagctcgccggcctcgggatcacgcccacctcactcgtgctcgtcgacacgggcgagcgcatcgccgacgaggcacgactgcgcgagatacgggcgaccgatcccggggccacctgcatcgcgacgttcctcgacgaagccgacccgttcgaccgtgcacacctgcaccgtgccctggcctacccggactcgatcgtggccagcgatgcgatgccgatctcctggcccggactcgacgggacgccgaccgtgtacgagcagcgcgaatggcccctccccgtcggcggtcagacccacccacgcacagccggcacgttcgcgaagtcgctgcgactcatggtcctcgacagcggggcgtggagctgggtcgaggctttccgccgctgctcataccttcccgcccgcgtgctcgacgaggtcgcctccgggatgcggcgcaagggtcacctcagcgtcggggcggacgccgacatcgtggtcatagatccgtcgacactcaccgaccgtgcgacctatgcggatccgacgcgcccctcccggggcatccgcgagctgtacgtgcacggcgacgccgtcgtgcacgcgggagagatcgacctgcagcacgtcctggatgccaccgccgccgagctcggcgtgcctggcgcgatcgtcggcgtcgtggacggggacagggagatcgtcgccaccacgggcgtcgccgccgtcgacaccggcgccgccgtgacggagcgcacgctgttccagatcgggtccacatcgaagaccttcaccgggacggtcgcgatgcacctgatcgagagcggcgcactgggcctggacacgcgcgtcgtcgacatccttccggagttccgcctcggcgacgccgcggccctggaggccctgcgcatccggcacctgctgacgcattcgggcggcttcctcggcgacgccgacgaggccccgggctggggcgacgacgccctggcacggaacatgcgcgggtatgcgcagctcccgcagttcttcgctcccggcaccatcgcctcgtacagcaacgccggcatccggctcctcggccgggtgatcgaagtcgtgaccggtgagaccttcgagcaggcggtgcaacgcatcgtgctggatccgctcggcatggcggagacgttcttcttcccctgggacatcatcgcccacccgcatgccgtcggccacgtggccgccgacgacggcaccgtgacgcgactgcgccagtggccgctcacccgcgacatcgcgccggagggcggcatcgtctcctccgtcggcgatcaactcgcctacgcgcgcttccaccttcgcggcgagagtcccgcggccccaccg

SEQ ID NO: 54703 - DNA, 126 bp, Glycine max
  Peptide Sequence Number=SeqID_171481
atggctcacaagtcttatgtcttcatgtttggggagattgtgatgtcgactcatgatgtcaacttacacccatgggtcttttataaggatgtccaagaaggtcgtaatgtcaacctacacttataa

SEQ ID NO: 54704 - DNA, 1335 bp, Glycine max
  Peptide Sequence Number=SeqID_171482
atggagaccaacaacaaacaacagcagcagaagaagaagtggtttatgccactggttctgtctctactactgtccaccctgctcatacttttttccatcttcgtctcctccgattcctcctctctgctctacctctaccgtacacgtggcagactcgaggagcctcgtttcgtggagtcaaagctgaggctgtccgccacgtcatccagcgattccgttcccaggatcgcgtacctgatctcggggtcaatgggcgatggcgacactctgaagagaaccctcaaggccctttaccatcccaggaaccaatacgctgtgcacttggacctcgaagcttcttctcaagaaagattggagcttgcaaactttgtgaagaacgaccctctctttgcggaagtgggcaatgttaggatgattgttaaggccaacttggttacttatagaggacccactatggtcactaataccctccacgctgctgccattctgttaaaggaaggtggactctgggattggttcatcaatctcagcgcttccgattaccctttgatcactcaagatgacaggcttgttcctctttctctctctttcgttgtagcccggggtggtgggggaggaggaataccagatctgctgcatacactgtcatcaattccaagacaccttaactttattgagcacaccagtgatattggctggaaggaagatcagagagccaagcctgttatcattgatccagctctttatagtgtcaataagtctgatttattttgggtgactgagaaaagaaatgttcccaccgcatataagctgtttacaggttctgcatggatgatgctctctcgccaatttgttgaatatttgttatggggatgggataacttgcctagaattgtcttgatgtattatgccaactttctatcctcccctgaagggtattttcacactgtcatctgcaattctgaggagttccgaaacactactgtgaaccatgacctccacttcatatcatgggacaaccctccaaaacaacatccacatttccttacaattgataactacgagcaaatggttgacagcaatgctccgtttgctcgaaaatttggcaggaatgaaccactcttggataagattgataatgaactcttgagacgaaatgaacatggttatgtgcctggcaggtggttcgaccaagcaaatcctaacatcaccaaaccatattctgccataagaaatatcactgaacttaagcctggccctggagcagaaaggcttaaacgccttatcaatggtttgttatcatcagaagattttcacactaagcagtgttcttga

SEQ ID NO: 54705 - DNA, 2844 bp, Glycine max
  Peptide Sequence Number=SeqID_171483
atgccggagcacaacacgcgccagtcagccactgaacgcctcgaggaggcagtccaaacactatcccaggcccattctgccatgaacgacgagctcgaatccatcctggatcgtctttctgtgcttgcgattcctgctgcccctaccactccgacatcgcaacccaaccagcaccaccatcacctgaaattggagattccacggttcgacggccaagatcccttagggtggatatttaaaatatcccaattcttcgaccacctattcatgagagtcattgttgacctcattactaaattcgcccacctattctctgaaccaacctcccttccccctttccgccacatctcccaccacatccaccttcatcctcacacttcccctataaacgtcaagccataccgatacccatactaccaaaaagccgagctcgagaaacaggacggcacatggcggtgctgcgtcgattatagagcccttaacgccatcacggttaaggaccgctttcccatgcccaccatcgacgaactcttggacgagttaggccacgcacgatggttttctaagcttgatctataccaaggttttcatcaaattcgagtagcagaggaagacatccataaaactgcgttccgcacccaccacggccactatgaattccgagtgctgccgtttggtctatgtaacgcgccggccaccttccaggctacaatgaatgaacttctcaagccttttctccggcgattcactgcggtattctttgatgacatcctcatttacagtccctcacttccggcacatgtgcaacacctgacggcggtcttcaatacactctctgagggtgaattttatctccgccgcactaaatgcttatttgctcgccgcacccttcagtatctgggccatattgtttcggacaagagcattgccccggacccggacaaaatccaagcaatgctctcctggcccactccgtccacggtgtccgaattgcgtggcttcttgggccttacggggttctaccgccgttttattcgcgggtatgcctccatcgcctcccccctcacatccctcctccgcactgatgtgtttcaatggaactccgatgcccaggcggcattcgttcaactccaacaggccatgactcaggcacccgtcctcgctccaccagacttcactgcaactttcatccttgaaacagatgcatctgggaccgccatgggcgctgtcttgatccaacgagcccacccaattgcattccacagtaaggtgttctgtgaccgcctccgaacaaaccacaaaagtctcagagatctcatgaatcaaacgattcagacccctgaacagcagacttacctcacaaagctcctcgggtatgattatgatattgaatacaaattcggcgcgacaaacatcgtcgctgacgccctctctcgaatcccaactcaggggaccctcttctccctttctttaccaaattttgacttcttggatcagctgcgccagtcactgcactcttcacagtcctataccactctcctacaagacatcctccaacatccagaccttcaccctggttacacgaccaaccgcgatatgattttcctccataagaagctctggctcccctcagactgctccttcattcctgctcttatggacgaattccactccactccgattggcggccatttgggttttgccaagacactacaccgaatccaagagaacttctactggccttccatgcgacaggacatccgccggtttattgcccattgcactacatgcctgcagactaagtatgaaaccaagaaacctgtcggcttgctgcacccattaccaattccggcaaccccttgggaagagttatccctcgacttcatctgcggtcttccaccttcacacggccattccaccatcctggtcattgtagataggttttcaaaaggcattcatttgggcgccctcccagctcactatacagctcattcggttgctactctcttcttcaatcttgtctgcaaactccatgggcttcctcggagtctgcctatcacccggaaacggacggccaaaccgaagttctcaatcgggtggtcgaacagtatcttcgggccttcgcgcatgaccacccccactcctggacgcgcttcctaccccttgccgagtggtcctataacacctcagtccactcaggcaccggtggaagccgtggacaccctcctcgcgaatcaccagcatattcgctccgtcctccagactcgcctccgcaaggcccaggacaacatgaagaaggcagccgatacccaccgccgtgaggtctcgtactcccctggagattgggtctatgtgcgcctacgaccctatcgtcaatcctctcttgctccgggctactgcaaattatccaagcgctattttggcccattcaagatccaagaacgcataggtccagttgcgtaccgccttgaattaccaccacactctcgtatccacccggtttttcacgtttcactgttgaagctccaccccggcgagactcccaccactcctggctttttacccgagaccactaaaggaaacgaccccatcgttgccccgctcactatattggactggaaattggatgcgtccacctccccaccatcacgccaggtgctcgttcagtggaacggtctgtcgccggaagattcgacttgggaagactggaatgatttggctgctgcttatgtccttgaggacaaggacatttttccgccagggggtattgatagcaaacgtactaagaatagcaggcccaaaaggatccccatcaaaccgacccatctaaaagattatgtgtag

SEQ ID NO: 54706 - DNA, 1227 bp, Glycine max
  Peptide Sequence Number=SeqID_171484
atgggaaggccaccatgcaggagtaatggcttcgctgatggaatatggctgatcagtggtagtccacctgaaaaaactattgtctggaatgctaaccgtgataaccccccgcttccctctagttccaagttgaacttgaccggcaccggtctgcggcttttcacaaatgggaacgaaagccaagatctcattccaaatcttacagcagtaacttgcgcttccatgcttgattccggcaacattgtactctatagtaatgatactgaaaccgttgtctggcaaagctttgatcatccaactgacaccatgttaggagttcagaatttaactaactctgacactctggtttctagtgtgtccagatttgaccattccagtggacgtttctttttcatcatgcaagctgacgcaaacctcgttgcttaccctatgcaccaccaaataagtccccaagatgcttactgggcttcaaaaactgcaggttcttctttccaacagctcagtcttgatattttactgctccagcttaactggcgatgccgtgtgagtgttttcctgaatgatattactaccattgctcgaacacatcataggaatttggttaagctcattggtttttgcatcaatggatctgggaagcttcctgtttacgaatacatcagcaacgggtctcttgcaagttttctcttcaacgatgagaaacacatatctcggagagacacactgaaaattgcattagacattgccagaggagtgctgtatctacatgaagagtgtgaggtccgtattatccattgcaacataaatcctcggaatatacttatggatggagcgtggactgcaaagatctctgattttggattggcaaggctgctaaagtctgaccattcaagaatgagaaaagaggatgatgggacaagcaagtacttgacacctgaatggcagaaggatgcaccagtatcagtaaaacttgacatttacagttttgggatggtactactggagattgtctgccgcagaagcagcatagattcaggacagttaaacaagcttgttaaagaaaatgaagatgtagagtggaggatattggaaagaatggtgaaggtggggttgtggtgtgtgcaagacaatccgcctctttgtccttcaatcaagaatgtcatcttgatgttggaaggattgaaagatattccagttcctccctctccagcccacctcgctaaataa

SEQ ID NO: 54707 - DNA, 399 bp, Glycine max
  Peptide Sequence Number=SeqID_171485
atggatgccatattgggctacctaataattttagtgatgacttcggcagtacaagcccaattgaaagctgggttttattctactccatgtccaaatgctgaggcaattgtagggtccaccgttgtatcccacttcagcaaagatctaaccattgctcctggcctgctcaggcttcatttccatgattgctttgtccaaacagaatgcagattcttcagttatcgtctatacaatttcacaacctctggtagtcctgatcccactataaacgtagcttttttagctcaacttcaagcactttgtccaaaaaatggagatggcttgagaagggtggccttggacaaagatagtcaagctaaatttgatgttagtttcttcaagaatgtgcgtgatgtttga

SEQ ID NO: 54708 - DNA, 357 bp, Glycine max
  Peptide Sequence Number=SeqID_171486
atggagaagcagaagctgaaacaactcttactctcccatccttccacgttacacttcctaccgtttcaacccgccgctatgctcaaaggcaagctcaagcttcccgctccggacaaggttcggagggtctttcccgaccagcttggcagcttggtcgcaggattcgacgaaaaaggccatggaatcgaaggctccgaattcaaacttgagtccggcaaagagctcaagccgattcagcctggcgagttaggatttcacatagggagtgatgatgatgatgacaaggagacaaaaatttggcagagattctgtcactccggtttcagtgttgaagaagttgtgatcacacctagatag

SEQ ID NO: 54709 - DNA, 288 bp, Glycine max
  Peptide Sequence Number=SeqID_171487
atggcaactcgtaggggccactggtggttgtgggtggtggaggaaaaaatgttagggtttagcgcgataattcatggtgagcacaatttctcttgcgctaagcgcgacaattcgcacccagcgcaattccctctcgggttggaattccgcttacgtgagagatcaagaattgttattttaaaaatcccaacggtcaaaccatgggaacatgggttaggaacaaatttgaaggtgatccaacggttaatgaatccaagatcttggtttaaccggaataagtctaggtaa

SEQ ID NO: 54710 - DNA, 414 bp, Glycine max
  Peptide Sequence Number=SeqID_171488
atggtatcaccttggattggagaagaaaaattgaaatggttttgttttgatttcctttatattcatttacccttttcgttatcagctttctcaaagggagataaatttggaaaagttgcaaagaattgccagcactgccgactgtcctgctatgatttgtgttacttatcttcatctcatgacttgtggggcaagcaactaaaagtgaacaggcaaaaaaagtatgctaatctgaaagagggatcttctccagaatccgctcttgctttccagttttcactgatcatattattgaatctaagacagtcaaaacatatctggaagggatatgaggaattaagttcgaccaagcggcacaaggacaatgatgttgatggccaacttaggcgacatgaaatttctcatgaagattga

SEQ ID NO: 54711 - DNA, 207 bp, Glycine max
  Peptide Sequence Number=SeqID_171489
atggtactaggcgatcatgcatggatgaaggagcgtgcatggagtagtagtcaattggagaatgcaataagaaagatcataatggctgcaagaaccaccggaaacaccaaaagcaaaggaattcctggtggtgaaggaacacccatcaaaagtggaccaaacacaagtatggctacaatgataaaaaatatcactatggaaccatga

SEQ ID NO: 54712 - DNA, 135 bp, Glycine max
  Peptide Sequence Number=SeqID_171490
atgaccatgtatggtgaaagtcctcgaaatctatgtgtagaggaagttttggagtatgttgaaatcaaaccagaaacattcaaaggaaacgaattcgagcatatagatacaagatgcggtcgaaatcagttctaa

SEQ ID NO: 54713 - DNA, 120 bp, Glycine max
  Peptide Sequence Number=SeqID_171491
atggatacccaacattacccaagctatatagatgcttgctggagtgatggatcaactgcagcaatccagaacccaagtcttggtcctagtcaagcacagaattacactgccatggtataa

SEQ ID NO: 54714 - DNA, 226 bp, Glycine max
  Peptide Sequence Number=SeqID_171492
tgggctaagcgcgcatccaccactaagcgcagcttcaacgcgcttagcgtgacagaagaatctggcagggcatcaatatcaaggtcgtgtgctaagcgcgagggtggcgctaagcgcaacgataacaagggcccagggaaaagaattctacagcacaccacagttcctatttcaggaaaagagctctggaggcagcaagaggagcagcttttgcagaaatacctag

SEQ ID NO: 54715 - DNA, 582 bp, Glycine max
  Peptide Sequence Number=SeqID_171493
atgattaaccaaattagtccctcagattctttgtctcttactactttagtccttcataaggacaaccacactgacattttagatcttttgagagttaatgctgtgccttgtagaattgctttcgaaaggggcaaagagcgccatttttgctttctagcaatctctgcaggaacatctgggtggcttgtgctagcagaagagttgccaatgaagaagctctatggagttattcgggttgctgcacctttggctgggtgcaatcccaggattgatgataaacacccaagatggttacatctgcggatccgaccatcttctttacctgttctggatcctgccaagttcaaccccaacaggaaattaaagacaaaagcttttgtcgatggaagatggacattggcgttcagggatgaggagtcttgcaagtctgctttatccatgattcttgaagagattaattttctgagtgacgaggttcacagaagactaaagcctttgcttaaccttgaaaccgcgttggatttatcaggcccagaggaggattcctcttcacattcaacaacacctcccaattcggtgtaa

SEQ ID NO: 54716 - DNA, 612 bp, Glycine max
  Peptide Sequence Number=SeqID_171494
atggttgaaaatatcaagagaagtagctttgaagtgttgggaatgtgctgtgctacagaagaagcactggttgaaagaattttgaagcctcttcgtggagtcaaagacgtctcagtgatagtccctacaagaacagtcactgtggtccatgatgttctcttgatttctgagtcacaaatagccgatgcactgaatgctgcaaggcttgaagctagtttgagactacagggagagactgataatgaaaagaaatggccagatttaactacgatggtgtgtggcttgttactagcactttctttcttgaagtatgcatatcaacctttgggatggttggcacttggttctgttgtcattggcttccctaaggttctactcagggccatagcttccataaaggctcttactcttaatatcaacattctggttctattggctgtgtgtggtactgctgctttacaagatttttgggaggctggaatcatcatattcctattctccattgctcaatggcttgagacaagagcaactcacaaggttggtgacatcactttcccctttctcattgatagtttgctgcattttcttacttcagtatctcttcctacttga

SEQ ID NO: 54717 - DNA, 651 bp, Glycine max
  Peptide Sequence Number=SeqID_171495
atggctaaatgcttggaaactggcgagccagtggccattaagaaggttttactggacaaaagatataagaatcgtgagctacagttaatgcacttgatggatcatccaaatgtgatctctctgaagcatcgtttcttttccactacaagtgcagatgaactttttcttaatttggtgatggaatatgttccagagtctatgtatcgagtctcaaagttctatagtaatactaatcagagcatgccacttatttatgtaaaactttacatgcaccagattttcagggggctggcttatatccacactgttcctggaggttgccacaaagatttgaagcctcaaaatatactggttgaccctcttacacaccaggttaagatatgtgattttggaagtgcaaaagtgctggtcaaaggtgaagctaatatatcacatatatgttcacttttctaccgggcaccagaacttatgtttggtgccactgagtatactacttcaattgatatttggtcagctggctgtgtccttgctgagctgcttttgggtcagcccttattacctggcgaaaatgcactggaccagcttgtagagattatcaaggtgcaattggtgttaccacgagttgatcatttggatttcatgaacatatga

SEQ ID NO: 54718 - DNA, 951 bp, Glycine max
  Peptide Sequence Number=SeqID_171496
atgtcgacaatcaatgacgtatcacggttagccggggtatcgaaagccacggtttcgcgcgtgctgagcggttcgcgcggggtaaaagaggccagccgccaggcggtgcttcaggcggcggaaacgctgaactaccggcccaatatgattgcccaatccttactgagccagtcgacgggctgtatcggcgtgatttgcgcgcaggacaacatcaatcagaccaccagctatctctacgccctggaaaaacagctcagccagcatcagaagcatctactgctgcgcttcgccaataaccgcggcgacgtattaagcgcgctggatgaactcacctgtggcctgtgcgatgacgtgctgatcatcggcgcgcgctttccgctgcagatcgagcgccccgatgtggtgctgattgattgtctggaaagcgatggcgagaacagtattcagtttgatcacgccttcgccgcggaaaccgcctgtcattatctgattaatcaggggcggcggcagattgcgctgatccatccgcaggggagcggctttgccgatcaggtgctgctgggctataagcatgcgctggagaagaacttcctgccgtttaatcgcaacctggtcttcctggactgcgcctcgtcgtcggtggcggtgcaggagttgatgaataacgccactaccctgaactttaatgcgctgttggtgagcgatgaactgcaggcgcagcgggtagtgccgcagctgcaggcgtttaaccgcgcggtgccggaaaaagtaatggtcttcagtctcgcgggttcgctgcagatgccgggtattccgaccatcccggcgattgagtattcgatggatgcgatggcttcgcggatcgtcaactggctgatcgggaaaagcccgcagcccggcggcagcctgctgcgcggcgacttaattattcccgagcgttgggggaaataa

SEQ ID NO: 54719 - DNA, 291 bp, Glycine max
  Peptide Sequence Number=SeqID_171497
atgaaagcgtgttggatgttgtgtctggttactgcccttagcgccagcgcggcgtgggccgaatcgccgctgcaaagcctgcagtttgagcagcaaaaacagcaggtgttgaaagcggtgaaggaaaaatgcgccccggcgagcaccctcagcgataccgatttcgccaataaaatcctcgcctcgaaagacaaccagagttacgttcgcgaagcgacgctggcgaaagagcgcaataatcaaaaaggctatctggccgccattgataaaattcgctgcccggagaaataa

SEQ ID NO: 54720 - DNA, 246 bp, Glycine max
  Peptide Sequence Number=SeqID_171498
atgggagaaggaacctttcgctttggccttgatcatgccactccaaaacccgagccaaacgaggccaaacatgttgcacccattgtgtcctcttacaacgagcgcatacgtcctgttcttgatgctgtcgagaacctgaggcgcctcaacatcaccaaagaagggatacagcttccaaccatagttgttgttggtgaccagtcttctggaaaatccagtaatacatataaatatgcagtggtgtaa

SEQ ID NO: 54721 - DNA, 141 bp, Glycine max
  Peptide Sequence Number=SeqID_171499
atggaacctttgcaggcattggacacctcatcagatgatactgatgctcaatctgatatagtaggccctgcaaaaatgtctcaactatcaaactatgatgatttcaatgtaatcaaacagagaaacacatggatcggataa

SEQ ID NO: 54722 - DNA, 324 bp, Glycine max
  Peptide Sequence Number=SeqID_171500
atgtaccggtcccgcacccaaacggatccagaccggttcgttgttcaggactcatattttccagtttggcacggaggatcggtgatgctgtatcaggaagcgcacgtgcctgattcgatgttgtcggaggttgagttagaggattgggttgtgtttgagcacgggaagtgctgggaagatatatgtcacgcgatattggaagcacatgatttggtttacattgtggattggtccatctaccacaaggtgaagctggtcagagagcctacaaaacccttacctagcagtggtaactttaatcttggggagttgctcaagtcataa

SEQ ID NO: 54723 - DNA, 309 bp, Glycine max
  Peptide Sequence Number=SeqID_171501
atggattttgcacaagctgattacaatgctttgtatgttcaaaatgggccaaccagtttccctagtaaaattgattgctatcacaaatgtgaattagaatgtttaccgttattcataactggtgctgtgtatataggatgtgttgctgcatgttttcatgataaatgtaagaaaaagcccatggatgttgtttacaattgtatttctcgttgtgccttgaccaagtccactgaaatcaataatgatgatcatgatcctgcaaccaatgtcgtggattcttgcttcgaggagtgccagaatgaaaaataa

SEQ ID NO: 54724 - DNA, 381 bp, Glycine max
  Peptide Sequence Number=SeqID_171502
atggcaaagaatcaaatgaaagctattgcattggtgatgatcctaacaattataatggattttgcacaagctcattacaatgttttctctgctcaaaataggccaaccagtttgtctagttggccgcctcatgatgactgtcatgcgaaatgtgaacaagaatgcttgccgcacaccttaaatcctaccatgtttctactatgcattactgcatgttttcatggtaaatgtggtgataagtccaataatgatgttgtcaacaattgtatttctggttgtgtcttgaccaagtccactcacatcaataacgatgttcgtgatcctgcaacctatgcaacctatgtagttgattcttgctccaaggagtgtcaaaacgaataa

SEQ ID NO: 54725 - DNA, 273 bp, Glycine max
  Peptide Sequence Number=SeqID_171503
atgtcgaaggagtttcgcaaggatttcgtcattcttattggcgaaacacttattttgcatgtcaacacaacaggttctcagcaggttcacgtgagtacaatgacgaaacacattgtgcatccttatatcatgtccatgcatggcatgtcgacattccgtcatccaccattggtttcgccatcatcattggcaaaacacgtgtcagcgcgttcggtttcgccatcaccattggcgaaacatgcctgccacatgggtttctccacatcagcataa

SEQ ID NO: 54726 - DNA, 3156 bp, Glycine max
  Peptide Sequence Number=SeqID_171504
atgcgctcaggagcttgtacattgcaacagaccctcacagcagaggctgcttcagtgttgaagcactctctcgggttggcacgcagaaggggccatgcacaggtcacccctctgcatgttgctgcaactttgctcaccctaagagccagttccttaagaagggcttgtctcaagtctcaaccacaaacacaaacacattcacaccaccctcttcagtgcagagcccttgagctttgcttcaatgttgccctcaacaggctccctacaactcctggccctttgctccacacacaaccctctctctccaatgctctcattgctgctctcaagagagcacaggctcaccagagaagggggtgcattgagcaacaacagcaacaacagcaaccacctcttctcaccatcaaggttgagcttgaacagctcatcatttctatccttgatgaccctagtgttagtagggttatgagagaagctggtttttcaagcactgttgttaagagtaatattgaagacacttcttcttcagcaccttctgttttctacaacagttctggtggtggtgttttctcttctcctggctcaccttctcccagtgagaagaataatgttttcaggcagaaccatttcttagctgcttacacttctaatgagtttagtagtacttctcctaattcttcacttttgttgaagaaggcttcagtgtttcccatcattgagtcaccaccaccctcttcatctaaggaggatatcaaggttgtttttgatgttctcttgaggaagaagaagaggaacactgtgatagttggtgattcattggcactcactgaaggtcttgtgggggagcttatggggaaattggagagaggagaggttcctgatgagttgaagtcaacacatttcatcaagtttcagcttgcatcaccggtttctttgaggttcatgaaaagggatgaagtggagatgagtctttctgcactgaagaggaaggtggattctgttgttgtatcaggtggaggaggagccattttctatgttggagacttgaagtggacagtggaattaggaacaagtgaaaaagaggaaggtggtgatgtttgtggctataattattattataaccctgttgatcatctcgttgctgagatagggaagttgttttgtgactccaataacactactaaggtgtggcttttggccacagcaagttatcaaacatacatgaggtgccaaatgaggcaaccccctcttgagactcagtggtctcttcaagctgttcctgttccatcaggtggacttggcttgagtcttcatgcttcaagtgttcatgattcaaagatgacaatctcccagaatccatccaatatgatggaaacaaagctcttcagtagcaaaaaggaggaacaggataaactcaactgttgtgaagaatgtgcctccagttatgaaaaagaagctcagttgttcaaaccaggccagaagaaactgttaccatcctggcttcagtctcataccaccgaagcccatcaaaaggatgagttagctcagctgaaaaggaaatggaacagactatgccactgtctgcaccagagcaagcagcctcagaaccattggagcaacactttacatggcaattatcacagttcaaatggcaacaagatctaccattacaattcatcatatccctggtggccaaaccaaggcactagtgtcttcacagattcaagctccatatcttttgctgattcacctccaaaaccagcttatagctccaacaacaacattgtgcctcggttcaggcgccagcaatcatgcaccattgagttcaatttcagtgatgtcactcagaaaaagccatccacaacagccttggattctctcaagggcatggaaggtaataatagtagtgaagtaaagattactcttgctcttggaaattcaacattcggtggtggttcggggcaaacggtggaaaatatcataactactactgatagaacactgcgacgagctcatatttgtaaactgttgcaggagaatgttccatggcaatctgagacaattccttccatagctgaggcattggttgattccaaatcagcaaagcaaagttccactacttggcttttattacaaggaactgactctattggaaaaacaaggttggcacgtgccattgcagaatcagtgtttggctcagttgattttctccttcacttggacatgctgaaaaacaacaacaaagagaattcagctgatatagtggctggagcattgaaaagccatgaaaaggttgtggttctgatagaaagtttggattttgcagatgcccagttcaggaagtttcttgcagatgggtttgaaactgcaaagtttggaaatttaagcatgaatgagaagagttcaggccaagcaatattcatattgaccaatggtgacactaggagcaatgaagagaagaaaaccaataactcagtgatgaagttggtgttgcagataagtgaaaccaaacctagtttggagtcttcatcacctagtttgggtcagaagagaagggctgaagtactggatttgtttaccaatgtcaagagtccaagggttgaggagaaagaggagggtaagaaagtcttttcaaggcattcaagcttcaacaaccttgacctgaacatgaaagctgatgaagaagaggatgatgatggaagtagtccaatatcaagtgatttgacaagggaaacagtggttgatcaacttgagttaattgagaaccggtttgagtttaatgaaggtccagagagggagagggagagggaggtgacacaaatgtttctgtcaaggataaaagagtcttttgaggaggtatatgatgatgataatggtgatggggtggtggtgaattttactgtagaggagagggtgatagaggaaattggtgtggggtttggtaattttactaacagcatgtttgagaaatggctgaaagacatttttcaaagcagtttattacagacagttgttaactttggtgatggggggaaggagaggggtataggttttacactttgttggggtggtaaaggagataggaaatcggatagtgatgggttcatgggttcatgtttgcccaagaatgtccaagttaactacttcatggattga

SEQ ID NO: 54727 - DNA, 415 bp, Glycine max
  Peptide Sequence Number=SeqID_171505
gtccaagcagaagaagggcatggaggagcaccagaaggggaagctgcagggcaaggaggaggtgcggttccgcggcgtgaggcggcggccgtgggggaagtacgcggcggagataagggatccatcgaagcaagggtcgaggctgtggttggggacatttgacactgctgaagaagctgctagagcttatgatcgtgcagcttttaacctaagaggtcatcttgcgattctgaattttcctagtgagtactattctcagataaggggttcaccaccatatccaccacatttagcaacaccctcttcctcttctcatgccagtgaaagcacttcttctgctgcacaacaaaggcatgtttttgagattccgtgtttggatgataaggtgttggaggatcttcttggtctatcagag

SEQ ID NO: 54728 - DNA, 444 bp, Glycine max
  Peptide Sequence Number=SeqID_171506
atggatgaagaagggtcaagggggagggccaaggaggacgccggagatgtccggtaccggggggtccggcggcggccctgggggaagttcgcggcggagattcgagactcgacgaggcagggtcagagggtgtggctggggactttcaacacggcggaggaagcggccagagcctatgatagagctgcttataccatgagaggtccatttgcaatccttaactttcctgatgagtaccctgtgactgctgctggtgccactaatgctgccacttattcttctgcttcatcatcatcatccttggcctcttcttctcggcatgccgatgtggaagctagaggaagaagtgagcaaggaagagaagtgtttgagtttgagtacttggatgataagttgttggaggagcttcttgattgtgagaacaaaaagaaaagaggaccctga

SEQ ID NO: 54729 - DNA, 375 bp, Glycine max
  Peptide Sequence Number=SeqID_171507
gtctgtgatgaacttgaggatgttatggaagcggggggaaacattgtggactaccatggctgcgttttctttcctgagcgatggtttaattgtgtggttgtacttcaaactgataacaccattttgtatgatcgtttgagtaggagtggtttcattatcatagcttactttccccgtatatgtgacagagggtacaaagattcaaagctttcaaacaatattgaatgtgaaatcttccaagttctgcttaaagaaagttactcggaggagaaagtgattgcaatgaagagtgataatattgaagacattagtagaaacgatgcaactctgacagattgggtcagaaattggtccttaccctcacaaacttcttaa

SEQ ID NO: 54730 - DNA, 970 bp, Glycine max
  Peptide Sequence Number=SeqID_171508
atggccacagcattcttgcttgtgagctactacatctttgtgatcaagtgctgcctcaattggcatcgaattgatgttctgagacgtttctctccatctagaaggcgtgaagatccaccaccaacatactcaccagccacagatactcgtggactagatgaggcactgatccggttaatcccagtgactcaatacaaagcacaacaaggggatgatagagactttggagagagaagattctgcgaatgcgctgtttgcttgaatgagtttcaagaagatgagaagctgagggttataccaaattgcagccatgtgtttcacattgattgcatagatgtttggcttcagagcaatgccaattgccctctttgtagaacaagcatttccttgacaagcagattccacattgatcagcttctcaccctaaggccttcttcttcttcttaccctcatgatcaaaccccacctagggaaaacctcattggtggtgatgaagattttgttgtgattgaattgggtagtgatcatgatagaagccagaatttgcaagaaagaggcaatgctttggagttaccaacatgtcctattagtccttcttcaccaaggaagctattggaacatagaaatgtgcagaagaagaaagcaatgaaactgcagaaagtgacaagcatgggggatgagtgtattgatattagagccaaagatgaccagtttttctcagtgcaaccaatcagaaggtctttctccatggactcatcaggggatagacggttctatttagcagttcaagaagctctgaggaatcagaactggcaagtcaatgaggtcaactccattgaaggttgcagtggaattggtagtagagctaagagtcctccttcaaggccatgtgcacgtaagcatgggcaggggctacaagatctgttgcacacttcaggaacccgtgagatgccacatctttgtcaaaaag

SEQ ID NO: 54731 - DNA, 144 bp, Glycine max
  Peptide Sequence Number=SeqID_171509
atgaagagttgtagggattgggtaacactatcagaggtagatggagatgaggaaacagtggcaaattgtggggcccttctccataagttagggcttatgcatgaaatcagtgacggtttaaatacatctctaaaagatcattaa

SEQ ID NO: 54732 - DNA, 336 bp, Glycine max
  Peptide Sequence Number=SeqID_171510
atgacgagtgtagcagtgatgaaagctcaaagacctttacatggcatgcagatgggagaaattgcgatggaatgcttcgccatccgaccgattcctcctagggaaagaagattaatggtctatatccgaattttgcaaaaaaatgacattgatgtttatctcagtcccttgatagaagacttgacaaagttatggaacgagggggttgtcgtgtttgatgggtatctgtcataccctaatttcgtccggggactattgtttgatggcatgcaacccttgtttgaccgcttcgaggtacttggcaccctttgttgcaccatacgtcaagttccgtga

SEQ ID NO: 54733 - DNA, 249 bp, Glycine max
  Peptide Sequence Number=SeqID_171511
atggagaaaacaagcggagtcgccaccaatgtttatttgaggaaaatgttagaaaaaccaaaaagacaaaggtctgcgtattttgaaaatgaaggttcgagagttgtttacgcacgggaaaatgaaggtccggtagaaaaatcaaaaagacaaagctggcttaaaacaaagaaaaagatcaccgatggtagaaaaatgaagatgaagacatgcaaagcaaggatgaacccctacgggtgcatagaatga

SEQ ID NO: 54734 - DNA, 810 bp, Glycine max
  Peptide Sequence Number=SeqID_171512
atgcatgctagagctagagtaatgagtgaagtagaggaggtgcaagaatggatgaaggccgacatggaggccatgaaagagaaaatggccacaatggtggaggccatgatgagcatgaagaaaataatggaggtcaatgcggttgtagttgccgttaccagcgccgttgctgaggtggacccgactccctcatctggcctcaaccaaataaatcatccaacctcgaatatggtaggtcagggaggcaaagagttgggaagtacgggcgacccctattttgtgcaagttcagaacaagcaagccttctcgccatatggcttgcctcccaactatccaccgcccaatgttgcacacgctctcgttgagaatgtcaataacttcactcccatactcattgagagccaacaatctcaaactgatcatgcacatgtccctcaacccatgggggagacacatgaagtaccccaccacaatctagccgacttcgagcctcacctcagatacgccactgaggggcaagtagttagtggtgtacccctaccaaacactttggagggccctcagtttcgtccaccaccacaacccttgcattttatggcgggaagaatccctcttgctatggcggaaaagggaaagttggatcatatagaggaaaggctcaaggctattgaagggggcggagatcatgcttttgctgacatggcagagttatacctagtgcttgacatcatcattcctccgaagttcaagacaccggatttcgataagtacaaggagactacttgccccaagaatcatctgaaaatgtaa

SEQ ID NO: 54735 - DNA, 615 bp, Glycine max
  Peptide Sequence Number=SeqID_171513
atggcatgcggagagcatcatggttatccgctttcgttgttttcaagactattacagtctcctttccatccagagataatcaagttcgatggcatgcaaagaccatcatggtcatccgctttcattattttcaagactattttagtctcctttgccttccagagacaatcaagtccattggtatgcggcgataatcatggtcatccgctttctttgttttcaagactattaaagtctcctttgccatccagagacaatcaagtctgttggcatgtggagacaattatggtcatcctttacatttcgaagatgacaatgtcttcaaaaggcgaaaatgccttcatttacatttcaaagacgacaatgcatttacatttcaaagacgacaatgtctttagtcatttcatgtcttcaaaaggcaacaatgccttcatttgcatctcgaagatgacaatgtcttcaaaaggcgacaatgtcttcagtcatttcatgctttcaaaaggtgattgtcacaacctgccctccgacgtgggcacgaaaaggcctctcagatgggccaagggtgcgtcttccattgaaggaaaacgcgcggagtcgccaccaacgtttatttga

SEQ ID NO: 54736 - DNA, 174 bp, Glycine max
  Peptide Sequence Number=SeqID_171514
atgaggagttggtgtcgtgaaggaattggaggagtggaccgaatagggttgcgtcattggattcttgaaactgtgcgtttgagggagggaaagaggggggtgagtgtggtgacgaatgagaaggaggtggagaccttgattcccaaaatgagaagttctaaagtcgtgttttaa

SEQ ID NO: 54737 - DNA, 462 bp, Glycine max
  Peptide Sequence Number=SeqID_171515
atgactaccactaaaagtgaaagcccagctcatcaagaaaagaaaggtgaaaaaatgaaaaactcagcagagaacaaaaaagaagaagaagtagaactaaaaccctcaaagaagaaggaacaacactattatccagtttcaaaaccaccttcagccccaacactacaagactcattcaatatctctcacagccaccactctttcagcgaaggggaccttcagaaagcggcggctagctactctctttcttcgctcagcgacggcgccattaaggttgttaaggatgaaaagaatgataagagtttggtggtggcagtgatggatgttgaagaagatgctgaagatgctgatggagtgaacaagaaagaggctttctctgtgctggctggtgatagaagaaagaaattgcgtcgagggtcatcaacaaacaatttgtatctttcatactatgattcatcatag

SEQ ID NO: 54738 - DNA, 105 bp, Glycine max
  Peptide Sequence Number=SeqID_171516
atccagaaggttgttggaaatctcaaacatgagattgcggttgagtcaaaaggatattactattctaaagttgagaaactcacgttctatgattactacacttaa

SEQ ID NO: 54739 - DNA, 357 bp, Glycine max
  Peptide Sequence Number=SeqID_171517
atgggcaagcaatggagacattttaagtctgatttgacgatgaaatgggcacctacaaccggcaagggcagtgtcgatgacactgtatgtcaaaagtacgacattagcaaggagaagtggacccaattttgtcagagccatagagacccttcatgggaggattccttggaggagcaggcctcacagggttcctttgtcgcccatggacgccaagatgtactgactgttgccattgggcgactagaacaccctcgtcgtatctgtgttgctcgagttggtgtcatgatcaaacaatactttggaccaactctaaggaccttccgctcatctttttccatgtgtggcgtccctaaataa

SEQ ID NO: 54740 - DNA, 532 bp, Glycine max
  Peptide Sequence Number=SeqID_171518
atggcaagacacaaggcaggcaaaaacgagagagagccgacgaacggggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattctcacgttccctattggtgggtgaacaatccaacacttggtgaattctgcttcacaatgataggaagagccgacatcgaaggatcaaaaagcaacgtcgctatgaacgcttggctgccacaagccagttatccctgtg

SEQ ID NO: 54741 - DNA, 162 bp, Glycine max
  Peptide Sequence Number=SeqID_171519
atggaggtgaatgaaagttcgggtgaaaaggcaaaaaagacttgggttgggttggtatccgtaatgggagaactgggaaatggagaaaaggaaaagcgagaaagtgaagcaagagacaagtctaaaaccaaggatcataacaagaatggaatgaagtattga

SEQ ID NO: 54742 - DNA, 351 bp, Glycine max
  Peptide Sequence Number=SeqID_171520
atgggtgcagatcctccgttggagtccatcatgtttggggtgacatgtggtgtagatattccttcctcgtgttctagacaatgtcaaatcctctgtcaaaatccactgggttggaagtcgcatgcaaatctgttgtgctttcgtgcaaatctgcacccaagcagtagcaggtctagtgatagaaagagtagcattgtgatggagatgtcgttgaaaggatcaaaaaaggaatacacggtggctagcaatgatatgtttgttaccccttggagtgtgtttgttgctagattcaaattgatgggatacacggtggaaggagaagggggaattgaaggaagaatgaatgaatga

SEQ ID NO: 54743 - DNA, 117 bp, Glycine max
  Peptide Sequence Number=SeqID_171521
atgaagacattggccaagtcaattagccaaaaaggctctttaaacccagaactcaacaagatgttgccaggtgtttctgagccaaataatcctgcttttcatgctaaattagtgtaa

SEQ ID NO: 54744 - DNA, 321 bp, Glycine max
  Peptide Sequence Number=SeqID_171522
atgaagtttagccttagcttctttaggctagtttggaggagcatatttgtggtgctagtgactatcctagcgatggccatgcctttttttaacgagatgcttgcccttttgggggccatggggttctatccattaaccatatattttccggtggagatgtacattgcaagaaagaagatcaaaagaggagcaaagagatggctaggacttaaaaccttgagcttggttttcatgttattgtcaatggctatagcatgtgctgccattcatggaatgaatcaagctcttcgtaaatacaagttcttcatgtataaagagtag

SEQ ID NO: 54745 - DNA, 246 bp, Glycine max
  Peptide Sequence Number=SeqID_171523
atggacaagattcctttcaatcttccccacacgatctacatcaacattctcaagaacatgaagaccctaggaggagtggacgacatccactatgccaccctaatcaacaaaatcttatgggaacaccaggcaatgaaggttgacattagaagaaacatgcccaatcccccagttgataaggatacatccaacaaaggaggcaaaagaacctggctagaatcatggctgatgaagacaaaactctag

SEQ ID NO: 54746 - DNA, 423 bp, Glycine max
  Peptide Sequence Number=SeqID_171524
atgaccaaaatagaggacaaaggccctctaggcttcctaaggaagcgaaaagaagaacccgttgttccacaaaagcctaaccaaactatgatcccctcttctttggaaaagaagagaaagacaatagttggacttaagtccttaacacccaaggaaaccatcaagatcctatcctctgaaggctttaatgcaatagtagctctggatgccccctccttgatgagatcaacgtatcccaacctggtcacgatgagtcctcagttgttagcaaatggtaccaccacaaccacttatccatcacctgaagaggctgaggagaagcaaaagcaagcaagcaaccatccttttatgaaggcatccaagccaactccgcgtatgagaatctccgacatggatccatcaaaggagaatccaactccttaa

SEQ ID NO: 54747 - DNA, 195 bp, Glycine max
  Peptide Sequence Number=SeqID_171525
atgattcctaaagttaatgacccgcaaagcctaaatgaatataggcctatatctttagtaggctattatgagaaggcttacgattctgtatgttgggagttccttctgtacatgatgagacgtatgggtttctatgctaagtgggttagctggattgagaggtgcctcaaacttcctcagtctcagtccttgtaa

SEQ ID NO: 54748 - DNA, 216 bp, Glycine max
  Peptide Sequence Number=SeqID_171526
atgcagctctctgttcatgcaggatacatgcctgttcattgcaggtgttgggctgacccgacacaaccctaccagataatatattgcaaaagcgcagcagccacgaacgcagaaacagaacagcagcacgaccccgcacccgcacccagcagcaacgaccgacagcagcacgaccccgcgaagcagcaaccagcagcaccacgaatggcagcttga

SEQ ID NO: 54749 - DNA, 153 bp, Glycine max
  Peptide Sequence Number=SeqID_171527
atgacagcagtaaatatggagaaggatacggtgtcctttaatatgccctttaatgatcgacaaattgccatagatgttcgatgcttttacttgcgaaatcaaggcctctacacaagattgatgaaggaggaggttcgacagggtacaaattaa

SEQ ID NO: 54750 - DNA, 1161 bp, Glycine max
  Peptide Sequence Number=SeqID_171528
atgccccgcatgcgtcctgaatctgttggaaagttaggtgaatgctataaatccaaacctgacttcatcaaggcctgggaaaaatggaggtcacaaattacaaaactggattgcagtcgattctggattcaatgtgataatcaacaaactcgtgagggcttgagaaacttgctacaaattatgctgggtaacactgagagtctctgcatggctacatgttattggattgaattatatatttctcatttcctgtacataaggccatttacaatgggaatagaaagcatgtataatttggcccagaaatgcatccagttgaaaccacgatctagtacccataggttgtcagtacttatgattggaattcttgaagaaaataccgaggttgttttagctgagtgttccagagaatttggcccttggttggtggcacatgccatagaactgttgactgcagggagtgagcaagcagagattcttctgcatgaggagcgttataacttggggggaatcagcatagtggaactacatcggcttgtatatgctcaaattctatcgtcacatgcattgacctggcaaactgagagtaaggatgaaacggatgtctcgtacacaggatttagtatgagcaagagaccaaaacagcctatgccaaatgaaagttttttttatgagattgctcctatatatttaacatcatgcatgaagcaaggaatgggcttgttagagaatttattgtacaggcaatctgctcaacataatgatgtgttgcttaagaacattgagatatgccgtttgtatgagcttgatcatattagttcaaatatcatgaagattgctggagtacatcactggaagcatggccataagggtgctggagtattctggcttcaacaagcccaagacgcaagttgtcttgataagattgcccaacagttatttgattctgttggaaagtctatatctgatgaaagcttcaagcaatgggaaggcatgattgaactattgggttctgaatctaagcctgctgggggacttgaatttttgcacaagtatagggatttcaagaaatcccttcagaaggtatctagtggaaaatcaactgatgcagcaaggcaagctgtaggctccctcatactggtattacacacacctttgtga

SEQ ID NO: 54751 - DNA, 378 bp, Glycine max
  Peptide Sequence Number=SeqID_171529
atgacagatagatggaagactgaagcagccagttgtttgaattgtagtttgctggccatcccgtttgtttaccaaggcatacccataggggcaaaccctagaaggattcctaagaaagtgacggaaaagttagtgtccatacaacgaagattcctatggggaggtgacatagatcaaaacaagattgcgtggattaaatgggagatagtatgtctcccaaaagacaaagggggactaggaatcaaggacttaaacacattcaacatcgcactgttaggtaaatggaggtggaacttattccagcatgaaggtcaactgtgggctagggtcctcgagtctaaatatggaggctggaggggattggatgaagcacattga

SEQ ID NO: 54752 - DNA, 1712 bp, Glycine max
  Peptide Sequence Number=SeqID_171530
atgtatattttggttgacaacagaccatggttgagtgaccttggttcacggggagtacacatttggcaattgatggttactaagtcaaggctttctccatttgcatattccaaatctcgaagagagaggaaggaaggcaaggaggtttgtcctcaatcaagctctagcaaaccaaagaaatttatgagatggttctcgttgattgaagcagtgatgttatcaagaaagaaagttttgttgcctgtgaaaaacctaaggaattctttacaattgagcagtgaattgcatagaactctgtatggctttattgtatttgaagttgcatggaccagtgttcgtggtattaactactataatgagcttcagactgatacatcactggctatagaagctaaactgatgaaaagatgggaatttgacagtatagctcaagctgcagactgtatgtcttcatggttctcaggaacaccttctgaaaagttgcttctgaaagaacacctggattccgcctcaggggacacattttatgatgctagtgaagatttttctggcactgtatccgttgatgatggtgatgataatgtctgcagaattctgactgttgaagatagtttgggtaccaaagttggagtatattctgatgatacagaagaaacaacagacatgctacacacacctcctccttctggacctaacaagagaagaaaattaatgaatttctttagtgctggagttgaagttggtagctactcggcagctgaaattgataactcattggattattctcagacctttagctgtgtttctgatgatacagttgaaaccactcaagatgatacagttgaagcaacacaatatagtgatgttctactgtcatttaggtttaatgatcatgacctcccatttaaattcagggaagtcatagtatctgatctgcgattgcttactttgttggaggctggtcttccatcttgggtcatcttccttcagtcatatccagtgttatgcaatctttatcgtccttggatgtgcccacttgcaagacttttatattttttgatctcatttgttactgtcctcattggattctatgatttatacaaaaatgttcctgttctcaaggcaactgcatctcgtatatgtgggcctcttcttgattggattgaaacttgggagatggtttcaagggtcaaatacttaggcacaatgctgtttctacataacttccagaaggctgttaggtggtttcttgcctttacacataccatgcgatcatttttttcctttcttgttcaacctcttgtagagtcattggtggagatttttggatttcttctcccaagcttcaagtttttgtttgaattagctgaaagcatcttttctgtcatttggctcgtagtggatacttcttttgatatagtgggaaatgtactggagctgctcttttcaccattttggtttgtcctcaatgttgtttggagcattgctacttgtatcttatatcctttattttgggttctctgggaattcctatatgctcctgttcgtcttgtcctgtttgcagcatcttctgaagcaacagtcagtgcttctgaagtttctatgtggcgaactctttggaatgaccttttttcccagattttccgtgctctcaagagcatactctatgggtttgttgccttcttcacagcctgcaataggcatcgactaag

SEQ ID NO: 54753 - DNA, 828 bp, Glycine max
  Peptide Sequence Number=SeqID_171531
atggagaggaatcacttgcagcaaaatatcctagactacctaatctcatgccaacaaaaccatcttattcagcacatgggaggcaataaggaagctgattgggagtggaacttttcatggagaaggccattgtttgacaacgagattccaatggctgttgattttttacaacatattgaaagcaaacctattcagatacacagaagagacgagtgggtgtggacagcagattcaagtgggcaatacacgacgaaaagtgcttacaagatgatgagggggggtgacatagatgggacacaggacagggcttttgaggagctatggaagctgaaggtaccaatcagatatgcagtgtttgcttggcggttgcttagagacaggttgccaaccaaatcaaatctacttaggagacaagtaaagatcgttggcaggacctgtccattctgcagaagcgcggaggaggaagcgggacacttattttttcattgcagcaaaatcatccatatttggtgggaatccttgtcttgggtgaacaatgtgggagttttcccgcaagatcccagacaacatttcctccaacatggatcgatagcagctgatggattaaggattaatcggtggaaatgttggtggttggctgtcacctggactatttggaagaaaaggaatgacatacttttctccaatgactctttcgacaacagcaaaatgatggatgaggcagctttactcatgtggacatggctcagaaatttggagaaggattttgcaactcattttaaccaatggtctagtaacctcagagaaggattttgcaactcattttaa

SEQ ID NO: 54754 - DNA, 381 bp, Glycine max
  Peptide Sequence Number=SeqID_171532
atggggacagggatgggtacgtattttttaatctcggcgaggatcggggtcgaggtcggggatcggttaccaagtcgggggcggggtgggaaatgcaatacccgtccttgtttcaccccgttgccatgcctagtttctttgttctttgtttattacacaatatgtcttcctcaactgttaaatggagatacttttcaaagccctaaccctttgttctttgaaacaaagcgaggcctcacacttgaggcctttgaaaacaaaaatcctccaacgcctctatcttcaaccattggaccaagtatgcaatattttattctgatacccacaagcagtgagccgtggaatgttgaaaggtatgattttagttattcgtcaaactga

SEQ ID NO: 54755 - DNA, 384 bp, Glycine max
  Peptide Sequence Number=SeqID_171533
atggcagcagaatggagaaggaagagagagaggagacgccacttcaaggagaagatgactctagaagaagctcaccaccataggaagccatggataaaagcttggaggaagaaggagatgaatgaagggagaggaagagaagaacacaaaattttgtgctctaaaagagctctgaaatctaaacccgaaatctaccctaaggctcatgagaatcctaaggcattctcttgcatctctggcctaatcttcttggagtcttctatccaatgcccttgcagggtaggattgcatcagtttgttctagttgggttaaagaaaaagtgtcttgggttgcatcgtttaattgtgaataatgggactgaggataatattatggttgagaag

SEQ ID NO: 54756 - DNA, 210 bp, Glycine max
  Peptide Sequence Number=SeqID_171534
atgctgctgaagggctcactcagtgagccagattggctaagcgaggctcatctgcttagcgaggaagccagctcgctaagcgaacacaaaaccctagaggatgttaagtcagagtgcagtaatctagaatcaagaacaaaaactaagagagttaggctttttcatgtgaggaatcctagtctgagtaaattgatggtgcaagaacattag

SEQ ID NO: 54757 - DNA, 210 bp, Glycine max
  Peptide Sequence Number=SeqID_171535
atggctccctattgtcgattcatcatggccgcttgtatggccccagccggagtaggaattagtcctgttggattggaggatgaaaagcattgtttagttacatcgtctcaaaacaagcaatgtgagataaaaatcgtaaggggaaaagcaacgtgtggtcagatcgtttttctggcacaaagctatgcaggattcatgacaagtcgttga

SEQ ID NO: 54758 - DNA, 650 bp, Glycine max
  Peptide Sequence Number=SeqID_171536
aacctaggtccacccatacatatgcaaaagaaaaggaaatatccagtcttagagcaatcatcactaacccaaacctatttagaagatccctaacagtgagactcccaggaggaaacatcccacatatcctcatcggaatcttcctcagaatcctccttactattttccttaatgagccacctgactcctccctagggaagctccccaccaatttcctttgtcgctactgcatcatcctctacagtcaagctcaagaagaaactcctgttgcatttgaccctaacaataaaaatgtaaggttcagatggctgccaggagttcaccttcaccaagaaataatggtaggctctcactcgtcggctatgcctcgtatttgtcgggattttcaagtcaccttagtggaaaacatgaccacaaactcagtgccatatccccaagaaacaacaagtcaacgaacataccccagataccactccataaggccatcccaaactctaaggattggcgcatcaactcctttctcccagaggatttattttatcgtcatcgtcgggcctgactgtaatggtacaaaacgtcgtcaaaaggtgaaccagaaaaacagaagaaagcttggaagagaagttgaagatctgaaggctctctcttag

SEQ ID NO: 54759 - DNA, 183 bp, Glycine max
  Peptide Sequence Number=SeqID_171537
atggtgaagggtgggggtgtgatgaaagggaaagggagagaggaagggaaaagagttggctgttggaaatctaggaggataggaagatcaaacaatttccgaagtagctccttctcagtgcaaccaagtgaaaatcagaaactatggttgatagactctacatcacttgtgagtaggttttga

SEQ ID NO: 54760 - DNA, 573 bp, Glycine max
  Peptide Sequence Number=SeqID_171538
atggagttcaaaagggtggacactcaagatgctgtcaaagatatgttgtggtcacatccatattccatcaagctactgaattcattcccaacaatgttgatatttgatattacttacaagatgaacaaatatattcttctgttgttggagattgttggtgtgacttcaatagacatgacttcctctgttgcctttgcttatttacaacctaagaggaaggaaaattttgaatgggctttaagaaagaatgtcagagcaaaatggaagatgcacgttagtaagacagaaaagtgggagactatgatggatgcttgggctgggttggtgcaatctcttgatgaagaattgtatgagcaatgcttgaaatgctttgcaaacctatgtgtcgcaacctacccttcggcgggagggcgacgcgagggctcacgggtgcgtcttccaagaaaggaaaatgcacggagtcgccaccaacttttattcgaggaaaacgtcaaaaaaaccggaaagttgtggtctacgaaatttaatcgtgaaaggttcgggagttgtttttacgcgcaggaaaggtattag

SEQ ID NO: 54761 - DNA, 3288 bp, Glycine max
  Peptide Sequence Number=SeqID_171539
atggagaatctttgtgttcgctttaacggcaagaactatgctgcttgggagtttcagttcaagatgttcgtgaaaggaaaaggcatatggggacatgtcgatgggtcctcctctaaacccacgacaatggctgagttggctgcttgggagacgctggatgcccagagtatttcttggcttttggggtccattgagcctctaatgacatgtgggactatctcaacagcattttcaatcaagaccattccgcaaaacgctttcagttggaattggacagccaattacagtcaggctaatttctctattcaggaatattattcttgtttcctgaacttatgggctgaacactctgctatacttcatgttgctgttctgaaaacttctttggctactgttcaagaggtttatgaggtcactaaacgggaccaattcctcatgaagctgagacctgaatttgaagctgtctgtgctgctctcttaaatcgacacccatttccttctctggatgtatgtgttggtgaactgcttcaggaagaacagcgtcttctcactcaagcagctttgtcccgtgactcttctatttcaatagctattgctgttgcctatactgcccaggataaaggcaaaggtcgtgatacacgacagcgtggccatatcatcacggactgtcccactagaccaccacggcgtcaggtgcaaccttttcatgcagctaattctatgactaagacacccacttctgtcccaaccaatgctgatgccttaactctagagaaggtgcaacaaatggtgctttctgcattatctgccttaggcatccaggcctccaatcatatgattggtacctcggaacatttaaaaaatgttcgcacttataatggcactcaaaacattcagattgctgatggtaatactctttcaatcactgccgttggtgatattactccttcctttcgtcatgtgtcgaggaaggtgatcacgacggggcctaaagtgggtatattatttccactccagtttactctacctagacttttgtcttttaattgtactggtgtcacaaataagtatgaggattggcacaaaaagttgggtcacccaaattcagttgttttgtctcatttactgaaaaatagattcttaagcaataaaattaccattcctggttcatcctttaactgttctgtatgcaaacttgctaaaagcaaaatcctcccgtttccttctaatgctcatcgcgctgacaaatgtttcgacattattcacagtgatgtttggggtatatcgcctatcttatcacatgccaagtacaagtattttgtgatatttattgatgattatagccgctttacttggatatattttctccgttctaaagatcaagttttctctatgtttaagacatttttggcctacattgcaaatcaattccacaccagcattaagattttgcgcaccgattctggtgggaaatatatttctgctgagtttcaaacgtacttgcagcaacaaggcattatttctcaacgttcatgtccatatacacctcaacagaatggcgttgcggagcgaaagaatagacatttgcttgatgtcacacaagcattacttcttcaggcttcggttccttctcatttttgggttgaggcattgaccactgctgtctacttgatcaattgccttccctcccaggttcttggccttgattctcctttctttcgactttataacatacaaccgagatatgatgatcttcacccttttggttgtgtatgttttgtacaccttccacctttggaacgtcacaaacttggggctcagtctgttcaatgtgcatttatgggttatggctatgtatatactaggcgccctcttgtcccgccccttcccgactctgaaccgtcacctgaacgtacaccaatagcacctcgtagatccagctgtatttctcgtccactagataggtatggttactcccctacttctcttactgccactttatctagcattcctattcctacatgctattcacaggctgttaaggatgtgtgttgggtcaaagctatgcaagaggagttgcaggcacttcaggagaattatacttgggatattgttccatgcccgcctaatgatgaaccctttggctgtaaatgggtgtattctatcaaacttaattctgatggttcttttcatcgttacaaggctcgattggttgctttgggaaacaaacaggaatatggagtggattatgatgagacatttgcacttgtggccaaaatgactactattagaactgtgctatctattgttgcctccaagggctggtctctccatcaaatggatgtgaagaatgtctttcttcatggtgacctagctgaagatatttatatgacccatccacaagctggtattgttcttcttcttatttatgttgatgatatggtcattactggttctgatcatgtgtcaatacagcacctcaaacgacaacttcaagcttcttttcatatgatggatctaggcaatcttaactattttttgggtcttaaggttaattctcatcccaaatgtctctttcttcatcaacacaagtatactaacgatttgatctctttggctggtctccaatctgctgctcctgtggatactcctcacgaagttaatgtcaaatttcttcgtgatgagggtgacattctacctaatcctttgttgtatcgtcagttagtgggtagtcttaattatttgactattacacgtcctgacatctcctttgcagtccagcaggttacccaatttatgcacactccttgccaccttcacctagttactgtccgacgtatcattcattacttgaaaggttggtgcatgtttcttggttcttcacttatttcttggaaaagcaaaaagcaagcccgggtctctaagtcttccactgagtctgaatatcgtgctatgtctctagcctgttctgaaattatttggcttagtggtcttttagctgagcttggtttccctcaaaccgaggctacacctctctatgctgacaatactagcgccactcagattgctgccaatccagtcttccatgaacgcaccaaacatatcgaagtggattgtcattccattcgtgaggctcttgataatcatattgtctctcttccccacattacctcgcaacttcagcttgcagatatatttaccaaggctgttcctcgtcctcggcatcagtttctcaataacaaattgatgctccttgatcacccgcatcaatttgaggggggatgttag

SEQ ID NO: 54762 - DNA, 1053 bp, Glycine max
  Peptide Sequence Number=SeqID_171540
atgggacacttgaaagatctcatgagtgctactgatgctgctatgagtcctaggagatcgcttgagcaagacatgtattcagagcaatcagaccaagatgagaaagaatcgctatatgatgattatgctattgcaaatggtcctgattctacaaaatcattttcaattgatcaaacatcgaggtcaagcttggatgtgcaaaatataaatgcaagttcccataatagctccaaagattgttgggaattagttttggcaaagacagtaactgcacccattgaaacatcacccaaattggcaaatggatttcatccatctgtcaccttatttgatcaagcttcagttcctcaagacaagtacaacccattccttgatgacacaacaattgttgctccccctgtaaccactagtgataattttattgatgtttttgattttgatgtggcaccaacatttaaggcaacaacacaaaccttttatgctcaggatcttgttgtaacaaccttctcagatcaaagttccaattccatagcaaatccagatgtaatttttggtgacatgtatccaaatgagacaacaaatgaggcaactttcagagctcaaggttcttctgcaaagaacaatatgatagtgccattaaattctaatactaaaacttcagataacatgattacaacaccaagtttccagtcgcaatgttcttttaagaatgcttcacttccaacattccaaatgcacaagtcaaatcttgatgccataatggaagcaccaactcttatttctcctcagaatcctaatttgagtattcttcccatacatttccaagcacacaatttgtatgcttcaacaataccaccaacatttagtgcaaaggattgtaatgagacaacattggcagcttccatagaggatgatccttttggaccatggcctagtacaaataccaacgaacaaactttaaataatgtatcaatgcaagaggatactttgtcgcgacaacaacaactatggttagagcaacaacaaaagatcatatcaaagcatttgacttga

SEQ ID NO: 54763 - DNA, 231 bp, Glycine max
  Peptide Sequence Number=SeqID_171541
atgagtggcaatagcagcaacaacaacaatataagtaaaagaatctctgtgttgtcatcacacttcgctagatccagccccatcatggcttcagagaagcaagcggctcttgccgtcactccctctgatgctgatgctcctaccatatttgacaagatcatcaataaggagattccttctactgtggtttatgaggatgacaagtttgagtggaagtcctggctctcatag

SEQ ID NO: 54764 - DNA, 882 bp, Glycine max
  Peptide Sequence Number=SeqID_171542
atgccaagcaaactaaggaatgcaattggggcagtgaaggaccaaacaagcattagtcttgccaaggtaaccaatgcagccaatcttgaagtcaccatccttaaagccacaaaccatgacaaaaatccaattgaagagcgtcatgtgaatgaaattttgaacatagtctcctctaacaaagtatatgcagctgcttgtgctcattacataggaaaacgcattggtaagacccgcaattgggttgttgctctcaaatgtctcatgattgtccttagaatatttcaagatggtgatccatattttcctagggaagtattccatgcaatgaaaagaggtgcaaaaattctcaacctttcaaatttcaaggataactctaattctagctcttgggattatactgcattcattagaacatttgctttatacctcgatgaacgcttagattgcttcctaacgggaaagctccaacgccggttcacatatcacaaccaatttcatgagaggaaccaaaagaacaagttatccaatgagccaggtatcaaagacatgaaacctacaatggtgcttgacagaatttcacattggcaaaggttgttggatagagctattggatcaaggcctacaggattagctaggaccaaccgtttggttcaaatttctctttatgctattgtgcgagaaagctttgatctgtatagggatatctccgatgggcttgctgttgtcttagatagcttcttcaatttgccatttttagcaagcgctgcaacattcaatgcttgtgttaaatcctacaagcaatttgatgaattatctactttttattcgttttgtgcaagcattggggttgggagatcgtatgactacccaagagtggcaaaa

SEQ ID NO: 54765 - DNA, 285 bp, Glycine max
  Peptide Sequence Number=SeqID_171543
atgggtatagacgtcgtcgtcttaatgtgtcttagagatattaggcacaacaaattcaaagattctttaataggaacagtagaaacaagcctaggacaaggaccaacctatttcaactgttacccaagcaaaatggtgagtctgatggatagaaacatccttgactctctattcctaaatatccactttcatgacctccacatgaaagagagttcaattccagcaactctaatttacagaatccagtataaggtcatgaatacttgtgcatcaagagtcctttga

SEQ ID NO: 54766 - DNA, 240 bp, Glycine max
  Peptide Sequence Number=SeqID_171544
atggcggtgccaccgaagaagaaccaacaagaagacgaaggcacatggactagaaaacgaaggaagaacacgaatgcacagggagggagaaggaaaggaagcgacgacgtacgaaatgtgaacagtgacgctgcacagctagcaacaccctcaataatgtggctgatttgtgattgtggaagccaaacacaaatggactccattctacaaactcaacctataacttgctactacaagtga

SEQ ID NO: 54767 - DNA, 242 bp, Glycine max
  Peptide Sequence Number=SeqID_171545
gagtaaagttggaaagaagctcaagtggtggtggttgtggtgagggagaaggagaggttatatttgtgtggttgtttaggtttttgatagtggaaaggaccaaaggaggagccaaagcaaactgggtaagatggttttgttccttgaagggagagaaaaagatgaaggaaaggacaacgaaaaatagggggaataatagtgcagaaatggagcatctggagcattccatggcctctatctaa

SEQ ID NO: 54768 - DNA, 256 bp, Glycine max
  Peptide Sequence Number=SeqID_171546
gcttagtgcgagattggcgctaagctcatattcacttactcgcgctaagtgcgacgtcgagattaggaagccctttttaagcctgatttgcacagaattaaagggagagccaagaggactattcactactcagagtgtgaatttcagagagcgtaaagcagagcaaggggccaagttttcatcttttagggagattagtgagtttttgagagtttgtgagattcctagaggtggaggagatatccccactccttag

SEQ ID NO: 54769 - DNA, 229 bp, Glycine max
  Peptide Sequence Number=SeqID_171547
ggacagcgagtcaggtagcaggcggagataccttatggtcatccgcacctttcgtcatccgaggggaacaaattcgacggttttactctcgtcttccggaaacattcaagcccgacgacgcgcgagattcttctctactgagcaggggcgatcgagtgcaatggcggagggaagttccgctggtggggatattggccggacaaatgatgttccactcgaacgaaattag

SEQ ID NO: 54770 - DNA, 1359 bp, Glycine max
  Peptide Sequence Number=SeqID_171548
atggactcaatgaggagaaggtgtataaacaagagattgaaacccaatcctgaaggtcaagactttattagcaacctacctgatttcattattggtctgattctctcgttgcttccaacaaaagatgcatttcgtaccagtgttttatccaagagatggataaacctctggatgttcatcactgcagtagaaattaaggataaagaacaactctctcgcaaaaagataaggaaaatccccttctataaatttgtgaataaagtactacttcatctagagagttcaagcatccaaagtttctctctttctctttcacagagttatagacattgccgtgttgataagtggattaatgatattttaataaatctgagagtcaaagagctttacatcaattcgaagcaaaatctcagcatttcttgccatacccttttggaatccccctccttagaggtattgatgctgaatatgaattggtattctatcactcttcccacctttgtttgtctttcatccctcactgtcctcaagttctccaaaatcacagtgacctgtgaccctttcaagtcgcaaatgttgacccttaacttcccagtccttagggagtacttgacagaagattgcaattggtcaaatgtaaagggtgtcacattagaagtgcctcttcttgaagtgctttcaattaagtattcaagattcccaatatctaaagagtcgaatactgtaatcaagttttgtgccccgtgtcttgcgaaattctattattatggtcttctgttaccagacaccaactcgttagacctatctataggacatattgcttatgctcatattgatatttgtccgttcatttatatggggagtgcagaacaaatggcgcttattgcttgtgagcttttgaaaaagttcaataataatgtggaatgtctaacgtttcagtggccagagattgttgcaccggctaagcttcctacttttcgaatgttgagttgtttggagttagggtatcttacgggtgaagttttgttgaacttccttcgaaacacgccatttctgaagactcttgttattttaaagggcatatatcaatttgatgaagaactcagtaatcctgataatgtgccgtcatgttttatgtctaatcttcaagtggtgaattttggagctctaaatggtaaaaaacacgagctgcgtcttgctaaatttataatggataatgctaaagagttgcagagggtgagtttcagtgctgctaggaatatgcacaggtcaaaatttgaaaaggttaaaaagaagataatttcgtttaagaaaagtgttagtgttgcggtaatagattttctaccccttcataattag

SEQ ID NO: 54771 - DNA, 313 bp, Glycine max
  Peptide Sequence Number=SeqID_171549
atgacccagctgggtcagcctgaggaggtggcggcggtgcgtctggggcctacgggtcgccaccctgtgcctgctagctgtgcagtacttctctatgaaagcccgggtgatcggcggtcgaatcaccttactgggtgtgacaggaaccccgaacgactggcagagacccgtgatcaatgccggaaaacccaaggccctgctagacttatctggggtctagagggatggcgtacaccagctagcacttcgcagagggaggtcagaattatgatcgctggggcagggatgttgctgagcagcaatgtcatcccaa

SEQ ID NO: 54772 - DNA, 525 bp, Glycine max
  Peptide Sequence Number=SeqID_171550
atgttgtcaaatcaggaattgcatgaggctggacaaactaagttttggtttccaggagcaactattccagagtggttcaataaccaaagtaggggacattcaagttctttctggtttcgtaatgaattccctgtcaatgttctttgtcttcttctagcacgtgtggaacgcatagatgtagatgatattttcatgcctgcggtgttcatcaatggcaaacttcataaaaatccctctcggggcactaaagtaagaaaggtgaaattggattatacatatctatttgacctaaaatcagctttggagcttaatgatatatctgaagtggctttagaaaaggaacggaaccaggtggaaattacatacgcaggtctgatagagacctcactggttaaagcaaccggaacccatgtattcagacaggatgatattcgatatgatgatccttattatggtaagagaaaattagagcatgatctcaacagttgtgaatcacgtgttggaaataaggctttttatgtttag

SEQ ID NO: 54773 - DNA, 1695 bp, Glycine max
  Peptide Sequence Number=SeqID_171551
gtcaccaggaagatcgacatgccctcggacttgcgcgtgacctggtccagcggcgtggtccgggccagcaggatcatcaggtcggaatgctgcacccgcgagatccagaccttctggccgttgatgacgtagcggtcgccgcggcgcacggcggtggtcttgatcttggtggtgtcggtgccggtggtgggttcggtcacgcccatggactgcaggcgcagctcgccggcggcgatgcgcggcaggtattcgcgcttctgcgcctcggaaccatgccgcagcagggtgcccatgttgtacatctggccgtggcaggcgccggaattgccgccgctgcggttgatttcctccatgatgaccgaggcttcggtcaggcccaggcccgagccgccgtattcctgcgggatcagcgcggccagccagccggcctcggtcagggcgcgcacgaaggcgtcgggatagccgcgttcttcatcgatcttgcggaaatattcggcggggaactgggcgcacaggtcgcggacggcttcgcggatgtcctggtaggcgtgggaggcttgaggcatggggtgggttgcgatgtcgacaatgaaagggaattcgggacaggatcgaatgtgccgcaaggcgccgcgcctgccaattcacaattcattaatacggggttcctgttcgcaaaagcgcatttatgtgaccgccgttcgtcatgcggggagcggggttgtgtggcgatgcaacagacggatggatatgcggaaaaatctcagggtgacgacggcggtttccgccattctggcggtgtttgtggcgctgtttgcgctggccgcggcggccggcatcttcgtgctgcgcgaaaaccgcgccgacatcgaggcgctgggccgcggcagcatcgagcgcgccagcgacctgtcggacatgaccagccgcctgttccaggcgcgcgccgcgctgaccgacgccaaaaccgccatggaaggcggactggaggaggcgcgcgaccagtcgctgaagcaggccgacgcgctgctgaaacaggcggcggccagccaggcgcggctgcgcgccaatgccgacaccagcgcgcagggcgcgccgctgttcgaccagacgctggcggcgtatgccgcctttgccgaccagaccctggcgccgatgttcaaggcgatcaagggctggaacggcatcgaggtcaaccggctggtcgacaaggtgctgccggtgtccggcgcggcctacgtcaagcaggccgaggcctaccaggcctacgcgcgccagcagggccaggcggcggtggccggcgccagccagaccatgcagcgggtgacgctggtggccgcggccgtgctcggcttcgtgctggtgctggcggtgctgatccggctggccgtgcgccgacgcatcctgcgcccgttgaacgaggccggcgcgcacttcgaccgcatcgccgacggcgacctgaccggcaatatcgccgtccatggcgacaacgagatcggcgtgctgtattcggccatgcgccgcatgcagaccggcctgtcggcggcggtggcgtcggtgcgccatggcgtcgaggaaatccatacgggctcgggcgagatcgccgccggcggcgccgacatgtcggaccgcaccgcgcgccaggccgggtcgttgcaggaagcggcggccaacatgacgcagctggcgcacacg

SEQ ID NO: 54774 - DNA, 120 bp, Glycine max
  Peptide Sequence Number=SeqID_171552
atggatacctcaaagccttacactggggcaatggtcatgacgaaagataacgattggtacctcaaagccttacactgggggaatgagggggcaccgtgcatgagcctcaagcgaacctag

SEQ ID NO: 54775 - DNA, 404 bp, Glycine max
  Peptide Sequence Number=SeqID_171553
gtagtttcatgacaaatggaattgaattgtttggatattgtgaaagcttggtggggttgatggggacccgggctgagaggaacgaggagaaggctacagtggtacctggagatatgtcgcgggggtcaggagaccttggggacgtcaggtggggtgctattgcccaaaaccaagcttggccaatcctgacccaacccgggcatagtcaatcagtgagaacctgtgacggtctaaaaattgaaacaggacattcagtagcctctggtaatcgattaccaatgggtgtttgggagaccctcgaaggcaatgagaggtgtcgattccgtggcacaattcgactcactgctacttcactagtacatccggagcaacccgcacgcacacttcaacagcctgtggagtga

SEQ ID NO: 54776 - DNA, 153 bp, Glycine max
  Peptide Sequence Number=SeqID_171554
atgctacaatgcttaaggtacttctctcagctcaaacatgatatcaaaattcccaactgtgagaatgctaggagatgggctgtaaacgtagtgctcaaatttcatgacgatccaacggtgaatgagtctgagatcatcatttttctgagacag

SEQ ID NO: 54777 - DNA, 318 bp, Glycine max
  Peptide Sequence Number=SeqID_171555
atgcgccggaaatcaaaaggaagcgtggttacgctatccgtgaaattccgtaatttgacgaaaaccaaaaggaagtattgttacacaatccgcccacttgggccttccagattcttcctccagaaggcggttgcttctggaggaagcaacctggctcgccagggcgagctgggtggcaagctcctcccttattttgctataaatagggggaggaatgaagaaggaaggggttcaaccttcttggcacttcgtattctcttgaaattgctgaggaaaattgtttccgtgaagaaaatccaagccgaggcacttccgtaa

SEQ ID NO: 54778 - DNA, 365 bp, Glycine max
  Peptide Sequence Number=SeqID_171556
ttggtgctaacggatctggaaagacaaactttttccatgccatccgttttgtgttaagtgatctctttcaaaacctacgcggtgaagataggcaggcactactccatgaaggagctggacatcaggttttatctgcgtttgtagagattgtgtttgacaattcagacaatcgtatcccggttgacaaggaggaagtgcgcttgcgccggactataggtttcaaaaaggatgagtattttctagatggcaagcacataacaaaaactgaagtgatgaatttactggagagtgctgggttctcccgatcaaatccttattatgttgtgcaacaaggaaaggtattggctgatggtgacagtgcttga

SEQ ID NO: 54779 - DNA, 288 bp, Glycine max
  Peptide Sequence Number=SeqID_171557
atgctgaactacaccacttggttggtgtccaaaattgatccaatcaagtacatcattgaaaagcccgctgccactggatggatctctcggtggcaggttctactgtcggaatttgacattctttatgtcactcaaaaggcgataaagaagagtgtcttggcatattacctggctcaacagcccatcaatgactaccagcctatgcatccagaattccctgatgagcacatcgtgaccttattcgaggaggaagtagaggaagaagataggaacaaatgcatcgagtga

SEQ ID NO: 54780 - DNA, 535 bp, Glycine max
  Peptide Sequence Number=SeqID_171558
atgacttgtgtacactcactcgtgttgttcctgtttggggtggtgattctcactactccagtgttggctaatttctttccacccatttatgagcctcctccaattgagaaaccacccatatatgaacctccacccagctatgagcctccaccaactgaaaacccaccaccattatataaacctccattctaccctccaccagtgtaccagcctccatatgagaagccaccaccagtgtaccagcctccatatgagaagccaccaccagtgtaccagcctccatatgagaagccaccaccagtgtaccaaccaccctatgagaagccaccaccagtgtaccaaccaccaaatgagaagccgccaccagagtaccaaccaccaaatgagaaaccgccaccagagtacgaaccaccccatgaaaaaccaccaccagagtacgaaccaccccatgaaaaaccaccaccagagtacgaaccaccccatgagaagcctccaccagagtaccagtgcactgccacgagaagcctccaccaga

SEQ ID NO: 54781 - DNA, 240 bp, Glycine max
  Peptide Sequence Number=SeqID_171559
atgacatttgaggcagcaaaggaaattgctgagaagattgattcattggaggagcaggcgtcacaaggttcctttgtcccccatggatgtcaggatctcctgactgttgccattgggcgaccagaacaccctagctgtgtgcgtgctattggagctagtgtgaccataaagcaatactttggatcggctccacgaacctcccacattcctccatggctcccgaagaactcgagcagctga

SEQ ID NO: 54782 - DNA, 369 bp, Glycine max
  Peptide Sequence Number=SeqID_171560
atggctactccacttggctcgcctcctcctcctcctcctcctcctcctcctcctacaagaacagtggtccatgtcgatcttgcgatcgggaaggccgacggtccccacaagaagaaattaagaacatatttgggaattgtcgctcgtcataaggtcaatgtgacataccagacttcgaagcaagtacctgctgctcaaaaggatttgatatgggaggatattcaaactgaatttgatatccctgaagcaactaacagtaggacaaagaagaaaatacttcagactgtcaaggagcggtggagacaatttaaatctgatttgaggaggaaatgggcacttgcagccgacaatgatagcaaggagaaatag

SEQ ID NO: 54783 - DNA, 387 bp, Glycine max
  Peptide Sequence Number=SeqID_171561
atggaaaaatccgacaagatgaatttcaaagagaagaaagaaaagaaaggatatatcacttgggaagataatgtcttaaattattcaagtgattcagagaagaaaatcataagtttgggtatcatgatgaaagactatgaaaatggggaaaagcaaagtcgatacattgatagcaatttctccaaacacatggcatgcatcaaagtttattcatatttctccccaagaaaagtgaatatgcgatttatggagacaacaaacaaaggccacttgatcaacaacctcaacaattattggaagttgaagttaaaaatggaagttggaagttggaagtggaagttactggaagtggagttggaaatgaagttattggaagttgaaagttga

SEQ ID NO: 54784 - DNA, 804 bp, Glycine max
  Peptide Sequence Number=SeqID_171562
atgacctcgtgctggaaattcaataatttagagagagatttagggatcgaggttagatcaattttggcgcctattggacaagggagttcacaggtttcaggctcatctcaattatcatcaaaagatgtgtttctgtcaaagactgaagtaaaaaatatctctgagattaatgccagttcagaggagtttgttcgtgttactgtcgccaagattacaaccatagtgatggacaactattcatggtgctatccggcttgtggtcaatgttataaaaaagctgacatgcaaactgtgccattcacatgtctgtatggcaaagagaatgatcaacctgtactgaggtatcgggttgaggtgatggttagtcacaagggtgaacaaaccaaatttttgatctgggatcgtgaatatgcacagttaattggtcagtcagtggatgaagtcaacaggctcaaaatagaagatggagatgttgatttaaatgcctctcctcaagcactagatagactattgggttgtttccttgcattcaaagtgaaggtgcaaccaaggttcaggaattttgttgttcttaaatattcagatgaattagagttgatcaatgttgtgctagatatgattcccgatagtgagcaatctctgtctattacagctgatcatgatcggtcaatgcttgcctcaagtgagcctacagagtttgaatctaattttgcttatcggtcaattaatattttatccagcaatctgtgtctgttacctggggatcatgaccctcttcctcgggattccactgacaccaactaa

SEQ ID NO: 54785 - DNA, 336 bp, Glycine max
  Peptide Sequence Number=SeqID_171563
tgtttatactcacctttattatcattcaagtcaatctcgccatgggataaaaagtatagggatcgatcatactgtagatcaccttatgcatcaagaagccgcaacagaatccacacacctccactgttgggatttgcaaagaattgtctgtggagggagaaatatgcatcgcacgaagcattacaaaatggaggcttcaatcccttctctttctctctaacgtttgggaactctatcagagcaatcagaggaaaaattgaggaatctcagaaaattgctagagatgccgctatcgctgtcggaagacacgtgatcccgcttagaggtaagggatga

SEQ ID NO: 54786 - DNA, 663 bp, Glycine max
  Peptide Sequence Number=SeqID_171564
atggcacacgatcaagggtgggaacaggagttaagtcctaacaatcaatatgaagaagaaagaactcctaatcttgaaagtgtgtttgaagaattcatgtcaaaccatgctagcgcaaaagctaatcaaaattcaatgaaaaatcatgaaattcatttttgtaagaactactcaatagaaaactttcaagggggacacgagttacaaccttactatcaaaatgaagcagaaagaggttccaatctggataaactgttgatgcaattcatggaaacaactaaatcaactcaacaagcactccaaagtgtagaaatccaggttgaagctcaagagaaaagccctgtaaaagagcatgagtcaagagaaaaaaatgaggagaaagatgaggaacaagcacaacaacaatgggagaagtattcaatagtagaaaaccaacaagaaaatattctccaaagcaataaccttcctcgtcaactgattgacaagaaaggaaggcaaggagagcatgaggaaaccttaagtaccattctttctttaataactaacacctttcttgaaataatttggaatttcattccagattatatgaagttcatgaaatttctagctaaaaggagaaacttcaaggaagatgtgttctttgtgactttcatgccaccttga

SEQ ID NO: 54787 - DNA, 264 bp, Glycine max
  Peptide Sequence Number=SeqID_171565
atggactccttgaagcaaagttggtacattgatagcgattgctccaaacacatggcaggagatgcatcaaagtttatttatatttctcccaaagatagtgaatatatgacttatggagacaacaacaaaggttttgatgatgataaaaagaattcacttgataatgattgtcatcatcaaaaagggggagaatgtcaagcaaacaacatcaagaaaaagataaggcctcaaacaatctcattggttgattggtttttgccttaa

SEQ ID NO: 54788 - DNA, 378 bp, Glycine max
  Peptide Sequence Number=SeqID_171566
atgtcggtgcgtgtaggcgtatatcctagcccgaaccttctacgattctctttgaactccaccaagcttgccatgtcgtcgtcgttccgacctaaaccccttctgggcttgtacccaagcctcaacattacacgggctaccatcaatgcagcactggatgaacggggttacactgggggagactcaatgtcgcaacctacccttcagcgggagggcgacgcgagactcacgggtgcatcttccaaggaaggaaaacacgcggagttgccaccaacgtttattcgaggaaaacgtcggaaaaaaccagaaaaggcgtggtctacgaactttaagtgtcaaaggttcgggagttgtatttatgcacggggaaggtactag

SEQ ID NO: 54789 - DNA, 903 bp, Glycine max
  Peptide Sequence Number=SeqID_171567
cacgtcctcgccatcagagggctgcatgccttcacctttagaggactacacgtcctcgccatcagagggctgcacgccctcaccttcagattactacacgtcctcgccataagagggctgtacgctctcaccttcagaggactacacgtcctcgccatcagagggcagcacgccctcaccttcagaggactacacgtcctcgccatcagaggactacacatcctcgccatcagagggctgcacaccctcaccattggagggctagacgccctcgccttcagaggactacacgtcctcacctttagagggctacacgccctcgcctttagaggcctacacgtccttgccttcagagggctgcacgccctcgacttaagagggctacacacccttgcctttagaggactacacgtcctcctctttagaggactagacgtcctcacctttagaaggctacacgccctccccttgagagaactacatgtcctcgctttcggaggcctgcacgccgtccccttcagagacctgcacgctgtcgtcttcaaagggagacacgtcctcgacttcgaagggctgcacgcctcctcgcatttagagggctacgggggtcgcgcccacaagacacccagtggacccggagaagtccaacagggccctagggtttccagctctggttacgggcctctggatcacgcccgcaagtcacccagtggacccggagaagtccaacagggtcttcaggtttccagctctgattacgggcctctggatcgtgcccgcaagacacccaatggactcggagaagtccaacagggtcttggggtttccagctctgattacgggcctctgtcagttctacggagtgcctgtcacccccagcaaggtcatcaggccccttactaa

SEQ ID NO: 54790 - DNA, 915 bp, Glycine max
  Peptide Sequence Number=SeqID_171568
atggggtggtcggaataccgaggaagcacttggaggagaaagcgaaagctttggcggatcaagggatttgtagatctagcggcgatcgatgccttccttgcttaccaccatagcaaagaaagcccggttgttgctgtgttagccaacgcctacgacacatttgaccgaagatgcgagaagagcggtgcaaggattgtatgttgcacgcccgctctttatgtatggctggcctcacacctctttcgtcatgaaagtagactcgtctatcccctgcaaggtcaccgcatgtgcgccgagaaatggaaggcaatttgggagcagctcttggctagtatggtaggggcatccattaattggttcccccaatggaaggaaggaagagttggggttttgtccttatatgaggggttctcaaacatccccttgatgggagcgaggggttgtatcaattataatcccgtccttgccataagacaacttggctaccctatgagaggagcgttgtcggaagaaagtaccacgcccttcatcgcacggggtttcggtgaccccaatgcaaggatatttcaaagggtccaaaaggcatggagtgcagtgcaaatgaaagataaggagcttaggggaagcagcaatggtatcatcggtggctatcataagtggttgagggctcagatgcaagagttagattggctcccgaagctaaagacctcaagtgaggaagaggctgaaacccctgaggagagcgaggaggtggaagccctaaaagtggaacttgatagggcacaagcagtcaaggaaaagttcaaaatgacagccatcaaggtctggaaagagtgcgacgaactgaaagacataaatgtggccaacgccgaagcattggaacgggaaaccaagagggcccggaaggaagaataa

SEQ ID NO: 54791 - DNA, 450 bp, Glycine max
  Peptide Sequence Number=SeqID_171569
atgagcaagatagaggaagttcaggaacagttgaaggctgacatggatgccatgaaagaacaaacgactaccatgatggagaccattatgagcatgaggaaaatgatggaggtcaacacggatgcagttgccgctacaagtgctgccattgaggtagacgcgactaacccatctggtgtgaatcaaagcaagcatccattcccaccgtatggcttgcctcccaattatacaccacccaatgttgcacatgtgcccaatgagaacatcgaccactccactcctatacccttgagagccaataacctcagtctgggcatgcacatgctgcttaacccatgggggagacacatgaagtaccccgagaccacatgctggccgacttcgagccttaccccggatatgccgccgaggggaaagcatttggtggcataccccagccaaacaccttag

SEQ ID NO: 54792 - DNA, 278 bp, Glycine max
  Peptide Sequence Number=SeqID_171570
atgatggaaaggaaaaattttgatcacctagaagaaaggctaagggccattgaaggatggggagactacccttttgtcgacatggcggaactgtgcctagtacccgacatcatcattccttcgaagttcaaggtgccggactttaacaaatacaaggggactacttgccccaagaaccacctgaagatgtactgccgaaagatgggggcgtacgcgaaggatgagaagctcttgatgcatttttttcaagagagtttgaccggggcagctatcacttg

SEQ ID NO: 54793 - DNA, 318 bp, Glycine max
  Peptide Sequence Number=SeqID_171571
atgcatttttataccattaatcactttccagcatatgggaatttgagcgggtacaatgttaagggacatcgtgcatgccccatccgtgaagaagacataagctacatacaactgaaatatgagaaaaatgtctgtaatagtgtcattgggacgctccttaacattcaaggcaagacgaaagatggtttgaatacttgtcaagatctagctaagatgggtattgagcccagttacatccaaggtcttatgaaaggagatgagtttttgtcagagtttgcgccatgtcaaagtcccacaagaatactgttcaaatattaa

SEQ ID NO: 54794 - DNA, 198 bp, Glycine max
  Peptide Sequence Number=SeqID_171572
atgtctcagaacttcacaaatttcctaacgatgggtgccaaatacctcgaagtggtcaaacgagggtcgcatcccaacagcggatggtccccggacgaaattaggagcctgggcggcgagacacagaatgaccataatttgtctctgcgtgccaccggacacgatcgcctttggatggcgaaaaggtgcacggaatga

SEQ ID NO: 54795 - DNA, 327 bp, Glycine max
  Peptide Sequence Number=SeqID_171573
atggggacaaatcaaactggcaaaaggttttatcaagtcaagattaagggcctagatatcaccaacattaaggaattggggtggttgatgggacctctccaaatgcaagccttccgcaaggcgtacggaaagatcttagattttaccatagcagagatatccacagaagccattgcatcactcgcccaatactatgaccagcctttgagatgcttcacgtttggagacttccaattagtaccgaccgttgaagaatttgaggagattctaggatgtccttttgggggaagtaaccgtatcttttctccgggttccttccctccttga

SEQ ID NO: 54796 - DNA, 766 bp, Glycine max
  Peptide Sequence Number=SeqID_171574
cgcagttaagacggatctcaatggaaaagtcattactaatgacgatgataaagagattcctgacgctgttaacacattaatttttacaatagcccaacatttcattggagacccatccttgtggaaagataggtctgcagaattattgtcaaatcttaagtgtagaaccttagcggattttaggtggtatagagatactttcctaactagggtttacacaagagaagatagtcaacaacctttttggaaagaaaaatttctagctggtcttcccagatcattaggagacaaggttagagataaaatccgtagtcaatctgtcaatggagatattccatatgaaagtttaagctatggtcaactaatttcttacgtccaaaaggtagccttaaaaatttgtcaggatgacaaaattcagaggcaattagccaaagaaaaggctcaaacaaagagagatttagctggtaaaatgttgcaacggttggagctagggtttgcaattagttaccctttggctatggcattggacaaaatgcaggataagtgccttcagaggtataccctgcattcattgggtttgatgataggatcaaagcttctatggaaaagcttggtgtccctttcatttgtgacattggcattcactaggttaattactctataccatgcattcattgggtctgaaataccaaaaatcccaactcaatgttcagaagtgccttctttatgtcatcaaataccaatggaaggaatggaagaggtttaa

SEQ ID NO: 54797 - DNA, 393 bp, Glycine max
  Peptide Sequence Number=SeqID_171575
atgcagagttcaaaacgtgatgtctaccttgaagcctacctgaatgggctagacaactaccttaagggaataattaacagtgctttgaaagaacttaatgatactccacagcctaaatccaaggctggtgctaggtggattgttcttaacattaaacacaagtacattcatcatctaaagctgtccaaaatatgggagttttgcaaaatacatagtgacatccagagcaaagaacctccgctagtcgctatccctccaggaccgctctcctccgtagagtctgcctcagatgccgacatgacgtcctcgagagatccacctcagggagtgggtcctcatcaccctctagaaagtcaagagcctccacagcaggctcaggaggtagctcctctg

SEQ ID NO: 54798 - DNA, 231 bp, Glycine max
  Peptide Sequence Number=SeqID_171576
atggataggtcggcccttgttttgttgggtttaagtcttttaccggaccggatagaccaacttccctactataaagaccacactgccgatccacattggcagactgatcttttactggttactggagcatgcggcatagaactaagacgggaacaaagagagaagggcgcaagaaaatcacctccaacagacaagagattcggcactagtccagctacaatcacttcctaa

SEQ ID NO: 54799 - DNA, 438 bp, Glycine max
  Peptide Sequence Number=SeqID_171577
atgtggttcatagtactttatgatcatgtattcagtattggttttcttcttacttccaaaaacttattcagagctgtcaatctggtcggcttaaggtttactggttgctatcggtcacatgcttacaatcatttgaagaagcatgtgagatgtcttaagcatatccaccattggattagccataccacgatgcctgaaaaaacattaggttgtcaggtgggtaatttggtggccactaactcagaaggtgagacctctgagacaataccatgtgatcctttctccctcaatagaccccatcatggcccactgtgcaattggattgcagaggtcctagacattatatatacacaatttcttgggtttccaggcaacacaagtcatcccattcctgaagtatcagaactcaaaaatttcttccgcattcgacttctttga

SEQ ID NO: 54800 - DNA, 315 bp, Glycine max
  Peptide Sequence Number=SeqID_171578
atgttggacccaatgttggctgcctggtactggaagtcaattcaggaggaggctatcctcaagtttgctaaggcctttgaccacatagcgttcatgggtgcccaaagtgtttttttctctcgatttctcaatatcatcctccctgaggtggtttcatatatcaagtttaagagtaagcatggtgttgacgatccttacggggtggttgttgttgcaaagtcatcatgcaagactttggctaaagagaaggaggctctagaaagacagcttcgtgataagaaaatcgttgttaataggacttctaaggcaacttga

SEQ ID NO: 54801 - DNA, 555 bp, Glycine max
  Peptide Sequence Number=SeqID_171579
atgtcggatacaatgtccaggacatcctgcccgaaaatactggagttgctaaaagcattgaagctgcaggatccacgatgtcggatacgatgtccaggacatctggcccgaaaatactggacatataaatctgttatatctttaacagattattgtgcaattttcaggaagaaagatagatctcatccagcacaagaagttgcagcccagatacgctcactgctatataaacacgaaggctgcacgagttctgtaccaagtccgggattgaagagttattttattctgatagtgatagttcctcagcctctgggtctgatgcagggtcaccaaaaacctgaattctttttgttagtatgctctgtcacacattcttttattgaagagaagtcagctggtgcaaatgtgaattctctgagaggttttgaagtaattgatgacatcaaaactaaagtggaggctgcttgtcccggagttgtttcttgtgtagatattttagctattgcagcctgtgattccgttgttgcaataagtttaataaatatgaacaaataa

SEQ ID NO: 54802 - DNA, 429 bp, Glycine max
  Peptide Sequence Number=SeqID_171580
atgtgctatgcacaactacagctgaacaaggaaaataatggtcaaaaggcaagtgtagataagggaaagctcattgctaagtcagcatcaatgcctaatctgatagaactagtagatggaggcttagcatttcctcactattgtcttactgggaatcaatttctgagattatgtgcaggagcaatacctgggacacgtgactatgataaccagcactataaagaccttcatctcttgcctccaccgcttaataaactagtgggacagcccaatacttcagcccaagaccaaatcactgctcacaacaagaggaaatttcagcaccaagacaaaacatgcatccttagcttaatgggtctgttgtggctaaacaaaaaatatacaaagttcattcaaacctccaggcttctaatctactcgtggtattga

SEQ ID NO: 54803 - DNA, 207 bp, Glycine max
  Peptide Sequence Number=SeqID_171581
atgaggaattggagtcacaaagcaaagggatataaagagttgttagatttattagcaaagcataaggctgaccttcatggtttcaagttggatgtatttccaaatggagaggatgctaatcaagttcagagtgcaggcaaaaggttggatttgaatctcaactttcagaaaggaagagatcatgcagttgattctcttcatgggtag

SEQ ID NO: 54804 - DNA, 195 bp, Glycine max
  Peptide Sequence Number=SeqID_171582
atggcaagaggaagaaggcaaacatctggtgactggaaagacaaccgtgtgcactgctctagcagaagccacccagctccgccacatcaatgtcgatatattgagcttagaattggagattatgtcagggttcctttcattggtatcaaagctgtccttaccccttttccttcttcattcttcttattaccatag

SEQ ID NO: 54805 - DNA, 891 bp, Glycine max
  Peptide Sequence Number=SeqID_171583
atgatcaaacctggaaaagggacgagcagtgaacagagatgtgcgaccggaagaaagggtttcttggaagcacatgcactgtttttctggttctgctacaccgctaaacacagagaaaggcacagcacgatgacgatgaagataatggtagcgattaagcgagtggtggactacgccgtgaaaatcagggtgaagggcgacaagacaggggtggtgacccataacgtgaaaatgtcgatgaaccccttctgcgagatcgcgctggaagaggccctccgcatcagggagtctggcttggcctccgaggttgtcgccgtcaccatgggaccctctcaatctgtagacactctccgaaccggtcttgccatgggagccgacagaggcatccatgtcgagtcaactgcttctctctaccctctctctgttgccaagattttgagaaaactcgtcgagattgagaaacccggtcttctcatccttggcaaacaggccattgatgacgattgcaatcaaacaggccagatgatagcaggactcctcaactggcctcaaggcacttttgcttctaaggtggtccttgacaaagagaaacaggttgccacagttgacagagaggttgacgatggtattgaaaccgtgtgtctaaacttaccagcagtaataaccaccgatctgagactgaaccaaccaaggtatgctactcttcccaacataatgaaagcaaagtcgaaacccataaaaaaattcactccggaggagttgaatgtagaaatcaaatctgatttggagatagttcaagtcacagaacctcccaagagaaaagcaggggttattctttcttctgtggatgagctgattgacaaactaaaacatgaagctaatgtcatctaa

SEQ ID NO: 54806 - DNA, 219 bp, Glycine max
  Peptide Sequence Number=SeqID_171584
atgcctgagctcatgatcttgggaggtatatcgggtgtgcatataatttcatcggtggtgaagttcagggattatcttaatgccttttcgagattaatcaaagaccaaaaagatttcaagccatacctgctcatggtcttagtccaggttggcttaagcatcttatatctgatcactaaagcctccttcaatcacgggatgagcccttgtaaaagctag

SEQ ID NO: 54807 - DNA, 798 bp, Glycine max
  Peptide Sequence Number=SeqID_171585
atggaacagaaaagatgttcttttgtgactaaatgcagagatttcaagccacacctgctcatggtcttagtccagtttggctatagcttcttatatctcatcactaatgcctccttcgatcatgggatgaacccttttgtgtatgtaacctatcggcatattctggctgcggttttgatgttcccttttgcatactttctggagagaaatgcaagaccaaagctgacattttctcttttcatggaaatctttgtgctttctctgttaggggttagtttaactattaatatgcactttgcaagcctgaaatacactaatccaaccttcattgttgcaatgctcaacaccatacctacccttactttcgtcattgctgtggcattcaggtttgagcttctcgatcttagaaattctcgaggaatagcaaaagttttagggaccttgatctccctagctggtgctttgatcattgcactatacaaaggaaaccttatgagaaatttgtggcgtccactaattcatattccaggaaaatctgctgctatcaatgagagctggttaaaaggttcacttcttacagttttgagctgtgttacatggtctatatgtgtgattggggaaattcaggcagccactttgaaacgataccctgcccaattatcactcgtgacgtggatgagctttgttggagcagcacaatcagctgttttcacagttatagtagaacacaaccgttcagcatggactatagggctcaacattgatttgtggtctacaatatatggtgttaagtattaa

SEQ ID NO: 54808 - DNA, 315 bp, Glycine max
  Peptide Sequence Number=SeqID_171586
atggcattctggaactatggttggacacttgtggatgctgataataatcaagcatcttcatgttgcgccactcgatctctcaagactcttgatctctttccactgacaactaccataatcaatgaagattgcaccacaccacccaagactcttgatctctttccactcataactaccagaatcaatgaagattgcaccacaccacccaacctattgcttaaggagattaatctctatataggaaaccatgctagaatgttccaattaccaagattactaagtcttgtacgtgggacctatggttgcaccatgtga

SEQ ID NO: 54809 - DNA, 234 bp, Glycine max
  Peptide Sequence Number=SeqID_171587
atgggcacaaagggggacagaggaaggtttatggtgtgcatagaattgagtgctaatacccgaaagatcactacatgcacattatattttggagggcatgaagaaacaaaaaactttcaagagaagagaagagaagagaaggctaggcgtgcccgacaccaacccctccctctccttattgtggctcgacttttcaagttctctcccaacatagattctctttgcagtgcctaa

SEQ ID NO: 54810 - DNA, 756 bp, Glycine max
  Peptide Sequence Number=SeqID_171588
atggcggcaaccagtgacgaagaaatggagtcactactctccgcgttcgatcagatctacgaggatgcgaagagcggcatttcggagatgcagttgctgcaatccaactacaacgcagagtttaagatgcgtgaatcgctccaaatctctagcaacgccctcaaaagagaaaatgacagtttgacaaaactgtactcggagtccttgaagaatcttgcggatcagcttgactatcgtacaaaatgcctgaatttgaaagaagaattggaaagagcgaacaatgaagttttgcttaaagaacacggacataggaaggatgtggaattgcttaagcgagaatatgaacaaaaaattgtgtgtttagaagctcaagttaaggaatctgtacacgagaaagcaacatatgaagcaaccgtaaaccaactccatggagatttagcagcacataaaagtcatatgcaggttctagcaatgaggttggaccaaatccatgatgaagttgaattaaaatataattctgaggttcaggacttgagggtatgtcttgcggttgagcaggaagagaaaaatgatttgaacagaaaaatccaaaatctggaaaaggaattgttgatttgtaaagcaaaattggttgaccagcagcaggaaatgacctcaaattggcatgtggaaacacttaagcagaaaatcatgaaactgaggaaggaaaacgaggtcctgaaaagaaagttctctcactcgcaagagagtaagtaa

SEQ ID NO: 54811 - DNA, 348 bp, Glycine max
  Peptide Sequence Number=SeqID_171589
atggcaactgaggagttgacggcagagaggctggcgaagggatcgacagaaattggccccgatcaagcgcaagaggaacaaagtatcaagccttttgttcaatggcatctggttaatgataaagatgttctgaggagggaagcaatctcttacttcaagaagcttttccaggagaattgccagggtgatccttcttgcgtggaaggggataacattcccagaattgagcaaggtccttttgaggatctattgaagcctgttagttttgatgaagtgaaggttgctttgttctctatgagtccttgtacagcccttggtcctgatggcttccaacctatttttcactga

SEQ ID NO: 54812 - DNA, 246 bp, Glycine max
  Peptide Sequence Number=SeqID_171590
atgaaaacgaatcaacaacaaacagtactacaacaaaatcacaccgaaagagataaacgaatgaagaagttccagaaaagcagaatcttgaattaccaaaaagctgtaaagttaaagaaactgggagtggtagccatggaagcaattgatccagcagcaaaaacgaactgtgatatccttagagccaaaccaaggacagtgcccggtgtccctgggaaatccttcatctttctctccaaatcttag

SEQ ID NO: 54813 - DNA, 1065 bp, Glycine max
  Peptide Sequence Number=SeqID_171591
atggcacagaaaaaagcttctcatgtgcttgtatgcaaagagttaaagccacacctgctaatggtcttagtccaggtgggctatacctttttgtatttcatcactgaagcctccttcaatcatggtatgagcccttatgtgtatgtaacctatcgccatattgtggctgcggttgtgatgttcccttttgcatactttttggagagaaatgcaagaccgaagctgacatttgctcttttcatggaaatttttgtgctttctctgttaggggttagtgtgactcttaatatgtactttgcaagcctaaaatacacaaatccgacctttgttgcttccatgatcaacaccatagcttcccttaccttcatcattgcagtggcactcaggtttgaggttcttgatcttcgaaatcctcggggtatagcaaaagttattgggaccattatctccttagctggtgttttgatcatgacactgtacaaaggacccgttatgagaaatttatggcatccactaatccatattccagggaaaagtgctgctataaatgaagactggttaaagggttcaattcttacagtttcaagttgtgttacatggtctttatggtacattatgcaggcatccactttgaaaagataccctgcccaactctcactcaccacgtggatgagctttgttggagcagcacaatctgctgctttcacagttatagtagaacacaactcttcagcatggactatagggctaaacgttgacttgtggtccacaatatatggtggagttgttgttgctggtttgataatctacattcaactatggtgcactgagaaaaaagggccagtttttgtcacagtgtttaatcctctttctacgatattagtggcaattctagcctactttgtctttggagagaaactttatttgggcagcatcataggtgcaataattgtcataattggtctgtactttctgttgtggggcaaagaaggtgaccaagaggtttatatgaagaccaaagataaatcccagtgcagtactgtagacccagaatgcagaatatag

SEQ ID NO: 54814 - DNA, 150 bp, Glycine max
  Peptide Sequence Number=SeqID_171592
atggcaactgctagtggttacattaatgcacgcaactgttgttacagaaataggggacaagggctggccgtttacgtgtttgactttcaagctggcaacatcacaggtcaatgtggacaaggaacctcaccagacggtaacataggatga

SEQ ID NO: 54815 - DNA, 252 bp, Glycine max
  Peptide Sequence Number=SeqID_171593
atgcacgggggaaccgccagtcaaactggcgagttcgtggcaggggaggcacagcctaccttacaggctacgtgtgcaggctacgtgctgcaggagagagaggcttggcgcagagggaagaactcgccattggtgcaggcgagttgcagctttggtgaagttttgaatcttatttgcattatcctacactacactatgtattcttcatacgtgctttggattgctattcttaatacgcgcttccgatgttga

SEQ ID NO: 54816 - DNA, 278 bp, Glycine max
  Peptide Sequence Number=SeqID_171594
atgggttggtggatctagtgacaatcgatgcctttcttgctgatcaccacagcaaggaaagctcggtcatccctgtttgggcggatgcatatgatacattcaacttgagatgtgagaagagcagtgcaagaattgtctattgtacgcctgctctttatgtatggttggcgagggcttcgaagaagctttttgctaaaatggctaggaaggccaccgcaggggagggatctagttcagccccacaagcggaaattgagtttgatggacactatttctga

SEQ ID NO: 54817 - DNA, 468 bp, Glycine max
  Peptide Sequence Number=SeqID_171595
atggcgatgagcgttgcaaggctgaagaaggatgagatccagaggctaaagaaggagatcgattcggtctggcgtccggcgatggagctgcatgagttagagacaagtgcggtgctgaagaacctcctcgaagatagagaaagaatgcctgctttgctcgtctttttcgatgggaccgccttcaacaacatcgtcgaggagttcaagaatttcaccacccacatcgctcacgttctccccgttttcgacgatggaggaagcactgctaagattgtggtttgccctagagattggagaaacttaatagtattgggtgacaatggattttttctttgttacatttatcaaggtggtaacactatattttttgaggtagcagtggatggaactcttgcaatagtggatggcttaaggtggggaggctcaacaacgatggatggacctaagctcattctaaaattattatag

SEQ ID NO: 54818 - DNA, 1299 bp, Glycine max
  Peptide Sequence Number=SeqID_171596
atgcaaattgaagtgatgattagtttcgtggtggtgccatcacatgtggcaacagaggttatcattgagaagaagaatgccacggatggtggtgttcatggatgtagggttgttgggtcggagccaatgatgagtgagtggagatcaaagaagaagggtggtgagagagaaggaaaatgtccaatggaggatctctcctctaagggtggtggaagtcgtaggggcatggcatggtttgtctcttcttgtgcactttatttaatacatttccaagtgagtgctccacgtgcttctggagtaggaggaggaagggtaggtggtgcatgcgacaacgaaattagcgacggaatgcaatgcatgaaccaccctcacaacaacagcaacaacaatcccggtgggatttgcgccttctgtctccaagataaactccgcaaccttctctcttcttcacctcctctttcttcctcgtcttctccttccccttctttcactcctccacctcctccctctgttaaaaccgaccacgaccacaacacgcgctctcgcctccccttcctcgtacccaagaaaaacaacaacaaaaaaccctcctcctacaccaacatttcttcatcagctaatatcattttcaaacgcagcaagtccactgccacacccaaaaggaaccagtttctcgaggagaaggacttcagtcccagaaaaagaaacggtttttggtctttcctctatccttcttcttcaaaggaagctaagagctttggtccaaatggtaagtacagaggcaagtgcttgggaaaaaagagtgatcacgtgattattgtggaagaggacaagtgtttgagctcttcttcttcttcttcttctaaggtttcgagatctagatctgttgggtgtggtagcagaagcttctccagtgatttcttcgagaggatctcttctggcctcggcgactgcactctacggagagtggagtctcagcgtgaaggaggaaaacctaagctagctgcttctgctaatactatgaaccattgcatgaaggaaagagtgagatgtggaggaatattcagtggcttcgttatgaattcgtcttcatcaacaacgtcttcttcgtcttgggtttcttcttctgttgatgatggcagaggaaggagttggggttgggcgtttgctagtcctatgagagctttcaccaccaaagggtctcctccttcttcttcttcgaagagagatgcttctgataagaacaacgccacgcctaacttatcagccattcctaccttgctcactgttagaggctga

SEQ ID NO: 54819 - DNA, 276 bp, Glycine max
  Peptide Sequence Number=SeqID_171597
atgtttaggattttagatgccaacccctggagagagacttcgaagcccgtgtatgtactcacacagaaggaaaatcaattgtgcacaatgaaaacccgcagaaatagaagtgaagttgaaagagagcttggattgttgttttctaaaggcagcaagtggagttctggaattggaaatcagtccaaacaagtaaggggagggacgactaataagtttcaaatgcttgtggaagatgttagagaaggagtgctgtgcaaactaggatgcaaactataa

SEQ ID NO: 54820 - DNA, 345 bp, Glycine max
  Peptide Sequence Number=SeqID_171598
atggatgagttcgatgtgcaggtggcttggctgggagcccagccttctcattctggagggggtgggacctccgcagcccaggagcctactcttgaggagccaccagcagagggggaggatgagctcacccctcctgagcccttttattttgatgtagatgcacacatggctcaggaggaagggacttccacagatcagatacttgagccatctcttgcacctgttcttgaggagacccagccatctacaccagttacggagccagagcagcctatccatgattcatcagtagctctagcattggatcttaatgaagatcagccacaggatgagcatggcatttaa

SEQ ID NO: 54821 - DNA, 225 bp, Glycine max
  Peptide Sequence Number=SeqID_171599
atgaaagtcaaacacatgcgttatacgaccattactctagactcaagcctacatgcaatgtggtaccatttttcagtgaaaaacctcgtcgggtgcctaggagtacatgacaggacatgcctcacaatgggcttacaggagcactcaaactggatgacccccaaggcctacactccgaaaagtccgtcagggcctctccctcttgattcagtgcgcctcaagtga

SEQ ID NO: 54822 - DNA, 582 bp, Glycine max
  Peptide Sequence Number=SeqID_171600
gtggatcctgaagtggacttcttcccaacttgggtgattgataacattcttactatcccaattaagcagtttgattatcatgatgtgctagtttggagattcactgtagatggagtttactctgggaagtcaagttatcaacttgcattgaataaagaagaaaatgctgcaaagggttccagcgaagggtgcggagatggttggaagatttggtcatcgaatgctattccccattctatcattgagagggttccaaattctctgcctttgcctcctcgaaccctacagattcagagtcgtacaagaacaggttttggggtcatctttagggatgaaaatgtgtatgtattagtgcctgttgctaaattcatgaaagaggagtttgacgtgcatctcaccgtggtgtctgccatcatcgtcattggtgtccgccagctgaccgtggggtccgccatcatcgtcattgttcgtggcaaagtgcaaccctacgtcttatctcctggggctaccattgtgcttacattggggaaggagttgaaagaagctgatagagcttcttgctccaagttccttcacctttaa

SEQ ID NO: 54823 - DNA, 603 bp, Glycine max
  Peptide Sequence Number=SeqID_171601
atgaatgctcagatgcatcaatttgatgggttggcaaggggtagggggattgaagtagaatgttggatggtggtatgcatggcatgctgtggtcaaagctatttggattgccagaaatggtgtggaggttgtggtgtgttgtttgttgttgctgcagagagtgctttttcggctattatagaggttgtggtgtacgaacttcaccgtttgtatcggattcaaaacatattgatgaaaaatatggaagccactagaggtgcgcaacaaaatcctaagttgaactttgatcttgaaagacctgctaaggaggacatggcagaagctgacagcgatggagttctagatgttataaatgagactgagattgagctgacactacgccctttaagttacaaacgtaaaaaagtggagacaccactaacttcagatttggcacatagcttgtctttttcttctactggatctagccttataaacaagacaagattgaagacccgtcatagcagttattcagctgcagaagaattaagtggaggcttaattggccttgtccatgtgcgacatttgaccgcagggtgccaaagtggaattagaagtagttaa

SEQ ID NO: 54824 - DNA, 1182 bp, Glycine max
  Peptide Sequence Number=SeqID_171602
atgagtgaagacgcgaaaaagaacattgccggagctctaacggcgaggcccaactccgatgaccagaaactatcgccgttaccgtcaccggcgccggccgttcctccgaagaaggtcatcatcaagagcgccgacatgatccccgacatgcagaaggaggccgtcgatatcgccgtcgccgttagtttcgacaactttctcctttttttttgtggttcctcgttttggattctgtttctgggtttggttgtgcttgctgcgttgtgtcataaagtcttgaccattttgcggattattcaggcgtttgagaagtacaatgtggagaaagatgttgcggagcagataaagaaggagttcgataagaggcatggccccacttggcattgcatcgttggtcgtaattttggttacaaaaatgatggtgaaaaggggtctgtaagcatccccggggaagggattccagggggagccatggtaagaactaagaagggaggagaggatgaagaggtgaagaggcttgaggttctggttgtgccaatctgcttagagcgtaaggcacttaattggtttcagtggtgggaggtgtggacagagcgcatcgcatggttcatgttcaaacgggcattgatgggagtttggatgattccaaaacacttcattggagaacccacatcaggctcttataagcctttgtcagatctcagaagcaatcaccagaggattataaagagatatcgcccgcaaaggagggttggtcccgtcaacaatagaaccacattgggaaacaagtggataagccccaatgacctgaaagaaatgagcgggactagatcatgcaactgcaggaattcatcatttaagaagacgactgacaaagaattagaggggttgggagatataaaggctagttttaaggttcatgtaataaggattaatgtgaatggagaagaggtagaaataaagggggatccatcattatctagaactgtggcaaaggcaacattaaaggagctgaaaagaggaaatgagtcatactatgtggtgttaggaatgttaacactttatgacttggatttgctaagaacagtggaaggactggagggagtgagttggaggaatatgcagagctttttcaagaagccattgaactacctcctactagaagatgtgatcatgcaatag

SEQ ID NO: 54825 - DNA, 261 bp, Glycine max
  Peptide Sequence Number=SeqID_171603
atggaggcttttcaggttctcaaaaaagccatgactggactgctcacattgagcatgcctaattttagtatgccatttgagatagaaaccaatgcattgggatttggaattggtgcagttctaatgcaacagggaagatccttggttttctctagccaagctgtatcggaaaggatgcaaatgaaatctattgcaaaaatggaggcactatttgttggggggtgggccattttgtcattaatagtgattaaagaagcttaa

SEQ ID NO: 54826 - DNA, 618 bp, Glycine max
  Peptide Sequence Number=SeqID_171604
atggtgtttgtggaaaagatacaacagctcacaaatattccatctgaaccaacatggaatatcaggcatcatcttcctccttcaaattggccagttgaaggcaatgtagatatcaaagacttgcaggttagatatcatctaaacactcctctggttcttaaaggcattagcattagtggaggtgaaaaggttggtgttgttggtcgaactgggagcgaaaagtcaactttaattcaagtattctttaggctggtggaaccttcaagagggaaaataacaattgatggtattgaaatattcgctttggggcttcatgatcttagatcacggggaagaacaaccaagggttatgctaatcgcctttggaatcagaaccctatccttcttgatcatgtactccttcttgagcatgttgatgcgattcttgcattgcacatcagtgtgatggcatggatgacctcttggcaatgcttcaaaccttgtgggagctacgagaacccaagggaatggggacatgaaaaaaaaatcccccatgatgggatttgggaacacgaagggatgatggggatagaagatgcgaagggaaaggtagttggtggatggggagcgagggagtaa

SEQ ID NO: 54827 - DNA, 1752 bp, Glycine max
  Peptide Sequence Number=SeqID_171605
atggatcgtatgaagcttttcaatggaagcaatctgctagacgttgttgacttgatagatagcggtgaaatgcaccatcgagttagaaaagatggagatgcaaagccattcgtagaaggcagacgaggtggtcgtgctttaattattgtcaatgtataccctacgtgtgatcttgtggaaaatatgaggctttgggaggaacttttgagacaaaaaggatcatacaatgacaacatttggtgtatggtgggtgactttaatgttgtaaggagtttggaggaaaggaggggtattgtagggcaaagggtagggtgctcaagggagacggaggaattcaacactttcttagatacaatggagcttggggacatcccaatgattggtagaaagtttacatggtacaaagcgggtgggctagcaaggagtatattggatagaatggttgtcttgtcgagttggcttgacttatggccgtcatcctcacaatttatccttaatagggatatatctggcctttgtcccttggttctaaaacacaaaatcattaattggggccctaaaccttttaaggttctcaatgcacgactcaaggaaagggatttcactaaatttgttcatcaagtttatgtctttggcaacttggatgccttgtgtggtaagttgtctaaggagatcaaggagcttgatattaaaggcaatacgggttcattgtctcttgaagaggaagaacatagaaagaatcttatggaagagttttggaaggtatctaagaggcaggaatcccttctccttcaaaattcttctagagcaagatggctaaaggaaggaggtgacagcacttgttatttccataaagtggtgaaatggaggaggagtaataatattcaaggtattgtaaaagaaaggagatgggttgatgatcccatggtagtgaaggaagtagtgaaggcatttattatggagaggtttaaagagcatggtgacaagagtcccatcccaaatggttataatttctcattcatcaaacacttctgggatttactaaaaggagacattgttgctatgatgcatgactttcactcttgtgggaaacttcctagaggtgttaatgcatctttcattgctttgattcggaaagttgacaacccacaaggccttggggaatataggccaatttcccttataggatgcctcataagggaagcagtgatgaataatctttttgtacttatggaggtgggtgatggttctatgaaagttgttttgttgcaatttacagatgatactttgttttttggtgttacattggtcggaaatgttctcactttgaaaagtatactaaggtactttgagataatggcgggggatgaaagtcaactttttcaagaaggtgtgggagccaatgataaggaagttgaaggggaagcgcaattcatgggtacgcaataccattgtgagcttgcaaagaaattttctttgggggtgggtggagcggaagggaggaagctagcttggccttgtagtttgtgggccaaagtcaacatggccaagtacaaaaaagccaataggactcttgttgagaatgaaaggggatggtttcatagagatgtggctcaaaagttagcggatgaagctgatatcttattttgggaggatgctttgtgcggaaaaggaaggataggtggtgttagcggtttaagtggaggatggggcgatttagttgggaggaggaagttttgggattgttgctag

SEQ ID NO: 54828 - DNA, 231 bp, Glycine max
  Peptide Sequence Number=SeqID_171606
atgggggagaaaactgttgtggtgagtttgacatgcagcaaaaggacagacacaatggtgaaactgtgtgaagtgttcgaatctttgaagctcaagatcatcactgccaacatcacttcgttttcagggaggcttttgaagactgtcttcattgagtgcggaacacccattgcgaatagtattagacttttcagggcattcatgagggctttaactagaaattccgagtaa

SEQ ID NO: 54829 - DNA, 489 bp, Glycine max
  Peptide Sequence Number=SeqID_171607
atggtgggtttgagtgtggtgttagaagcacagaaaggcagtgttagcaagaagactccacaagtgattaacaaaacaacgatgcttagtagttgcagcagcagcagcaacaacaaacactcttcttcttctgctgctgctgcagtgagtagtgtttctctttctcagcactctccttttcaggaagcagcaaagtttctagaccaatgctttctctgcaggaagagactcttgccagggaaagacatctacatgtacaaattaaaggtttgttttttggggtctgttttggaacatgaatgtgcatctgaagaggggacagggctttctgtagcgtggagtgcaggtgcaagcagattttcatggatgaggaagagattgttagtatccagaaagacaagtgttgttcttttacttcttcctcagcaacaaattgacacggtggttttgcacttttgcttatacatgatgaatgaagtgatgacctag

SEQ ID NO: 54830 - DNA, 174 bp, Glycine max
  Peptide Sequence Number=SeqID_171608
atggtggcagaatatgcaaaaggactatgcttgcttgccgcactggccgagaatacttgcatgacagaaattaggtggaccattggctgtgattcaatgatgcttctgacttctgagcctggactttgctttcagtcttttggtacccgtgcgtgtcatgcatggtcagactga

SEQ ID NO: 54831 - DNA, 789 bp, Glycine max
  Peptide Sequence Number=SeqID_171609
atggtgctggtatggcttgtcttgttgatagagagaaaaatagatgcaagagaagctgaaagccatccaaagattaccagaagactcttacagtttaaaccctggggaatagaagagacaactgctgaagattgtgaagtggacttggggttagaggctcatctgagtggagataatgtagaagaacaaaaaatttctttctctgacaagggaattcaacagaggagtgttaaagctgtttgtgaagacagtatggctttggtatcccaagagaagggtggcaaaaaaaaagagaaagacctgcaggcagtggtaccaaaaaatgattctcatgacataagaccaattgagcaggagattgacacgagtgcaggaagtcttgatttttacaagaaacgttcagaaccacaggagactgaggaatgtgaaaatgtccaagttgctgagattggggaaaattttgaacaaaataaggcagacaagcaagaggacttgaatgacaatgaacatgaaagaatgttggttcctgaaatagaaatgtctgataggcacaatgagcaaagcaatgaggttactgagaaacttgaaatttcggattaccctctgcaggcaatgttatttgacatgattcctagccttgccacccaaaaagtcaagcaaccgatgaatcgaagtgttagagaagagaagctaccagaaacctccaatgcagaagcggagcctatgattactaagaaaaagaaagttagctacaaggatgttgctagtgagctgctgaagggctggtaa

SEQ ID NO: 54832 - DNA, 1566 bp, Glycine max
  Peptide Sequence Number=SeqID_171610
atggttgcggaggagaaatcccaaaagacatacccgccaactgctgaggtagtggatgagcttaagagaatgggggacataggagttccaatagcagccatgagccttgtgggatacataaaaaacatggtcttagttgtgtgcatgggaaggttgggaagccttgagctagcaggtggtgctttggccataggcttcaccaacataaccggtttctcagtcctctcaggtttagccatgggaatggaacctctttgcactcaagccttcggttcaagaaacttctctttggtctctctcactctacaaaggacaattatcatgttattggtagcttcactacccatttctctcttgtggctcaagctcgagccactcatgttatggcttcaccaaaaccctgagataaccaaagtggcaagtgtttattgcttcttctcaatccctgacctaattgctaacagcctccttcacccgattcgaatctatttacgtagcaaagggacaacttggcctctattgtggtgcactttgctttccattctcatacacatccccattgtggctttttttaccttcaaacttcatcttggtgtgcccgggattgctatgtcagcttttgttgccaacttcaacaccctttttttcctcctatcatacatgctctacatgcgtgtctcaaagggatcactttccatgcctttactattatcgtcaacctgccaactgccatcaccatcaccacaacaacaacaacaacaacatcatcatcaagaccaaacctcattaaaaacaacaacgctaggaaaagagtggggcatgctaattaggttttccattcagagttgcttaggggtgtgcttggagtggtggtggtacgagttcatgacgattctcgcgggctacctgcataacccgcgagttgctttagccactgctggcatagtgatacaaacaacatctctcatgtacactttaccaacggcactgagtgcttcagtgtcaactagggttgggaacgagcttggggcaggtcaacctgagagggcaaggttgtcaacaattgtggcaataggaatgtcacttgcaagttcaatattagggttgttgtggaccacaatagggagaaatagatgggggagggtgttcacaagtgatagtgaggtgttggaactaaccatgagtgtgttgcccataattggggtttgtgagttagcaaattgccctcaaaccacaagctgtggaatccttagagggagtgctaggcctggtgttggggcagggataaatttctactcattttaccttgtgggggcaccagtggccatagtgatggcatttgtttggaaactagggttggtggggctttgctatggcttattggcagcacagatagcatgcgcggtctctattctagttgtggtatacaacacagattgggaaagggagtctttgaaggcaaaaagcttggtgggaatttataagagttcatgtgatgatcaacatcatggagaccaaacagtcaaatgtgaagaaggtgttgtctttctcaatgagaaagaatag

SEQ ID NO: 54833 - DNA, 888 bp, Glycine max
  Peptide Sequence Number=SeqID_171611
atgacagaatctgttaggaaaccacctattactgaagtttacccaataaaaagaaagagtgaaccttgttggtcatttattgctcataatgtggatggagttgagaggtttttcataaaaaccattgaaaatagagacgagggaattgttttaaaagaccacagctccaaatgggaacctagtgattgtagtggaaagtggctaaaattgaagcctgaatacattcaagctggctctgatctggatgtacttatcataggtggctgctatggctctggacgacgtggaggagaggttgctcgattcttggttggcctcgcagagcgcccatccccaaatacgcaccctaagcgatttatctccttttgcagagttggtactggactctctgatgatgagcttgatgctgtagtgaccaaacaaaaaccttacttcagaaagtatgaatatccaaagaagatgccaccaagtttttatcaagtaactaatcattcaaaagaaagacctgatatgtgggttgatagccctgagaaattaattattcggtctataaccagtgatatccgaactatagaatctgagtctcggattgacagggtgagatatggcaagccttggtatgaatgctttgatgttcaatcatttatagaactagtacattctagcaatggtaccacgcagagggatacagaatatggcagcaaacaggacagtaaaccaaaacgactgaaatcctccactaggggagaaaagaaaaacttgtccattgttccttctcatttaattcaaactgatgtttccagcgttaagggggggtccttaatattttcaaatatgatgttctgtatcctggagaatcttgctacctaccaattgtccactaactaa

SEQ ID NO: 54834 - DNA, 327 bp, Glycine max
  Peptide Sequence Number=SeqID_171612
atgaagtggataatcatgataatcctgaaagatctaaaactgggaattagtgaaaaaagcatttttcatgaattccatcctgatgctgaagtcttgtttaaagttacctgtgacttaaaattagtatgtgaaaagctaagggatcggaatcaacgtcataagcggcaggatattgaagttggaaaagctgtgtgcccccaattagctaagagagttgctaatgcaactgaagcatggaagaatgtttgctttgctaagccttttattcagtcacttatgccccaaccaaatcactggtcaatcttattcctttccatgacaaggtga

SEQ ID NO: 54835 - DNA, 405 bp, Glycine max
  Peptide Sequence Number=SeqID_171613
atggctttctctggatacgcgtctcaaggatgtcaacaaaatatctcaaggatgtcaagaaaatttccaaccagtgggattcttatcatatatgcctcaatactcatttcaagtatatatgtctcaatactcatttcaagttcctctacctcaaatgttttttatggacactcacaaaggtttgacaccactttcaatactccatcatttgtatataatctatcaccatcgagctcttatcatcgtttatcattacctactcaaatgcgtgacatgatttatgaaaatgaagaggaagatgatgataataacaatattaacaataacgaagatgatgatcatgtttccaacaacaacataattacactgatcatcctagaccaggaggagatagagattatctaa

SEQ ID NO: 54836 - DNA, 243 bp, Glycine max
  Peptide Sequence Number=SeqID_171614
atggctttgttgaggcgtgtagagtggtgtctgtcgacagagaaagaagaagaagggaattttcaccagagaaggtgttgtgttgaagccaatagacaattagacagagaaaaggtggaagatcgtaggtgggataaagatgctaaagatattcggggaatcacagacctaacgctgccacgtcggtttcctattgttccaaatgatgttaactgtcaacaagtaccaaccgtttccatgtga

SEQ ID NO: 54837 - DNA, 1560 bp, Glycine max
  Peptide Sequence Number=SeqID_171615
atgggcggcgaagccgaaaattccggtttgaaccaatgggttcattctttgtcaataattctgggttgtctggatcacaaaaaagcggaagcatgtagcatcacccttgttccggagcaacttcggagatccaaagaggaagcttacacgccacacgtggtctccgtgggacccctccacaagggaaagagaacggacctactatacatggaagagatcaagctacgctgcatgctctatctcctctatcgatgcaaaaatgttgatatcaataagctcgatcaagttttgctcaattgtggcaaagctatgctgaagttggatgaaatagttcgcggtagctacaatgtcgatgaccttaagctcaaccgcaacgacctcgcgaaaattatggtgttggacggttgttttctgttggagcttctaattagtggatcaccggaactgaatgaaaaacttgagagccaattggatggtcttagttccggaattgaagtcatacaaagggaaaaggtgttgtcggatttgattatgctcgagaaccagatccctctcatcgttctgggtaagttgtttaccacactttttcccgagaatcttacaaaggatgataatgatggcatcagattgatacgtgagcatgcgctttctatcttgggctatgattactctactctgggctcctcctattcttccgagttaaaaggctttcattttcttgaacttgttcactcgttcatagataaggaaaaagaacaagataaagcaacgaagcagaatgccaatgctgctgtggagaacaacgaagtgaacaatgcttcggcaattgatataccgactgacaaggttgcaaagcagaatgccaatgcttctgtggagaacaatgcttcagcaattggtacacggagtaaaaaggatgcgaatactagtcatggtcaacgaaaactatcgcgatgcgctacgaggcttgaagcagctgggattaaaatcaaacctccagaaggagttacctcagaatcaaggagggcaagtgaggcaaggtttgacttgaagataacgttcagcaaagagaaaggaatactagaaatcccgcagctgcatattactgaaaccacggaagcaaagtggcggaacttgattgcgtgggagagtttgatttgttcggtccacgaccttaaactgcttaaggatagacatgttatagaggtacatgaatcaatgagcaacgaagatttgatgaatatgcttcgtaaaatcacagagggagttcctgatgctgagattgatcatgagattgatatggattcctggtttcgtcaggtgattaacgaattgaactcatacccaacaactgtagatcgtgcgaggaaaaccaggaaagtcttggggcatattttcagacgcgttctaacatggatttggtacaaatgcagaggcgcatatgggttgttgagacgagattatatgcctaacgggtggagagtgatagcggtgcttgctgctgctacggcgcttactctcactgctatccagacacattatgcaatccaccgtaactag

SEQ ID NO: 54838 - DNA, 219 bp, Glycine max
  Peptide Sequence Number=SeqID_171616
atggggatgtctcctccacctctagaacctcaaaatcactcacagactcatctcatgctctcaagatggcttccttttcacgctcagttctatatggactcaagcggtgcgcttagtgggatgagccctcactcagcgaacatgcacagctcatccttcttccagattcttccttgcactcagccaaaggagtgttgcgctcagcagatggctcactaa

SEQ ID NO: 54839 - DNA, 471 bp, Glycine max
  Peptide Sequence Number=SeqID_171617
atgaagctacatcattatccgcttcaactcttgagacttccattcttccactgcgttcaccgcggagttcccatgattggcaagtgggttaatccttatgtttggactatcctctggaaatgtaagtcatccagcatcaatcaagctttgtaccttgtgcttaaaggctacacactgctcgatggagtgccccgggatgccaccatgataggcgcatgtggtgttagtgtcgcaacgtgcccttcgcgggcgagcgaaggcgaggctcacgggtgcgctttcaaaaaggaggaaagatgcgcggagtcgccaccaatgtttatttgtggaaaacgtcgggaaaaccgaaggaaaccggtcaaaataaaaattctaagtttgggagttatatttacgtttgaggaaggtcgacaaaagcggagcttttgctcctacgtaccctccatcaaagaggaaatcagatctacgtag

SEQ ID NO: 54840 - DNA, 279 bp, Glycine max
  Peptide Sequence Number=SeqID_171618
atgcatgaacagcgcttggcaatcaattcgtggggctccggactcgatggtggaggatgcatgaatgacaatcaattcatggggctccgaataagatttgatggtagaggatgcacgaatagcgctaggcattcgtggggctctggactcgatggtggaggatgcatgaatggcaatcaattcatggggctccgaataagatttgatgatagaggatgcatgaacagcgctaggcaatcaattcgtggggcttcagactcgatggtggaggatgcatga

SEQ ID NO: 54841 - DNA, 426 bp, Glycine max
  Peptide Sequence Number=SeqID_171619
atgaggcttgtgtggcggctggccagctatttatcttgggtgttatctgaaaattaccctctgtatgatagggcactggtaatcgattaccagttatgtgtaatcgattacatagtgctacctgctactgattccactgtgccaaggctgtgtaattcgtttttgggcactggtaatcgattaccagagaggaaatcccttgaaaaagacatgttgactatgcgtagccgttatgggacgcattgtatgattgcgatggcagtgcagttgatccatgatcgcgttgtgatggagtgcctagagggtgtttgggagaccctcaaaggcaatgagaggtgtcgattccgtggcacaattcgactcactgctacttcactagtacatccggagcaacccgcacgcacacttcagcagcctgtggagtga

SEQ ID NO: 54842 - DNA, 1545 bp, Glycine max
  Peptide Sequence Number=SeqID_171620
atgaaatgtcaggttgctataaagacattgatagtcattcacaggactttgagagagggtgatcccacctttagagaagagattcttaactactcccgcaggggacatattctccatatatccaatttcaaagatgattcaagccctctagcttgggattgttctgcatgggttcgagtctatgcactatttttagaagaaagacttgaatgttttagagtccttaaatatgacatagaatccgagcgtttaacaaaagcatcaccagctgtaaataaagcacatagcagaactcgattgttggatagtaatgatctgttggagcagctaccggcactacaacaacttctatatcgccttattggttgtcagcctgaaggatgtgcttaccgtaatcatctagtacaatatgcgttggccctggttttgaaagaaagtttcaaaatatactgcgcactcaatgatggaatcatcaatcttgttgacatgttctttgatatgacaagacatgacgcagtgaaggctctaaacatttataaaagagctggccaacaggctgagaatcttgctgacttctatgattactgcaaaggcttggaccttgctaggaatttccaatttccaacactgagacagccacctccctctttccttgcaacaatggaagaatacattaaagaagcaccccagacaggccatgttaataagagactggagtatcaagaaaatgatgaatcgtctaaagaggaatcagaatccaatgaatctgcagagcctcaagcaaatgaggaacaagctgaggaagtcaatggggaagagtcagtagaagaggaagaagaaaaacctaagcaggaggaggaggcagagtctcctccttttatatcaactgatgatggtatagatgatttgctgggtcttaatgaaataaatccaaaagttatggaattggaggaaagcaatgctatggctcttgcaattgtaccatctggtggaaataatccaaacaatcttgctttgagtaacattgacgggactattggatgggaactttcacttgttactgcaccaagtaaccattccagtcaagccccggatcgcagaatggctggtggttttgacaagctattactggatagtctatatgaagatgaaaatgccaggagacaactccaactccaaaatgcaggttatggacatggtggaacaatggatatacataacaacccatttgatcattacaatcagcatgatccatttgcaatgtccaacaacattgcacctccccccagtgtgcaaatggcattaatgtctcaacaacaacagcaacaacaaatggtgttccaacagcagcaaatgatgtaccaacaaccacaacaacacaacaacaacatgatgatggtccctcaccaacagcaacaaccatataaccaattccctcatcagatgcagaattcaggttctcataatccatttggagatcccttaccggtaccaaactataatcatagttccatgccccaacgtggaaattacaatttaatatag

SEQ ID NO: 54843 - DNA, 2145 bp, Glycine max
  Peptide Sequence Number=SeqID_171621
atgcgggatgtggatagtttaaatagcgaaggatctggaaaatctagttactcacaggaacagactatgtccaagctagtttcctcgaaattcaaaacaagtagcacaaaatgccaagagaagaaacacaaagttaagttaaaatctcataaacacagagctggtacaaacaaatcaaagaagacagttacggattcttccatcaaggcaccgcttgaggattcttcgaataaaaaagtgattattagaaaatatcggcataaaaccgatgggaaatcttcgcggatgctgtcttcaacaaagctagaaggaggaaaaaattctcatagttctggaatagaggggaatgatgttgatggggaggaaaagattaaaaaacataagagaagaaagaagaaaagacaaaggaataacatggatgttgatgatgcttcacgcctgcgaaggagaacaaggtacctcttaatcaaaatgaagctagagcagaaccttatcgatgcttactctggagaaggttggaaaggtcaaagtcgggagaagattaggccagaaaaggagctactaagagcaaaaaagcagattttaaaatgtaaacttaatattcgtgatgccatacgccagctggattctcttagttctgtgggtagcattgaagattctgccattgctccagatggatctgtttatcatgaaaatatattctgtgccaattgcaaactacatgaagctttcccagataatgatattatactctgtgatggcacatgcaatcgtgcttttcaccagagatgtctcaatcctcctttggatactgaaaatattcctcctggagatcaaggctggttttgcaagttttgtgaatgtaagatagaaatactagaggcaacaaatgcccatcttgggactcaattctccctagacagtacttggcaggatgtattcaaggaagaggcttctatgcctgatggtgacattgcattgctaaatccagaagaagaatggccatcagatgatcctgaagatgatgattacaatccagagaagaaagaagacagccacagcatcgacatagaaggagatgatggaaatgcatccaatgattcaaccagttcttccagtctgtggtctttgaatggtgaatgtcctccagtagatgaaggcgtcagtcatgaatactattctgttaatagctgcatagattctaatgaatctggggaaatagcatgtggccctaggcagcgtaaagctgttgactacaagaaactctatgatgaaatgtttgggaaggatgctccaccttgtgaacaagtgagtgaagatgaagattggggtcctggcaaaagaaagagaagagaaaaggagtctgatgctgtcaatactcttatgactctgcatgaaagtgagaataaacattccaataatgagaaaaatgatacaacaagagagggctcttcaggcatacaaataagaagatcttgtttcaggattccggttgatgccgttgagaaacttcgccaagcttttgcagagaatgagcttcctccaagatctgtgaaggacagtctttcgaaagagttgggactagatcctgaaaaggttagcaaatggttcaaaaatgctcgttacttagcacttaaaaccagaaggtatcaatcagaaggagaacagcttcagagtttcacttctaagatctcaacggactctatatctcaaattgtggagaaagatgagcttttgaaatcaacggtctccaaaattactgtgattcattcccagaaggatggtaaaaacatcacaggcaaagagaaaaataacttatctgacagtcttttgaagaaaaggcaacaacaagaaatacctccacctttggaaagagaaaatggcaacaaggattctatggaggtcagcaatgatgttaagttgaagaaaatgctgaaaaaaaggaaaagaggggtaaatattatatttgaaggagattctcaggcagcagagttggaatttgaaagactcagcaaagtgaagaggaaactagatagcatgaagcagaaattaaatgaagttcaaaattgcagagcaaagggttcaaatgaaccctctattatatatgtacccacagcccaattaagggaaaaggttgaaaaataa

SEQ ID NO: 54844 - DNA, 927 bp, Glycine max
  Peptide Sequence Number=SeqID_171622
atggctaaaaccaggtgcgtagagaaagtgtgtcatataagaatgaacatcttatatcggcactgcaacaaccaccaccataccgtcaccgtgattgctgctaaaaccaccgtcgttgtcactgttgtcggtggtcatgggggcgatcatagtaatagtaatgatggaagtaatagtgacaacggtcatggtggtggtgacggtgatcataatagttgtgatgaaaacgatcatgacgataatggtcatggagagtgtgaaaataacgacaacgacgcgttctcttttctccttgaaagcaaacgtggtttccaaacggagtcgaacaaggtcttcttcggcgtgcgagagaatattaataagccttgcgaattgagcacttcagtgccgaattgcgatgaatttgagagtgaagagttcgattgccaatcgatgctcgacgaggaaatagaggaaggaatcgatagcatcatgggaggaggaggaggaagagttgaagaggatgatgttaatcgtgccgcttcgtgtcacggcggtgacggcgagaaattcggttgcgtgagggctctacggcgagatgatacgaagtggtggaatttttgtgtggttgacatgcttcaaatctcgccgcggatgaagcacgctgcggcggaggatttggttccggccaccgcaatggcaacaacgaccgagaagacaaagacgaagaacaagaaaagcaaaaaggtggtgaagaaattaacagaggaattatcagaggtagcagtgagtaagggcttgcggttgaaattgaattacgacggtgttcggagtgcttggtccaatcgggggtcgccatttgccgatggttcgccgggaaatgacgtcaccctacgttgctcgtctctcgctcgcgatttgaataagtctaaaagaaaaaaggtttga

SEQ ID NO: 54845 - DNA, 225 bp, Glycine max
  Peptide Sequence Number=SeqID_171623
atggcgccccagtccacggcagggaaagcctccgggctcaaagagctcttacaaaggtacttacatttacctcaccccaaggagactagtgaggagaatgaatctactgatggtgaggatactgatatagagataaatggcccagacgggacgaacgggactgtgaaagtgaaggttctgacattttcagaaaatgtagctcactcagaagatgaggaaggatga

SEQ ID NO: 54846 - DNA, 411 bp, Glycine max
  Peptide Sequence Number=SeqID_171624
atggaatcagtgatgctgctgagcgtgctcctgggcgtggaggaggtggcggcgctcgtgggggagagcgacgaggtaggagaagatcatgccgccgtagcagacatggaagatgggatcaggggaactggtttcaatgtacttggcatggtaattgtcgaagcctctctgaatcgctttcttgatgtagctcagggacagcatcggcttcacgtgctcagggacctcgctcaccctcttccccttgatctcgttgtagaatctcctcagcgccattgttgcgaacgagcgaacgaacaaaccctagattttgcgattactttgctctgcctaatggaaattgggaaattgggaataatgggtttctatgccccaaacagggcagttacgtgcatccagccaaattactga

SEQ ID NO: 54847 - DNA, 2727 bp, Glycine max
  Peptide Sequence Number=SeqID_171625
atgcctccggcgctgtcggatccgctgtcggtgactccggcaagctccgacgctgttctgcagcgatcggcgccgccggagaatcggcgattcggtgatcttagagggttgcagtggcggataaatcttggggtgctgccgtcttcgtcttcgacttcaattgatgatcttcgtcgagtcaccgcgaattgtagaagaaggtatgctagcttgagaaggcgccttctggttgaaccacatgttccaaaggatggagctaattcacgcaatcttgtcattgacaatccactttcacagaatccagatagtacatggggtcgctttttccgcaatgcagagttggagagaatggttgatcaggatttatcacgtttatacccagaacatggcagttattttcagactccaggatgccaaagcatgttgagacgaattttattactgtggtgtctcaggcacccagaatgtggttatagacaaggaatgcatgaattacttgctcctctgctttatgttctccaagttgatttggagcatctttcggaagttcggaagctttacgaagatcactttacagacagatttgacggccttttatatcaagagaatgatctttcttacagctttgattttaaaaaatctccagaattgatggaggatgaatttggttctcatggaaatgctgtgaaagtcaatagtcttgaggaacttgatcctgagatacagaccattgtattactaagtgatgcttatggagctgaaggtgaactgggcattgttttatctgagaaattcgtggagcatgacgcatactgtatgtttgatgctttgatgagtggggcccatggttcagttgcaatggccgatttcttctcttcatcccctgtatctgggtcccatagtggcgtgcctcctgtgattgaggcttcggctgcattgtattatttgttgtctcttgtagattcatctctccacagccatctttttgaacttggggttgaacctcagtacttttctcttcgatggttgcgagttttatttggacgagaattttcacttgccaacctcttgatcatatgggatgagatctttgcatcagagaatagcagcttggaaaaaggtgctgatgactgtgagttcaggatcttaagttcacctcgtggagcatttatctcagctatggcagtagctatgttacttcatttaagatcttcactacttgcaactgaaaaccctacaaggtgtcttcagagattactaaactttcctgaagacattaatattgaaaaactactagagaaggctaaatccttgcaggctttggcactgagtgttgatatttcatcatcgtcacttttgtttcttggatttcattaccaaagtaaatctatatatactacatctgtgacccttccatctgaatccgtgtctccgaaaactccactgaatttgttacccgatagctattgggaagagaagtggagggttgcccacaaggctgaagaacttaggcaagatagtctagaaaagcaggttcccactcggaaaaagggatggacggaaaaggtaaaattcagtttgagacgagcaaaatctgaccctcctttgtcaaggattcagagtggcaaacattttaggcgcagtttgttggaagatcttcgcaaggcactcggctcagaggaagatgcagagaaaatgcagccagatgaaacactacggcagcatgataatccttctgaagcagttgaagtacaacaagaagatagtgtctgtagtggtgacagcaattacttgtctgatgatagatctccaagtggaaattctggcagtgaggaagacttgtctatatattctgacccgactagtccccagaatgaggtcaatgatcatgaaattacctcagcgaaaagtagtgttacatctaattcatccctagacgaatgcaatgaaacttcaggtaccagttcaccatttccaatctccgatcctcctgagaacatttctcagacatcacagtgcaatacagaaaattatgaatgcagtgaaacatcacataccagtcccaatgatccacaccttctaatctccgatcttcccgagaacatttctcagacatcacagtgcaatacagaaaattctgaatgcaatgaaacttcacataccagtcccaatgatccaccccttctaatctccaatcctcccaagaacatttctcagacatcacagtgcaatacagaaaattctgaatgcaatgaaacttcagttatctgtcccaatgatccactccttccaatctctgatcctccaaagaacaaacctccgacatcagggtgcaatagctttgaggaagcaggaaatacagtcaatcctcctaaagacaaaaaacagaataagttgcagtggttttggccgtttggacggaataatgttgaggtgatctccgagaaagcagcaggtgctgctgaagccgccaaccgtggtagcattcaaaaaaatactccacaaccagcctcatctgcagttaatgagccttgtagttctgttagttgcagtggagaatctgttgacaagaatgtgatgggcactttgaagaatattggacagtctatgcttgaccatattcagataattgaatctgttttccaacaagaccgcaaaggccaagttactgccatgacagctctcaaagagcttaggaaaattagcaatcttttgtctgagatgtga

SEQ ID NO: 54848 - DNA, 411 bp, Glycine max
  Peptide Sequence Number=SeqID_171626
atgaagcaatactcattacttaagagaaggttgcaaacctttcattggggtagatggttgtcaccatggaccaaatatggtggacagttgcttgtagctgtggccagagatgctaatgatcaatattttccattagcctttgctgttgtggaaattgaaaccaaagagagttggaaatggtttttgacactgctatttggtgacattggagaccttgagaccaacagatgggtgcttatttctgacagacaaaagggactgattaatgcatttgaggaattagatgacaaaattgaacataggttttaccttaggcatatgtatgaaaatttcaaaaaaatatttagaggagaagttgtgcctagggacttggtgatgactgtctcaaaagctacatatatggaggcatag

SEQ ID NO: 54849 - DNA, 234 bp, Glycine max
  Peptide Sequence Number=SeqID_171627
atgacactgaggtggtgcaggtggcacgacaacgttgggggggtctacgcaagagaagaagtgtttggtcgaagaaaggttgtgggaaataaaatctggaggtggaggtggcatgcgacgtcggaggaggctggcggggttggtgtgcaaccagatctagtggttaagggttggcatagcagtgtgatgacgacaatggttattgatggcaatggtggtgcgtgtggatgctag

SEQ ID NO: 54850 - DNA, 297 bp, Glycine max
  Peptide Sequence Number=SeqID_171628
atgactaacgacatcggtagggaaggaataaacatactctctttcgccatagcctctgctatcaccgttgtggttgtgggttccaagaacgagctcatcattgagatcaataccagagctgctcctttcggtgtggtcaaggttctggttggcacgtggattcggaggcgacaatggaggcatgtgagtatggagactaggaagagcgggttagaggtgaacttgctggagaggattgagaagttggacgaggatttaaggagttttgtgacggttgttagggttttgtcgagatag

SEQ ID NO: 54851 - DNA, 1989 bp, Glycine max
  Peptide Sequence Number=SeqID_171629
atggagacagagcaagaattggaatgggctgaagcccagaacatggtgttcttaagcgaagacctcgtggccacggctaagcaacagcttctgtttctggcagaggttgataggaatcgttgcctttatgatggtccagttttacacagagctaactacaggtataaatattgttggcttcctttactagccaaacatgctgagtcacatgtgacacaagacccttttgttgttcctcttgactgtgaatggatttggcactgtcataggcttaatccggtgcgttacaaaacagactgcatggaactgtatgggagaatactaggtgatcggaatgtggtatcttcaactcagggaaccagcaaagaggaaagtgaaaaactctgggagacaatgtatccaagtgagccatatgaacttgatctaaacaatgactcaatgcaaaattttgctgaaaatttcttggaagccaaacaaagtagcaccgactatgatctgatttcagcagttaaaaggcagaccactttcttctatcaggtttcaaggccttattggaatgatgatacttttcttgaaggagctgtggccagatacaaggggtttctgcatttgatcaagaggaatagagagaggcatgtaagctgcttttgtgttccaacttatgacattgacctaatctggcactctcatcaattgcatcctgtgtcttactgtaacgatctagtggcaattatgggcacaatactagaacataatgacatggattctgatcggaccaagggccaaaagctggatgctggcttttctgaaaccaccacacagtgggaagagacatttggttcaagatactggaaagcaggagcaatgtacagtggtagtccaccatcacctattactgttgataagtataaaatagatgctatacacaaaatctcagctccatccaataagacaaaccagaatgtgattcagcttccacagaaaatgcttgtgcaggtgatgcttgagattgttgatgtgagaaacttacctttggggcatacaggcaagctacttgtatccttcaacaagaaacaagaagacgtgcttttcaataccaagaagcaattatgcatttcctcagagtcacaagggaaacaagttgctgttttccaatgtgaaagtaatggagagttagttcttgaactcatttctcgcccaagtttcaattttagaggagtaaggccagccaaagtattgggaaaaacttcaatcaatctgggggatttgcaagatgtagcatctaaattgccaaaagagaagtggttagatttgacatctacagtcaattggtcaaagcctattggtattcgcattggtttgtctttaactcctccagtttcggcaccatatgagttgcactttgtttctatgtatccattcaaaggaagttatttttccttcctgcttccaagaaagttccagcaaacaaaatgttggacaaatgttgtggatgaagctggcaatgagatcattcacatccagaaaggtaacttgtcaaatgagaagacaaagagtagtatcaataaagaagtgattggcaggactgcatccggtgaaactcatcttcttgcagagttaaaaggaacaatgtggtctatgatgaactctgactggatgctacagataaaaaagaccagcgctgaagatcataaacgtgtatttgaactcacaggcactcggaaggtgattatttttccaggtagaaaattggagtatggaacaagatactaccgaaatgaaaaaggaaattgcttcatgacagcagtagaattctctggaacacatccttatggaaaagcagtggctttgatggatttggcaaatggatttctggagatcaaggaagagtggctggtcttgcctgccttattgtctgcatttgttctctctaataattttcctgatttcagtaatgagactgagaaggcgaatgggactaatgcataa

SEQ ID NO: 54852 - DNA, 258 bp, Glycine max
  Peptide Sequence Number=SeqID_171630
atgtcagaaacagggacactgctattcgaggctgtgccagtgcttcacagctacaagcctatcctgacaatcgtagacaacgaagaactcctatcttctgcttcctttgcttgtttctcgttctctccatgtggtcattgctccaacatgatgacagtgctactgcaaacatggcaaactaaagacaaatctcctctccttcacttcatgcttcctgctcaagatctgggaggtggcttgtggcgattgggttggtga

SEQ ID NO: 54853 - DNA, 288 bp, Glycine max
  Peptide Sequence Number=SeqID_171631
atgtgggacattgtaagagacgagtttggatcacttgatgagaatgaaattcttgaagttgctaatttatttcttgatgaaccagaattagaaattatgtttttcaatgatgatgaatttcttcgctccatcaagaagaaaggcgaagaaactctcatgttcattgcatattccgatattgccccttctgtattcaacatattgtctccttgtgtggtcgacgctgtcactttctctttcatgatttgtgagcaatggtgcgtctgcaacgaaggtcatggccagtga

SEQ ID NO: 54854 - DNA, 681 bp, Glycine max
  Peptide Sequence Number=SeqID_171632
atgattgagaaagcacagttttcgtgccctccttcgtttcctgtgggagcaaagtctttaatacacacaatgctggacccaaatcctgaacgtcgtataaccattgagcagataaggaatgatgagtggtttcaaaaggaatatgttccggtcagtctcatcgagtatgaagatgtaaatctggatgatgtaaatgctgcatttgacaatgatgaggatcagaggactaaccagcaatgtgagaatgacgacatgggtcctctaactcttaatgcattcgacatgataattttatctcaaggcttaaaccttgcaaccctatttgatcgtggacaggactctatgaaatacgaaacgcgcttcatcagtcaaaagccaccaaaggtgattttatcaagtatggaagttgtggcacaatcaatgggatttaagacacatattcgcaactataagatgagaatagagagtatctcaacaaataaggcttcttatttctcagttatactagaagtctttgaaattgctcctacatttttcatggtggatattcagaaagcagctggagatgctggtgaatatctcaagttttacaagaatttttctagcaatcttgaggatatcatgtggaaaccgccccacgaaacaagcaaattaaggaactccaagaccaaagggcagtga

SEQ ID NO: 54855 - DNA, 975 bp, Glycine max
  Peptide Sequence Number=SeqID_171633
atggcgagtgaaaagttggtgctggcagtgatcagggccgcgaggccaaccttccgcaaccaaaacgacaaaatcgcatttgccgttcactcctccttcctcacctccggctatgtcctcaccgctacaggtccccaggccctctccgacaatgcgttttctgacccatccaatgacgaggtatccgttgatcattggaacgagctgaacgatgagtacgcgttcgtttacgcgaatccagaaaagggttcggagaaagtgcttgtcaagtgcctcgtgatgaacgacaaattgctcgttcatgcttttactcaaggatcttcggagcctttgagccttgagattgatgttggggattatgctggagaggatggagtcagcaattattctcagcagttcaagaatttggataagcttgtgaagaaaatagatggggatatcttgtctaaattagatggttctgctaaagccagctcatcaagtagaagctcagaaacaagtaacagaactagacaagagatacctgatcctgttgctggatttggtgaacctggtggtcctccaacgcaatttattttcccttcagttcccattggttctggtagtgatcttgttcctgggcctgctgctggagtgtttccttcaaggggtggtcatggcattggtggaagcatgcttgtagcagggcctaatgacccccgttggtttggtggtgttggtggtattggtggagatcctgcttttcctggaggattgccgcatgccttaggtgctaaggcgagggaagggaaggttccaagttcttgctctgaggcaatgggtgttcctcccggtgcgcgatttgatccatatggacctcccggtgttcctggttttgaacccaacagatttgcaaggaatcctaggaggccaggatatgacactcatccagattggcaacattttcggagagatgctgattcagactacatatag

SEQ ID NO: 54856 - DNA, 444 bp, Glycine max
  Peptide Sequence Number=SeqID_171634
atggttctagcaagccgtactaagatttatatcatattggagtttattacaggtggtgaattgtttgataaaattgtaagccatgggcgtcttagtgaagctgaatctagaagatacttccaacagcttattgatggtgtagatttttgccacagcaagggagtttatcatagagatttaaagcctgaaaatcttttacttgattcacaaggaaatataaagatttcagattttggtttgagtgcatttccagaacagggggtcagtttgcttcggacaacttgtgggactcctaattatgtagctcctgaggtactcagtcacaagggttataatggggctccagcagatgtttggtcctgtggagttatcctctacgttctattggctggatatcttccctttgacgaacttgatctaactacgttgtacagtaaggcatga

SEQ ID NO: 54857 - DNA, 2478 bp, Glycine max
  Peptide Sequence Number=SeqID_171635
atgaggttgttggagtttgggtgtgtatttttagtagttcttctgtttggccttgtgaaatttggcaaggctgaggtttacatagtcaccgttgagggagagcctgtcataagttacaagggaggaatcgatggctttgaagccaccgctgtggaatctgatgatgatgatgatgatgagaagcttgattccacaagtgaggtggtgacttcttatgctcggcaccttgaaaagagacatgacatgcttctgggtttgctgtttgagcgtgggacatacaacaagctctatagctatagacaccttataaatgggtttgcagttcatctttccccagaacaggcagaaactcttagacatgctcctggggtgaaatctgttgagagggactggaaggtgaagaggctcacaacacacaccccgcaatttttggggcttccaactggggtgtggccaacaggaggtggatatgagagggctggagaagacattgtgattggatttgtggactctgggatctaccctcaccacccaagttttactactcataatactgaaccgtatggtccagtttcaaggtatagaggaaaatgtgaagtcgatcctgacactaaaaagagtttctgcaatgggaaaattgttggagcacaacactttgctcaagctgcaatagctgctggggcgttcaacccttctattgattttgattcacctctcgatggagatgggcatgggagtcatacagcctctattgcagctggaagaaatggaattcctgtgaggatgcatggacatgaatttgggaaagcaagtggaatggctccccgtgccaggattgctgtgtacaaagcactctatagactctttggaggatttattgctgatgtagttgctgcaattgatcaggctgtgcatgatggagtggatatactcagcctttcagttggaccaaatagtcctccgtcaaacaccaaaactacatttttgaacccttttgatgctacacttcttggagcagtgaaagctggtgtgtttgtcgcacaggctgcaggaaatggtggtccttttcctaagtcattagtttcatatagtccatggatagcaactgtagcagcagcaattgatgatcgtagatataaaaaccatttgatccttggaaatggaaaaatcttagccggacttggattgtcaccttctacacgtttaaaccaaacatacacattggttgctgcaactgatgtgcttctagattcttcagctacaaagtacagccccactgattgccagagaccacaacttttaaataagaacttgataaagggaaatattcttctgtgtggctattctttcaattttgttattggttctgcatcaataaagcaagtctcagaaacagcaaaggcccttggagcagctggatttgttctttgtgttgaaaatgtttcccctggaacaaaatttgatcccgtccctgttggcattcctgggattcttatcacagatgccagcaaatcaaaggaactgatagattattataatatctccacaccaagagactggactggaagggtgaagactttcgaaggtacaggtaaaattgaggacggtttgatgcctattctccataaatctgcaccacaagtagcaatattttctgctagaggaccaaatataaaggactttatcttccaagaggcagatcttctcaaaccagatatattagctccgggttcattgatttgggctgcatggtctctaaatggaactgatgagccaaattatgctggagaggggtttgcgatgatatctgggactagtatggctgcaccacatatagctggaattgctgctctgataaagcagaaacatccacattggagccctgccgccattaaatcagccttgatgacaacatcaacaactctagacagagcaggaaatcctattctagcacagctatattctgaaacagaagctatgaagctggtcaaagccactccttttgattatgggagtggacacgttaatccacaagctgccttggaccctggcctcatctttgacgcaggatacgaggattatctagggttcttgtgcacaacacctggcattgatgttaacgagataaagaactacacaaactcgccatgtaacaacaccatgggccacccatcaaatctaaacactccctccattacaatttcccatctagtaagaactcaaattgtcacacgcactgtgacaaatgttgctgatgaggaagaaacctatgtgatctcaggcaggatgcaaccagcagttgccattgaggtgaaccctccagcaatgaccatcaaagccggtgcatcgcgtaggtttactgtgacactcactgttcgctcagtgacaggaacctatagttttggagaggtgctaatgaagggaagcagagggcacaaggtgaggatccctgttcttgccaatggatactcaagatag

SEQ ID NO: 54858 - DNA, 1015 bp, Glycine max
  Peptide Sequence Number=SeqID_171636
atggaggatgctcgcagggtgtttgagaacatgcctagaagaaatgtggtggcgtggaccacgttaatggtgggatttgtgcaaaactcacagccaaagcacgccattcatgtgtttcaagagatgttgtatgcaggaagttacccttcaatttacactctttctgctgttctacatgcttgtagttctttgcagtctctcaagttaggagatcaattccatgcttacataatcaaataccatcttgactttgacaccagtgttggcagtgcgctttgtagtttatactccaaatgtggcaggttggaggatgctcttaaagcatttagtagaatcagagaaaagaatgttatttcgtggacttcagctgtttctgcttgtggggacaatggtgcacctgtgaaggggttgagactttttgttgagatgatttctgaggacataaagcctaatgagttcactttgaccagtgccttgagccagtgttgtgaaattccatctttggaacttgggactcaggtttgttcgctgtgcattaaatttggctatgaatcaaacctacgtgttagaaattctttgttgtatttgtacctcaaaagtggttttattgttgaggctcataggttctttaatagaatggatgatgtcagtatggttacatggaatgcaatgattgccgggcatgcgcaaatgatggaactcactaaggataatctttctgcatgccaaagaggaagtgaagcactgaaaattttctccaagttgaatcaatcaggcatgaaacctgatctgtttaccttatctagtgtcttaagtgtatgcagtagaatgctggctatagagcagggggaacaaattcatgcacagactatcaaaaccggattcttgtcggatgtgattgtaagtacttcactgattagtatgtacaataagtgtggaagcattgagagggctagcaaagcatttctggagatgtctactagaactatgatagcatggacttctatgattacag

SEQ ID NO: 54859 - DNA, 976 bp, Glycine max
  Peptide Sequence Number=SeqID_171637
atggcagcttatatccagattctaaaagaggctaaaccaattcatatctctacttctagaaatgttgttcgctcttcatattcagctttgaagtttgaagattcaggggacagcattgagcctcccttcgaacacaaacccgcggtagaggcctttgccgttctcggggaggttatcgatccacctccactcgtgcccctcggaggcacggcggtcccagagcgccaatttcccgatcctcttggcggagaagcagaccatgtcgccggcgccgccgaagaccttgaacttggtcgactcacggaaggcgcggaacatttcaggaggcatgcgggcggcctcgtcccagcggaggttgtcgaggtcgaggcggaggacgaggatggtggagcagggggcgttgagggcgaaggaggacttgaggccgccgaccatgaggatgaaattgccgtggccgccacggacgaggcggggccgattgaggacatcgaagacgtccccccactcgtggcggttggaggagaatttgagccaggtggtggtgttgcggtggcagtagagggcggcgagctccgtgaggaccatgacgcggtcctcggagtcgacgaggacagagccgtggcgggaccaggcggagccgaggtgggggaggacgcggaaagtgcgggtgagagggttacaacagatgagggacttggagttggagttggagttgttgtgggcccagaggtagaggaggccgagggaggaggcgacggggagaggggagtggaaggggaggaagtcgagggggaagggtgtggtggcggttgcggagggccaggagctggaggggtggatgggagctggagaggacctggaggaacgaaggtgttgagagcagctgcaggaagaattttgacactgagcggcatatcattatttccctcagtggcagcctgcagaatatctgccggaggctgtcctccgctagacg

SEQ ID NO: 54860 - DNA, 324 bp, Glycine max
  Peptide Sequence Number=SeqID_171638
atggcaggagctggtgatggtggtggtgattatcatcaactggatggacctcagcgtttgttattggacgcaatgactacacagatgcgacgtttgctgaaccgtaacaatgaggagctctatggacgaatggaagatctggagaaccaactgaatcagaatactggaagacattatagtggtaacagagtgggcaatgttggacccaggcaacacagaatggaggggcagaacataattgagggagtaaaactcaatgtacctcctttcaagggtaggagtgacccagatgcctaccttgactgggagatgaaaattgagcat

SEQ ID NO: 54861 - DNA, 321 bp, Glycine max
  Peptide Sequence Number=SeqID_171639
atgcagagggggtcacaatctgaaccatttgatgtagaaatgagagatcgcttagaggatatgattcgtgatcttggacaaagagtcttttcagcaagcacatgcccctatgccaagaagatactgtgtccgatgggtatggagtatcagaagattcatgcttgcccaattgattgcatactgtacaaacatgagtttgaagaaatgcacaaattcccaaggtgtggggtatcacagtacaaagtgaaggatgatgacgagtgcaatagtgacgaaaactcaaagaagggccctccagcgaaggtgttgtggtatctttga

SEQ ID NO: 54862 - DNA, 321 bp, Glycine max
  Peptide Sequence Number=SeqID_171640
atgatagaaggaggagacgaatgtgcatataataacaagaggggacccctaagggcaaaaggccaccttggggtggttgcagctcgcccaggcgagctaaaacttaatcctgaagcagtgagctcgcccaggcgagctagtcccttagccttgaagttatttggtggcccaggcaagccaaatgctggcctaggcgagctggggtctaggaaaaacaaggaaaagacccttttgccctcctttcttggcatcttttgtcttcctgatcggaacatcgaatggtttcttgctttgaactgtaactggcattcaacaccataa

SEQ ID NO: 54863 - DNA, 246 bp, Glycine max
  Peptide Sequence Number=SeqID_171641
atgtcacaaaactttatggattatgcaaccatcccctctttgacttctggaatgttacgaaactttacggattgcgcaataatgcttcctttcaactcccgacatgtcgcggaacttcacggattgcctaacgatgggtgtcaagtacctcgaagtggtcaagcgaaggcttatattccttcggttaagatcctcaggttcagtagcctctccaacttatcagcaattgtcgcaaaagcatcgtag

SEQ ID NO: 54864 - DNA, 270 bp, Glycine max
  Peptide Sequence Number=SeqID_171642
gttttcaacaacattgtggatccagcactatctcaagctggccctgctttggacaagcctgctgctcaagagacatttttggaagaatttaagaaagtggcattgagcgtggttgattttcttaaagagaaacctgtcattgttgcccacagtgaaaacacatttgatggacgcgacgttgaacttagctttagagaatctgccgaaagatcgcaacgtaaaaatatcaaaggactatctgcaggtggtgttgaagatatacttttgtaa

SEQ ID NO: 54865 - DNA, 214 bp, Glycine max
  Peptide Sequence Number=SeqID_171643
actcctcttctccttgaagtggtgtctcctctctctctcttccttctctattccactgccattcatcttccaagaagcaaaggaatccattgatgaagaagatcctaggcctacaagctccaatggagcttacataaaaaagtatcatgaggaatttaaaagtcctgtgattggtcctgagtgtcctgtgtatgaacatcctcctcgtccgtaa

SEQ ID NO: 54866 - DNA, 795 bp, Glycine max
  Peptide Sequence Number=SeqID_171644
atgcccactaatatcagagagattgaggcagctttgtgtatacccgaccgagggtttgttttaaatgctgaaggccatcctcggaagatcctcaggaaagatctaacaactctttctcaagtttggagtgttctctcatactccaacctggcttcgacttcccacacctcagatttgactgtagatagagctaggttaatctttgacctagtctctcagctggacatgaatgtaagagctctcatctctggccatatcacatctatggcccagtctaactcctctagacttcggttccctgctcttatcacagctctatgtaggtccagaggggttgcttctgacagcctggtcttcgaacgcttgagcccggtcattaacttggcctatatcaggaagaactattggaaccctgatgatctgacatttactattagaggggccaggagagcaagggcaaggccagctgaggctccttccttccacatctacagctcctcctccaacactttacagctagtagaacctccagactctattccttctatagagcagtttaatgagtgggtagcctggcccgggactcagcctccccttcataaggaagacgaaggtcccaccgctcaggtaccacaacagatggaggatgagtcatccgagacttccactccagagcccctaatcagaaggaagacggtagttgaaaaacaagaagctgcagccacttctgagaaatctcttgaggccacccctaagcctccagcaccagtggcagatacaacctcaccgcaatag

SEQ ID NO: 54867 - DNA, 405 bp, Glycine max
  Peptide Sequence Number=SeqID_171645
atgggtgcaaaggatatgtcactcattcacaagcaaaataaaaatcttgatcctgtcaatgatcttgtgcatactcatttaggtccagtgctagtgcagatggtgaatcctaagaaagatgcaggtctggcactggtacagatggctcaagctgagaagacatgtccagtactgacgtggaaggctctgatggaggctgtggagtcacctgtggggataaggctcttgggctgcagaggcctcaccccctcccaaaggagaaggctggactcttggccaggccaccttctgaacaaaatcattcaggctcatcaccggcctctattgggtcacatcttgcaagctctacatgatcaggagctggccctgatacaggctctgtatcatattcatgataggatctga

SEQ ID NO: 54868 - DNA, 1461 bp, Glycine max
  Peptide Sequence Number=SeqID_171646
atggagctgatcatgttgctgctctcgttggtcctttccttgttagtgttgtctgttatcttgttgttgtatgttactcgttctcctaaagcaatggaaggcatccctggaagccttggttggcctattgtgggagagagtttctcattcctctctgacttttcaagtccctctggaatctttagcttcatgaacaagaggcaaaagagatatggaaaggttttcaagagctttgtcctggggaggttcactgtcttcatgactgggagagaagcaagcaaaattttgttaaccggaaaagatgggattgtgagtttgaatctgttttacactggccagcaagttctgggccccaccagtttgctgcaaaccactggagaggcacacaaaaggctaagaagactgattggtgaacctttatcaattgatggcctgaaaaaatatttccattttatcaatactcaggcaatggaaacattagatcaatgggatggaaggaaagtcctgtttactctaaaagtgattggacatatgatcatgagtttagagccttctggggaggaacaggagaagtttaggtcaaattttaagattatttcttcctcatttgcttcattgccattcaaacttccagggacagcattccaccgtggtatcaaggctcgagataggatgtatgagatgctggattctacaatttcgcggaggagaagtggccaagaatttcaacaggatttcttaggatccttagttatgaaacacagcaaagaagatggagaagaagatgaaaataaactcacagataaacaactgaaggataatatattaactctgctggttgccggccatgataccacaactgctgctcttacatggctcatcaaatttcttggtgaaaatccacttgttttggaacaattgagagaggaacacagacaaattgtcgccaacagaaagagtggaacggatcttacttgggctgaagttaataacatgccttacacagccaaagtgatcagtgaaactcttcgaagagccacgatactaccttggttttcaagaaaggcatcccaggattttgaaattgatggtatggctatacagaatggccaaatatggctatataatgtgtttgtgtgtgtatgttataaaattaagaaaggttggtctgtcaacctagatgttgtttctattcaccacgacccagaagttttccaagatcctgaaaagtttgatccctctagatttgatgaaacattgaggcctttcagttttcttggatttggtagtggaccacgtatgtgtcctggaatgaaccttgccaagcttgaaatttgtgtcttcatccatcaccttgtcaacagatacaagtggagacatctggagaaagacaattctgtccagccgacgcttgtaaggatgccaaagaacaagtatcctattatagttgaggcactataa

SEQ ID NO: 54869 - DNA, 276 bp, Glycine max
  Peptide Sequence Number=SeqID_171647
atgagttgctctgcttcttcgaaatttcgggatttgaggagtggccatgtaaggagggagagggttgtgccgtggagacacagtcgcccctccaactccatcattgtcgccttccttgcccagcctcactgcaatcctattgttgatggtggtagaagaggtggtgcacttggcatggtggtggagaggtggagcatgcacacaatgcaaaggtgggataaaggcgtgcgacacaatgtgatggtgggtggctgtagagtgtgcaagggggtctag

SEQ ID NO: 54870 - DNA, 1200 bp, Glycine max
  Peptide Sequence Number=SeqID_171648
atgggggcatttgaagatgtttatgcactttacaaaggaatgcctgaaatggatctggttccgaattctgtgacttactgcacaatgattgatgggtattgcaaggtaggtagaattgacgaggcacttgaggtatttgatgaatttagaaagacttcaatcttgtcacttgcgtgctacaataccattattaatggcctttgcaagaatggtatgacagaaatggccattgaggctttgcttgaactcaatcatgaaggtcttgagttggatccagtcacttttcttgcctctactctcaagattttcataaaggagagtagagctttagatgcatataggcttgtcacagagactcaagatcatttaccagtcatggagggatttttgttagatgcagagcatgtttataggaaaatggtcctcaagggctttcagccaaaagcacaagtttacaattcattacttgatggaatttctaagtttggtcaactagaaaaggcatttgagcttctaaatgatatggagacaaaatatattgagcctgacagtctgactattagtgctgtaattaattgttattgccaaaagggcaacatgcatggagctcttgaattctattataagttcaagaggaaggatatgtcacctgatttttttgggttcttgtatttgataagaggtctatgtaccaagggaaggatggaagaagccaggagtgtcttgagagaaatgctccagtccaagaatgtggtagagttaattaacacagtcaacaaggaggttgatactgaatcaataagtgatttccttgccactttgtgtgagcaaggaagggttcaagaggctgttacagttctcaatcaaattgcatgcctactttttcctgttcaaaggttgtccacttattatcaaggattccataaacaacagaagatttatgaatggaaggattttggttcaatatcttcaagcattctaccttcctcttgccaaagtagtttgaatcttggatcttgcgatgacaaagatgttaggaatcttataacaagtaatggtggttatatgacaagatcccagctgcatggctttgacttctattattctagaatggccccactttgtgccaaaggggaactgcagaaagctaatcaatcagcaaaagaatttctttctgacctgacagagtctatgaactga

SEQ ID NO: 54871 - DNA, 1179 bp, Glycine max
  Peptide Sequence Number=SeqID_171649
atgaatttagtggcacctaatctcattttaaatccacttattaaaggtaacaacgcagttttgggtgttgaggtgcaggagcaggagagtgagacaaacattgtgctgacgaagccattctctttaggaaatgggaatgaatcagattctgagctgcctcctcaattcaacttccctaagtcacaacttcagtgctatggagaatctatatattcctcaacttcagatttgctaagcaggtgtaacactgggcagagtccacttgaaaggctcatatttgttgtagcatggagcatatccaccacacgaccagcaatttttggagttgctccctacaaccccactcttggagagacccatcatgtttccaaaggaaaccttaatgtcttattagagcaggcacatgcttttacattctgttacatgctcaatgtggcttcacaccaccctcctgtatctgccctccatgcaactgatgagaaagaaaatatagaaattatatggtgccagtatcctgttccaaagttcaatggtacttcagtggaagctcaggtgcatgggaaacggcagctgaagctcatcaatcatggagagacatatgaaatgaattctcctcacctcttgatcaaaattcttccagtgcctggaattgattgggttggcaatgtaaatatcaagtgcatagaaacaggccttgtggctgaattatgctacactagtcaatctttctttggatttggagggagtaaaagattgataaaagggaagatcattgattcatcttcattgaagattctgcatgaagttaatggtcactgggatagtaccgtaacactaaaggaaacaagaagtggagaaataagagtgatatatgatgccaaagaagtcatttcagggcttcaagctcctactttgaaggatgcagagagtgtgtggctaactgaatcagctcttatttggagtgagttgagccaagccattctaagcaaagactgggaaaaagcaagagaagcaaagaaagctgtggaggaaagacagagggagctcttgagagagagagaatcaaaaggagaaacttgggttcctaagcattttattctgtctcaaagcaaagaagggatctgggactgttctcctattcaaaagtgggtcccggcatctcctattgtcaccttgtaa

SEQ ID NO: 54872 - DNA, 201 bp, Glycine max
  Peptide Sequence Number=SeqID_171650
atgtctcatacgatgcagagagactgcatagcttcggatgaaaggattaagaagctgagaatgcttgtagcggctctgaggaaagaagcacaatttaaagacgaagtccacaaggcacaacaggaagaattaaagcgccttagggaaaaaactattctttcagggaactatcctccttatggtaggcgctcctccctctga

SEQ ID NO: 54873 - DNA, 408 bp, Glycine max
  Peptide Sequence Number=SeqID_171651
atgtcactccaaatcgaccaactcccaatgatcctttatggctgtccgatagtgacatcgggcaccttcttaatgtgcccaatatctggcaggctgagcttcacaaaaagtggtcgaatggaagtggattgtaacgcaaagggagtaacattgcttgaagccaaaactacaaaaacatttggtgattatggagacttttcaccctccgagtccaccgaggaacttgttccaaaagttgattatactcaacctatagaggagattcccctactacttctactgcaattaacaacaaggttccatggaggtgaatgtcttgccattggagttgttatctctcattcattgactaatgcaaccggcatcattcacttcatgatcgatcacagatgggcaaagctgacttga

SEQ ID NO: 54874 - DNA, 1341 bp, Glycine max
  Peptide Sequence Number=SeqID_171652
atggcatttgcatataaaccattgcatcttcttttgctgttatccttctcaacatgttgtttctcatcaactagcacggtttcatcggctaaacctcggagactggtctccaaactcattcaccctggctcagttcaccatccccactacaagccaaatgaaacagccaaagaccgaatggaactcgatatcgaacactcggctgcacgtttagcctacatacaagcgaggatagaaggttctttggtctataataatgactacacagctagtgtttctccctccttaactggcagaaccatactggtcaatctctcaataggccaaccctccatcccacaactagtagttatggacactggcagtgacatcttgtggatcatgtgcaacccttgcacaaactgtgacaaccatttaggtctactctttgacccctcaatgtcttccaccttttccccactgtgcaaaacaccctgtggcttcaagggctgtaaatgtgaccctattcctttcaccatctcttatgtggacaactcctctgcctcaggaacatttggccgcgacattcttgtcttcgagacaactgatgaaggtacctctcagatatctgatgtaataattggatgtggtcacaacatcggatttaattcggatcccgggtacaatggaatactaggactaaacaatggacctaactctttggcaacacaaattggccgaaagttctcttactgcataggcaacctggctgatccatattacaattacaaccaattgagactaggtgaaggggcagatcttgaaggctattccacaccttttgaagtgtaccatggcttttattatgtcaccatggaaggcataagtgtaggggaaaaaaggcttgacatagctctagaaacatttgagatgaaaaggaatggcacaggtggagtgatccttgactcagggaccactatcacctacctagttgacagtgcgcataaattactatacaatgaagttagaaatctccttaaatggtcctttagacaagttatatttgaaaatgctccatggaagctgtgttattatgggattataagtagagatctagttgggtttccagtggttacattccattttgttgatggagcagatttggctttggacacaggaagcttttttagtcaacgcgatgacatattttgcatgactgtaagtccagccagcatccttaacactacaattagtccttcagttattggattgctagcccagcagagctacaacgtgggatatgacctagttaatcaatttgtttacttccaaagaattgattgtgaacttcttagcggttga

SEQ ID NO: 54875 - DNA, 1350 bp, Glycine max
  Peptide Sequence Number=SeqID_171653
atgacatttgcacatgaaccattgcatcttcttttgctgttatccttatcaacatgttgtttctcatcaactagcaccatttcatctgttaaacctcagagactggtctccaaactcattcaccctggctcagttcaccatccccactataagccaaatgaaaccgccaaagaccgaatggagctcgatatccaacactcggctgcacgtttcgcttatatacaagcaaggatagaaggttctttggtctctaataatgagtacaaagctagagtttctccctccttaactggtagaaccataatggccaatatctcaataggccaaccccccataccacaactagtagttatggacactggcagtgacatcttgtgggtcatgtgcaccccttgcacaaactgtgacaatcatttaggtctactctttgacccctcaatgtcttccacattttccccactatgcaaaacaccctgtgacttcaagggatgtagtagatgtgaccctattccatttaccgtcacttatgcagacaactccactgcttcaggaatgtttggccgtgacacggttgtctttgagacaactgatgaaggtacctctcggataccggatgtactatttggatgtggccacaacatcggacaagatacagatccagggcacaatggaatactaggactaaacaatggacctgactctttggcaacaaaaatcggacaaaagttttcatactgcattggcgacctggctgatccatattacaattatcaccaactgatattaggtgaaggggcagatcttgaaggctattccacaccttttgaagtgcacaatggattttattatgtcaccatggaaggcataagtgtaggggaaaaaaggcttgacatagctccagaaacttttgaaatgaaaaagaatagaacaggtggagtcatcattgacacaggaagcactatcaccttcctagttgatagtgttcatagattactatccaaagaagttagaaatctccttggttggtcctttagacaaactacaattgaaaaatccccatggatgcagtgcttttatgggagtataagtagagatctagttggatttcctgtggttacattccattttgctgatggagcagatttggctttggattcgggaagcttttttaatcaactcaatgataacgtgttttgcatgactgtaggtccagtcagtagccttaaccttaaaagtaagccttcccttattggattgttagcccaacagagttacagtgtgggatatgacctggttaatcaatttgtttacttccaaagaattgattgtgaacttcttagtggtggatga

SEQ ID NO: 54876 - DNA, 285 bp, Glycine max
  Peptide Sequence Number=SeqID_171654
atgatcaatgcaaattttgatgcctcgataaagattggtaaagggatggggttcggccttgtgttccgcaatcataagggtgaggtccttgcatctgcaactcgcttggaagatcagtgctatagcccccagattgcagagtacctagctttcaaatggagtatccagatggcgaaccaacttctgctgcagaatgattgtagagacatgacaacacatatagacactgttgctttggtacatacaaagaagataggaaacattgttgctgattctttagcttag

SEQ ID NO: 54877 - DNA, 1119 bp, Glycine max
  Peptide Sequence Number=SeqID_171655
atgactgggagagaagcaagtaagatattgttaactggcaaggatggaattgtgactttgaatctgttttacactggccagcaagttctgggccccaccagtttgctgcaaaccactggagaggcacacaaaaggctaagaaggctgattggtgaacctttatcaattgatggcctgaaaaaatatttccattttatcaatactcaggcaatggaaacattggatcaatgggaacgaaggaaagtcctgtttactctaaaagtgattggacatatgatcatgagtttagacccttctggggaagaacaagaaaagttcaggtcaaattttaagattatttcttcatcattttcctcatttccattaaaacttccggggacagctttccatcacggtatcaaggctcgggataggatgtatgagatgttagattctacaatttcgagaaggagaagtggccaagaatttcaacaggatttcttaggatccttagttatgaaacaccgaaaagaagatggagaagaagatgaaaataaactcacagatcaacaattgaaggataatatactaactctactggttgcaggccatgataccacaactgctgctcttacttggctcatcaaatttctggatgaaaatccaattgttttggaaaaattgagagaggaacacagacgaattattgaaaacagaaagagtggaacaaatcttacatggtctgaagttaataacatgtcttacacagccaaagtgattagtgaaactcttcgtagagccacaatactaccttggttttcaagaaaggcatcccaggattttgaaattgatggttataaagttagaaaaggttggtccatcaacctagatgttgtttctatccaccatgacccagaagaacccttgaggcctttcagctttcttggatttggtagtggaccacgtatgtgtcctggaatgaaccttgccaagcttgaaatcagtgtcttcatccatcaccttatcaacaaatacacgtggaggactctggaggaagaaaattctgttcaaccaacagttgtaaggatgccaaagaacaagtatcctattatagttgaggcactaaagagcaatgagtaa

SEQ ID NO: 54878 - DNA, 738 bp, Glycine max
  Peptide Sequence Number=SeqID_171656
atggaaccaaagttcatcggagaccattttacgacgatgatcttaaagaaaatgtcagagagtggatcccatcatcgacgatctcactctgactcctttgtttgcttccttgcaaacttcaacatctccaagcccccttctttgctatcgctcccatctctcattactcttgatgtcgttccgatggtcatggattcagacgaatttgatgaacaaaaaagatcgatagaaacaccaatcccaagacaccaccggagcttgtcagcgcactcttacttgttcaacaagccctgcagcgagttggagagggagttccagatgcttaagactaaagtaacttaccttacagaactgcataccatgcttcagagtggtgggaaattatttgttggaaagagcaaccctgatagcattcgtggaaatgctacacagtacggaagcatgcaacatattcttaaatgtcaaaagaagaaaaaggcaacaaacttatcaatgtctcgtatgatgcagagaaagaaagcacgtatcgatgaagagattaaggagatcacaatggattatgaggcattgaaggaaaagagtcggcttattgatgatagcattagggcacaaataagtgtcttgcagactgttgctcccggtcaccctcttttggatgtgttactggaccagtttggcatgcctccttctccctctgaacaacctttccatggacagaaccataatttgcagaagtga

SEQ ID NO: 54879 - DNA, 318 bp, Glycine max
  Peptide Sequence Number=SeqID_171657
atgatatctcgtggatattctcaccaaggtgagaaaggcttatttggattgaggcgaaggttagcacaaactggtgaggcctttgaagatacaacacagaagattgatggatcgaccaagcttggcatttggcaggaggttgctgacagtgacgaggagaggactactactttggagcaacacatgtatgctatgttggtgcacatggcaggtttggatcatcagtactcaggctcctatcctaagagtagcacacctaaacatccacactatcaagattatatggacaattatttcttggatgacaatgagacttga

SEQ ID NO: 54880 - DNA, 228 bp, Glycine max
  Peptide Sequence Number=SeqID_171658
atgtctcgccggcaataccctaagaagatatcatacttaccccggcaagtcatccttggctcaaaagcactccctctacctcttcatgcaagacatttgagcatacatcattcaacttcaacttcaacttcaactatatcacactcttctaaactcatgcacatgtcaaaccctttgaataaaataatatataagaaggaaaggcagcgagataatagtaatggttag

SEQ ID NO: 54881 - DNA, 702 bp, Glycine max
  Peptide Sequence Number=SeqID_171659
atgaaccagaagttcatcggaaagccgccggcgacggtggacctggatcggatgccggagcgtgggtcccaccaccggcgttcccactccgacacctccttccgcttcgccgcgaacttcgacgaccttctcctcttcgacccctccgacttcgacatctccggcctcccgtcgccgctccctctgccatctccggtctccgccggcttggttccgatgtccgtcgactccgacgagtccggcaaacagccgaggccggccggggcgtccgccggcgggcacctgcggagtctgtcggtggattctgacttcttcgacgggctcgggttcggcggcgacgagagaggcgccgggaaaggaggcggcggcgagcggagggtggggcaccaccggcacagcaactcgatggacgggtcgtcgacgacgtcgtttgaggcggactcggcgatgataatggacggtgtgaagaaagctatggctcctgataaacttgctgaacttgctcttatggatcccaagagagctaagaggattcttgctaacaggcaatctgctgcaagatccaaggagaggaagattcgttacacaagtgagttggagaggaaggtgcagactcttcagactgaagcaactaacctttctgcacagcttaccatgcttcagtgtttgatggagccccccaacacactaactatgatgtag

SEQ ID NO: 54882 - DNA, 543 bp, Glycine max
  Peptide Sequence Number=SeqID_171660
atggcacagaaaagagtttctcatgtgcttgtatgcagagagttaaagccacacctgctaatggtcatagtccaggtgggctataccttcttatatttcatcactgaagcctccttcaatcatggtatgagccctcatgtgtacgtaacctatcggcatattctggctgcggctatgatgttcccttttgcatactttttggagagaaatgcaagaccaaagctgacatttgctcttttcatggaaatttttgtgctttctctgttagggtttgaggttcttgatcttcgaaatcctcgtggtatagcaaaagttattgggaccatgatctccttagctggagttttgatcatgacactgtacaaaggaccagttatgagaaatttatggcatcctctaatccatattccagggaaaagtgctgctataaatgaagactggttttcacctaaactcagtcaaaactgtttgacgtgggagcttctagttttagcttcattttttctcatttcttacgcatgtttatggcctagcaatgcataa

SEQ ID NO: 54883 - DNA, 252 bp, Glycine max
  Peptide Sequence Number=SeqID_171661
atgtatctagattctaggctactgcacactgatctgaggctgaaccaaccaaggtatgctactcttcccaacataatgaaagcaaagtcgaaacccataaaaaaattcactccggaggagttgaatgtggaaatcaaatctgatttggagattgttcaagtcacagaacctcccaagagaaaagcaggggttattctttcttctgtggatgagctgattgacaaactaaaacatgaggctaatgtcatctga

SEQ ID NO: 54884 - DNA, 213 bp, Glycine max
  Peptide Sequence Number=SeqID_171662
atggggtggtggatacactgtggtagagggggtcgcgtgtgcaatggaaggggaaaaagggtggcgcctctagggaaggggaatgagggtggcgcgtggggaaagaggtcttgtgtggggaggaggaaggagaagaagggttgggcacgactcaggggaagatggacaagggttggtggctcacgggaagggaaaagaggaaggtttacatag

SEQ ID NO: 54885 - DNA, 315 bp, Glycine max
  Peptide Sequence Number=SeqID_171663
atgtcaggatttacacgcgattctcctcaaatttcagccagcccgcatcaattagaccttgcaccttacgcttcagagccctacaatgctcaatggaacaccctggggcttctccatgacaagcacacgttgcgttcgagtcgtattctcggggaaatggaggctttctcgttgcataattcatttcttggttggtgtttctggtttgtgccaaaggtggtgttcatcattggaagtgcggcggtgggtaaggataaggtttgtcattggttgagtaatgacattgtcgggttggtgggaaatttggccatatag

SEQ ID NO: 54886 - DNA, 561 bp, Glycine max
  Peptide Sequence Number=SeqID_171664
atgagaccccgagggacaaatggacgaatgatcataaatccagatttcttctcaactcatgctcaagaaacactttgttgtgtgctctatcataaaaagaatattccaaatttatctagaaagtggagaccacaggttatagccttaagagccatcaagaatcttgattcaatgactcttgaagagctcgttgggattcttaaagtccatgagcaagaactttctcaagatgaaggaaccaagaaagggaagtcgctagcccgcatggttcaaagaccaaaaagcaaccttgtgtccaaggagccatcgtccaaggcccttgtttgcaagaagccaggacacttcaagtcaaaatgtcttgactttgaaaagtcaaaggataagaggaagaaattcttcaagtccaataagaagagcctcatgagcacttgggaggacttggacaattcatcgtttgatgaggatagtgaggaagaagccaacttgtgtctgatgcctgatgtgtccaccagtaaagctgaaccaacactggatgcaagttcagatgatgaggatcattag

SEQ ID NO: 54887 - DNA, 864 bp, Glycine max
  Peptide Sequence Number=SeqID_171665
atgtcagagttggatgagtcctttgcagagatgaagataaaggatatcgttaagtctgctggtaagattgtaaggaacaaggctaggcttgtagccaaaggttactcacaacaagaaggtatagattataccaaaacttttgctcctgttgctcgtctagaggcaatacacattttactatccttttctactcatcatggtatgatgttgtaccaaatggacataaaaagcacattcctcaatggactaatcaaggaagaggtctatgtgaaacaaccccatgggtttgagagttatatctacccttatcatgttttcaaacttaacaaagctttgtatggtttaaaacaagctcctcgagcttggtatgaaaagttaatttcatttttaactgaaaatggctttataagaggaaaggtagacactaatttgttgcacaaagattatggtagtcaattcctaatcgtccagatatatgtggatgatatcatattcagtgccactaatgactctctatgcaaggattttccaagcttatgcagagagaaaaaagattacaggttgcctggttattatgatgcggattttcctgaagatagagtggacagaaaaagcactagtgaaggatctcactttggtggatggttggtctcttggacgaacaagaaacatggaataatagctctatccattgcagaggcagagtatatatcagctacaagttgttgttctcaacttttatggattaaacatcaactcgaggattacaacttgtttaagagtgaaatttctaccctttgcgataatactgctgccattgatctttctaaaaaatatcatcatgcattcacatgcgaaacatag

SEQ ID NO: 54888 - DNA, 495 bp, Glycine max
  Peptide Sequence Number=SeqID_171666
aaaaaagacagctccgaagtcaataacagaaagagtcctctggaggctcaaaacaaagcccggcttttagcagaatactatgataagacaaaaagtccttcaggttcagatctggattttgaagccctgttttcaggaaaaaccgatgaagtgaatgaagaactttgtaataaaggattagcaaaggcctgcatgaatctttttggactcaaaatgatgaagtatactcccggacttttgaccaaaccggagaaaatcgcctcaaaaaaaatacaacctcatcctgaattaattgccctgtcaaagaaaataataaacatgggagagcctgaagggtatacggttctgggaagctattattatacattaggattaaaagaaaaagcttttaaaacctgggatgaaggagaaaagaacggaagcttaaaatccggaaccaccaaagcccttattgaatttcaggaagaactggaaaaagaggccgcaaaagaataa

SEQ ID NO: 54889 - DNA, 198 bp, Glycine max
  Peptide Sequence Number=SeqID_171667
atgacaatcaattcatggggctccgaacttgatggtggaggacgcacaaacagcgctaggcaatcaattcgtggggctccggactcgatgcgcaaggcaatcaattcatggggcttcggactctatggtggaggacgtacgaacaacactaggcaatcaattcgtggggctccggactcgatggtggaggatgcatga

SEQ ID NO: 54890 - DNA, 299 bp, Glycine max
  Peptide Sequence Number=SeqID_171668
gtgatggttttggtggagttggaggtgggttgggtgttgaaggtgtggagagtagtgcatctgtggtggtcgtaaacgttgatttcatggacggtggtggtacaaagaaggtgaaggtttgtggagagaggttttggagagtggggatggatgagagggtttgtatgaagaggttgctttcgagggaggaagtgttgttgttgagggttgttgaagatggtgcttcggaaatggaggagtgcatgatagaatcatcacatgcatgctgtttttgtttggggagtgagattgttgagtag

SEQ ID NO: 54891 - DNA, 303 bp, Glycine max
  Peptide Sequence Number=SeqID_171669
atgaccgcatccgcatgctttggaaccgcttatcatgatggggattgcaacgttgttcttcgggaggagaaaacgacgcaaacagtcgttgatggtggggagagtggccagcatgtggtggtggtggttcttgtggttttgccacacgtggatcttgcaatcttggtgggtggtgatgactgtgttgttgttgttgttgaaggtgatggttttggtggagttggaggtgggttgggtgttgaaggtgtggagagtagtgcatctgtggtggtcgtaaacgttgatttcatggacggtggtggt

SEQ ID NO: 54892 - DNA, 624 bp, Glycine max
  Peptide Sequence Number=SeqID_171670
gctgatgttgatgggaatggagtacttgactatggagagtttgtagccgtgacaattcacttgcaaagaatggagaatgatgagcatttccgcaaagcattcatgtattttgacaaagatgggagtgggtatatcgagttaggtgagctggagaaagcattaacagatgagtcgggagatactgatactgctgtattgaatgacatcatgcgtgaagttgacactgacagggatggtcgtatcagttatgaagagtttgtggccatgatgaaaactggaactgactggagaaaagcatctaggcagtattcaagggagagattcaagagcttgagcataaatttgatgaaggatggctcacttcagcttcatgatgatattagtggtcaagctgtagtgataagggctcttcttgtgcatcaaagtctcaaagatgctatgaatggtgaaaccaatcttgatgtgaagatggaagataaagacaagaagatcttgctcgacaaagcacatagcaccatcatcttgagtctgggagacaaagtgcttcgacaagtctccaaagaaaagactgtagccgaaatttggtcaaagttcgaagacttgtacatgaccaaatctctataa

SEQ ID NO: 54893 - DNA, 3282 bp, Glycine max
  Peptide Sequence Number=SeqID_171671
gccttggatgatgaaatctttcccagaattgcctcagcaaccacatccaagatgacgtgggatactctaaagcaagagtatctaggtggcaagaaggtgattacagtgaggctgcaatcactaaggagagagtttgaaacagctctaatgacggacaaagaatctgtccaagaatacttgtcacgtgtatccactgtagtacaacaaatgcggtcatatggagaaacaatgaccaatgagcatgtggttggaaaagttctaagaagtctcacaaacaaatatgaccatgttgtagcagctattgaagagtcaaaggacatggcagattacacctttgatgaactcatgggatccttgcaagctcatgaggagaggctcaatagaaatggtgagaagaaggaagagaaggcattccatgtgaaaggagaatcctcaaacaaggaaaagacagggcaattcagtggaagaggtagaggaagagctggctcaagaggaaggccaggccacaaagaagctagctgctggaagaaggaggaggatgaacaaaagggtgatcaaaagtccaattttgtggagaatgagcaaaagttgttcttagcacaaagggcagctgacaatgatgcaggaggtgacgtgtggtatattgacagtgggtgctccaaccatatgtcaagtgccaagtctatgttcagagaattgaatgaatctttaaagagcaaggtgaggcttggagatgaaaaacaacttgaagtggaaggaagaggcatgattgcaattaaaactgagcaaggaaacactaagctattatatgatgtgcagtatgtgccaaatttggctcactatttgctgagtgtgggtcaattacttaattctggatattcagtactgtttgagaatgatttctgtttgatctgtgataagaaatccaaagaagttgtagtaaagattgttatggggagaaatagaatgttccctcttgatttatctggcaatggactgaagcttctgagttccaaagacatggtgcaagggctgcctaaaattggtgagcttgagttgtgtgaaggatgcttatatggaaagcagtcaaaaagatcatttcctagtggcagagcttggagagcaagtgaaagtttggagctactgtatgctgatctctgtggaccaatacagacaatttctcttggtggaagtaagtatttcttgcttataattgatgactacaatagaatgagttgggtctactttctaaaggctaagtctgaagcctttgaaaactttaagatttttaaggctatgcaaggaataagaagagaattgactgcaccatatactctagagcaaaacagagtagctgaaagaaagaacatgactgttgtagaaatggcaaaaagcatgctcaaagctagaggtgtaccaaacaacttctggtgtgaagctatagctactgcagtgtacatcctcaatgtctctcctacaaaggcagtcatgaacatgacaccatttgaagtatggagaggagaaaaaccatctataagtcatttaagagttttcagttgttcaacttatgctttggttgatttgagatctaaactagatgataaatctgtgaaatgtgtattcattggctatgctgctcaatccaaggcatatagattgtataaccctcttactagcaagattatggtcagtaggaatgttgtgtttgatgagaatgcaggctggaattgggagcaaagagaaagttgtgacagtattcagcagaaaatagttgggactgatagttcaggggaggactcaattgtgccaacaaatgatcagcagtctccaagtcctcctacaacaccatcatcttcaaatcacagctcatcatcttcttcatgtccttcatcatcaagttcatcgaatgattctgcaccaagaagatacaggactcttgctgacttgtatgcaaactgtgactttgcactgatggcagcagatccaaccagttttaatgaagctaaagatgaagttgaaaggcaagatgcaatgaaggaggaaatcaagtccattcaaaagaatgagacttggaaattggttgatcttcccaaagagaagaatgttattgaacttaagtgggtattcagaactaagttcaatacagatgggagtattcagaagcacaaagccaggttggtggcaaaagggtatgcacaacaagaaggaattgattttgaggagacattttcaccagtggcaagatttgaaactgtgagagtggtattagctttggctgctcaatggaaattggatgtgtttcagttggatgtaaaatctgcatttctcaatggagacttacaagaagaagtttttgttgagcaaccactcggctttgtcaaagatggtgaaggaggcaaggtttacaagctgcaaaaggcactttatggactgaaacaggctccaagagcctgctcctctcagaagctgctaaatgagttcaaagcatcaatgatggagcaatttgagatgacagacttgggactgcttcaaactcctatgaatcctaatgagaagctgcagaaggaggatggcacaagaaaagctgatgaaaagctgttcagaagtcttgtaggaggtctgaattatctcactcacacacgacctgacattgctcatgatgtaagtatggtatctagatacatgcactctccaacaaagcaacaactaggtgtagcaaaaaggattctgaagtatgttgcaggatcaacttgttttggaatcttgtatgaacatatcagtgaattcaagttagttggctacatagacagtgactgggcaggcagtttggatgataggaaaagtacattagggtcagttttcagttttgactcaggagctatcacttggagctcaaagaagcaggatattgtggctctgtcatcatctgaagcagaatatgtagctgctagtgcagcagcaagacaagctgtttggcttagaaagttgttgaaagatttatgttgtgagcaggaaggagcaactgaggtatggtgtgataataggtctgcgattgctatgacaagaaacccagcatttcacgcaagaaccaagcatattgaagttcagcatcacttcataaggaagcttgtgttagaggaaacaatcgctctaagattctgcagcacaaacgtccaaaatgcagatttgtttagcaaggctttagctcaagccaaatatcaattctttatggagaaaattggtatgtatgagtttgaattaaggggaggtgttgcaacataa

SEQ ID NO: 54894 - DNA, 963 bp, Glycine max
  Peptide Sequence Number=SeqID_171672
atggggcacaaaaagcgaaaccctgcgccgcgctcgaaacaatccctcgcggccgccaccgccaacggtggtgccacctcgccggacgccgacaccgcctgcaatgtttccgatcacaaccctaggaagatcgaattggccacgctccaatccgagggttccgattactccacaatcaagctcgaatgcgagcgcgcactcaccacgctccgccgcgggaaccacaccaaggcaatgaagcagttgaaggagatttgcgccagagaggagggctcgcctcacgccgcgttcgtcaaccgagtccacagcctaatgtgcttcaagacggcgacggtcatcaccgacccgagctcaaagcagcggcatttgaggaacgcgctcgagtcggctcggcgcgcggtggagctcatgccgaattccgtcgagtacgcgcatttccgcgccacggtgatgttggaggctgcgagtgaagggaaggattatgaggaggtggtgcacgagtgtgagagggggctcgccattgagaaccctagtgatcctgcgaaggagacattgcaggatgagagcgagcagaaagcttcttctcttgaggaacggattgcgcacgtgcagaatgaattgaggcagcttattcagaagtcgaatatagcatcgttgtcgtcttggatgaagaatttgagcaatggggaggagaggtttcggttgattccgataaggaggaccccggaggatcctatggaggtgaggctggttcaaacaaggaggcctaatgagatcaagaaggtgaccaagacacctgaggagagaagaaaggaaattgaagtccgagtggctgctgctaggctgattcagaaaaattcagagtcgccacaatcggcgaatgagggagatagggatgataggcagttggattcatctgcaggatctggtcagaggattggcgataggaggaggcatggaaac

SEQ ID NO: 54895 - DNA, 282 bp, Glycine max
  Peptide Sequence Number=SeqID_171673
atgacagtatggaatacaacattttttggcttatggaatgaccagaaggtaaaacaaaacattctagaaaggatgcaggaagcatcttggagcttggagcacaaggaagtaacaatccaagattgcaaagcatccacttctttggttgggtggcggcatgatggtaagtttggtgaggtgtggaggtggcattgggtggttgcggtggtgatgtttgggtgcaacgatggtgttgggtggaggtggagtgtggtagtcatggaggtttggagggagagctga

SEQ ID NO: 54896 - DNA, 207 bp, Glycine max
  Peptide Sequence Number=SeqID_171674
atggaagaaaacaagaataaggtagtgttggggatccaaaggatggaagctcctcaatttactgttgcacaaaatctgccatgcagcacgttccaacacagtgatgctcggtaccaaacactctgggctcttctaagtcatcctgttacactaaatgcatttgtcatcattatccctcgccagaacctgctcctattaaaaccctga

SEQ ID NO: 54897 - DNA, 3570 bp, Glycine max
  Peptide Sequence Number=SeqID_171675
atggggagtctttcgccacaaatgcagagacttctgccccacaatgttgatagtgaatggattgagatgattcttaattgttcttggaagcctctggatatcctagctgcagttagaatgctttataataaagcaaagttcaaaagttcttcacttcctgaggatttgtacttggatcatcatgctctggactataatgattgttttaaagatgcaagcagctcttacattgagaaggaaagttcgggggacagtcttcctaattgttcagtagaatgcaacaaccattataaaattatagaaaatgatgtaagagaaggtgttgaagaccaactttctatggctaatcccattattgactgttggccggtatctgatgaccctgagcgtgcaaaactcctggggaaaattcatgccatttttgagactcttattaagcacaaatgtcttgccgctagtcatcttaacaaggtcatacagttcactatgggtgagatacagggtcttgctgctggttctcaacttctgaatcatggtgtggaccaaacaccaatgtgcatgtgctttctaggagctacacagcttaagacaattttccaatttctgcaggaaatatctcatgcttgtgggttggccagaaatgctgataaaggtggtagtcccacaaatgatttgctcaatatcagtcaaggtcctgagattaaagacaagattgtacttgatggagatgcatcatgcctcctactggatgagtgtttattgcaaacacaagtcactgctggtacagttcaggggactgtcttggatgatgtgaccaccccaagctctcctgatggaatttcatgctataacgatgctttgctatcctggatattttcatgttcacctatcggggatcagttgacatcatggctacggaccagagaagataaactaaataaaggaaaggaaattgtacagttgcttgagaaggagttttatcatctacagggcctatgtgagaagaagggtgagcgtgtaagttatgaggaagctctgcaaacagtggaggatctttgtcttgaagaaggtaagaagagggaaactgttggtgagtttgtccagcgaagctatgaatctgtcttaagaaagcgaagagaagagctcattgagagtgagaatgacatgatgtatgtcagcaataggtttgagttggatgctatatcaaatgttttgcaagaagcagaagcaagaaatgttaatcaatttggctatgaagaaacttatgctggtgtgacttctcagttatgtgacttggaatctggtgaagaagatgaatggagaatgaaggattacttgcatcaaatggatggttgtatagaaaatgctattcagaaactgaaagagcatttatccatagagcttagcaaaattgatgcccgaataattagaagtgttacagagatgcagcaactggaattcaagcttgggcctatttctgctaatgactatcgagcaatattagtgcctctagtgaagtcgtaccttagggctcttttggatgatttggctgagaaggatgcaagagagaagtctgatgctgtaagtgaagcacttttggctgaaattgctcttgattccaagaaggctgttaaggggggaagtgagagcacaaggcatgtcgagaaaacaaaagataagaagaagaataaagatcacagaaaagcaagagatttgaaggtcgctagtggtcatgcacagttctcacttggatcaacaactcctgattccaatctagttgcacctgaaagtgacttcccagataatgaggttgttgctatgaacgatgatgacttggaacaacttgaagaggaatttaggcgtaagattgagttagaagaggaggaaaaaaagcttgaagaaactttggaatttcagcgaaggatagaaaatgaagccaaacagaagcaccttgcagagcaacaaaaaaaatcatctgggttatacttggaaggagtggtagacaaacttcaagattctgaaacaaaggtggatgctgatccaccagatgctcatgaacatgttggagtacttgtgcaggaccagctggtaaaggagaatggatcccgaagcaatttggatgcaggtttgcctaatggagttgttccagagaatggtctagatcgccgtgcaggaaaaaaacataaacggaaaaattcttccagacaagttgatggaaagtttgaacctgtttcatcaggacaagagaatattgaagatacacatactgattatcacctgagagagcaattcaaacttaatagcaatcaagatgttaataatgtgtggcaaaacaatggatcaaaggtgatgggagagttgcaagtagaagatgcagaggaggaaagatttcaagctgatcttaaaatggctatactcttatcagacacgtatcaagctcgtggaaatttgcattcagtttccagtttaagaatgccacagagagcttcttcacaggaagatagtgtggattgtctgcctgtggaagactcaactgataatgtgaatggggctacattgcttggtactggactgaagaatgaagtgggtgaatataattgttttctcaatgttattatacagtcactatggcatttaagacgctttcgggtggaatttcttggcagatcaagatcagagcatgatcatgtgggtaatccttgtgttgtctgtgcattgtatgaaatctttactgcactggacactgcatcaaaggattcaaggagagaagcagttgcacctacatccctccggatagctctaagcaatctgtatcctcacagtaatttcttccaggaggctcagatgaacgatgcttctgaggtactgtcagtgatatttgactgcctccatcggtcatttatttgtggttcaagtgtttctgatgcagaatcagctgaaagcaactgcatgggatcttgggattgtgcaaatggtagttgtatagcacattcactttttggaatgaacattttcgaacaaatgaactgctatcactgtggtcttgaatccagacatatgaaatatacttccttctttcacaatataaatgccagtgccctccggacaatgaaggatacgtttgctgaaagttccttcgataagcttttgaatcttgtggagatgaatcatcagttggcttgtgatctagaagctggtggctgtggcaagctcaaccacatccatcactttctctcaactccaccccatgtttttatgacagttctaggttggcaaaatacaagtgagagtgccgatgatataacagagactctggctgccctaagcaccaagatagataccagtgtcctttattgtggtttagatcctaaatgcgtccataacttggtgtcagtggtttgctactatggccagcattatcattgctttgcttatagccatgaccatgaacagtggattatgtatgatgacaagactgtcaaggtaattggtggatgggcggatgttcttacaatgtgtgaaagagggcatctacaacctcaggttcttttctttgaagctgtaaactaa

SEQ ID NO: 54898 - DNA, 510 bp, Glycine max
  Peptide Sequence Number=SeqID_171676
atggggacaaaccctttgttgttactttcttgctttggttttctggctcttgaaatactcactggctgcttcattctcgtccagggaaacacaattgctgttatgggttcattcataggattgaagcaagtcagaagaattgttgaagaatgcatgatgaataaaatgcatcctgtatacaacattaagagtggcagtaagggtgacttatctgtcaacttttccactattacacccaaaaaaccaaactctgctttacgtaaagttgccagagtacgcttaacctttggatttgaaattactgcttatatacccggtattgaccataatttacaagaacattctgtagtcttagtaagaggggggagggttaaagatttacccggtgtgacatatcacattgttcgaggaaccctagatgctgttggagtaaaggatcgtcaacaagggcgttctagtgcgaatccgaatctgattctccaagttggagaaaatttaactccgacatga

SEQ ID NO: 54899 - DNA, 162 bp, Glycine max
  Peptide Sequence Number=SeqID_171677
atgttagatgcgttattggctgaagagagatattctgatgagctttctggtcaaactcaggttatattatgtaacgactgtgaaaagaatggagaggctcccttccagtggctctaccacagatgccctagttgtggttcctacaacactagagttctatga

SEQ ID NO: 54900 - DNA, 392 bp, Glycine max
  Peptide Sequence Number=SeqID_171678
atggatgaagaagggtcgagggggagggctaaggaggatgccggagatgtccggtaccggggggttcggaggcggccgtgggggaagttcgcggcggagattcgagactccacgaggcagggtcagagggtgtggctggggactttcaacactgcggaggaagcggccagagcctatgatagagctgcttatgccatgagaggtccatttgcaatccttaactttcctgatgagtaccctatgactgctggtggtgccactaatgctgccacttattcctctgctgcttcatcatcatcctcagcctcttcttctaggcatgccaatgtggaagctagaggaagaagtgagcaaggaagggaagtgtttgagtttgagtacttggatgacag

SEQ ID NO: 54901 - DNA, 1782 bp, Glycine max
  Peptide Sequence Number=SeqID_171679
atggcactcacacgcgatacttggataaccgtattatgcaggaaattgagagattggtggcattgggttgccgatggggatcttccaattgttgcttcacatggggtggagattgaagaatataaatcacttgatccaggggtccgtgttgtcatcttaaaagcattatgtgacattcgtgtggagcaagaagatatccgaagttatattgacaactcaattaaacacggtgttcagctttcaacattccgtaaagagcgtattggaggtgattcacatggaatttcttattggtatgaagatgaccccattattggtcataggttgtatcgagaaaaaaggaaaactgaagtggttcaaatgaagaaagggaaaccaagaggttcccaggttctttctaatacatcataccagtgggaagcagttgctaccaattttgatgaatttgaagatgtttctgagaagcttttctcaagtaaaaacagaacagaggcttccatgggaaaaaagctgaagatagacatgcttcctgaaattgagaaagttcacaagaaaaaggagaagttgctgaaaaagcaacacagacaagctcttctgcttgagaattacttggttgttgacgggcttggtcctgggcgttctcttcgtgacaggaaacctgttacctacacttttgatgattatgatcggtcaatcaatgaggcaattaaagtaaccaagtatgcacttatatcctttctctctttgtcatgtatatgtggggaaggagatgggttggtaatattcattcgtttgttccgtgtactcatggcttatgtatctgtttcttccattttcaggcagaaacagccatctccagaatgtatgcccaggagagaatcagtagcaaaagctgaagctttgtctaatggtaaatatggtcctccacatgccacacaagatcggaattttggtataccatctccagaatcatctgattctgatgatgacaaagaagataatgaaactgacaacttggatcgaagcaatcgtcaaagacggagacctaaacggtattcagaaagagagtttgttgaagcagtatcagataatgaggcagacttcgacagtgatgatgatattgttggagaagccgtatatgatgaagaatatctcaagaaacgcaagcagaaaaggatgtcttctagtagctctgaaggagatgaagaatatcagtgggacgaatacaatgttgaagatgaagaagaagaagatgatgacgacgatgacgattccttgagcatcagtgaggatagtgacaagcctcgtaaggtcaaacagctgcagttgcatggtcgtacaaggagagaaaccaaactcaggtctgtgggtgagatacaatcgggtctaagacgtagtaagagggcaactaaaaatcgtataaattaccgacaatgtgaggtatcagaatcagaaacagagtttatcaaatctgagaagtctaattcatcagctgatcactcagatcccaatgagaatggtgaatacatgatggaaagtgaagattcagatgacagtgataatgaagaacaagaaatgaaagtagatgaccctgttacatatcctgcagtagaagagaatgaacaaaaccagcctcctgaaaaattaagtagtcctggtcaggaggaagttgagagcagcacaggaaagagacgcttccttgatttgaatgagcttgcccctagcactggtttcgatgatggtccgaacacaataatgaaagatgaagacaatgattactga

SEQ ID NO: 54902 - DNA, 1611 bp, Glycine max
  Peptide Sequence Number=SeqID_171680
atgaagacgacgaagggcggcaaggtcatgaaccctaccgatgcttaccgaaaggagcttcggaagaaagaattgaaaaggaataagaaggaaagaaagaaggtgagggaggtggggattttgaagaaagatcctgatcaattgaagaagcagattgacaacttggaaatgatgaaggctgatggtgctttggataaagcaagaaagcacaagaagagacagctacaagatacacttaatcttgtcataaagaagaggagggaatatgaagacaaaatgcgggaaaagggtgagaccccagttatgttcagtcatttggggcctcctcgaaggagaacaactgcagaagaagaagagagggttaagcacccgaagcctgaggactctgtttattatcatcctacattaaaccctacaggggctccaccaccagggaaacctcctatgtttaaatcatctataggacccagaattcctttgtctggtgctgcatcatcctcggcaacagatttggagaatgatgtattaactgtaccaccacctcccccgccgccaccactgcctgatggtagcagtgcgagttcagcagatggtgccgttttatctgcatctttgccattgccccctccccctcccatgcctccaaagcctgctactgctgtgcctacatcattaccaccacctcctttgcctcctccacctcctggtcccccacctaaagaacaagttgcaaatcgcactcttccccctccacccccgcccctacaacagtctcaacctcctccacctggtaccagtggaggtgaagggagaaatcagtctgcatttgcattgatagatgattcaccttccaaggagcctggccagcttcctccacctcctccacctagtcaggtgccacccaaggctggtgctatccagtctgatggtgctgtgctttctactgagaataagaattcactgtcaagccaggagatcccaaaaatggttgccgggcatcctcctccaaggcaacaaccccctgttccaggacccaccttaatcccaagtttacagcctgatgtattactccctggaatatctcgtttccctccacccccgccaccacccgatatgagaccttctttgtccgtcacagggctacatgctcaggcaccacctcctggaatgatggtccccctaatgccaaggccaccatatggtcctccacctggtcctcctccaatgatgagacctccacttcctcctggtcctcctccaaacttccaggaagaggatcatatagcaactaggccacctcctcctcctccgaaaccatcatatgttaaatctgctgcttctactgttgttaaaaggccattagctcaacacactccagaactaacagccatggttcctgcatctgtgcgagtgagaagagaagcggcaatgtctaaaacaaagccaaaaccggcagtgtcaacctctagggcagtctctggtacatctggaccaactattgtgaaatcagagtcggtgagcttgtcatcagctccaaaaacacagagcattgatgactcatatacggctttcttagaagacatgaaagcccttggtgcacttgatggttga

SEQ ID NO: 54903 - DNA, 768 bp, Glycine max
  Peptide Sequence Number=SeqID_171681
atggcaactgaaccgagtgagagcacacaaaggaacacccttgtcgttagaaagccatgttttggcctcccaacaggttgccctcaatgcctctctgcttacatttttctcaagctctctcaagttcccttcaacttggattaccaccctaactaccctgattctgatcagattccttactttgaggatggtgattctgtgacatacaataatgagaaggaggggatcattgagtgcttgaaaaggaatgtgggtggtgatttagatagtgaggtttcttctctccctgattggataccaaccaaagtgatggccaccacttggcttgctgatgcacttgagtatgaactgtgggtgggatgtgatggttcctctgcttatagcatctattattctgatcttccctggcctatcggcaaggttctcttttggaagaaagcttattgggtaaagcagaaacatgggataagtgaagagaatgtagaagtaaaggaagaagagatttatgggagagcaaactctgcatatgatgctctgtcgacttggttaggggaacaaaactacctttttgaaaacaggccatcgagcttggatgctatttttcttgcacatgcattagttgttcttcaagctttacctaagatcttatcgaaaaagggacctagggcacctggcttgcaagtcctacctagttggatcagggaggaagggggatttaatatatgcagcattacccctgaaagccaagaggccgtttccaaaatgtga

SEQ ID NO: 54904 - DNA, 594 bp, Glycine max
  Peptide Sequence Number=SeqID_171682
atggcctacaaaaaagagggggaacttgatgctgttgcagtagttcattcctatgcggaaaaagtgccagctgtgtctcacaagacaaggctttctgctcttaatgttcctcctatgggattgttctatccaacacttttaactcctgatgtgtatcctcctccgccccgtacttggtttcacgactatgaggatatgcttgaagatacatggcatattgacttttcgcggaggtctgacatgccagatactttctatcccaatgttaatggaggattaccaatgtgggaaagctatccagttttttcaactaagccaaaaaaagaagagaaagttggccttgcagaggctattactaactgcattctctcaactggtcgcatagacatccagagaaaattattttgtagcatacaattggaattgacacatttttctggaatagactggtggggtggctttgacaagtggcttagttgcagcagtagaagaaagctgatggatgaatccactattcttttgagtctcagagttttacatgccattcctccaaatgaagcaattgatactgtggaggtgtgcgtacaaatctga

SEQ ID NO: 54905 - DNA, 289 bp, Glycine max
  Peptide Sequence Number=SeqID_171683
atgccatccataatccattcatccaatccaatgagtcaaagcagccagcgaagcgaagccgagtcacgtcaagccgagctgtattgcagccccctcctccctgcaaataaaccgcgccgtcgagtggaacgtcgccatccccctcctctcgccgttggcatcatctccgacgccgatcgagctaaaaccgccgcaagagccgccgcagagggagccggagaaggtcaccttgtcgttcaagaagtggcagcatcctgcggctcccttctgttacgagcccgctccaatg

SEQ ID NO: 54906 - DNA, 600 bp, Glycine max
  Peptide Sequence Number=SeqID_171684
atgactttcaatgtacctgatgtgcagatgggacgtgttgatggacacaatcctcatatcaggaaggatttgccgttgacctggactaatgtctatgaggaggccactaattcatctgtatcattagagacttcaagtaaagatgagactggtcagtttttggatccaaaagaaggtacacattcaaaggaacctaatgcaagtgaaagaaaattcaaagagttcatttgtggtgaggaagcattaagaatatccccaactgaaccatattgtttttgccatccaattcgcagaggacatttgaacatttcacaatattattccatgcagcaggtacttgaagatctacatactatttgggactggattttaatagagaaactgcacattcctcacaatgaaagaaatatgtattctgctgttcttgtgatgccagaaacatttgacaatcgtgaaataaaagaaattctatctttagtactacaagaactccgctttggctcagcagtggtacaccagatggacactggtatcatcggcaagcctcattctcaaggagtgggttcagtccctcaagattggtatcaagcatgttggtaa

SEQ ID NO: 54907 - DNA, 330 bp, Glycine max
  Peptide Sequence Number=SeqID_171685
atggattaccttaagtccgcgcttccttctcaaataatgtcagaacgaggctccaatctggttgttatcaacccaggttctgcaaatgttaggattggcttggcttcacaggacaccccttttaatattcctcattgcattgctcgccataccaaacaaattcctaactttactgttatagatcagatgcttaatagtatggttacaacaacacagctcatcgaaagggaaaaagcttatgattttattgcaccattgttgaagataccgtttttggatgaaggtcccggtaactctttcccccgtaagactttctttggatctgtttaa

SEQ ID NO: 54908 - DNA, 216 bp, Glycine max
  Peptide Sequence Number=SeqID_171686
atggcaaggagcagaatcgtctcaggccacggtcagaagtcaagacaagtcaatggcagaaatcaaccaaggtacatagggacggatgcaagtggggctagggtcacaaccgaccgatcgttgccccttcccggcgctaaacaagcagagaaggtcgttgtagggcagcccagtatcctttgcgttcgcagtttcttttactattgtttgttttaa

SEQ ID NO: 54909 - DNA, 2368 bp, Glycine max
  Peptide Sequence Number=SeqID_171687
aagtgagtcatccacttcttctttctcttcttcctcttctgcttccccggatcgctctcattccattagtctttctcccccggtgagtataagccctagaagatcactacccaagtcgccggaaaataccataactcatcattcgtcgccgccggaggaggcggcgattagaagctccgcgtcctcgtccacactgtcgtcgccgtccccggttttcgggcagcacgtgccgtcgtcgccgtcaatgtcgtcgacgccggagcggagggagtgtcagtctccgtcgctgtcgccgctctctctgtcgcctaagaaaagccaaaccccagatggagaatcagttccaggacttgttgtgcttgaaaagacgcaatcttttggttcgtctaagtcgaaaaacgaaagtgggtcaccgagattgtccaacgcctcttccattgggaagtcctcggcgttttctctgccgtcgccggataaagggatgaccttgcatcatgggttggatcagtctccgacaatatccgatgtttcagatcggtaccgacattctcctctctcatcgttgcatttgtcgccgacgctgctttcttcgccggagagagagttgaactctcagcctcagcctcagccaccaccttctcggaaaaactgggagattcctgatttgttgacaccaattggtgaagcaccgaatttttcagctccacagaggaaacaatgggaaattccggttctttcagtaccaattgctccatctagtagtgttttagcccctcctcctcctccgcctccaccgccgccaccgccaccactggcggttccacggcagcgtaagcagtgggagatgccgtctcccttgacgccggtggatcaaccggtgtcgaggccgccgccgctgacgccaccttctaggccttttgtgttgcaaaccccaaacacaaaggtttcaccagttgagttgccacctgctagttctcagaattttgaggagggttctgaagagacatctaagcctaagttgaagcctttgcattgggacaaagtgagggccagctctgatcgtgagatggtgtgggatcagttgaggtccagttctttcaagttgaatgaggagatgattgaaactttgtttgtagtgaacacgccaaatccgaaacctaaggatactactccacgctctgttcttgcgccacaaaaccaggaggatagggtattggatcctaaaaagtcccaaaacattgctatcttgttaagagcacttaatgtgactatagaagaagtgtgtgaagcactcttagaaggtgttactgatactctcggaaccgaactacttgaaagcttgttaaaaatggcaccaagcaaggaggaagaacgcaaattgaaggaacataaagatgattctccaaccaagcttggtcctgctgagaaatttttgaaggcagtgcttgatgtacctttcgcatttaaaagggtggaagcaatgctttacatagccaattttgagtcagaagtggagtatcttaggaaatcctttcaaactttggaggctaagcagaatccgactgcctgtgaagagctgcgaaacagtagaatgttcttgaagcttctagaggccgttctcaaaaccgggaaccgcatgaacgttgggacgaaccgtggtgatgctcatgcattcaagcttgatacgcttctgaagctggttgacgtcaaaggcgcagacggcaaaaccactctactgcacttcgtcgtacaagaaatcatcagaactgaaggcgcacgtccctcgagtaccaatccaacaccgagtgcgaactcgaacgatgatgccaagtgtagaaggctcggcctgcaagtcgtgtctagtctgagttccgacctagcaaatgtgaagaaggctgccgcgatggactctgaagtcctcagcagtgaggtctccaagctctcgaaagggattgcacacattgcagaggttgtgcagctggatgaagcaggagggtccgatgaaagcagccagaagttcagagagtcaatgaacaagttcatgagaatggccgaggaggagattctaaaagtccaagcacaagaaagtgttgcactatcccttgtgaaggagatcacagagtatttccatggaaacttgtcaaaggaagaagctcatccatttagaatcttcatggtagtaagagacttcttaacagttcttgatagggtgtgcaaagaagttggtatgataaatgagagaaccatggttagttcagcacatagattccctgtcccagtgaaccctatgcttccacaaccccttccaggacttgttggaaagagacaatacaattcctcagatgatgatgatagttcatctccttag

SEQ ID NO: 54910 - DNA, 2049 bp, Glycine max
  Peptide Sequence Number=SeqID_171688
atggaacaatttagacaacttggggaggcactagggggtttgaaatctgtgatggtattccgggagagcatacaaatcaatcataggcaatgttgtctgctgcttgatgtgttcacctttgcatatgaatgtattgcagatgagatcatacagaacttgaaatttgaagagaagaatgggaagtggaagattctagaacagcccttgagagagatccataagattttcagagaaggagaagcttacattaggcattgcatggaaacaaaggactggtgggctaaatccattgtcatgagccacaacaatgattgtgttgagtttcatatacacaacttgctttgttgcatgcctgttgtgattgaagccattgagtctgcaggggaaacatcagggtgggatcaagaggagatgcaaaggaagaggcttatcaattccgataagtataggaaagaatatagagacatgaggcttttccagtggaaatttgggaaacagtacctcatcactcaggacttctgccgccgatatgatacggtttggaaggaagatagatggttcctttacaacaaaatccatgaaaagaaagtggaaggtatatcaaagtatgagaagaaattgatagatttacttttgaggaatttggagagatcagaatcacttgtagggaagctcttgccaagttcaatattggttggatctaaggactatcaggtgaggagaagaatggggaatgcaagtcagtacaaggagatttcatggttaggtgaaagctttgtcataagacatttttctggggacattgaggctttggaacctgagatcatagaacttttatctctttcccatcctaatataatggacagcctttgtggttttactgatgaggagaagaaggaatgctttttggtaatggaactaatgagcaaaaccctttccacccacatcaaagagattcacggtccgcggaagcgaataccgttcttgcttcatgtggcaattgatctcatgcttcagattgccaggggaatggagtatttgcattcaaagaaagtatatcatggagaactaaacccttcaagcattcttgttaggcctagaggtacatcccaagaaggttacttgcatgccaaggtaatggggtttggactaacttctgttaaggacttgacccagaaagggaacacaaatcagaatggaactcccccattcatctggtactctccggaagtacttgaagagcaagatcattcagggggtgaagcaaactccaaatacacagagaaatctgatgtgtacagttttggaatggtttgctttgagcttctaactggaaaagtcccttttgaagatagccatctccaaggggagaaaatgagcagaaacataagggcaggagagaggccacttttcccacccaattcacccaaatatgtcattaacttgacaaagagatgttggcatattgatccgcatcaacgtccgagcttcgctaccatatgtagagttcttcgttatataaaaaggtttcttgcattgaatcctggttacagcaatcagccagaaccaccagtgccaccagtagattactgtgatatagagtctgtgcttctgaggaagtttccttcttggggaggttctgaatcaccatcagtaccaatcactccatttcaaatgtttgcatatcaagctatagagcgagaaaaagtaagcacaggatgtaaggataactctgagtctggaagtgatgcttcagcttgtggtgatgaacttgttacttctggggatgaaccttttccatccacagttgaaaggaagtctttgcttggacatgatattttgaacagaaggattcaattgaccaggaaatctcttgatttgaagctcaccaaacaaccaggtacaccaaaagggagattggccagacctccacaaatgtcccctcgtacaagaactttgagaattacttcagataaccacatgatatcaagtccaagagcaataagaagagtatctcctggtcatgtctcagactctgagctttcttag

SEQ ID NO: 54911 - DNA, 1578 bp, Glycine max
  Peptide Sequence Number=SeqID_171689
atggctttaagctccaaaaaactggatcaagtatccatttgtgtaaatgtgactaggaaacagttgctgattactgcattttgtttagtttcctttgttaagagcatgctatgcagaatgattttagagtcagaagttatgcgtgaatcagaggaatcaaattctgtagatgatgttggaatatctgatgacgaggctgaaacagagcaattactagattttctaattttaatcaaagaagcaaagaaaaaacgggaagcgaagctggaagaagagctaaatttattgaatgaagatattaaggaggtagaaaaaagttattcatttgtgacagattcagtatttcctttggtgcaaatgaacaatcctgaagtgagaggagacaatttatattttcaagatccttccggttcagacattagtagatccattcgaaggtcatttggtgatgaagaaagatttatgagtaatctaaatcagctagagaattcttacttttccatgagattccgagtgctgccaaaagaggcttcatctgtttcaagcaatgaaaaaaatgtgatggaaagtagatggaggttgcctcaagtagagaatgttaataaggagtctagaagaattcagagttctgttggttgtgtaggatccttctttgaaggtttatgcaagtttgctcgttacagcaagtttgaagagtgtggcagattaagaaatagagatctgcttagttctgccaatgtaatgtgtgctctaagttttgaccgtgatgaggatcacattgcagcaggaggagtttcaaagaaaatcaagattttcgaccttaatgctattgcaagcgattctgttgacatccagtacccagtaattgagatgtcaaataaatcaaagcttagttgtgtgtgctggaacacttacattaaaaatcatctggcatctactgactatgatggtgcagttcagatgtgggatgcagacacgggtcagccattgtctcaatacatggagcaccaaaagagagcttggtctgttcacttttctctgtcagacccaaaaatgtttgctagtggaagtgatgactgctctgtcaaactgtggactgattacaaggtttatggttatgatcttcgtcacactagaattccttggtgcacattagctggtcatggcaaagctgttagctatgtaaaatttatagattctgaagcagttgtctctgcttccactgacaactctttaaagctttgggacctgaacaaaaccagctcttctggtttgtcatctgatgcttgtgccatgacctttaaaggtcatagtaatgaaaagaatttcgtgggattatctgttttggatggatacattgcatgtggttcagaatctaatgaggtgtactgttatcacaaatcactgcctgtgccaattgctactcataaatttgagtcaattgatcacatttctggtcatctaaatagtggtgataataatggacagtttgtttctagtgtttgctggagaaagaaatctaacatgcttgttgctgccaactcagttggaattgtgaaactattgcagatggtctga

SEQ ID NO: 54912 - DNA, 918 bp, Glycine max
  Peptide Sequence Number=SeqID_171690
atggctactgcaaatggtggaactggagctgagaagcacaagaggaaaactaatgatccttttcttaagcaagggggacaccaactcatgccaagatcacctagattgtgcacacctattcggaaggaatggccggagagttttccgaatgacaatgtgattggtaatgaggataatggtttgaatagatatattacttccttagctggatctggacctcctggtactagtttttgctcctcaatagattctgaacacattgttgaagagttgcctgttaggaattataagaacccgaattatttgactattgagtctaagtataatagattgagtagagaaattgtccccaaggttgaggaacagataccactcagattaagcaaaggactcaagggaattgattctgaattttggggcctgaagtctcttcctggcaagagtgtaaatcatgactcactgaatgtctcagaaggtagaagcaatatgggcaaggctatcatctcaaacaatgcacatctaattagcagtataactcagagtacttcatctgcatataattatcctcaattgattgtaaagcaaacaaagaagggaaaggggattatttgtgaagatttaaaccaaagcttcagtactggaggagcacttaacagccaagaggatgagaaacctgcttttgcagctaagtttcaatccgagacactggtgagatcaaatgttgatgagaataagcctttattggaaggaactttcttgtctggtagcaaaggactcaacttaagagagtggctgaagtctgaaggacataaagtaaataaatcaggaaggattcgtatatttaagcaggaaaaggcctttggaacagaacacctgtgcttgccagagtttgagtacaaagcaacaaaagctctgtga

SEQ ID NO: 54913 - DNA, 726 bp, Glycine max
  Peptide Sequence Number=SeqID_171691
atggcttcggagaatgtgaagaccggggattcggccgtgacgacgatcgtcaatctcgccgaggaggccaagctcgccagggaaggcgtcgtcaaggctcccagctacgccctcgccagcatctgcaagtcgctcgtcgccggtggcgtcgccggaggagtgtcacgtactgcagttgctcctctggaacgattgaaaattttgctgcaggtccagaatcctcataacattaaatacaacggaacagtacaaggcctaaaatatatatggagaactgaaggattccgtggacttttcaaagggaatggtactaattgtgctagaattgtccctaattctgctgtgaagttcttcagttatgagcaagcttctaaaggtatactgcatctgtataagcagcaaactggaaatgaggatgctcagctgactcctcttttacgccttggagctggagcttgtgctggaataattgctatgtctgcaacttatccaatggatatggttcgaggcaggattactgtgcagactgaggcatccccatatcagtacagaggaatgtttcatgctttgtctactgtgctcagggaagaaggtgctcgtgctttatataagggttggcttccttcagttattggagttatgatgattatgcttatgatcctgaagatggattataacaaatgcaaacatgctttaattacaatcttcatgggaattgggaactga

SEQ ID NO: 54914 - DNA, 687 bp, Glycine max
  Peptide Sequence Number=SeqID_171692
atggcaactgagagtctgattagaatctcggaagctgggggtaaatggccttctcacaaggaagctgcagcttttggttcatcgtctcgtaacatggcgacggaggatttgggtatacttctgaagggccataggttccaaggtggtggaaaggatgcggcacccaatcgcagtggcagtgcacctcccagcattgaaggctcatttctggccatagaaaaccttttaccccagcataacaccgcccagaatgcaagctttgcaaatctaagcagcactacgcaaaattgcgagtctgaagaacaattgcgagctgatccagcttatttggcatattacaattccaatgtcaacctaaaccctagactttctcccccgcttacgtcctgggaaaatcgccatctaggacgacatattggcagttttagaaataattggagaatgtcttctgcagatgatagcggtaaaagttctgtacatttgactcaaaggactctttccacacacaaggaggagtctgaagatgattcagcccaacagccatatgacgatgaattagttaaggcaagtggaatatggcgtagacctgatgcaacttcattggcatctcagcacaaaaatatggttgatttaattcaggaagattttccacgcaccatgtcgcctgtatataataagtctctttct

SEQ ID NO: 54915 - DNA, 2135 bp, Glycine max
  Peptide Sequence Number=SeqID_171693
gtgcagatgacataagggtgtcatcaagtgttgatacccatgccccagttgcaagctcatcatctcttgaatccactggcagcattggtgttactgacttagacattgcaactgttgagtatcaactaaaggctcttggtgtatctaatgcaccaaattcagaaagtctgagttacaaagagaaatggaagaccggctaccagaacaatttgatgcaacgccagggattccagcaacaaaacaatccatatgatgttcctagtgccaactctcaaaatgtaaattctgtgtatgctggtagggaacaatttccttttaattccaacaagttctccaatgtccagccactactgcagtcatctggttttacacctcccctatatgccacagcagctgcttatatgtcctcagccaatccattttacactaatatgcaggcgtcaggtatatatactccacaatatgttggcggatacactgtaaatcccacagcttttcctccatatgttactgcttatcctcctcatggtgctgtacctcttgtcattgatggagctactagctccagttatactccactaacaccgggggtttcaattgggggaaacatttcgcacggagctgaaatggtacagacaaacaagtaccttgggcaatttggatttcctccgcagccttcttttggtgatcctatgtacatgcaatatcatcagcaaccttttgtggagggatatggtatttctggtcattttgatccactggcacctagagcaagtggtgttagccaaattagtccttatgattcgcaaaaaaggcccagtactggtgcttatttggatgataaaaaattacctgatcagagaactgctgctaatatgacctctagaagaggtggagtatcaattcctagttattttggacacatgccaaacatgggttttgtaatgcagcatccgagttcaccacttcctagtccagttttatctggatacccagaaggaagtccaggccttccaggagttaggaatgaaataaatctttccccggcttctggaagaaatggaggcataatatctggatggcaagttcagagatcttttgacagtgctcatgaccccaaaattgttaattttcttgaagacttaaaatctggcaaaagtcgaagatttgaactatctgatattattggacatattgttgaatttaggcaacagaagttggaaagttgtagtgtcgaagagaagacattagtgtttaaagaggttcttccacatgcttctaaattaatgactgatgtttttggtaactacgtaatacagaagttttttgagtatggaagcccagagcagaggagagaacttgcagatcgacttgttggccagatactgcctttaagtttgcagatgtatggctgtcgtgtaatccaaaaggcacttgaggttattgagcttgaacagaaagctcagcttgttcatgagctagatggaaatgtaatgagatgtgttcgtgatcaaaatggtaaccatgttattcaaaagtgcattgaatctattccaaccaaaaagattagctttatactatctgcatttcgtggtcaagttgctactctatcgatgcatccttatggatgccgagtcatgcagagagttctagaacattgcacagacgagagtcaatgccagtttattgtagatgaaatcttggagtcagtctgtgctcttgctcaggatcagtatggtaattatgttacgcagcatgtcttggagagaggaaagcctcaagaaaggagtcaaattatcaacaagttgtcaggacatattgttcaattaagccagcataagtttgcttcaaatgttgtagaaaaatgtttggagtatggtgataccaccgaacgggagttgctagttgcagagatatttgggcatgatgaaaaatgtgataatttattgacaatgatgaaagatcaatttgcgaattatgtggtccagaaggtcattgatatctgttctgaaaatcaacgagcaatgttgctttctcacgtaagaattcatgctcatgctttgaagaaatacacttatggaaaacacattgtggctcggttggaacatcaatttggaggtgtgtacattggttga

SEQ ID NO: 54916 - DNA, 750 bp, Glycine max
  Peptide Sequence Number=SeqID_171694
atgactgctgctacacataactttcaacttaagtttctggctgttgactcattgttgctattgttactcattaatatgatccatcttattgtattgtattgcattttccttgagcaagaatgcaagataaacaattctgtcaatgttgaacatatggatcgtttctccactaaatttggaagtgaagaacataaaggtaatacagaaaatgacgatgaatctgaaaatgcaaaacctcaaaagtcttccaaagcgacagattttcaaatactttttggtggtaataatgaggatgactttatgattggcatcaaatttactaggaagacaatcaagttgtttagtgatttccatacctctgacattattattgcttcagcactttgcttggttaataaaattgaagaggctgggagtaataaggaaaaagatgtagattttctttcttccatagaggttctgatcattgatcatgcagatgtaatatcaatgcagaattggtctcatgtgcatacagttattgaacacttaaaccgcttaccatctaagcagcttggaacagatgtaatgcgcattagaccatggtatcttgatgatcatgccagattttacaggcaaacaataatactgggtctttattcaaatccagatgtaaatgcttcattcaatcatcagtgccttaattatgaagggaagctgaaactgccactacactatagcggaggatggcatctgattctgacagattga

SEQ ID NO: 54917 - DNA, 327 bp, Glycine max
  Peptide Sequence Number=SeqID_171695
atggccctacaaactttgagagctagtgcattaaattggcacaaggaaggaagcaataaaaatgtaggaaagcgacaattgaagttgaacaagttgaagctcaagggcacttgggtcctccttccttggtcttccagttgttgtagcaagggcacacagctttattaccataataccccgggggcacacacaggcatgtcctgcagcacttctgacagaaaaacatgcagggcttgtggtattgggtctggctacatctcctcgagcattgtgatgggcattctggtcatatcagattccaaaaagagaataagagacgcaccatga

SEQ ID NO: 54918 - DNA, 114 bp, Glycine max
  Peptide Sequence Number=SeqID_171696
atgacgaagatttcgacatttggggcatattcttcatcatctaatccagaaacatcgatcgaagatgttgaagctggcacatcgtctccaattgtccgaccaatagggaacaag

SEQ ID NO: 54919 - DNA, 333 bp, Glycine max
  Peptide Sequence Number=SeqID_171697
atggcattgaacgagaaattaggggcaagtggtaacgagaaagaacaactcaccagcgacgacggcgtcggggtgatactccggcgaacggtggctagggagctgaggctagagttccgcggtggtggcgagggagctgaggctagggttccgcggcggcggcaagggaggttctttaaacctttaaaggctatgtcagtcactttgccgcggaaaggaagtatgtatagtgtatatcttataagacgtaagctagcgtggatcactagcctaaatctctcacggtgcgagacagcttctaaaccgttagatatttttttatcttcaatctag

SEQ ID NO: 54920 - DNA, 324 bp, Glycine max
  Peptide Sequence Number=SeqID_171698
atgagtggtcatgtcgctccacctatttatgaatataatgatgaagtcatcagtgatgaattttttcttgatgagtctgatatcctccatgaactttccatggacgatgaagatcttcctgatgtggatgatgattctgaaaccgaacatgttgaagaggttgatgatgccattgacacattcaaaagtcataatggggaattgtatgcagttgcctgcagtccaacagatgcgacattggtggctacagggggtggtgatgacagaggatttctctggaagattggtgaaaaaggagattgggtttccgagcttcaaggatag

SEQ ID NO: 54921 - DNA, 195 bp, Glycine max
  Peptide Sequence Number=SeqID_171699
atggcattgaacgagaaattaggggcaagtggtaacgagaaagaacaactcaccagcgacgacggcgttggggtgatactccggcgaacggcggcgagagagctgaggctagagttccgcggcggcggcgagggaggacgtaagctagcgtggatcactagcctaagtctcctcccggtgcaagacagcttctaa

SEQ ID NO: 54922 - DNA, 612 bp, Glycine max
  Peptide Sequence Number=SeqID_171700
atgcgccgcctgcggctgccaccgcaacttccaccgccgcgagccggaggagccccccatcgcctccaccaccacgcacccacccgcagccccaattctgcttccccaccgccgatctcctcgtcgtactacccctccgcgccgcacatgctcctcgccctctccgccggactggcggctccgccggagagcaccgccgcgcctgccgccgcgcccacgagaaagcggttccgcacgaagttcagccaagagcagaaggagaagatgcacaagttcgcggagaaagtagggtggaagattcagaagcgcgacgaggatttgattcacgaaatttgcaacgaagttggcgttgatagaagcgttctcaaggtttggatgcataacaacaaaaacacctttgccaaaaaggataacaataatattgttactagtaatgatattaatattactactaaaaataatatttctactgataatgatgcaaatgggagtgatgtcaaggtttttgaaaaccctaacaatgatggtggtgaagatcgcgctgaagatccgagtagtaatcactatgatggggtgaacgttgttggtgctaatggatcttctagttcttga

SEQ ID NO: 54923 - DNA, 624 bp, Glycine max
  Peptide Sequence Number=SeqID_171701
atgataacctccaatgtcagttgctattatttgagcataaaacagatttttgcacggttactgttggctcattattggagtaggtgcccaaacatcaagacttccatcacttatccattgagccaattgttccatttgtctctggaattctttgtaaagggatctgagcatgttattgattttgtcgcttctcatccagattcgattgaatgtgttggtttctcgccaagtgattccttggctgcaattggaggcatggatcaaagactggtcatctgggatatacaacatttcttatctcgagccacctgtgaccatgagggtggagtgacatgtatgacatgggttggttcatcgtgtgtggctactggatgcgtggatggaattgtgagattatgggatattcggtctggtgaatgtgtagaaaaattcagggggcactcagatgccattcaatctctttctgtgtctgctaatggggattatattgtctcggtctccttggatcataccgctcgcgtttttgaggtcagaatgtttcaacaatcagatttacaagttagcaaggaagcaaataaagaagtctctaaaacatggattcatgcatatgccaacacatgttaa

SEQ ID NO: 54924 - DNA, 216 bp, Glycine max
  Peptide Sequence Number=SeqID_171702
atgggtcatctatggctcatgtgtataagagaagaaagaaagaagaggatggagagaattgggaaaggacctaacagcatacaggaagagaaagacttagttggaggagtgaggaacataataggacaagtggcacaaagagtgggggcaatgggattttggaatcatgaggagaatgataaaggagaggggctggaaagtgtaaggggcatctag

SEQ ID NO: 54925 - DNA, 372 bp, Glycine max
  Peptide Sequence Number=SeqID_171703
atggccaagctttcattatatgccacactccttctcttgtgcacatcaggtattatgatggacatggtggcaagtgacaggtgcaaggaagacgttggggcttgcactgctgactgcaactcgagatgtgtcactaggttccaaggtgggtttggggagtgcatgaccatcaatggtgtcaatgattgttggtgttactatgattgcacacctaaaaggtgcacaggaggcacaggtgaagttggggcctgtgataatacccaatgtgatcttgattgtggtcataagtacccgggcaagggagctactggattatgttatagtgttggagatcccatgtatgatacttgtcaatgtacctactattgttag

SEQ ID NO: 54926 - DNA, 345 bp, Glycine max
  Peptide Sequence Number=SeqID_171704
atgtggcgagggattcatgaagatgacttgcatgatggaggtgtgccatttttggtttgggtggaaactactacgcatgcacggatttgttttgtgatggaagatgatgagaaaatgtcactgctggtttcatggaggttcaaatataactaccatttttctgccagaaaaaaagggtctgaaagtgtgcgagggaatcagaaaatgagaattgaaagagtgttatcgagggagagaatggttggtggctcaagaggtgcggcaaagctgaaatatccaggccaaaataggaagaaagcaaggacaagggaaataggtcttcgaatcatacccagaaaagcttga

SEQ ID NO: 54927 - DNA, 552 bp, Glycine max
  Peptide Sequence Number=SeqID_171705
atggcaagtcagatcctatcaaataatcacctcctttttcagccattttataatctcaaacatttagagctgcatactggtttcaacaaaagtgatgttccgggattgacatgcctattcaagagctctcccactctcgacactctgattctcaagatcattcacgaatacaggattgaaagaaaacttgctcatatatacaaagcactacacaatttatcaaagtttgttgatttccctcttgatcaggaatggaatagagacttatgggacatgactatcactgagggagagcagtattgggagtctcaaatccgaactcttgaatcttttctacaacacttgaaagtggtgaaaattcatggttttcttgattatgagaatgaggttgcacttgcaaagtttctcctcaagcatgggaaggccttagaagaaatgatattacacacaggacattgcaatgcaagagatacccttaggagacaaaaaataaggtcacaaatgatgggattttcttgggcttcttctaatgcaaaagtggcatttcagtag

SEQ ID NO: 54928 - DNA, 369 bp, Glycine max
  Peptide Sequence Number=SeqID_171706
atgtctctcacacgagacattaattcttacacccccattcagtacttttgcgcgccacctccttggaccatccaccaccgtgcctccgccgccatcgcacgtcccgaccaccaccattttcccttctccgaccatatccgccccaaaaccaccataaaaaccagatcggcagccaaacaaatctgggttcgttgttcagatttggcaagtggttcaagcgaatctggcatgaacattcatagaagttgtatttgttttttcttgagccttggcgcaaaagaggaagaggaggaagcgaaggttgtaattcctgttgtatgtggcccttcgtcagcagtggctcgtttagcaagcagtcttattgcttga

SEQ ID NO: 54929 - DNA, 479 bp, Glycine max
  Peptide Sequence Number=SeqID_171707
atggaaacaagatccgccaaacgcaagaagatggctcaaattgtagagaacgatgccaaagcagccacggatcggatcagtgatctccctgatgcagttcttcaccaaatccttttccttctccccataaaatgtgttgcacaaatgagcattctttccaagagatggaagtttctttggtccacttttcccgaccttgacttcacaacccttaacccatttcaaatctcttcccaaagcgtcaagtttttggagtttgagaagccaaggcaacctttggattcatcacgaatggatttcatcacccaagttctctctattcgtgataagcattcagatattaggtttctttgttttcgtgcgcgtttgagtttttcgcggctgaatagtttgatccgtagggccattaggcacaacgttagagagcttgatattggagcttccacagtgtgtacagatgattacttcaactttcctag

SEQ ID NO: 54930 - DNA, 748 bp, Glycine max
  Peptide Sequence Number=SeqID_171708
attatgcaacccaaaatacattttcaaattgtcttgtccaattagggatagcttgattcggagtaatatcaatcaatccggaatagattttcagattgacttacattactttagatcattttttctgtgtgaaagacgtgcagttgtagaagaggggcaagagatttacaaagctcccgaacattttgcggttgatgatgttaagatgttgtgtttggtggtggacctgaggacaaatcagtccttactgaatatgctgatcatgtggcttgaccgtggagagttaaagctagtagctcatgaaaggaagttgagggatttgccccccttcccccataaggagatcatgagattggtggaggatttagggttacttccattgacagaatgtagttatgaaacccctgataagggacttttttctgcttttgttgagaggtggcatcatgagaccaacacctttcattttcccataggagagatgacaatcatatttgatgacgtgtcatcattgctgcatattcttattattggtgatttttatagttactcgcacacgtctaaagaggtggttattgcattgttgatggagcttttgggagtgaacaaggaggatgcatttttggaaactaaacaatgtatagggggtcatctgggtgatgcaggttttataaatacaaagcaactcaatggttatgcaactctaatgcaggcatggatctacgagcattttcctactattgggtag

SEQ ID NO: 54931 - DNA, 2096 bp, Glycine max
  Peptide Sequence Number=SeqID_171709
atggttatgatgagttgcgggcatatcattgacctgtatcatctctcatactttcatctatcctacctcaccaagaataactattatacttctacagatcctaaacatcacatattcccagacatccaagattctgaagggctatttgatccagttgctaggagagttgtcgtgagtagagatgtgatttttgaagaagaaaagcggtgggattgggatggaaaacaaatagcagtagatataaaatgggatgaggagaggcaaccacctacatggatgggagattatgttagtggtgaaggtttatctgatgatgaggttcatatggcattaatggtgtcaactgacccattatgttttgaagaagccgtgaagagtgcaaattggagattagccatggacaatgaaatcaaatccatagagaagaaccaaacatggagactcactgagctacctgctggggccaaaagaattggagtcaagtgggtctataaaactaaatacaatgagcatggaaagattgataaatacaaagctcgtttggttgctaaagggatgggcacagtaaggatgatcattgctctagctgcacataaaaactggtggatttttcaactagatgtcaagtcggttttccttcatggtgagctaagtgaagatgtttatgtggagcagccaagaggatacaaaaaagaaggtagtgagcatttggtctacaacaagcagacattgttcactaagagaagcagagaaggaaaaatcatcattgtaagtgtttatgttgatgatttaattttcaccgataattgtgaattcatgatgtctgaatttaaaaactctatgttaagagagtttgatatgtctgacttggggaaaatgagtttaatgtacctcactgccacaagacctgacatgatgtttgtcaccagtctcataagtagatttatggcaaaaccttcacagactcatctgcaggtagctaaaagagcacttcgttacttaaaaggaactgtgaactatgggattcattataagaagggagggaatggtgagttgttagcatttacagatatcgactatgccgaagatgtggaagataggaagagcatgtctgaagctgagtttgtggctgcagcagtctgtgcttgtcaaggagtttggatgaagagaattttagaggagctgggacaatctcatgaaggctgcataaatataatgtgtgataacagctcaaccatcaagctgtctaaaaatcctgttatgcatggtcacagcattgacgtgaggtttcattttttaaggaatcttagcaaggagggtacaattgagttagttcactgtggaagtcaagatcaagtggctgacataatgaccaaaccattaaagcttgaagtttttcagatgcttcggaatcaaagaaacattactggacccaacaagcctcgaattcctaaacaattcaacaacctgcctcacctcgtcctccccagactccgcaacgagaagaaagcacgcgccacctggccggacgacgcgctccatctcggcggcgaaccgtgccgggaacagtgcctcgtcgaatctcgcggtgaaggcgaggtcgaacgcgccgtcgaagaacggcagattgtgcggatcggcgcggcggacgagcggcggggactcgaggatctcgactccggtgacatcgtcgatcccgaggcggcggagcgcggcgacctcgtggccggcgccggcggagacgcagaggacgcgggagtggttgtagttgttggaggaagcggcggagaggaggagggggaggaggtggtcgcggaagaggagggagaaggagaggaccttggcggtccagaggcgcgtggattgaatgcgcagggcgcgcttctcggcggggacgtgggggcgcgtggaggagaagtcgcacgtggatttggggaagcggaggtgcggcttccggggcgcgtggtgggggacacacgtgtcgggcgtgcggaggaggaggaagaggagcgtgagggaggctactgcgatggctacgaaagagaggcgcttgaggaatctgtcgatgagtatgtcttctcctccctccgcttcat

SEQ ID NO: 54932 - DNA, 513 bp, Glycine max
  Peptide Sequence Number=SeqID_171710
ccagtggtggtggtggtggtgaaacttggaggtggtggtggcggtggtgatgaaaccagtggtggtggtggtgatgaaactggaggtggtggtggtggtggtggtgtgttagagagtgaaggtgctggtgatatcgagggtggtggaggtgatggggatggtgagttagagggtgcaggtgctggtgagacaggggatggtggcgataatggtgatggtgagttagatggtggagatggtgatgagaccggggatggtgagtcagaaggcgaagctgctggtgaggctgggggtggtggcagtgatgacaatggtgacttagagggtgaaggtgatggtgagtcagaaggtgaaggttctagagagatgggggatggtgacggtaatgacaatggtgagttaaagggtgaaagcgttgctactgctggagctaaccatggaaaagaaaaggaggttaagggagaggataagggaaaaacccttggaacccattttccaaacagtttctcttga

SEQ ID NO: 54933 - DNA, 303 bp, Glycine max
  Peptide Sequence Number=SeqID_171711
gctcatgagtctgatcaggcacaggcaccactcacagtgttgaacccttttgagcataaaactcaaacaggagttcaacttaacgatgatcagaatagtgatcataaagttgcagtttctggagctattgaagagtcatcatcatcagaagaagagaaaaatggagaagctaaagctgctgaggcaccacaaattcgaagaatagggaaacatcattcttcggacaaatcagtggcaggtggaggtgtcatcattggagggcttgttactgccatctttgctgctgttttttgctacattcgg

SEQ ID NO: 54934 - DNA, 132 bp, Glycine max
  Peptide Sequence Number=SeqID_171712
atggagccgatcacatcggaatttaaagatgttgcagtgctcattgtcgccgatgacggaagtggccatggtgcgaatcgcggaggccgagttgctggtttggatgcaagccttcgttctccagttagatga

SEQ ID NO: 54935 - DNA, 174 bp, Glycine max
  Peptide Sequence Number=SeqID_171713
atgggtgttttcagtgacggagacttgcgtgaagctaataatggtgatcttacggtgaaagaaaggacacgagtaaagttgaaagataaaggagttagagttactataagacatagcaatggacctggatggtctacattttctaagaactatacacgatctctatacctttaa

SEQ ID NO: 54936 - DNA, 1008 bp, Glycine max
  Peptide Sequence Number=SeqID_171714
atgtgttacgtggggaaagcaacaaagatcttcatcttcatcgtcaccgtcctcgtcgttgtcggcatcgtctttggattcagcctcatgcgccgtaaccaccaccataacaacgctgccaaatgctccgatgctgcctgcaacaacatttctcctcccctcagccccattactacgcttccagctgactccaacccctatccaccgccgccgccaccgccaccgccaccgccaccgccgcaatcgactcctcctccgtcatatcctgcatacccgatacccgacgggtacggggatgagacaataaactcaaacccatcgggtatcgggtatgggtatgggaatatgttgagaagtggggtaaggaattggggagacaataccggcacccgacctgcccctttggcatatatgcagtccctggccgatacactggcgaaatggaaagaatataatgcctggctggagtctaacaatgaagctgagaagccggttaggaaggtccctgccaagggatcaaagaaaggatgtatgaaaggcaaaggaggacctgagaacttgcgctgtaattacagaggagttaggcaaaggacatggggaaaatgggttgctgaaatccgagagccaaacagaggaagtaggctctggttgggtacttttcccactgccattagcgctgctcttgcttatgatgaagcagcgatggcaatgtatggtttctgtgcacgcctcaactttcccaatgttcaagtttcaactttttccgaggaaccgtctagaaattctccagctgctgcttaccagtcaagaaattctccatctgctaaagaatccggttctgcgttggtgatattagagaggtctgagtgcatgatgttgtggaacaattctggtggagatgcagcagaggatgatggcatggaagacctttccttatccttaagtgtgaaacatgaggaaggggaggatgaatcagggaccagttcttcctatctttcattgtcttga

SEQ ID NO: 54937 - DNA, 123 bp, Glycine max
  Peptide Sequence Number=SeqID_171715
atgaaactcaaatctgacctttcattgtccttcgagaggattgcatggaaccaacgagcggagaagacaaagaaatctccaagtggcgtgacgaggaacccgtgggtagctcacaataggtga

SEQ ID NO: 54938 - DNA, 234 bp, Glycine max
  Peptide Sequence Number=SeqID_171716
atgatgtatcctcattgtgatgtcatcctttgctccatccaacctccactacctctttctttcctcattcatttttcgaggatagccgcgttgcgaacaatgtcgctgtcaaccaccatggtaacgcctttaacgatgatgtggagggtgaagagtatgaccatgaggatccatgatggccttcacattgttcataggtggaggatgaagagtatcactatgaagatcagataa

SEQ ID NO: 54939 - DNA, 507 bp, Glycine max
  Peptide Sequence Number=SeqID_171717
atggttcatcaattttttgttggggatacttcccatgaacagtcggatgatatttatgccaaattgaaagacttgaatgagcagctgaagaaagctggatacaaacctgacaccagtttagttctctacgatgttgaggaagaaataaaggagaagatgctttgggatcatagcgagaggttggcacttgcttttgctcttattaatactggtccggggaccactatcagaataaccaagaatcttcgtgtgtgtggagattgccacacgatgtgtttctttgtgcatcctagtagccatggccaaaggaacatattcacaaaccaaatgcttcctaagtatatagtatacctgattatagtgacaactgagatggaaaaactaaagaatggaaggattttagaataccagagacatgttaaaaataacagaggagtcaggagagaaagaggaagaatgacatatagttataggttaaagaatggagtgaagggagagctaaaataa

SEQ ID NO: 54940 - DNA, 1593 bp, Glycine max
  Peptide Sequence Number=SeqID_171718
atgtcactccttaagacaacagcaacccttattcccaaaccttcttccacctctactttcgattctctacaatgtggaaccttactccaatccctcaccaactccaaatccttaacccaagccctacaactccacgctcacgtcaccaccggcggcaccctccgccgcaacacctacctcgccaccaagctcgccgcatgctacgccgtctgcggccacatgccctatgcccaacacatctttgaccaaatcgtcctcaagaactcgtttctctggaactccatgatcaggggctacgcctgcaacaactctccctcgagggccctttttctatacctcaaaatgctgcattttggacaaaagcctgataacttcacctacccttttgtccttaaggcatgtggggaccttctgcttcgcgaaatgggtagaaaggttcatgctttggtggtggttggtgggttggaggaggatgtttatgtaggcaactcgatactttcgatgtactttaagtttggtgacgtggaagctgcgcgggttgtgtttgatagaatgcttgtgagggacttgacttcttggaacaccatgatgtcggggtttgtgaagaatggggaggcaaggggtgcttttgaggtttttggggacatgagaagggatggttttgtgggagataggaccaccttgcttgctcttctctctgcttgtggggatgttatggatttgaaggtggggaaagagattcatggttatgttgttaggaatggtgagagtgggagagtctgtaatgggtttctgatgaattcaattattgacatgtactgcaattgtgagtctgtgtcttgtgcaaggaagttgtttgaagggttgagagtgaaggatgttgtgtcgtggaattctttgatttcggggtatgagaagtgcggggatgcttttcaagctcttgagcttttcggtcggatggttgtagtaggtgcagtgcctgatgaggtgactgttatttctgtgcttgcggcttgtaatcaaatctcggcattgcggttgggcgcgactgtgcagtcatatgttgttaagaggggttatgttgtgaatgttgttgtgggaacggcacttattggcatgtatgctaactgtggaagtttggtttgtgcttgtcgtgtgtttgatgagatgcctgagaaaaatttgcctgcttgtacggttatggttactggatttggaattcatgggagggggagagaggccatctccattttttatgaaatgctaggtaaaggtgtgacaccagatgagggcattttcactgcagttttatcggcttgtagtcattctggattagtggacgagggtaaagagattttctacaaaatgactagagactatagtgtggagcctagaccaactcattattcatgtttagtggatctacttggcagagcagggtacttagatgaagcttatgcagttatagagaatatgaaattgaaacctaatgaggatgtgtggactgctcttctttctgcatgcagattacatcggaatgtcaagttagccgtgatctcggcgcagaagctttttgaattgaatccagatgga

SEQ ID NO: 54941 - DNA, 1527 bp, Glycine max
  Peptide Sequence Number=SeqID_171719
atggcaactctccacgcattagtgaaattttgcacagtgcagtgcaaagcctatgctggaagcaaatgtgaggatgcgtgtttttttttcatgcatttgtgcatattcaaagtgcaatttgcttacttgtttgtgaacaaccgcaaatatgtagttgctgacagtgacgtgcttaagaatgtgttgctgttcttctctgcttcttgtgcacatgaatttagtggacttgaaatatggcgtattgagaattttaatccagttcctgtcccaaagtcctcttatgggaaatttttcactggagactcctatgtgatcttaaagacaactgcctcaaaaagtggtgctctgcgccatgacatccattactggcttggtaaagacaccagtcaggatgaagcgggtgctgcagctatcaagacagttgagctggatgcagctcttggaggacgtgctgttcagtatcgtgaagtacaaggccatgaaactgaaaagtttctgtcttatttcaaaccatgtattatccctcaagaaggtggagtttcttctggtttcaaacatcctgaggctgaaaaacataagacacggttgtttgttccatttgccagagcttcactcaaccatgatgatatttttgttctggataccgaatcgaaaattttccaatttaatggttccaattcgtctattcaagaaagggctaaagctttggaagttgtacagtatattaaggatacctaccatgaagggaaatgtgaggtagctgctgttgaggatggaaagttgatggctgatcctgaaactggggaattctggggtttctttgggggatttgctcctcttccacgaaaaacagccagcgatgatgataagcctactgattctcgccctccaaagctgctttgtgttgaaaagggtcaggcagaacctgttgagactgattctttgaaaagggaattactagacacaaataaatgctatattcttgattgtgggtttgaagtgtttgtctggttgggaagaaatacctcccttgatgaaagaaaaagcgcaagtggagttgcagatgagatagtcagtggcactgatcaactgaaaccccaaataattcgtgtgatagaaggatttgaaacagtgatgttcaggtccaaatttgattcttggcctcagacaactgatgtaacagtatctgaagatggccgtggcaaggtagcagcacttctaaaacgtcaaggagtaaatgttaagggcttgttgaaagctgatccagtgagggaagaaccccaaccccacattgattgcacaggacatttgcaggtttggcatgtgaatggtcaggagaagattcttcttcaagcttctgatcaatcaaaattttatagtggagattgcttcatcttccagtatacatatcctggagaggataaagaagattgtcttataggaacgtggattggaaagaatagtgttgagggacctgacaacagattggattcagtgatcctattgaaaatgtttttgaaattatga

SEQ ID NO: 54942 - DNA, 189 bp, Glycine max
  Peptide Sequence Number=SeqID_171720
atgaatccaagtatatcagaccaggaaaaaagagattccagtcaaggccggaaatgtataggagttattagaggaaggagaaaattcaaaaagaatggacacatggtagctgacgataggagacaaggatgctggaatcatcgggcaagcttgaatatgagggaagaagaggttggggatgagaggtga

SEQ ID NO: 54943 - DNA, 522 bp, Glycine max
  Peptide Sequence Number=SeqID_171721
atgacacgttctcgaagcagcactacgacaacaataacctcgttgtgtggcatcattgaacttcttgaaggccacccttcacacaatgttgtcgaaatcatcttccacacaagttggggccccaagccattcccaggtcgggtcgaactaattttcaaggtgcagagggcgtcgcacaccctggcgcggttcgaggagtttcgcaaggcaatgaaagcacgcgccaccgcggggctcgccgagggaaatgacgatgaggagaacacatggtgcatcgccgacgggaacgaggttgttgttgtggtggtggtgatggtttatgacgagtgggctcatgtaacccgctgggctgagggttgtcgcaagggtagagggagaagtcccatgaataaaggcaccagcttggagttatggaggaaagatcgaggttgttctttaggtgagcctggaactgagagagtgaagagaacacatttgactgaatcaaggaatgaatggggaccattggatgaagagatgtga

SEQ ID NO: 54944 - DNA, 966 bp, Glycine max
  Peptide Sequence Number=SeqID_171722
atgagcaccgaaaaggagaaaacatcttcaccttctccttccgtcgagctctgcaagggcttcaatggcctcgagaaggttctcctccgcgaatcgcgtggttcctccgccgaggtgtatctgtacggtggccacgtgacttcttggaagaacgaccatggcgaggaattgctttttctcagtaataaggctatatttaagcctccaaaggcaattcgtggagggattccactatgctttccacaatttggaggccttggtaccctggaccagcatggatttgctagaaatcgattctggaccattgatgatgaccctcctccttttccaacaaatactttgagcaaagcctttgttgatttgattcttaagcccactgaagaagacacgaagatttggcctcacagttttgagttccgtcttaggatagctttgggaccaggaggagatctgatgctgacatcccggatcaggaacacaaacagtgaggggaagccattttcgttcacctttgcatatcatacatatttctctgtatcagacataagtgaagttcgggtagagggattggagaccctggattatcttgataacttgcagaacaaggagcgctttactgaacagggggatgctttaacgtttgaatcagaagttgacaagatatatcttagcactcccacaaagattgcaattattgatcatgaaaaaaagagaacatttgttgtgcgtaaagatggccttcctgatgctgtggtgtggaatccttgggataagaaagcaaaggccatggctgattttggtgatgatgagtacaagcatatgctttgtgtagaggctgctgctattgaaaagcctatcactttgaaacccggagaagaatggaaaggaaggttagagctttcagctgtgccctctagttatcgcagtggacaacttgatccccagagagttcttctgggaagctga

SEQ ID NO: 54945 - DNA, 987 bp, Glycine max
  Peptide Sequence Number=SeqID_171723
atggaagatactagcttctttgtgatcttatcatcctttctgcttctcatagttagtacacaaacaagctcagctcaacttactcgtggcttctatcgaaacacgtgccccaatgtggaacagttggttcgttcagctgtggagcagaagttccagcaaacctttgtgactgcccctgccactcttagactcttcttccatgattgctttgtgaggggttgtgatgcttccattttgcttgcatctccaaacaacaaggcagagaaaaatcatcctgatgacatttcactagctggggatggctttgacacagttgttaaagccaaggcagcggttgatagtgaccctcaatgcagaaacaaagtctcttgtgctgatattcttgctctggctactagagatgtgataaatttggctgggggaccattttatgaagttgaattgggaaggcttgacggaagaatatctactattgctagtgttcaacgccagcttcctcaccctgatttcaatttagataagctcaattccatgtttagcttccatggcctcacaaagacagatatgattgccttatcaggtgcacatacaattggattctctcactgcaaccatttctcaagacggatctacaacttcagcccccaaaaattaattgacccaacacttaacttacaatatgccttccaacttagacaggcttgccctctcagagttgattctagaattgccataaacatggaccctgtcacacctgaaaagtttgacaaccaatacttcaagaatctccagcaaggaatgggcctattcacttctgatcaggtgctggctacagatgaaaggtcaaggggcacagtcaacttatttgcatcaaatgaacaagcttttaacaaagcttttattgaagctattactaaaatgggaaggataggtgttaaaacaggtagacaaggggaaataaggtttgattgctccagggtgaactga

SEQ ID NO: 54946 - DNA, 300 bp, Glycine max
  Peptide Sequence Number=SeqID_171724
atgcaatcaattgatagtgtgcaggaggatgaccttaccattattgggaaggaatcttatgatgaaattaaatatttaagttttggccttggagttaatgatgaacgtatggctgaacaagctttgaccttttataaaataacagtactttctacatgtagtcgtagaaagactacaacttatgaatgtgctggcgtaagcaacgatgtagaaatcagatatttctacatcgttgctaaggagagaaacgatgttgaaagcataagttattacatcggtgctaacgagaaacgatgttga

SEQ ID NO: 54947 - DNA, 213 bp, Glycine max
  Peptide Sequence Number=SeqID_171725
atggccattgagggttttacaatgagaaagggtgaaagaaagggagtaagtgaaacccctaggagagggggttctgtcgtggtctgctggagtgggctttgggccttcgtaggcgcgctcagcgcgacaccccctcgctcagcgcgtgtagatcgcgcgcttagcgcgcatgttgtaggcttagcgcacgcttctgttagatcgcgggcttag

SEQ ID NO: 54948 - DNA, 2315 bp, Glycine max
  Peptide Sequence Number=SeqID_171726
atgtcaaaaaataacgcttctcaaacaaagtatgatgtttttgttagcttcaggggcgttgacatccgtcgtgggtttctaagccatttgattggcacttttaaaagtaagcaaataaatgcctttgtagatgataagcttgagaggggtgaagaaatatggccatcacttattgaagcaattcaaggatcatccatttcgttgatcatattctcaccagactatgcttcttcgcgttggtgtttagaagaacttgtgacaatacttgaatgcaaagagaagtatggacagattgtaatccccattttttaccatatagaacctacagaggtacgacatcaacggggaagttacgaaaatgcatttgctgagcatgtaaaaaaatataagagcaaggtgcaaatttggagacatgctatgaataaatctgttgacctatcaggaattgagtcatcgaaatttcaggatgatgatgagctacttaaagaaattgtcaaacttgtgctgaaaaggttgggtaaacacctggttaactcaaagggacttgttggaattgacaaaaaaattgcagatatagaatcattgatacgcaaagagtcaaaagatactcgtcttattggaatttggggtatgggcggtatcggaaagacaaccctcccacaagaagtatttaacaaactacagtctgaatatcaaggttcttattttttagccaatgaaagagaacaatcaagcaaagatggaataatttctttgaagaaagaaatttttactgaactattaggacatgttgtgaaaattgacactccaaattcattgcccaatgataccattcgtcgtatgaaggttcttattgttcttgatgatgtgaatgattcagatcacctagaaaaattactgggaactcttgatcattttggagcaggtagtagaatacttataacaactagagatgagcaagtgcttaatgctaacaaagctgatgagatataccgtcttagagaattcaattttgataaagcatttgaacttttcaaattgaatgcctttaaccaaagtgataatcaaagtgagtatgatgagttatcacaaagggtggtcaattatgccaaaggcattccattagttcttaaagttttggctcgtcttcttcgtggaaaaaataaggaagtatgggaaagtgagcttgacaagcttgaaaaaatgcctcttcgagaagtttgtgacataatgaaactgagttatgttgatctggatcgcaaagaacaacagatttttctagatcttgcatgtttctttcttagatcacaaacaaagataacgatagactatctaaattctctgttgaaagatagtgaaagtgacaattcagtggttgttgggttagaaaggctgaaagataaagcacttataactttcttggagaataattttatatctatacatgatagtttacaagaaatggcttgtgagattgttcgtcaagagtctactggagaccctggaagtcgtagtcgcttgtgggatctcgatgacatatatgaagcattgaaaaattacaagggtaatgaggccattagaagcatactacttcacttgccaacaactaagaaggaaaatttaagccctcgcttatttgctaagatgaacagactacgatttctggaagtttctgtagaagataattatgactgcttggatcaacttcatattcttggtaccaacctctgctggcccaagcagcaaaagactcggattgttgatattcttgctaaagggcttaaatttttggcaactgaacttagatttcttagttggaagagttactctggaaaatccttaccagagattttttctactgaaaaacttgtgatattgaaattaccatacagtggaatggaaaaactttggcttggagtgaagaatctagtgaatttgaaagaacttgacctcaggtgctccaagaagttaaaggaactaccagatatatcaaaagccacaaatcttgaagtaatacttctccggggttgttctatgttgactaatgtgcatccatctattttctccctgcccaaacttgaaagattgaacctttctgattgcgagtcccttaacatactaacaagcaattcccatttacgcagcctcagttatctcgaccttgatttttgcaagaatcttaagaaattctcagtagtatcaaagaatatgaaagaactgagattaggatgcacaaaggtgaaagcacttccctcatcatttgggcatcaaagcaagcttaaattgctacatcttaaaggaagtgccattaagag

SEQ ID NO: 54949 - DNA, 543 bp, Glycine max
  Peptide Sequence Number=SeqID_171727
atgaaagttgaatttgccaaatgcaaaatgggaaaaggagaaatggaggttgaaagagttgtttccccaaggtgtggcctgccactgacagaagagaatgtggagaaggttttggatgaggtaaggcctggcttgatggctgatggagggaatgtggcattacatgagatagatggtcttgttgttgtcctcaagctgcaaggggcatgtggatcatgtcctagctcagctatgacattgaaaatgggaattgaaactcgcctccgggataagattccagaaatcttggaagtggagcagataatggacaccgagactggtcttgagttaaccgaagaaaatgttgaaaatgttctttctgaaattagaccataccttgttggcaccgggggaggaatattagagcttgttcagatcaaggattatactgtcaaagttcggctaagtggacctgcagctggggttacaacagttcgtgttgccttaacacagaagctgagagataagatacctgctattgcagctgtgcagctaatagactga

SEQ ID NO: 54950 - DNA, 768 bp, Glycine max
  Peptide Sequence Number=SeqID_171728
ttcattgacaccggccatgcttgatccctataatccacgacctgaagtgaaggtggagtcagggtttctctctctttacacctcagatgagagctcagcttccaacaagtttggactcgagagttgcagggaacagcttctctctgaggtgtcgaggttgatgaacaagtacaaaggggagaaagagaaccttagcatatccttggctggtcacagcatggggagtgctttggccatcttgctttcctatgacatagccgagcttggattgaacaaaaaaagtggcactcacgaggtgccagttactgtgttctcctttgggggaccaagagttggtaactccgaattcaagcaccggtgtgaggagttgggagtgaaagtactaagaatagcgaatgttaatgaccccatcacgaaactacccggtgttgtgttcaacgagaattttagggttttgttgggagggaggtacgagtttccttggagttgctcgtgttatgctcacgtgggggttgaactactgcttgatttcttcaacgtgcaaaacccatcttgtgttcatgacttggatagctatattggccttcttaggcgtcccaataaagatgaagtgctaatgaagcgcgaaagggatgaagatggagtgaactctttgttggagaaagcaagagagttgctcttcaactcgcaaagcatgaaaattttggccggagtgttaactgcatacaactaccatgatttgctgaattcagtctcaagggacatact

SEQ ID NO: 54951 - DNA, 297 bp, Glycine max
  Peptide Sequence Number=SeqID_171729
atgaaagaggaagtggttgtttttgtcagctatgttgaggagaaagaagaaggcaaaaacaagcttttagggggaatggtgtgggttgaggagaagcgaagcaagtatggacgcacgcacacgcacaaaaagaagaccacaggcctagaaaacgagtttctgtgggagagtgattatagggagagtcagtgtgcacaggcacgtacaacacaaagatatgagcgtgtaatgtgtacgtgtatggccaataaatgttggtacaattgtaggtatctcattcacaagaatgtgagctga

SEQ ID NO: 54952 - DNA, 327 bp, Glycine max
  Peptide Sequence Number=SeqID_171730
atgacatcatttctttcatttcatttttctttcttcctcctcccttcgtgcttgtgccctagtgcatgttgtttgagggtttgtgtttttccttctttctcactccatcctggttattccgtcactccatcacaacaatgcaactccaaaagtaagggcaaggtgctccatgctcatgcgtggtggctgcggcgacggtgcgaagcaaaagtgcgagtggtcgaaatgtcaagtgcgtgtttcttccgtgagactgtgaccgtgcgagtgcgtggtggctgcgacaacggtgaagtgcgtggccacgacaacgttgaagggagttag

SEQ ID NO: 54953 - DNA, 594 bp, Glycine max
  Peptide Sequence Number=SeqID_171731
atggcttacgagataaccgagataaagagtaaaataatcagagctttccttccagcactccaacaaaatgcatgtgctagttgtgatatatggagtatctcaaatttatttttgacatacataacccataaaatttccaagtttcctgatgcctcagtaatctgtcttactccaagtactaaccttgatgaattaaagatttatttgctttggatttccagcatctctttctgtaatgaaacattaagccccgcaaatgttctatttgaatggatgcctggttctgcatcatttcttctaggtctctttttcatctttgtgaggtggccaattgttggtataatacttgaaatatacggttgtgtttttctcttcagtggattttggtcatctatcaaagtgttcctctaccatatccctgttgttggatggattatacagtttatctctcggtacaatgataattttcccttgtgtgtctcagtcctccttgtcaatctccatcaatttccgccatcttctgttttaagtccaaaggggtgtggtacctacaaaggcactccgacacccaagttagatatccacccaatatag

SEQ ID NO: 54954 - DNA, 327 bp, Glycine max
  Peptide Sequence Number=SeqID_171732
atgaagattttggtggaaagaaggtaccttgggcgagttttgggagaaaaaaggcgagggtttcatgcaaaaggaaagaagaagaagtgtgaaatgaagaaggcgagggtttcacccccttttattttgtcactacagacgtgcactcgctcaggcaagctacccatttgtccaggcgagctacccactcgcctaggcgaaaaaatagtcaatcaagtgttttgttcaattttactcaacccttatggcacccccaccaaacatgttgaatgtgcaatttctgatcaggcagactcggaagttagctctggagcacaggtcatatga

SEQ ID NO: 54955 - DNA, 576 bp, Glycine max
  Peptide Sequence Number=SeqID_171733
atggctccaaagaaactcacctctaagagagctaggaagaccactgcaggagaagggtctagcacagctctgcctgtagaaattgaatttgatggacaccgctttcgtagtgaagaacatcaatgccgcttcgtagtgatcaaagattggtctttcctcaaggaaagaagggaaggtgttatggataagcactccaaagtgaggggccaatggattccttatgacatagatgccatcaaccaatttttagggaattcattgatcctagaggaatggcaacaatgtgagtacattgcaaggagaagtcggactacaggttttgatgaagaggctataggtcagctgctttgcttcccaggatgtgatttttttgttggtattaagcctcccaggcacccaatggacccagaaaaatccaacaaggcaagtacaacaatcagagcaagattagcaacatcagccaacaatagatgcaccaccataacctccacatcagccaccatccttggagtccatctcagctcacttgcagaggatggagctccagatgcacacatacatgcgtcatttggctga

SEQ ID NO: 54956 - DNA, 474 bp, Glycine max
  Peptide Sequence Number=SeqID_171734
atggtgactttgctggaagttgtcgaaaatcgtgggagaatagtggagcgggaagagagggagataaaatcgcatcaagaggaaacaaaggttgttaacttgggcactagtgaagagaaaaaagaggtcaagattggcacttgtgtgtcagctaacgtccaagaagagttggtggccctattgcgagactcccaagacatcttcgcttggccttatcaggatatgcctagtttgagctcagaaattatgcagcataggttaccgttgaatctcgaatgctccctgatgaaacagaaattgaggagaatgaagcctgagatgtccctaaagataaaaaatagagccgttgcccgtacccagagtgggttgccaacattgtgtcagtccccaaaaaggatggaaaagtgtgaatggtataatcagataaagatggcgccagaggacatggagaagacgactttcattactttatag

SEQ ID NO: 54957 - DNA, 2493 bp, Glycine max
  Peptide Sequence Number=SeqID_171735
atggaatttacaagacgcagctatgcggttgtttatgtcattctcctttgtgcgttggcccaagggggctcagaggggaagggggggaaggaagaggaaatttctatagatggtggaggagctttctcatcatccatttatgttcatggaattaaggttgaaaatgagttgaaacattgcaggaaagaattgatagagaggaacaatgatgtcaaaactagtacttctcctgctccagtttcagaaaagggtagctctagatatttattgacaaagcattctggatcaaccttgggtgtggaaagtggtcatggcagaaatttgattgctgattcaccacataatgcaccaagcccttctgctactgctgaatcaccaagtcatggtccaacaccaacaagttctccatcatcaccatctcaatcatcaccaactccaagtccaaaaggtgtggatttaccactccctccaaatatgtttgtgccatttccaccatcaccccgtgtacctcatcctcctcctcaaaattttcgacctatagtatatgctcctgttccttcaccacctaacaatgaaaacaaaaagaagcaaacaattattttagccgccgctttatcaggaattataatcttgataggcttggccctctgctatcgtgaagcaagtcgcaacaaaggtgacagagatgacaggcctttgctcgtattaacctcaagtgattattctggtggatcaaagaaggttgttcgattgggagatgctgacaaggaagaatctgacattggcaatggaaagaagccttctaattttagaaattggtccattaagggtggacataacaatggctcactggttgagacaacagcatcagaaggtgtaggacaagttccaatgcctcctaatggaaagcctgcccctccacctccacctcccagaccaccaccaccaccggctccaaagccgccaccgcctcctgctcctcgtgcaccgccacctccaaaaggtgctcatcctccacctgctcctcctaaaccaatgggaggtaaaaatcaaggtccactacttgctaaagaaggaacttcaagtgatggtgatgctccaaaaccaaaactaaagccatttttctgggataaggttaatgcaaaacctgaccaatcaatggtgtggcatgagatcagagcaggatcattcgtgatcaatgaggaaatgatggagtctttgtttggctgcaccaaccagaataaaaatgaacctaaaaaaaattcaccacatgttgatacttcagtgcattatattcagattattgaccctaagaaagcacagaacttatcaattcttttgcgagctctgaatgtgacaacagaagaagttattgatgctcttaaagaaggtaatgagattccagtggagctcattcagacgttgttgaagatggcacctacaacagatgaggaattgaagctaaggctattcacaggacaactctcagaactaggcccggcagagaggtttctcaaattgttggttgacattccattcgctttcaaacgtcttgaatctctcatgttcatgtttatgcttaaagaagacttctcaagcattaaggactcctttgccacattagaggttgcatgccacgaactcagaaaaagcaggctattcctcaaactactcgaagcagttctcaaaaccggcaaccgcatgaacgacggaacctaccgtggaggcgcacaggcattcaggctcgacaccctcctcaaactctccgacgtaaaaggaacagacagcaagacaacactcctgcacttcgtcgtccaagaaatcatccgctccgagggaataagagccgtgcgaacagaaagagcgagcagaagcatctctagcgtcggaaccgattccgacgaaggaaccgaggagtccgaggagcattaccgcagcctcggactccaggtgatctccgggctcagcaatgagctcggagacgtgaaaaaggccgcgcttatagacggggatgcgctaagcagctccgtctctaagcttggctactccatggtgaagactcaagaattcttggacagggacatgaagagcattgaggaagagagtgagttccagcattgcatggagagtttcatggtgagagcgagggaggaagtgacgtggctggtggatgaagagaagaggataatggctttggttaagagcactgcggactactttcacgggaacgcggggaaggacgaagggctacgtttgttcttgatcgtgcgtgatttcttgaccatattggacaaggtttgcagagaggtgagcgagtccaccgtgaacttagccaaggctgcaagcaatagcgccaaagaagcgactaggagttcggtttcttcttcccaaaactccacaactccgcctgttgatcttcatagaaggctgtttccggccattgcggagaggagagtagattactctagctctgacgaggatgaagaattttaa

SEQ ID NO: 54958 - DNA, 1552 bp, Glycine max
  Peptide Sequence Number=SeqID_171736
atgaagcactttgctgcccaaaacgatgctgcggtgcttaatgaaattgtcgatctggtactgaagaggttagttaaaccccatgttatctcaaaagggcttgttggaattgaagagaaaattacaaccgtagaatcatggataagaaaagagccaaaggacaaccttcttattggaatttggggtatgggaggtattggcaagacaacccttgcagaagaaatatttaataaattacaatatgaatatgaaggttgttattttttagccaatgaaagagaagaatcaaagaatcatggaataatttctttgaagaaaagaattttttctgggctattacgattacgatatgatgatgtggaaatttacacagaaaattccttacctgataatattcttagaagaattggccatatgaaggttcttattgttcttgatgatgtgagtgattcagaccacttgggaaaattgttgggaactcttgacaattttggatctggtagcagaatacttgtaacaactagagatgaacaagttctgaaggctaagaaagtaaaaaagacataccaccttacagaactcagttttgataaaacactggaacttttcaatttgaatgccttcaaccaaagtgatcgtcaaaaggagtactatgagttatcacttagggtggtcaattatgccaaaggcattccattagttgttaaagttttggctggtcttcttcatggaaaaaacaaggaagaatgggaaagtttgctagacaagcttaaaaaaatccctcctacaaaagtttatgaagtcatgaaactgagttacgatggtctagatcgtaaagagcaacaaatttttctagatctggcatgtttctttcttagatcgaatataatggtgaacacttgcgagctaaaatctttattgaaagatactgaaagtgacaattcagtgttttatgcattagaaagattgaaagataaagctcttataactatttctgaggataattatgtatcgatgcatgatagtttgcaagaaatggcatgggagattattcgacgagagtctagcatagctggaagccacagtcggttgtgggattctgatgacattgctgaagcattgaaaaatggcaagaatactgaagacattagaagcctacagattgacatgcgaaatcttaagaagcagaagttaagtcatgacatatttacgaacatgagcaaattacaatttctgaaaatctctggaaaatataatgatgatttacttaatattcttgctgaagggcttcaatttttggaaactgagctaagatttctctattgggattattaccctctaaaatcgttgccagaaaattttattgccagaagacttgtcatattggaatttccatttggcagaatgaaaaaactttgggatggagtccagaatctggtgaatctaaaaaaagttgacctcacttcctccaataagttagaggagctcccagatttatcaggagccacaaatcttgaagaactgaaacttgggggttgttcaatgttaacaa

SEQ ID NO: 54959 - DNA, 1131 bp, Glycine max
  Peptide Sequence Number=SeqID_171737
atgttccttgaaattctagatgctgaatgttgcacttcacttcagactctgccagagcttccccggttccttaaaacactaaatatcagagaatgcaaatcgcttctgactttaccggtgcttcccttgttccttaaaactcttgacgccagtgaatgcatatcattgaagactgtgttattgtctccttcaacggctgttgaacagttaaaggaaaacagtaaacggattctgttctggaattgcttgaacttgaatatatattctttagcggctattgggcagaatgcacaaaccaatgtgatgaaatttgcaggccaacacctttctaccccaaatcaccatcatgttgaaaattacagtgattataaggataattatggttcttaccaagctgtttacgcataccctgcaagcaatgttccaccatggttggagtataagacaagaaatgattatataattattgatctatcttctgccccaccttcgcctctccttggcttcatttttggcttcgtctttggtgagagcacagacatgaatgaaaggcgtgaagttaacatcactataagtgatgttaagggtaaaggtaaaagggagaccaacagagtcagaatgtacatagattatggcattgggaaaattatatcagatcaggtgtgtgtgatatacgaccaaagatgttctgacttcctaaagagaagagccgaaaatcaaacaagctttataatccaggttacaattcaggcacaatgggcagtcgatccagtgactgatcaatgtttcaatttcatcaaactaatggaatcgggttgtgcctcctatcatcccagactggttcaaaatgatcattttgttagtttgaagctaatgtcgttaacaatattcaaataccagcgactaaaagctaccaaaaaaatgaaaaataaggccaaaaactgttgtagctccttctctctctctccctccttagaattggtaatctcccctcaaaggccaaaacttcccggcatcaaatccctcctcatcaactccctagttcctatccttcctgcatcaaatccctcctcatcaactccctctccaacctgtcggaccctagattggaaaaacgtcaccaaacattaa

SEQ ID NO: 54960 - DNA, 237 bp, Glycine max
  Peptide Sequence Number=SeqID_171738
atgaaggttcgtgatcatcacagctctctaaacctgtctcagaaaaacgacgatctcggactcattcaccgttggattgtcgtaaaatttaaacaccagtatttgtggagggagaaaaaggaatcgcatgaagacagtacaagtggaggtttcaatctcttctccgtctctctgacatttgagaattctatcggagcaatcggaggaataactgaaggaatctcagggaaccgctag

SEQ ID NO: 54961 - DNA, 174 bp, Glycine max
  Peptide Sequence Number=SeqID_171739
atggagatgcagcggaagataaaggagaagtgccgctctagcccaatcctcttggtgtcttctatccaatacccttggggggtaggattgcatcatcccttcccccttggaaaggatttgacctcaaacccagaggttcttgatactctgggcttcttccctcaacacctgtaa

SEQ ID NO: 54962 - DNA, 108 bp, Glycine max
  Peptide Sequence Number=SeqID_171740
atggaacatgaatcacaaagagagaaaagccactcagccaaaaagtcaacctgtgatgaatttatcccttgcacccctgttgagccaaaaggttctaagagagcataa

SEQ ID NO: 54963 - DNA, 336 bp, Glycine max
  Peptide Sequence Number=SeqID_171741
atgtttcagattctactaaaaggagatgtcattttgaaattccaatcacgccaatgtgaccggggatcaacaaagaggattctgctccgattaaaacatccttctcggcgtgatggttcaacagcaagcaacagtggctcgtggtggccactggtggtcatgggtggtggaggaggaggtgttacgacatgggtgggtgtttggagagaaaaaagggtgaaaaatcgtgtttttcacactgagggacatatttataatctgcagatcttgcttaacgagctcatctcgctaagtgagagtccacttttggtgctaagcatgacttttcacgcttag

SEQ ID NO: 54964 - DNA, 702 bp, Glycine max
  Peptide Sequence Number=SeqID_171742
atggacccaccgtcatcatcaacaatggtaccgataaagtcatcgtcgtcgatcgtggagtcgttgcggggatgcggcatttcaggtggcactcgtgtggataaggaggagctgaggaaaaagctaacaatgccaaaataccttcgctttgcaatgcgcgattctatcaggttcaaggacccagccgccggtgagagccgctgcattcatagcaaagacgaccacaacgcggtggcaccgtccacgcctatggttgttttcatcaaccctcgcagcggcggtcgccacggccccttcctcaaggagaggcttcaacatctaatgagtgaagagcaggtgttagatatgttagatgtgaagcctcatgagtttctccgatatgggttaggttgtctggagatgttggccagtcttggagattattgtgccaaagaaactcgtgaaagaatacggattatggtagccggaggggatggtagtgttggctgggtattaggatgtctcacagaacttcacgcacaaggacgagaacctattcctccagtagggatcgtaccacttggtacaggcaatgacttgtctaggagtcttggttggggtggttcatttcctttctcatggaagacagccattaagagaagtctttacaaggctagtattggtccaatttgtcatttggatagactaagggttaaatcttga

SEQ ID NO: 54965 - DNA, 330 bp, Glycine max
  Peptide Sequence Number=SeqID_171743
atgacagcggaatggagaaggaagagagagaggagacgccacttcaaggagaagatgagtctagaaaaagctcaccaccataggaggtcatggataagagcttggaggaagaaggagatgaatgaagggagaggaagagaagagcatgaaattttatggtctaaaagagctctgaaatctgaaattcaactaaaagcattggctgaagaaatgcaagctgtgagtaaaggtttagagaaagttgagcaagaactcgctgcttctgaaaatgatggtggttacggcacgaccgaacggtcggaattcattttaaccgaagttaacggataa

SEQ ID NO: 54966 - DNA, 210 bp, Glycine max
  Peptide Sequence Number=SeqID_171744
atgacgtcggcctcaggccccatcactttcaaaaactgcttccatattaatacatcaggctcaggaataatggggatgactgtggcaagaatagcggctgagatctacgggaatttgagcaagatcaatgatggcttggtcaagccagacatgagtccagaaatttatggaccctatcgatcaccatgtttcagcaagaattttgattaa

SEQ ID NO: 54967 - DNA, 231 bp, Glycine max
  Peptide Sequence Number=SeqID_171745
atgtgggatcggcacaggcttaaaggagcactcaaatcgggtgtatttacccccaagacctacactccgaagagtccgtcagggcctctccctcctgattcaggattccaaaacattagagagaaggagaagggattgaagcctccattccatgatcctacgtgcgatgcctctttctccgttcacaggaagtttttcataaatcccaacggtgaaggtgtgcggaattaa

SEQ ID NO: 54968 - DNA, 2232 bp, Glycine max
  Peptide Sequence Number=SeqID_171746
atggctggggacaagggaaccatcactcttgaagagatcaagaacgagacagttgatctggaacgtattccaattgatgaagtgttcgagcaactgaaatgtaccagggaaggtttgtcctccacggaaggagaaaaccggcttcaaatatttggacccaacaaattagaagagaagaaggaaagcaagtttctcaagtttctcgggttcatgtggaatccactttcatgggtcatggaggctgcggctattatggccattgctcttgcaaacggcgaagggaagcctccggattggcaagatttcgttggtattgtttgcttgttgctgatcaactccactatcagtttcattgaagaaaacaatgctggaaatgctgctgctgctcttatggctggtcttgctcctaagacaaaggttcttagagatggtaaatggagtgagcaagaagctgcaattctagtccctggagacatcataagcatcaagctaggtgacattatccctgccgatgctcgtcttcttgaaggtgatccactgatggttgatcaagcagctctgactggagaatcccttcctgtgaccaagcatccagggcaagaagttttctctggctcaacttgcaaacaaggagaaatcgaagccgttgtgattgcaactggtgtgcacacattctttggaaaggcagcacatctggtggatagcacgaaccaagttggacatttccagaaggttcttacagcaattggaaacttctgtatttgctccatcgcgatcggtatgttagctgagattatagtgatgtacccgattcagcaccgcaagtacagggaaggaattgacaacctgttggtgctcttgattggaggaattcccattgctatgcctactgtgttgtctgtgacaatggccattggttctcacaagctttcccaacaaggtgccatcactaagagaatgactgctattgaagaaatggcaggcatggatgtcctttgcagtgacaagacaggaacactcaccctcaacaaactcactgttgacaagaacttggttgaggtctttgcaaagggtgtggacaaggatcatgtgatccttcttgctgccagggctgccaggactgaaaaccaggatgccattgatgctgccattgtgggaatgcttgctgatcctaaagaggcaagggctgggataagagaggtgcactttctaccattcaatcctgttgacaagaggactgctttgacttacattgatgctaatggaaattggcacagggcaagcaaaggtgctcctgagcagatcatgtccctgtgtaacctcagggatgatgctaagaagaaggttcatgctattattgacaagtttgctgaaagagggcttcgttcacttgctgttgctagacaggaagttcctgagaaaacaaaagaaagtgctggtgctccatggcagtttgttggtctgttgtcactgtttgatccccctaggcatgatagtgctgaaaccattcgccgagctcttaaccttggtgtaaatgttaagatgattacaggtgatcaacttgccatagctaaggaaacaggaaggagacttggaatgggaacaaatatgtatccatctgcttcattgcttggtcaagacaaagatgcaagtattgccgcacttcccgtagaagagctgattgagaaggcagatggatttgctggagtttttccagagcacaaatatgaaattgtaaagaagttgcaagagaggaagcacatttgtggaatgactggagatggtgtcaatgatgctcctgcgttgaagaaggctgatattggaattgctgttgctgatgctactgatgcggcaagaagtgcttctgacattgtcttgacagaacctggattgagcgttattattagtgcagtcttaactagcagagctattttccaaagaatgaagaactacaccatctatgcagtatctatcacaatccgtatagtgtttggcttcatgtttattgcactgatctggaaatttgacttctcacccttcatggttttgattattgccattctgaatgatggaacaatcatgacaatttcaaaggacagggttaagccatctcccttgcctgatagctggaaactgaatgaaatctttgctactggggttgtgcttggaggttacttggcactgatgactgttatattcttctgggcaatcaaagagacgacattcttcccc

SEQ ID NO: 54969 - DNA, 375 bp, Glycine max
  Peptide Sequence Number=SeqID_171747
atggggtgctatgatttttctcttagagagaaaagggcaagtttattcggcactgtcgccacaaccattgccaccgcgtatgatggcaccttgatcatgcacgagccttttgtcttcaccagcaactatggaggcgattctcgcctcgaggcccttcgaaagaatgtgcacaaccccaacgctgtcatgctggccagaaaggcacaacaattggcgcttgcaatcagcaagtcaaatttgctcaatgtgcttgtcatcgacagtgatgtcatcggttccagtgtcacactcgatgtcgtgagtcatccatgggtgctctcttgtgcctgcgtcatatctatttttggttctctcttttgcatctccgttgattaa

SEQ ID NO: 54970 - DNA, 339 bp, Glycine max
  Peptide Sequence Number=SeqID_171748
atggaggctttcctcctgctcctgaccatccttttttatgccatagtaatacattttttgaatcgacatgtttacatgatgagaactgctttgatgaagaacgaaatcagttcaaagctttgctcacaagaaaaggagaagattagttttgcaattagtatggccacaaatttgctagatggtaataaccaacagcaagaaggagaggtgtttgaggattatctgaaggagcttgtgagcctctttaaaaacacaatatgcaagattagttatttgtttgtgatactaataaaagacaagattttttgtgatgctaatatgtcatcttgcacttggtaa

SEQ ID NO: 54971 - DNA, 318 bp, Glycine max
  Peptide Sequence Number=SeqID_171749
atggcgatgaaggctactggtggagaaagattctctatagaggcagtgcagaatgaggtcatagtggtggaaggatctggccaagttgttggaagggagtcaatagggggatggttttacggcaaaattggtcaccatgctcgtggactgctaatatgtaggagtggaacttctagtggagaaaagcttgcatggattgggagaaatcgaccttcgaggaatttttgcaattgtttaaatcaggtggcccctaaaagaaattatgcggatctttggatatggaggagttgtgcggtagggacttatactatgaagtag

SEQ ID NO: 54972 - DNA, 768 bp, Glycine max
  Peptide Sequence Number=SeqID_171750
atgttgggaaaaagaatgggccaatggggtagtgtgggccccgagaatctaagagatggaatcaggaccgtacgtttcgatggaagcaaagccgcggcaatacaaaaagccgcgtttgctttgctcgctcgcactcacaaccacaacacaacgcggcagagcgaagagaaggggcaaaagagaaagaagcgcttatcgaactcggacggaagcactgagttgactcggagggagtggaaagtgttgttgcgtaatgtctggtggtatcgctcgtggacgcctcaccgaggagcgcaagtcgtggcggaagaaccatccccatggttttgttgcgaagccggagacgctgcccgatggaaccgtgaatttgatggtgtggcattgcactattcccgggaagactgggaatttagtgcctctaaggcactggcaccagagactgattgggagggtggctacttcccacttacgctgcactttagtgaagactaccctagcaagcctccaaagtgtaaattcccacaaggtttcttccaccctaatgtttatccttctgggactgtttgcttgtctatacttaacgaggatagtgggtggaggccagccataacagttaagcaaattctcgtgggcatccaagacttacttgaccagccaaatcctgctgaccctgcccagacagaaggctatcatctattcatccaggatgcagcagagtacaagagaagggtccgccagcaggcaaagcaatatccacctcttctctag

SEQ ID NO: 54973 - DNA, 192 bp, Glycine max
  Peptide Sequence Number=SeqID_171751
atgatgatcgcaaaccttgttcatgggaacagaatgacagcagtagggtgcaggaacgacgaggcgggtcgttacatcaatgatggtggtgatggtggtgacaacattggtagtggtagtggtggtgacgacattggtagtggtagtggtggtgatgacagtagttatggtggttgcgctagaatactgtaa

SEQ ID NO: 54974 - DNA, 1689 bp, Glycine max
  Peptide Sequence Number=SeqID_171752
atggaagcttgctgctgcaaccttgaagtggatgtaaatggagaagagactttcatggtggacaaggatctaatatctattctacaacatactataatctgtagatattatgttgaacatggtagtcgcgagactgttattactcagtattcaaacaaatttgctagactgtttggaaagtctagtggtgccacaggaaagcttaaagtaatattccatgattttccaggaggtgctgaaggctttgagcttatgttaaaattctcttacaacaatggaacagctgatataagtccttccaatttgtttctggcgtgttgtgctgctgagtacatggaaatgaaggaacctgtggctgatgtttctaacttattggagcaaactgaaaagtcactccaagagattagctattggacttggtcagatcttttaattggtttgaaacagtgccagagtttactagttccagattcttctgtgatggtagagagatgcttggatactattgtgggaaggcttgttttggccagtgaagcaagtccttgtccatcaactagttccacagacagttcttgggttcggtattcgtgtgactctaagagcactgagagtgtaaaaacaagtttctctcgtttaacatggtggtttgaagatctcctgtttttgagtcccttgttggttgcaatgttggttaagttaatgctttcacgaaagatggatcatgttgtgatcagcaagtttcttctctactatcagaaggccaaattttccactgctactacacatgagaagtgcaagatcatagaaatggtcatagatatgcattatgatatggatttaagttgtgttccttgcaagacattgtttgggattctgagggttactttgggtttgaacataagcaaatgtagcaggaataagttggagactatgattggttcccaattggatcatgcaaccttggacaatttgcttgttccttctccttatggaataagctacttgtatgatgtgaaccttattttgagatttttgaaggcattcttgcggcgaggaaatggtctagtcactcccattcggaaagttgctagcttaatagatttgtatatagcagaaatagcccctgatccttgtttgaaaacttcaaagttcttggctcttgccacagcaattccagattctgcaagagattcttatgatgagctctaccatgcaatggacatgtatcttgaggtacacactcaattatcacaggaagaaagactgaagatatgctgtggtttaaattttgagaagctttcacctcaagcttgtctacacctttctcagaacaaaaaatttccttcaaaatttgcggttcaagctcttatctctcaacaatctaagctgaaaaatttactccatatgactcccagtacatcttcatacaatgattcaccttgcaactccagtggtgctgctcaaaagggaaagaaaaacaaaaccagtgaacaagttgtgttgtattctagcaattttgatatttctacagacaatgagaaactcgaagcacatttacaaggaatgcagtggagggtcatggaattagagaaattctgtaggaaaatgcaaatccaaatggcaaagatcacaaaatcaaaagcatcaggccatagttatgcaaaatctttgcccaagctatgctcatga

SEQ ID NO: 54975 - DNA, 342 bp, Glycine max
  Peptide Sequence Number=SeqID_171753
atgggagaagataacttagaggcactacttgctcaacaaaaatatgctattgaaaaggctggtttcggttacactcgtaacaaaaagccaaaaacttacaaaaacgttttcaacttcacaaaagcttctagctcacccttcacagtgttcatagcagcgaaaagacaactatggtacctagatagtgactgctcaaggcatatgacaggagacaaatcaaaatttgtgtctcttaaagcaaaagaagaaggttttgtgacctacgaagaaaacaaccaaggaatggctaaaacactacttattaaacataagccatggaagtgcttaaacacaacttattaa

SEQ ID NO: 54976 - DNA, 462 bp, Glycine max
  Peptide Sequence Number=SeqID_171754
atgaaaaaatcttgcgataggggacttaagaatattttgcggatgcatgtcaaaaagatcaattgctcagaatgggagcaggttctagttcctacaagtgtaagagcaatagttgctctaaatcttcatagttatggaagtggaagaaatccatggggtaatttgacacctgagtatttagagaagagaggcttcattgaagcacaatttgatgatggacttttagagatatttggtctaaaacaaggatggcatgcaacatttgtcatgagtgaactaatttctgcaaagcatatagcccaggcaacagctattcgattggaagttagaggtggggaatggaaagatgcatttatgcaaatggatggagaaccctggaaacaacctatgagcaaggacttctccacttttgtggaaataaaaagggaacctttccaatcaatcatgattaatggagaataa

SEQ ID NO: 54977 - DNA, 369 bp, Glycine max
  Peptide Sequence Number=SeqID_171755
atgacattgatgacagagaccttgttattggcagacagaggaggaagattaacaacaaccttcttggacatgagcttggacatctatgtttcaagagatgaaagatttggtcacttgaaattgtcaaactttcttgctaatgcactgaaatccatagctcaagttgtcaaacctaagttggaattactattcgacaacacccctgaagattttgatagctttgaagatgtatttaaactctatgaagatgagattaaggtgccagaaagtatactaaagaatattagggataaaatccctgtagagatgctcaaagaaattctccaagctgatggtgaaaggtccctcaagtttccaatacctaagtga

SEQ ID NO: 54978 - DNA, 327 bp, Glycine max
  Peptide Sequence Number=SeqID_171756
atgagtcctcgtgaacgtgtttgcaccactgccaactgttcgcaattgcaaacaagcggcagtggagctccatcgctaacaccatcgagcttcaaacaacgacatttccaagtaagaacaaggtgcagaagaattgggaatgaggaaaaccctaattttgtgtttgggtataaaaggggaaagatgaagttgattgtgctgccaacggtcacatgtataacctcccaagccatgtcacctgacacatacgtagaaaacaaacacttggtggtgattgtaacgacgacaatcttaacaatgaagatgatgaagattagcgacaattag

SEQ ID NO: 54979 - DNA, 231 bp, Glycine max
  Peptide Sequence Number=SeqID_171757
atggggtcagaacctaaagtggggtgctttgaattaactgacttgttaaaattttttgtgttgtcaagagaaggaggcacaattgtgagggtaagactggcctattggggaaaagggtaccctccattgccacaagcaagtgcaatggcaacagaagaagaagaagaagaagaagagaggtttatgatgggttcagggtgtgaacataaggatgagattgaaagcaattag

SEQ ID NO: 54980 - DNA, 1722 bp, Glycine max
  Peptide Sequence Number=SeqID_171758
atggtggaaggactctatagactcaagatgattcctatcaagtctaagtacaagtctaattttactggttctagcatttccaattttctgccttttcatggtccttgcaatgtaacttcattaaatggttacaagtatttccttactataatagatgattactcaaggtttgtttgggtttttctcatacagtcaaaagttgagacacaatctcatctagagagttttgttgccaatgttgagaggcaatttgagacaaaagtaaaagtgattaggtcggataatagggcagagtttatcatgagacaattttatgatgatactgctaatagaaagaaactagatcctagggctgccacttctgtatttttgggttttaaaccaaacaccaaaggatttattatgtttgatcttaaaaccaaggtcatatttgtctctaggaatgtgatcttttatgaggattattttcctttcattggtcaagacaaacctgatgctgtcattgtccttcctattccttcttctcatgccattgatcaacctgatggtgtcttatcagaattaccagttgatattatcatgcctgtaccaaataatgttgattctgatcccttaactttagagcagtcctataatacaaccagaagatatctgagacagacacacagaccaagtaagtataaggacttccatgtttcatacccatcttcaactatagctagttattctacagatgggtcagtggagagacataaggccaggttagtggccaagggctacactcaagtggaagggcaagattacctagacaccttttctccagttgtcaagctaatcacagtatacatgatgcttcctcaaggtatgcaagtagccaagcctgggcaagtttgtaagttgcaaaggtccctatatggactgaaacaagccagcaggcagtggtatgccatgctctcttcctttttgatctctcatgggtacaagcagtgtgcttcagatcattctttgtttctcaagcatggattcaatactgtcactgctctgttagtttatgtagatgatattgttttgtcaggaaatggtttgattgaaatacaagctaatacacagttgctggacaatgtttttaagataaaagatttaggtgacttgagatacttcttaggttttgaagtagctagaaaacctattggtatcaatctttgtcataggaagtatgccttagacattctcagtgatgctggtatgcttggatctaaaccagtatctactccatcagattatgctactaagctacatcaacaatcagggacttctctttcattggaagatgcttcctcttttagaagatatattaagggatccccaggagctgcaagtaaaatacatttaaagggttttattgattctaactggactggttgcattgacacaagaaggtttatcactggttatgctatgtacattggtgactcactgatttcatggaaatacaagaaacaagccgctgtatctagaagctcatcagaagctgaatacagggcactagccagtgccattggtgaaatacaatggcttacctatcagctggaagaatttagagtagactttcagcaacatgtcactctgtattgtgataacaaatctgctcttcacatagcttcgaatccaatatttcatgaaagaacaaagcatattgagattgattgccacatagtttga

SEQ ID NO: 54981 - DNA, 150 bp, Glycine max
  Peptide Sequence Number=SeqID_171759
atggttaggggggtgttggactatagtcgagggggattagctaaaagcaagaagtgtttggccatagttggagggccaaagggtgttcgaccatggttgaggggtatctggccatggctgagaggtgttatccatagtcaagaggcgtga

SEQ ID NO: 54982 - DNA, 375 bp, Glycine max
  Peptide Sequence Number=SeqID_171760
atggaagtaacacagagcttgcaaaaagaaacatcatcatcatcatcatcatcatcatcatcatcaatggcaccgaagagcgccaactttaatgatgatgaagaggacttgatggtagaaggaaaggactctggggagaatgttgtgggagaaaggcatgggttgagaagaggccttcaacatcatgccaacaagttccttaacgtttccaatgaagaaacgataaggggggcctctgattccttgcttggagaaatgggcttcaatttttctgggtcgccaccagaggaggatggtgagcttgaggaggaagagaaggagcatgaaggagaaagagagaagcttgagggaggagaagatgtcctccatatatga

SEQ ID NO: 54983 - DNA, 1386 bp, Glycine max
  misc_feature (72)..(72): n is a, c, g, or t
  Peptide Sequence Number=SeqID_171761
atgaaattgaatggatgtgctcctaatcgcgctacgtggaacaccatgcttgctgtatgtagtgaggaggtnaagcacaattatgttaacaaggtcttgagggaaatgaaaaactgtggatttgagcctgacaaagacacattcaatacattgattagttcatatgctcggtgcggatctgaagttgattctgcaaaaatgtatggggaaatggttaaatcaggctttactccatgtgtaacaacttataatgctcttctaaatgccctggctcatcgaggtgattggaaagcagcagaatctgtcattcaggacatgcagaccaagggctttaagcccaacgaaacttcgtactcactgttgctccattgttattccaaggctgggaatgtcagggggatagagaaggttgagaaagaaatttatgatggtcaggtctttcctagctggatacttttgagaacccttgtcctatcaaaccacaagtgcagacaccttaggggaatggaaagggcatttgatcaacttcaaaagtatggatacaaaccggatttggttgtcattaattccatgctttcgatgttttcccgaaacaagatgttttcgaaggcccgtgaaatgctgcatttcattcacgaatgtggattgcagccaaatcttttcacctacaattgcttgatggatctgtatgtccgagaggatgagtgttggaaagcagaagaagtgctcaagggaattcaaaactccgtaccggagccagatgttgtgtcttacaatactgttatcaagggattctgcagaaaagggctcatgcaggaagctattagagttctctcagaaatgaccactaaggggattcaaccaactatagttacatacaatactttcttgtcaggctatgcagggatggagttgtttgatgaagcaaatgaagtcattagatttatgattgagcacaattgcaggccaagtgaactaacttacaagattctagttgatggttattgtaaagcagggaagcatgaagaagccatggactttgtgactaagattaaggagattgatatctcttttgatgataaatctgtgaaaagactaggttcttgtattagggagaaagtgggatctactttgacatgtctcattgagtccatgcaggcttttggacctttattcaaggcttttacttcctacacctgcttcattttgcttcctgcacccccattgcacaaaaataccctcactttctccaacgacacccccatgccagagaagctccactatatgtttgcgccactattgatgccgcatccaaaggctatggcaaaaaaatgcttgaaacaagaagatcgaaaaacaaaaccttcaacatcacacttggagtga

SEQ ID NO: 54984 - DNA, 1299 bp, Glycine max
  Peptide Sequence Number=SeqID_171762
atgttgttgtatatgtttggtgcaacattcctagtttggtttggacccactgttcgtctcaccgtctctgagccagaactcatccgggaaatcttcacatccaagtcagaattttacgagaaaaacgaagctccaccacttgtgaagcagctagaaggtgacggactccttagcctcaaaggagaaaaatgggctcaccacagaaaaattatctctcccacttttcacatggaaaatctcaaattgctgataccggtgatggcaacaagcgtggtagagatgttggaaaagtggtcggcaatgggtgtgaagggagaggtagaaatcgaagtttcggagtggtttcaaaccctaacagaagatgtgattacgaggacagcgtttggaagtagctacgaagatggaaaagccattttcagattacaagcccaacaaatggacttagccgccgatgccttccaaaaagtattcatcccaagggtttacagattctttcccacgaggaggaatataaaatcttggaaattggagaaggagattaagaaatcgttggtgaagctgatctggagacggagagagtgtggtggggtggaggaaaaagggccaaaggatctgttggggctaatgattcaggcctccaacatgaattcttcgtccaatgtcacagtggatgacatcgtggaagagtgcaagagctttttctttgcaggaaaacagaccacatccaacctgctgacgtggacgaccattctccttgctatgcacccacactggcaggtacgggcacgtgacgagcttctcaagctgtgcggatcacgtgaccttcccaccaaagaccatgttgcaaagctaaggacgctgagcatgattgtgaacgagtcactacgactgtaccctccgacgatcgcgacaatcagaagggccaaagcggacgttgatttggggggatacaagataccacgtgggacggagctgctgattccaatcctggccgttcatcacgatcaggcaatatgggggaacgatgtgaacgagttcaatccggggcgtttcagcgatggtgtggcccgcgcggggaagcatccattggcgttcataccgtttggtctcggtgtgcgcacatgcatcggacaaaacctcgcagtgctacaaacaaaactggccctggcaatcatactgcagcgttttagtttcaggttggcccctagttatcagcacgcaccaacggtcctgatgctactctaccctcagtacggtgcaccaatcattttccaacaattctcacaatcctcttcttaa

SEQ ID NO: 54985 - DNA, 366 bp, Glycine max
  Peptide Sequence Number=SeqID_171763
atggagtgggacagcaattccgatctcagcgacgacgaggccgtttcgtttatgttaaacgacgacgatgatgacgccgttggacccctacccttccccgttctccaaacggcgccgtgcggcttcgtcgtcaccgacgccgtcgagcccgaccaccccatcatatacgtcaacgccgtcttcgagatggtcaccggataccgcgccgaagaagtgctcggtcgcaactgggacttggatttcttttgggatttttgttgtctctgtgttgagcggtgcgtttctcggttctatgccggagaactcgttcgggtatcaagggattggggaaattcacttaataggtttgggaatcccattctgtag

SEQ ID NO: 54986 - DNA, 528 bp, Glycine max
  Peptide Sequence Number=SeqID_171764
atgaaggcagatgtcacagagcaagagttagaaatccacccacaccactcaaacagaaaaactgggatttctaatatgattgacatggagaggaggaaagagactggcactgtgggttgttcatttggagaaaacagagaatcaaatcatgctgatagtattacatgctcagttggtagttgtagtatcactagcaggaattcctgtaaactgcaatttcctgtatctgcaggtccttttgatgatgtagacagttcatttagtgatgctgagtctgtctgccagaggagtgatgaggaaggggattgttcccctcctacacaagaggaattggcagcagaaattcataggttagagttgcatgcctatcgttgtacaattgaggcattgcatgcatcaggccccttaagttgggaacaggaagcattaatgacaaacctccgtctttcgctccacatatcaaacgatgaacacttaatggagctaagaaatttgatttcttctgaaaacagcattcctttaagatga

SEQ ID NO: 54987 - DNA, 195 bp, Glycine max
  Peptide Sequence Number=SeqID_171765
atgactcctgatgaccggctcagacgagtatgcaaaaacaacagattggagaaggcagctgacgtcttgcttaagacaagggcaattgtgaagctaaagtctggcttaagcgaggattccagtggctgccaagaattgaagatcaagtatcacttaagcgaggtccaactggcgcttaaacgagggatgtcctga

SEQ ID NO: 54988 - DNA, 1544 bp, Glycine max
  Peptide Sequence Number=SeqID_171766
agatcagaagatgccttgacgaaggggttgaattccaaggtgagttgctgaactttaggaaagatggatctccacttatgaacagattgcggctgacacctatatatggagaagatgagataactcatgtcatcggaatccagttctttacagaggcaaacattgatcttggtccccttccgggttctacaattaaagaatctactaaatcatcagatcggtttcattctgtgctttcttcgttgaatcctgttccagtgggggatcgcaatgttactcgtggaatttgtgggatatttcaattaagtgacgaggtattgtctctcaagatacttgctcgtttaactccaagagatattgcatcagttggttctgtttgtaggcatttgtatgagctaacaaaaaatgaagacctttggagaatggtgtgccaaaatgcttggggcagtgagactacacgtgttttagagaccgtgcctggtgcaaggaggcttggatggggtcggctggcaagagaactgaccacccttgaagcagcagcatggaggaaactgactgttggaggtgctgttgaaccttcacgctgtaattttagtgcttgtgcagttggtaatagagtcgtcctatttggtggtgaaggggttaacatgcaacctatgaatgatacctttgtattggatctcaattctagtaatcctgagtggcaacatgtccaggtcagttctcctccccctggtcggtggggccacacactttcttgtgttaatggttctcgtttggttgtatttggagggtgtggaacgcagggcttgctcaatgatgtgtttgttctggacctggatgcaaagcctccaacttggcgtgaaatttctggattggcacctccacttccgagatcatggcatagctcctgtactcttgatggtaccaagttgatagtttctggtggctgtgctgattctggggtactcttgagtgatactttcctccttgatctgtcaatggagaaacctgtctggagagagataccagtggcatggactccaccttcgcgtctgggtcacacactatccgtttatggtggcagaaaaatactgatgtttgggggtctggccaagagtggggccctgcgttttcgctccagtgatgtgttcacgatggatttaagtgaggaggagccatgctggagatgtgtaacagggagtggattgccaggattgccaggtactggaaatcctggaggcatagctcctcctcctagacttgatcatgtggctgtcagccttcccggtgggagaattctgatatttggtgggtctgttgcgggccttcattctgcctcccagctttacatactagatcctactgatgagaagcctacatggagaatccttaatgtacctgggcgccctccaagatttgcttggggacatagtacatgtgttgttggagggacaagagctattgtaatgggtggtcaaactggggaggaatggatgctaagtgaactccatgaactttccttggcaagttctgtcagttag

SEQ ID NO: 54989 - DNA, 318 bp, Glycine max
  Peptide Sequence Number=SeqID_171767
atggatacatgctatcataagcttggttttcaatttggttctatatacaagggtagtgattcgtaccaaacaatgcggggtaatgaagaagaagattgcaggaataaatttagcaataaggccatgaaatttacttgggtcataggcctaaaagttaaaagttgggttgcctatgaagaaaaggcaacaacttctcataaatggaaatacttggatcaagattttggtcctactaatgatcttcatcaaaaattcaaatggttagcaatactgaacaagcgagtcatcggttgggggaaagaaaaggaacgcctttaa

SEQ ID NO: 54990 - DNA, 1555 bp, Glycine max
  Peptide Sequence Number=SeqID_171768
atgtatttgagaggtttgaggacaacaacggtaatttcaaggcaagccttagcagagatatgaagggaatgttgagtctgtacgaggcatcgtttctcagttatgaagaagaactgattctggataagaccaaggccttcagtagcttccatctaaggggtgccctcaaagaaggtagaagcaatagtatgctcttagaacaagtgaatcatgcattggagcttccactgcatcacagaatccaaaggcttgaagccaggtggtatattgaatcttatgctaaaagaaaggatgcaaattgggtgctgcttgaagcagcaaaactagatttcaacattgtgcagtcaacactgcaaaaggacctccaagaaatgtcaagcatgggaatggcattcgagcctcagttcagtgatcttcgcaaaggtttaaccaaagtcacttctctaataactacaattgacgacgtttatgatgtttatggctccttggatgagctagaacttttcacaaaagccgttgaaagttgggatattaaagctgttcaagttatgccggagtatatgaagatatgtttccttgctctctacaacactgtcaacgaattcgcttatgatgcccttaaaatcaaaggacaaaatatccttccccatcttaccaaggcgtggtcggttatgttgaaagcattcttgcaagaagccaagtggtgccgggataaatatttgccaccatttgaagactatctcaacaatgcatgggtgtctgtgtctggagtagtgatactgacccatgcctatttcttgttgaatgataacatcactaaggatgcacttgattccttggacaattatcatgatcttttgcgtaggccatccattatttttcgactttgcaatgatttgggtacttcaagggctgagttacaaagaggtgaagcagcaagctcgatcgtgtgtaacatgcgtgaaagttgtgtaactgaggagggtgcttacaaaaacatacacagtttgcttgatgaaacttggaagaagatgaacaaagatcgagccatgcattctcctttttcaaaaccatttgtggaagcagcaatcaaccttgctagaatctctcactgcacataccttaatggagatggccatggtgccccagatattgcagccaagaatcggattcggtccttgataattgaacccatcccacttagggagataaatgcggatattgttcaccctaccccttcttccattgaagctccttcacttgttcttccattgaagctcctaccccttcttccattgaagctccttcacctcttcgacttcatcgctccaacttctccgctcgaacttgaggtctttgaccacgagaagtttaacaattgggtggagaagggtgtagctccagccattgaacccagtttaaagctctatgaagatgttttgaatctgggattcaaggttattctactcacaggatggagtgaaaggcacaggagtgtcactgttgataatttgatcaatgttgggtttaaggaatgggaccagctcatactaag

SEQ ID NO: 54991 - DNA, 502 bp, Glycine max
  Peptide Sequence Number=SeqID_171769
atggccctagacagcagttccatgttgctaaatttttccttcaccccaccacttgttagtttcagcaaacatcaaaaacaacgagggattaatcttctagtgcgtagaattggttccaccagccagtattactgcttggcaacaagcacaaacgttcgtgaaagaaaatcagccaattaccagcctaacctctggaattatgattttttgcagtcattgaagaatgactatgcggatgtaaaatatgagataatggccaggaagctggaggaagtgaggagaatgataaaggatgaaaattcagaaatatgggtcacactagatctgattgacaatgtgaaacgcctgggcctcagctatcactttgacaaggagataagagaagcccttcataggtttctctctttagaaagatgtagtgccacgaatattcacacaggcctgcatgagaccgctttaagcttcaggctccttagagaatatggagatgatgtttcagcag

SEQ ID NO: 54992 - DNA, 696 bp, Glycine max
  Peptide Sequence Number=SeqID_171770
atggaacaacctaatattgatagattgaacattgaaggtgaagttgacatggaattcaacatccttgaatatgaagaaaacgctattgatatgtccctctgtctaatgggtgattttcttgccaatagaagcatttgggtccctatgaaagaacgaatggttgaagtttggagacatataggagaaattaccattgatgaacttcaaccaaatcattttctcttcctgttctatcacaagaggagcgatgaaaacctaaagagcattcctctatatatgctggctttttgggtacaaattcataatctcccactgggtttcatgactcaagtcattggacagaatcttgggaactttattgtgaattttttggagtacgacgaaaagaataacttgaactttttacctcccttcatatgtattcaagttctgatagatgtaggaaaagcattgaataaatcaaagagaatcaagaggaaagaaggtgaggctacaaaggtttccttcaaatatgaacatctcagacctttttgctacctatgtgaactaatgcgtcatgttaatgaaatctacgacaaacatcttaaaatggtggttgatgacaaaataaaaaactggggcccaaaacaaagagcaaagcttcgtaaattagtcgataatggtggctcttggtggctacacgaagaaggtgactag

SEQ ID NO: 54993 - DNA, 438 bp, Glycine max
  Peptide Sequence Number=SeqID_171771
atggctccagttcctttcttgaaaagcttgaacactgctccaaagacacaaactcgtaggctaagcaactttggtgcaaatatagtaggaaaattgaaacatgcaggcgtcaactggaaaatgtcaaggaatctaacaacgatgatgtcagtctctctttccaatatcccctacaaaatcatttcaaaagtcattgccaatcgcctaaaacctctttggcctaaaatcatctcagaagaacaaccaacttttgttgaggactgttctatcatggataatgttctcctggcattagaagttatccaccatatgagaagcaaatccatgggcaaaatcggtgaaatttctctaaaggttgacatcagcaaggtttttgatataattgattggaattacctccttaatctatcgaggaaaatggattttcatgagaaatga

SEQ ID NO: 54994 - DNA, 228 bp, Glycine max
  Peptide Sequence Number=SeqID_171772
atggaaagatttgggaattggtcaatccactccacaattgtgagacccctatcaagtatactggtaacattccattggaagaccaatgaggttacaatcaagaagagtatgatgaaagccttgcataagccaattaggatgaacaacaaagccagtcatgtcattgctggaaagaaggttgctaaagtctctaatgataagccaaggaaaaagagtgtcttgagttaa

SEQ ID NO: 54995 - DNA, 210 bp, Glycine max
  Peptide Sequence Number=SeqID_171773
atgtcaggtccccattcacagtttttcgtcatcaatcaccatggtgaacaattttccatagaggtcgttggccaaagaagaggaggtaaagctgttgatgactcgcttagcgaggtagattcactcagcgagactcattcgcttagcgaggcatccaactcgcttagcggatgggaaaccctagaagaggataagaatggagtgcagtga

SEQ ID NO: 54996 - DNA, 246 bp, Glycine max
  Peptide Sequence Number=SeqID_171774
atgggaactctggaagaggcacataaggataggagagtggttcaacctgcaggaaatagtgttggagagggaacaatgggggaagatgtcaaaccatgcttgagtgctcatggttcgatccaatctctcttctacttcatccgagacattaaaagcacccaaaatgcaccaagggtgggagatgtcaccagagagctctctagggagtttccaagaatcacgtcttttgtctataaaaaccaatga

SEQ ID NO: 54997 - DNA, 461 bp, Glycine max
  Peptide Sequence Number=SeqID_171775
cttccgacatcgaagctcttcgatctggagttcccttgcaaaactttgggaaggaggatttcgctttggcgactcaggagtacgggattaatggcgtgttagcgatttttaatatcgggaatcggaccggtcaggccagggcggatttctatgccagcttgaacgggctggttcagcagtttttccaatctttgccaatgtcggtgccgttgccattcaagcacgaagagagttcggtgggggtaaagggtggggataaggggtggcagagaggagaggttgcagttactcaggaggatttgggattgcttagtgagaggttgaagaatcatgggtttgctgagagtgttagtggcaatggtggtggaagcgcggaggaagaaggtgatggaaggtttaacattgggtctattggtcttctgggcaggcttgttattgtttatttgcttattgatcgttag

SEQ ID NO: 54998 - DNA, 336 bp, Glycine max
  Peptide Sequence Number=SeqID_171776
atgaggactaacatgaaatcgtcacttgtgtgttgttgtcgctgtgtcacctctaccacaccatggcacaacctttgcaaattcgatctcgctgcgaagtgcttccagcgtgccacagatctagtctcaacgcttgacatcaactcaatcaccgatgtcggagagaggaaactattttcagatttgaacttggctcggtcccaaaccgcatgggaggttcgggatctgaacctggtggtggcgctgctgaatcagagcaagagcttcctcttcagcacttgcgagcactacggggatctcgcaaagcagtttatgacattcagattcagttattga

SEQ ID NO: 54999 - DNA, 465 bp, Glycine max
  Peptide Sequence Number=SeqID_171777
atgaccattatataccttcagctgaaaaagcttcgtcgtcattaccaacctcctacaagcagatcaaacgtattaaccatagcaattgcagcaatcatggtcaagaacctttgctctctatatgccattctcctcctcttattaacattaggagatctgatggctacggtggttggtgataggtgtaagacagatttgggggtttgccccccaaaaaatggttgtaacgagaagtgctcaaaaattcatcaaggtggtcagggaatttgcgaccagaacaatctttgcatgtgtaactttgattgcaaattatgtgacgtggttatgtctgatcaactattaggttgcactgacatttcatgcacttctgagtgtgctgccaagtaccctgggaaagaagctactggatattgtgttggctttggagagccctatactaattgtcactgtcagtaccaatgttaa

SEQ ID NO: 55000 - DNA, 387 bp, Glycine max
  Peptide Sequence Number=SeqID_171778
atggccaagaacatttgctctctatatgccattctcctcctctcattaacattagttgcggccattgtggtggcaggagatctgatggctacggtggttggtgataggtgtaagacagatttgggggtttgcccagcaaaaaatggttgtaacgcgaagtgctctaaaattcatgaaggtggtcagggaatttgcgagaacaatcattgcatgtgtaactttgattgcaaaatatgtgacgtggttttgtctgatcagctattaggttgcactgacatttcatgcacttctgagtgtgttgccaagtaccctgggaaaggagctactggatattgtgttagctttggacagccctatactaattgtcactgtcagtaccaatgttaa

SEQ ID NO: 55001 - DNA, 363 bp, Glycine max
  Peptide Sequence Number=SeqID_171779
atgaggagagtgtgcagtacaggagacttgcagaacatgaaatcaacagatatgtctcaaaaagggagccccttgttggaggaagcaaacttcaaagtagggcgttatagtgctgaagaaagaaaagaaaaaatctctaagtacagagccaagagaagccagaggaagttcaacaagataattaagtatgcatgccgaaagacactagccgacaatcgaacccgcatacgtggcagattcgcacgcaacgacgaaatcagcgagattccgaaagctccttgctcaagttcaaccacagaagaatatgaagacgagttctgggttgaattcattgaaggattaaatgaggaggtcatggcttaa

SEQ ID NO: 55002 - DNA, 321 bp, Glycine max
  Peptide Sequence Number=SeqID_171780
acttatcaaggtaatccttgtggcgtctacccagacttatcttccttcattggaagtggcgtctaccctgacttatcttccttaaccggaagtggcgtctacccagacttatcttccttcaccggaagtggcgtctaccctgacttatcttccttcaccggaagtggcgtcatccaaaaactctacagcctgtatcaagtgatccgccccgtgtacccctcgaatcttcccaacagaaccatggtcttccaatccccaacatgttggaatcatcccagagagcacgtatttgttcttgggaaagctgaagctcctcactag

SEQ ID NO: 55003 - DNA, 1113 bp, Glycine max
  Peptide Sequence Number=SeqID_171781
atgaaagatatgaattccacccttcctcgtactctccctgaggatttgatcacagaaattctgatgatgttgcctgtgagatcgatattgcgttttaaatgcatgtgtaagtcatggttttctcttatttctgatccagaattcgctcgatcccactttgccctagctgcaacacccaccaccagattttttgtgtcagccgacgatcatcaagttaaatgcatagatatagaggcatcacttcatgatgataattctgccaaagtagtctttaactttcctcttccgtcacccgaagaccaatattatgattgccagatagatatggtgggttcatgtagaggatttatactcttgataacccgtggtgatgtctttggtttcatcatatggaatccttcaacgggtctccggaaaggaattagctatgcgatggatgatcctacatatgatttcgatcttgatcgatttggctttggatatgactcatcaactgatgactacgtgatagtgaatttatcatgtaaatggttgttccgcacggatgtccattgtttctccttgagaaccaattcatggagtcgcattttgcgtactgttttttattatcctcttctgtgtggacatggagtgttcgttaatggggctcttcattggtttgttaaaccctttgatcgtcgtcgtcttcgagctgtgattatttcatttgatgtgacggaaagggaattatttgaaattccactaccacttaatttcgaccttaaagatccaatatatgatttgacggtcatggaaggatgtctgtgtctcagtgttgctcaagtgggttatggaactagaatttggatgatgaaagaatataaagtgcagtcgtcgtggaccaagttatttgttccaatttacaatcagcgtcatccttttttccctgtcttttgctcaatatgtttaaccaaaaaagatgagtttttgggatcaaatcataagacattagtgaaacttaataagaaaggtgatttgcttgaacatcgcgcacgttggcactacgtggactattgtagtattttagtacgccgtggtgtgtacagagagagtttgctatcactccctgagtaa

SEQ ID NO: 55004 - DNA, 807 bp, Glycine max
  Peptide Sequence Number=SeqID_171782
atgatcaagctgattgatgaggaagcagattcatttgcaaggagggcagaaatgtactataagaagcgtccggagctcatgaaattagtggaggagttctaccgagcataccgtgctttagcagagagatacgatcatgcaatgggagagctatgccatgcccacaaaacaatggcagaagcatttcccaaccaagcacattacatgctgaccgatgattcgcagggtgttgaatcacacactccaggagtgccttgtccaaattattccgagtctgagcatgcagagaaagcagatagtgaagttcaaaccttgaggaaagccctggccaaaatacagtctgacaaggatgctatctttcttcagtatcagaagagtatggagaagttatccgaaatggaaagagatcttaataaggcacaaaaagatgctggaggccttgatgaaagagcaagtaaagcagaaattgaaactagagtgttgcaggaagcactggcacatctaaagtctgacaacgaagctagtcaagttcagtacaaccagtgcctagaaagtatagctaaactggagactctgttatctcttgcccagctggatgtcaaggaatttgatgagagagcttctaaggctgaaattgaagccaaaaatctaaagcaagaactaggccagttggaagctcagaaggatgctggtcttcttagatacaagcagtgtgttgaaaagatttcagttttggaggccaagataacccttgctgaggagaattccaggatgttaaatgagcaacttgaaagagcagaactggaa

SEQ ID NO: 55005 - DNA, 1158 bp, Glycine max
  Peptide Sequence Number=SeqID_171783
atggaagccgaacccaaattctcggagtccgaagttgtgcgccaaattgacgtcttcttctcaccttcggtcggtgctcagacttggctatacgtttttcggcagctttccacgtcgcctcgttggcgaccgtactcgttggatgaacaatgccaagaggaggtacggttcaaccctaaacattcagaattcaaacttgatttagccattgacaaagagttcaaccagactttttcaactttgtggaagccatataaatcagtaccatatgttgaacctggatatgctgttgggcttcttatgggtgataagttgcacctgcatccaatccatgaagttgtgcatcatcttaattctgctgagaagtctgttagtacatctaaagagcagtgggttcctctaaagtacctcagctgcaagagtgatatctcttgtagttatttacagcaaatggtggtggcagaagagagttcttccacaaacaacttcactatgagcgcgaatgattatgttactgctctgtgtactggagggagcagcaacaattcaccaaaagtcgaaagaaaatctagcgtggaagttgcatttagtcttggaagttcatcatcacattccctcgggacatatggcacaagcaaatctgtagatagtggcacaagcagtggctcaccatctaaggatcaagaggatcaaaatgatgcttctaatgcatttgccaggaaaatcaaggaacaatgggattatgaaaactcttacaatgctactcttggagattcagaaattcatgatgcggaagagtatgatgagaattctgtgaattctgctgcagaactccggatcttggagaagagtgaggaccaaaggatgtttttctttaagattcctgcttatctgcctggtacatcaactgtgtcgggagagcccacacacttgaaagacttgccaaggggatacatgggcaaaatgctggtgtacaagagtggagcaatcaatctaaaactaggagaatctctgttcgacgtgtatccaggttcaaatcgtggacatgttgaagatgttgtggcggtgaacacacagaaacagtgttgcaatcttggcaagattagcaaaagggtcaatgtgactcccaatattgattttctagacaaatataactaa

SEQ ID NO: 55006 - DNA, 1179 bp, Glycine max
  Peptide Sequence Number=SeqID_171784
atggagcttaaatatgggcttcagttgttgaaggatttggagtttccgaaacagggttttaaggaagaaatgcaagagaatgtgaaagaaaacaggatcctgaatgaacttactttctcttccactaggtcgttattaagaaggcagcaaacagaaatctctaaattaaaggagatcaaagagaaactggaacgagagcttgttgtaaactctgaagaaaacaatgccctccagcaggaagctcatcaaataaagaatgatatccagctcttgaataataaatatcatgctatgctggaacaactacagactttaggtttggatcctaaatgttttgcagcatctgtgaaagatttacaaaatgagaactcaaatctaaaggaggtctgcaagatggaacgtaatgagaaagaagctcttcatgaaaagtcaaaggatatggatgaacttttgattgagaatgcctttatggaattttccctctcaagattaaatgatgaattagatggattaagagtaacagtgaggaaatttcaagagtcttgccaagttctccaggaagaaaaatctacggtcgttgatgagaaatcagctctactttcacagttacaaatagtcactgaaagtatgcagaaactattggagaagaatgccttgttggagaagtccctctctgattcaaagattgagctggaaggtttgaaggctaaatcaactgacttggaagaattctgcaagttgctaaatgatgagaagtacaatcttctaaacgaaagaagcatcctggtatctcagttggaaagtgttgaggctaaactaagaaacctggaaaagttgtttaccaaattagaagaaaaatatgctgactcggagaaggacaaagaaagcacgggcaatcaagtagaagagctccgtgcttcatttttggtgcaaaaggaaaagcatgcaaatcataaacacttgagtgaagtccgactgacaaatttggagaatctttttcatgcactacaggaagaactgtggttggggaagattgaatttgaaaaagaagttgacaaagctgtaaatgctcagatggagatgttcattttgcaaagttgtatagaagatctggggcagaagaacttggccttgttaactgaatgtgaaaagcatgttgaggcatcaaaaattttctaa

SEQ ID NO: 55007 - DNA, 1272 bp, Glycine max
  Peptide Sequence Number=SeqID_171785
atgctttcgattttccctgtttctgcactgggattcagttgtttaggagttaagtccggttatggcaaatataggtcccctggttggcacttctcaggttttagaaaggttgacccagatcgatgggaatttgcaaatgaaggatttttaagaggtgaaaaacaacttttaaaaagtatcagtaggcggaaatctgctcatgtaaatggtagtcaacaagcatctcaagtgcataaatcagctgctggagcatgtgttgaagtggggaaatttgggcttgaggaagaggtggaaagactgaaaagggataagaatgttcttatgcaggaacttgttaggttgagacagaaacagcaagggactgataaccaattgcaaaatgttgggcaacgtgtgcagtcaatggagcagcgtcagcagcaaatgatgtcattcctggctaaggccatgcagagcccaggcttcttagctcaatttgttcagcagcagaatgaaagtagtaaacatatccctgggagcaataaaaagaggaggctccagcgacaagaagaagatagtttagccaccaaggatctccatagttctcttgatggacacattgtcaagtaccagagttccataaatgaggctgcaaaagcattatttcgccagatattgcaaataaacaattctacaacacaatcatcaattaagaaccctgatgttttccttattgatgatattccttctgccattgcatcagatagcagtagttcatccactcaggtttctaatgtgatggttccacctatatctgagctgacgtctatggaagtaggatcacagtttcctctcagttgtatgcccagtaacatatctgaggtgcagtcttcacctgctgttttgggtttctgtagaagtcaggggatggagacagaaagcagtttattgaatcatgagctgaatgttatgggggctgatactaggaacatgggggagatagatatgatgtcaactgttttagatgaggcagacgaagctgatcatttttcacctgacacagatggaatttctaaactcccagaaatcagtgatgaattctgggaactgtttttaaggccaagcccacttacagaagacacagaggaaactaaatgtagctctctaggatgtggtttgactgaagatcagggtttgccttcagaaatgggaaataagcaggaaaattttgatacaatacaacatgttgactgtcttactcaacagatgggacttcatgcattggagtactga

SEQ ID NO: 55008 - DNA, 2070 bp, Glycine max
  Peptide Sequence Number=SeqID_171786
atgttcgtggctgaagatgaaaacagtgtactactccatgaggtactagctctaagcaacctcaacttggtttatgagagctttctcacccagaaagtcatcgaacaaaaagctctttctgaacatctcagcagcaatcttagccgtttaaacagtgacctcaatcaggaacttggtgtgttaaggaagaagtttgagctgaaagaagaagagagtgtttatctgaatgaggctactaagaggatggataaagagctgcgggaaatcaaaaatgcaaattgtcgtttaagtcatcaagttgaaaattcagagaatcttctcaagaagaaagacatagagctgctagaaattgagacaaggctgaaggctgcagagaaattgaatggggagttttgtagatatattgaggagctgaagatggatcaagaagaatcaagattgatcagagaaaacctagacaggcagattcttgaactatcagaaaattgcatgaatcagaaaagagaaattgaacactttaatgaagaaaatagaagctttcagtccgtgatgagatcattacttcatgaagttgaacaacacaaggttagagaacaagcactgaatacagagttgcaagacaaaacaaatgaatgccaactttgtgaggctgaggcagcttcgttctatttggagcttcagatttcatccattagtgaagaactgctgaaaggcaaggtcactgagcttactggagttttcaagagacttgatgatgaaagtgctggaaaaggcttaggacagaaggggcagttatctgcatatactccaatgattacttctttgaaagaggattttgcatctctagagcgcacttactttcttttgaccaataaaacttttgctgtaggcaacggagaacagaaggatgtagccattgagacttgtctccaagaagaacttagctatcaaagtttaaaaggaagtgaaagctccttaacaccagatggggttgcagatttgctgagcatgcagacgaggattagagtagttgaaaagtttatgatgaaagaacttgaaagacgtgtgaagaaggaaagtttgaccgcaaatgtcaaagcagaagctgtaacagaaatgaatgagcattcaaatttggaagttggcacatatccagaaattgacgacagaaaagtggtgatgaaaattaagaaagacaacagcaaacgaggccataatgcatggaggacaaaatctcagaaaaggttaataatgatagacattcctcttgatgactacaaggatgatccagacttcaacaagtatggcaagagagatcacactaggattgataatcatatgcttgagttatgtgaaactgatcagcatgatgttactgaagaaaataaacagaattctgtttcactagaggatgtaattacatgccatgagtcagaaagatgccaaaattactcttcagaattggagacagagaaggaattaggggttgacaagctagagttatggaagactcgaaaagagacaacaagtgaagatagcaagaggaaaattctggagaggcttgcctctgattctcagaggcttgccattcttaaaatgacactgcaagacttgaagaagaaaccggagacacagaagaaaagcagcaaggtaaatgagattgagtacgaaacagtaaaaagacatatagaagatgttgaggaagctgtcatgaaacaaataggcatatatgatcaactggcaaaggatactgaagagtgcacatcctcatcttcggacacaagcacaatgcagttggaaaagcaaggaggacaaacgcaaagaaaaaagctaacagaacaagctcgaagaggttctgaacagataggaaggttgcagtttgaggtgcagaacatccagtatattctgctcaaactggctgatgtgaagaacaacaaatgcaaaaacaaaaactctagaccaacaggtgtgttgctgaaggactttattcgcattggaaggaaaaatagcagaaggcgccgtaaggggtgtgtttgtggatgttcaaggccttcaactaatgaggactaa

SEQ ID NO: 55009 - DNA, 435 bp, Glycine max
  Peptide Sequence Number=SeqID_171787
atggaattctccgcctcaagtcacttccttagcattgaagttgcccagtcctcatctaaaattgtcagttcccagtggaagtatgccttagacattctgatggagactagaatgtttgattgtcgctcgagcgagactcctatggatcctaatgttaagcttattctaggcaaacttaattatctcactgtcaccggatcaaacatcatgtacgtggttagtatggtgagccaattcttaaatgctctttgtgatagtcattgggatgctgtcacatgtatccttcggtacatcaagagtgttccaggtcatggacgttgtatgaagacaaaggcaataccaacatcatttcttaccctaatgttgattgagttgggtcaccatcaggtaggagatctgcctctaggtactatgttcttattggagggaatatga

SEQ ID NO: 55010 - DNA, 483 bp, Glycine max
  Peptide Sequence Number=SeqID_171788
atggttgctgcggtctctatgaaagacaataaaagaactaacattggtggttgcaatatttcagggattaacatgactatttatttgtgttggatttatgatattcatcacagtttgacggtacaggagcattctgggaatgagaaatcgtgtgtgtggcatgcttctgattttgcagatggggaattgaaggatgagctgttctgtattaggtttccctctgttgagaactgtaaggccttcatgacaactatgcaagaagtggcagaatcacaaggagaaggggaggaaaacaaagatgcttcggctactgccgatctcctcgagaaactaactgttggtgaagacaaatcagacgagaaagagccggaaaaggtccagatcaccaagaaactaactgttggcgaggataaatcggaggatgaagagccggaaatggccacaaacaccaatgagaaaggtgagcaggatgtagaagcctga

SEQ ID NO: 55011 - DNA, 957 bp, Glycine max
  Peptide Sequence Number=SeqID_171789
atgatgatgataatgatagcagtaacaatgatcatggtggggagtagcaaagacgacagtggtggcaatgagaatgacaaaataagggagagtggttgtttagtgtggagctgttattgcacgattttttcaagtatatcagatatttgctggggattaagtgaaaaagactcaatggtaaacccaaaagtgtctactcaaccaaaaatatgctacaggcctattcaaccttctgacctggacattttagagcatatccattgcagattatttcccatcaggtacgaatccacttttttccatgatgtggtaaatggacgtgacattgtgtcatggggagctgttgacagcagtcggtcggatggtcaaagtgatgaactcattggatttgtaacagcacgaattgttcttgcaaaagaaagtgaggttgaccccattcatatagtggatatgcttggatatgactcggctaaatctgaccaaactctagtctatgttctgacgctgggagtagtggaagcatatagaagtcttggaatagcttcttctctgattcgggaggtcataaaatatgcttcaagtattccaacatgccgagctgtctacttgcatgtaatctcttacaataaccctgcaatcaatttgtacaagaaaatgtctttcaagtgtgtgagaaggttgcagggattttatttaatcaatgggcaacattatgattcgttcttattcttgtactatgtaaatgggggacagtctccttgctcaccattagagtttctcactgcaatagtaagctacatgaagagtggctttaactcagtggcagcaaggctgtgcaagaacggaggcaggaagatctcaaggcgggcaaagtgtaaagaaagtcattctcttgtgtcagcaacacccaacaaaagaaacgtggcagtcgagtgtcctggttatgagtgtgtttaa

SEQ ID NO: 55012 - DNA, 159 bp, Glycine max
  Peptide Sequence Number=SeqID_171790
atgggggcaatacaagccacagtcttagccctatgtgttgtgaaggattggagccaatggaagttgggttgggatattaggcttctaactgcggattttcttgtaattggagcagtgctaattgtgtgtggcttgtacatgtatggtgctgtggggtaa

SEQ ID NO: 55013 - DNA, 408 bp, Glycine max
  Peptide Sequence Number=SeqID_171791
atggcagaatcgtcaaagaagcgaaagggatcatcctccaccaccgctgctgctagccatcgccgccacggaccatctgaagcaccgaaaacaccaattcatccttccttatcatctccacgatcatcaactctattttcttcagatgatcaactgtttaaaaactatggattggttgaatttatgtccttaaaattgccttactatcctgaacttgttaaagtgttctatagcaatttaaaaattcaagatgatattatttcttctgaggtgcatgatatatctatgatcattgatcaatctctgttcttttcattaactaaactacccagtcaaggtgcaccttttgagggcaccattgtcgatgactggaaattcgattattctagtcatgatgctcgccgtatg

SEQ ID NO: 55014 - DNA, 174 bp, Glycine max
  Peptide Sequence Number=SeqID_171792
atggaagcagttggttcgtgcctcacaaacaagtactcagaaggattgccgagtaaaaggtactatggtggcgatgagtacattgatgagcttgaaaccctatgtcaacaaagggctttggctacatttcatgtagatggaaataagtggggtgttaatgctcaaacattatga

SEQ ID NO: 55015 - DNA, 153 bp, Glycine max
  Peptide Sequence Number=SeqID_171793
atggataatgatgatgatatatttcaaggtttggagagggcagcttcattgttaaatggttgttggttcttcacaggcatatttcataacaaatatggagcctatgaaattctgggagttcgtgtcattggtagtggaaggtcttggatatga

SEQ ID NO: 55016 - DNA, 492 bp, Glycine max
  Peptide Sequence Number=SeqID_171794
atggaatacgcacgggcagacgtacttaaatccattgaagagaacccctctgctgcttttgggcacctgaactttttgaagaaattgcacaacccccttacctctgacgagattctaggcaaaaaaaagcgcgaaaatgacgccagactagatgcccagaaacaggcacatatccttctgctcgagaaagcccaaactgctcaacatgaagtcgaacgtctcaccaaagaggcgaaagaaggatcttctgagatcaaagcctgtgatgataacatctcttcctgggaggcaactattatggatttgctgtctcaggttgatgatttaaggcagaaaattgtgacagagcaggccaaacgcaaggaactccaggagaaggccgctcactcgattcagaaactgattgctgaaaaagggagggaaggcctgaaggcctttagcgcatctcaagctgtagcagatgaggcaagagttatggagggtgcaccttga

SEQ ID NO: 55017 - DNA, 573 bp, Glycine max
  Peptide Sequence Number=SeqID_171795
atgtatgagcaattcttcccacaccatcttcgtacctatgtcaaaaaatacacacaaaaactcacatacccttatatccaagtttctttccctgagttctctggaggggaaaacccaaaggaaagtgaagcatacactgttattcaaacctaccttagtgcaaactcatcccaaaaagccaaaaggatcaaagctgaagtggtgaaggatagccagaccccattagtcttcagcatggacgacaacgaaaagataacagtgaagaaaaataccaaactaaggaggttgttggttgaaacatcaagcaagtctattgtagtgattgaggacattgattgctctcttgatctcaccggccaaaggaagaatgaagaagatgaggatatggatacggatgaggaggaacacaataattctgttaagaaatgtggagaagaagggaggagaaaattaagcaagatgactctatcagcattgttgaatttcaccgatgggatttggtcggctctcattaggagagggaggatagacaagcacacagaaatgtcatttgttgaagattatgatgtctaa

SEQ ID NO: 55018 - DNA, 738 bp, Glycine max
  Peptide Sequence Number=SeqID_171796
atgaaaatcatatatgcaggaaaagcagaggcgcatcaagttaatttctatgtgcacaataaatgtccctttccaatatggccagcaactgcaccaaacagtggccaaccagtgatagcagatggtggattctaccttgctccaggccaaacccaacgtgtcatagcaccatggacatggaatggtagaatttgggcgagaacaggctgcaattttgcttcaaattggaaaccagcttgtgaaacaggagactgtgatggaagactagcatgcaatggactcataggcacacctccagccacactagttgaagtttcactccaaggaagaaacccgaatttctatgatgttagccttgttgatggctacaacatccccgtctctgtcaccccaaagatcacaaacccaaagtgcaacattccagggtgcttgaaggatctcaaaggcttgtgcccacctgagcttgaggtgttgaattccaagggagaaattgtggcatgtaaaagtgcttgtttggcctttgataatgacaagttctgttgtaggaatcaatacgggagtccagggaagtgcaagccaagtgtgtactctaagatatttaaggatgcttgtcctaattattttagctatgcatttgacacacctacacctttggtgagttgtgcttcctcagagtttataataacattttgtccttatggatggggtgaaggtgctggtgagcacaaatctgagtag

SEQ ID NO: 55019 - DNA, 408 bp, Glycine max
  Peptide Sequence Number=SeqID_171797
atgactggtgagcatacatgcatgatcctgaaacccctacacaatgatgaaattgaagctgatggatcaaatcagttgggcttttttagtccattttaccaagattttagacaacgatttgctaaacttcttgcttccacttttcgtggcatggaatacgagcttgctttgagcataatagatcccaaaatcaatttcaagtgccaagaccctacggagacctcgtctgataaatgtctgcagtcggtcagaggttatttatccccacatgatatgaagcgattagaggcatatgttgacaacctggctgactttcatcggctaacagttgattggccaccaagagtgaccaagattaggttgacatataaaaatagacagaccaagaacatgagtccttttttttaa

SEQ ID NO: 55020 - DNA, 105 bp, Glycine max
  Peptide Sequence Number=SeqID_171798
atggtggctgaaactaggattccattgggcagggacactttgataggtgtgtccaggatccatctagagattagtacattaccattgcctgttggagttgaatga

SEQ ID NO: 55021 - DNA, 924 bp, Glycine max
  Peptide Sequence Number=SeqID_171799
atggttgatgaagccacatacctctatactctgcaagatgcacaaaatgcatcgaatcccctatacatccacccaaatgagagcccatccactgtccttgtttcgccaccgctctcatacgggaattatcacagttggtctcgtgcgatgaagatgagcccgttgataaagaacaagctaggattcgtcgacggcacaattgtagaaccacctaagaatcattcgatgagcgtggagattgcgcagtccattctttggcgtaagaaagcttcagacgtgtggaaggagcttcgtgagcacttttcccatgctgatttgtttagaatctcagaaattcaagaggaaatctttagccagaggcaaggtgataactcgatctcaaagttttacattgcaccgaaaaccctatgggatgaattagatgttttgaatccccttcctgtttgtacatgcaattctaagtgttcatgtggtgcaatcaagaaaattgaaaaggagataaacaagaatcaagtggttagattcttgcgagggttgaatgatcaatattcaggtgttagatcacaactaatgctcttagataatcttcctaatgtgaaccgagtttttgctcaacaagaacgacagtttgacactaagaatgcttccgtgccaaaggctcttcttgtggctagtgatgatacatcagactccaagagaaatcaagggagtgataatggttggaataacagatacacttcccagaaatgttcctggtgtggaaaaatgggtcacaaaattgacatttgttataggaaacacggtttccctgctggttttaagttcaacaattctaaaaacactgctccaagatctgcaaatatggtgatggttgagaaaaatgagaccaactgtccagatgattcatcaagaaaggatacataa

SEQ ID NO: 55022 - DNA, 1005 bp, Glycine max
  Peptide Sequence Number=SeqID_171800
atgaccactttaagagttgtgttggctttggcctcttccaaaaagtggcttctacaccaattagatgtagataatgctttcttgcatgcaaatctagaagaagaaatctatatggctttaccgcaaggaaatgacatttctgaaatcaataagttcaagcagcaacttcatgcacaatttcgcattaaggatcttggagaagccaagttctttttgggtttagaaattgcacggtcctccaaaggcatagtgcttaaccaacgcaaatatgccttggaacttttatcagactctagtcttctctgttgtaaggcagcaacaacacctatggatacctccatcaagctgggacctgctattggcaaaccactttctgatattagctcctctagaagattgataggaagactcatttatcttaccactacaaggccaaatatagcttttgtagtgaatcaacttagtcaattcctatctgctcccacatatcgtcatcaagcagctgctcacagagtactttgctatatcaaaggctcacctgggtgtggccttttctacccaacatcaaacgctcacaagctcacagcctatagtgactctgactgggccgattgcattgattctagaaaatccattactgtgtattgtttatacattggttcttctttaatctcatggcgatccaagaagcaaactactatagcaaggtcctcttgtgaagctgagtatcgtgcaattgcagcaacaatgtgtgaagtacaatggatttcttatctattgctggatctgcaagccgctaaaccttctcatgtgtcattcttctgcaactaccgctcaacaattcatattgctcacaatcctagcttccatgagcgtaccaaacatatcgagttggattgccacattgttcgagagaagtcaaccaaggccttattcatcttctgcccgtcccctcaacacaacgaccgatatttacacaaagcctctgacgcttgcaccgtttag

SEQ ID NO: 55023 - DNA, 144 bp, Glycine max
  Peptide Sequence Number=SeqID_171801
atgggggaaaaggtgtcaagcgatcataggaaagcacttgagaaagaggataaagattaccttttcccgaagattgatgtggcacagcagtggcagcagcaaggttgcagtgataatcctgtagatatgaaggaggctttctaa

SEQ ID NO: 55024 - DNA, 1044 bp, Glycine max
  Peptide Sequence Number=SeqID_171802
atggctacctctagctcatctggtgaggaggatcttactccacctcccactccaccaccaccaccaccttccttcaccggtcccagtcagaacccagccagccctttctatattcatcccagtaagagtctcacatttgttattgttactcctccacttactgccaataattttcaatcttggtcctgttcatttcgaatggctcttatctccaagcataaaatggactttctcaatggatctattccaattcctcagctcacagacccgatttattcttcctgggagcgatgcaatgtgcttctcatgtcatggctgcttaactcgctttctccctccattgctcaaagtgttattttctttgagcatgctattgatatttggaatgatctccgtgaacgcttctctcaaggtgatttgcttcgagtcgccgaatttcaggaggaaatctatactcttaaacaaggttctctctctgtgactgattactgcactactcttaagtctttgtgggaggaactagataactatcgccctttgtctcctagttcttgctctgcaaagacttaccaccaacaggattttatcattcgttttcttaaaggccttgatgagcgttttgccatggtgcgttctcagattctcttgctcgatcctcttccctttgccaatcgaggggaatcgacacgtaaatgtgacttctatggccacctcgatcacaccattgattcttgcttccagaaattgaacaccatgcgccaaaatgtagccattgtgacaaacttggtcacaccagtgatgtttgctactctaagtttgggtaccctcttggacactcgaaatacccaggtcgcccacgtctctttaacaacaaatttgcttctggtggcaccacaacctcctcaggtggaggacatgagcacattgaagacgattggtttggctgacttgaaggaaggcctttttcacttgatagttggtaaggatagaagtccatctaccaacaatatcaccatcaccaacatcaataactccaagctttga

SEQ ID NO: 55025 - DNA, 246 bp, Glycine max
  Peptide Sequence Number=SeqID_171803
atggacatcctcttcgcccggatccaagttgacctccgctccaacgacgccctccaccagtctggtgccttccttcaggccgtccagcagtccgccgtgggtcgcgacatcgccatcattgccaagactaattaccctaacatcgccatcatcgctatttggatggggtgttggcaagctcagggaaggcgtcgcatgaggcagtccgcgtggggtccaacatgctcaactgctccggcggcttag

SEQ ID NO: 55026 - DNA, 399 bp, Glycine max
  Peptide Sequence Number=SeqID_171804
atggagaggaaggagactattgatttttcttcttatttttatcttgaagcctctggtgactctgaagaagctgattttgatcacacctttgcttgtgaaatggccaaagcagatggtggtggcgaagttgttgatgataatgatgatgctctatcttgcaatggatctggtgcttgtaatgttgctgaatccgatgggtgtgacgagtcttgtgatgagcatgatggtgggattgagaagaaggaggaggaggatggtgtttatggaatgtcatattgtgaagatgatgagatgcaagaagaacagatgaaatcctatgtgtcttttgattcaggccacaaatctctggatgaaatggaaaagaacaggctcttctgggaagcttgcttggcatcttga

SEQ ID NO: 55027 - DNA, 1197 bp, Glycine max
  Peptide Sequence Number=SeqID_171805
atggtgagatggtattactattctcctgattgggaagcatcttattttttgtgtccaattcaggcatctagtccgttgcaagtgaagtatgcagatggtgaattggaaagattagaacacaaactctttattggcatgcttccaaagaatatttctgaagatgaggtctctgatcttttctcaatgtatggaactataaaggatttacagattttaagaggttctcagcagacaagatgtgcatttttgaagtatgaaaccaaagaacaggcccttgctgctcttgaggcaatcaatggaaaacatacaatggagggttcaagtgttcctttggttgtcaaatgggcagatactgaaaaggaaaggctagctcgaagggctcaaaaagcacagtcccaagtttctaacatgccgcaggctgatcctcaacatccctcattatttggagccttgccaatgggttatgttcctccatataatggatatggttatcaggctcccgggggttatgggctcatggcataccgttttccaccaatgcagaatcaaccaggtttccataacatgaacatgaaccaagtaaatgcagtgaggcctgatcttggtcacagtgtgaatcctagaaattatcatgcgcctcctgcaagttacattggcccttatcctgctgtgccaggtgtacagcatccaatggtatatcccagaagaattgtgggaatagcaactcttcatcttcaggtgccagtaaaagttccagtggtcaaattgaagaaaatgttagtttttgttgataatccgaattctgttaattattttaatttctctggcttaggaccacctggtgccaatctatttatttatcacatacctcaagaatatggagacgaagagctcgcaaccacatttcaaccgtttggtagagttttgagtgctaaaatttttgtcgataaagtaacaggtgtaagcaaatgttttgggtttgttagttatgatactccagaagctgctcaatctgccattagtacgatgaatggttgtcaattaggtggtaagaaattaaaggttcagcttaagagggataacaagcagagaagcatgaactattgtttcattgtttgcacttgctattattttcagtgtcacagtagttggtggggccggggatttgggttgacgggttggttaaggactatttaa

SEQ ID NO: 55028 - DNA, 1860 bp, Glycine max
  Peptide Sequence Number=SeqID_171806
atggtgggtgaaacggcggcaacggggaagtcggttggtttgggtttgggatgtgacccagtggtgggatccttggcttgttcgaagaagagagaatacagagtcaccaatcgccttcaagagggaaagcgccctctatacgccgtcattttcaacttcatcgactcccgctacttcaacgttttcgccactgttggcggcaatagggttactgtttatcaatgtctcgaaggaggagttattgctgttttgcaatcttatgtagacgaagataaggatgagtctttttacacagtgagttgggcatgcaatgttgatggcaccccatttgttgtggctggaggaatcaatggggtaatgcgagtcattgatgttggcagtgagaagatacacaagggagtcccgctatggcagcaccataggctgcaatggcatgtttatatggcagaactttggccttctgctgtgttcttccatccgccattgataacactgctcaaatgtgaccgtagtgttggttgttactctggaagttttgttggccatggagactccgtaaatgaaatcaggactcaaacattaaagccatcacttgtgatctctgcaagcaaagatgaatctgtccggttatggaatgttcatactggaatatgcattttaatatttgccggagctggaggacatcgtaatgaagttttaagtgttgattttcacccatcagatatatatcgtattgctagttgtggcatggataatactgtaaaaatatggtctatgaagggccgttatgttactgcagagttctggacatatgtagaaaaatcatttacatggactgatcttccttctaagtttcccacaaaatatgtccagtttcctgtatacaatgcttcagttcatttaaattatgttgactgtaataggtggctaggtgattttatcctctcaaagagtgttgacaatgaaattatcttgtgggaacctaaagtgaaggaacaaactccaggggagggtgtagttgacatccttcagaaataccctgttcctgagtgtgatatctggttcatcaagttttcttgtgatttccatttcaacttagccgcagtgggtaacagggaagggaagatttttgtttgggaattgcagtcaagtcctcctgtacttgttgcaaggttgtcacatcctcaatcaaaatctccaatcaggcagactgctacgtcctttgatggaaggtttgttagccacactgggcatcaatacgttgctaatgttgtttgtgtgctattgcagccatctgttagaaagcagcacaatgcaggttacaaacacaaggcaaatgtgaggacttactaccagcaatttgaagaacaacaaacacaaagtttaattgatcaaaggatcaaagaacatcttgggcaagctgctgcatttcagcaagttggtgtggcttataatcatctaatggttcagaggcctaaccttcctcctgtattgccaccaccaagattgcctattcctggaaatgcacaaatacctggaggccaaccactaatgcaagggatgagaccacctgtctttcctagacctcctggtgcaccaggatatgtttctgcacataccatgcctccgatgttacctccacctggtgctccccaggttccaggtcaactaaataccataccaaggcccccttcattagctccccctccaacggttcctggaagcactgctacaccagcttccaatggtgctccctctatggtatcatcagcaatgtatcaagccaatcctccggcaccttcatctggaagttatgataactacaatacgagtgctcaagcacctgagggtaatcactga

SEQ ID NO: 55029 - DNA, 1136 bp, Glycine max
  Peptide Sequence Number=SeqID_171807
atggcggttgcactaacgagttgcatttcctcatcctctgttctattctccacagttaaattccgctactcactcagacacagacccatcgtcgcctctttctataacaataataattacccactccgactttcctcttcttcttcttcttcttccaaatccaatcgacaaaaggaaggtgttgggcagaagaagcagtcaaaagatgaaagacctgcaagagggaatgtgctcgaaccccaacaaacttcttcttctaaaccttttggcattcaaaggaaaaataaggaccttatcttcgactccaaggaccagcaggttgaaccgagtgctttacaagattcggctttccttaatgctgttgtgaaggtcaaagtcaagaaaagaggggatgactcaaaatatgtggctaaggttttggccagaggtgttgactgcgatatagccttgctttcagtagaaagtgaggagttttggagagatgtggaacccctcagattaggacgtttgccacatcttcaggattctgtaactgttgtgggatatcctcttggaggagacacaatttcagtgacaaagggagttgtatctcgtatagaggtcacatcatatgctcatggatcatctgatttgttgggcattcaaattgatgcagcaataaatcctggtaatagcggaggcccggcattcaatgaccaaggggagtgcattggagtagcatttcaggtcctcagatctgatgaggctgagaatattggatatgtgattcctacaactgttgtatctcattttttgaccgactatgaaaggaatggcaggtatactgcatgcaaagacaggtatctgcgtttcgaatttgaagatagctatgtagctgttttagagaaagaatctgttaccgctgcttcaccctccgtactgagtgattatggaatcccatctgaaagatcgtctgatcttttgaaaccatatgtggatgcactagaagtagaaggtgaccaaccagcagacgaggaatttggtgatagcccgcgtcagcatttgaagcaagtgatcacaattttgggctgcagagaaagtgcagcaacagtatggggcaaccttgatgtgaacacattatgctaccatgggggcat

SEQ ID NO: 55030 - DNA, 1458 bp, Glycine max
  Peptide Sequence Number=SeqID_171808
atgaccggagtggtcatggtgaccaagggcggtggatgcggcggcggcgggaagcggacgaggtcggcgcgaaccgccgaggaggaagaagagcagcagaaccagctgtcgctggtggcgcttctcttggcggccatcagaaaatcgatggtgtcgtgcagggtggacccacccgaggacgtaatctccaccgtccatcacatggagatcggatggccaaccaacgtccagcacatcactcatgtcaccttcgaccgcttcaacggcttcctcggtcttccctatgagttccaagtcgagatccctgccagggtccccagtgctagagaaagaaagtgtaagactttcatgaagggtagtgaagaagatgacgtagccagaactttgtttcaaactagtgcatttggtgtaagtgtgtttggtgtctcagcagaatctatgcagtgttcttatgatccaaaaggaaacagtgtccccactattcttttgctaatgcaggaccgtctatactcgcagggaggcttgaaggctgagggtatatttcgtataaaccccgaaaatagtcaagaggagcatgtgagggaccagttgaataggggcattgtgccggatgatattgatgtccactgtttagcggggctgatcaaagcctggttccgagagctaccttcgggagtgctagatggactttcccctgagcaagttcttcagtgcaacacagaagaagaatctgttgagcttgtgaagcagctaaagccaaccgagtctgctttactcagctgggctattgatctcatggctgatgttgtagaagaggaggaatttaacaaaatgaatgctagaaatattgcaatggtttttgctccaaacatgactcagatgtctgatcctctaacagccctgatgcatgcggttcaagtgatgaacttactcaagacactcatcatgaagacacttagagaacacgaacaaacagcaaaaggtggctattctcccatgtcatatcattcatcagatcgccagtctgaggatgaatacagcagtcagcgagaaatggacacaagcggtgaattgagaggaaccaaatcagattatgatgatcatgcccactatggtcacagtagtgaaggggaagctggatctttgagtgagatagaggaggagtgcttcttgaagcagttggatgagaacaaaaaaggattctcagaggaatctgcagtttatttggataagtatgttagcaccaggagtttctctggctataacatggaaccttctatatctgttactgatggcaaagcagggaattcctgcttgagtacaacactgactgatttggcctcaaatgttgactcaagtagttcatcaataggatgtaccggcaccaaagatgtggagatgatggataagtttgcagattctatttcacctgtgccaccactccttgcttctagttaa

SEQ ID NO: 55031 - DNA, 297 bp, Glycine max
  Peptide Sequence Number=SeqID_171809
atgggggttgccaatttctctgtcttcctacttattatttctctaagtttcttccagttgctgagaatttctgaatcaaaattacccaaagaagaagttgatgctcttaaagaaattgtgagcacaatgggtgcgacatattggaagtttgatgctgattcctgcaatattgaaatggttggagtaacactagaaccaccagatgaatcagagagaagaattggttgtgattgcagttttgaagacggcactgtctgtcatgttgtgaacatgtatgactactaccaaattatttaa

SEQ ID NO: 55032 - DNA, 1710 bp, Glycine max
  Peptide Sequence Number=SeqID_171810
atgaggctccaaaaccactcacttcccaaacccgagttggtgctagagtataatgccaaaatcgtgtccacagatgaggctcaagtctctgatgctatccgagttgccacggatgagcttgcagggggtgggaaaggaatttccaacaccccattaactcttgtggtgaagaaggacggtgttcctgatctcactatggttgatcttccaggcatcactcgcgtgccagttcatggtcaacctgaggatatatatgaccagattaaggatataattatggagtatataaggcctgaagagagcatcattctcaatgttttatctgccactgttgatttctctacttgtgagtccattaggatgtcacaaggtgttgacaaaaccggtgagaggactcttgctgtggtcacaaaagctgataaggctcctgagggcttgcatgagaaggtaactgctgatgatgtcaacattggacttggctatgtttgtgtcagaaatcgcattggggatgagtcctatgaagatgctcgagcagaagaagtcaacctattcaggactcatacacttttgtccaaaatagacaagtccattgtgggggttccagttttggcacaaaagctggttcaacttcaagcggctagtatttccaaaatactgcctgaaattgttaagaagatcaacgacaagctcggttctcagctttctgagctggacaaattccccaggaaacttacttctgtgcctaatgcaatgtctgctttcatgcatatcattgggttggcaaaagagtcactgaggaagattcttctcagaggagaatttgatgagtaccctgatgacaagcacatgcattgcactgctcgccttgttgatatgctggatcagtactcaaatgatctttacaagggtcctgaaagtgatgctggtgagaagtttttgatggaagaaattaaggttctagaagaagccaagtggattgggctcccaaacttcatgccacgcagtgcttttcttaccctcttacagaataaagtgagagcaatttcaagcatgccaattgagttcacagtcaaggtgtgggactatcttgaggaagtggtggttgctgttctgaagcgtcactcagaacactaccaccaacttcagacaagtacaaaacgagcagggaagaacctcattgctaagatgaaggagaattctatgaaatatgtgatggaggttgtggaaatggaaaagctaactgattacactagtaatcctgaatacatgagtgagtataacgagctaatggccaaccaggatgaattcgtggagaaagttaatacaggcaactatcatgaagttgcccttgatggttttgagcaggcgattaaggttggtcatctgagtcagtactcaactttacttccgcaggcatttgacttgaaaatgagactgagagcatactggaagattgtgcttcggaggctgatcgacggcactgccctgcatctgcaactcagcattttcaaccttgttgacaaggatctgggagatgagattgtgaaggatatgatgtctccatatgcaggtggaattgagaagttgttggaggaagctccttcagtttcaatgaagcgtgacaaactcaataggagcattaaagttctgagagaaagcaaagaagtcgtggctaacataatggacaaaatttctagctatgatgattag

SEQ ID NO: 55033 - DNA, 273 bp, Glycine max
  Peptide Sequence Number=SeqID_171811
atgcctctccctctcggcactgtccttgttcctctcgtacggtgctctcataggtccaaacctaattctctctctaatcccgttctccctccatcaatctgcttctccctctgccgcgccgccgctcccgatctccatctggttcgctgttttggcacagaagctggttcaacttcaagcgagtcaccgagtaagattctcgtgagaggagaattcgatgagtatcctgatgacaagcacatgcatttactgctcgttcgtggatatgcttga

SEQ ID NO: 55034 - DNA, 1386 bp, Glycine max
  Peptide Sequence Number=SeqID_171812
atggaaagcgcttctttgctatgctcctcaagtttgcattataacattacccacatctgggggtggcgtaataatgctggtcatgtcaatcaaaggctgaataatgctggtcacccaacccatggcactctgatggaatttccagctaatccacactctgtgaactctgacgcactgttctgtggtctctactctgttcacatcctttggggtctgttctgttcatgtcaaggaggactagaggagtctatgttttgttttatattctttgatcattgtactgtttttgttggtgcccgattacatgctacaggaggtgttctcaggggtggacggtccgtggaaggtgaagcatccattgcagtattggacactgctgctggggtttggttggacagaaatggcattgtgtcctcctcacgctcaaacaaaggtcatgattatgaccctcctttggagcttatgcgtcgttgtcgccatgcagcagcagctgttggtgttcatatatttatctatggtggtctaagaggagatatactactagatgatttcctagtggctgaaaattcgccattgcagcctgacattaattctcccgagagagcttcccctgttacaagctccaaacaaaatcaatctaacttgacttataatgtaacagcaccaaatttggatggtggaccagatactccttcatttggtcactcaggcatggacaaaaattccttggagaaactgagggaagcatcagctgctgaagctgaggcagcgggtgctgtctggcaagctgtgcagtctatatcaagtaatccagctgaagaaacatctctgtcagttgaaaactcacaagctgcagaaacagtttcagatggaagatgcaaaaagcatacatttttgttacaggttgtagtttccaaggaggctgtaggtaacctaggtggaatgataatttcaactttgcttaggcctcgcaactggaaagctcctgcaaacaggcgggtcttcttggattcttatgaagtgggtgaactttgctatgctgccgagcaaatatttatgcatgaaccaatcgttcttcagcttaaagctcctgtcaaagtatttggtgatcttcatggtcagtttggtgatttgatgcggctatttgatgaatatggatttccttctactgcaggagacatcactcctggtatcaaagcattgcttgctgtgagtggggttttgaatgtggttaataataacttcaattctgaggtaccgtctagattcagcaaactgaaggacttaaacatatctgaatttgtcatatgctggctttgtggggacactgctgaaactcgagagtgtagacctacaaaagtttgtccaaaactacagcaggattag

SEQ ID NO: 55035 - DNA, 1131 bp, Glycine max
  Peptide Sequence Number=SeqID_171813
atgggttatgctatgagtagactagagatagaatccggtctctctgaagatggagatgccatccaagaagattctagtagtggagaaactaaaaggccattaaaaaatttagacaatgaaattgctcagataacaaagttgaagtcaacaccccatcaacaattagtccaagttggaactggaaggccagaattgccagtttctcctgtgaagatgctggcaggtcgagagtctaattactcgggacggggaaggttttcttcagccgatcgttgtcatcttttgagcagatatttgcctgtaaatggtccctggcttattgaccaaatgtctagtagggcttatgtctcccagttttcagctgatggctctctttttattgctgggttccagggaagtcacataagaatatacaacgtggacagaggttggaaagttcagaagaacattctagctaaaaatttgagatggacaatcactgatacatctctttcacctgatcaacgctatctagagatacatgatggtttggatttttcatcaaatgatgatggaggatactcctttggaattttctgtgtgaaattctcaaaagatgggaaagaattagttgcaggaagtagtggtgattctatatatgtatacgatcttgaagcaaataagctctcacttcgaattttagctcacacgtgtgatgtgaacactgtatgttttgctgatgaaactagccatcttatttactctgggagtgatgatagtttctgcaaggtaagtggagctcaagtcgcaacgctgaagcaccataaatcacctgtaagagattgtagctggcaccccttccacactacacttgttagctcttcttgggatggagatgttgtgaaatgggaatttgctgggagtggtgatacaccaggctcttcaactaagaagaggcaacaacccgagacagacaaagagttagatatagggcagtggatggttgctaatggcggaaaaacagagttccagacccaagactcgaaaggcttacaattgcaatgcaaaaagggatacccaaatggttgtcccacttgcaaccattttccattgcagggagcacctactcgtgcttatggaaagcttagctga

SEQ ID NO: 55036 - DNA, 1053 bp, Glycine max
  Peptide Sequence Number=SeqID_171814
atggatgaaattatagttgcgcaagccagggcacatgccgggaattcaagtgagagtgaagtaaaagggttgaaaattttgaatatgaagatcagtattttgctatgtgtggtgcttttgggtttccttggggtttgtcaaggaggcagcctaaggaaaaagttctaccgggattcctgccctcaagccgaggacattattaagaccaaaacccagcagcatgtgtctgctaatcccgatttgccagccaagttgcttagaatgcattttcatgattgttttgtcaggggttgtgatgcctcagttttgttgaactctactgccagtaacactgctgagagggatgcaattccaaatttatccttggctggctttgatgtcatagatgacataaaaagtgcggttgaggcaaaatgttccaaaactgtatcttgtgctgacatactggcattggcagctagggacgctgtttcagtccaatttaataaaccaatgtgggaagtgctgacgggtagaagagatggcacagtatcgaacagtaacgaagccttggccaatatcccagcacctttcttcaacttcacccaactcaaagaaagctttgctggcaaaggtctcactttgcacgatctggttgtattatcaggggcacacacaattggaatagggcattgcaacttgttcagtaacaggctttacaatttcaccgggaaaggtgatcaagacccttctttgaacaccacttatgctgaattcttgaagacaaagtgccagagcctgagtgacacaaccacaacggtagaaatggatcctggaagctctaccaagttcgatagtgactattatccaaaccttctccagaataagggcctattccaatcagacgcagcccttctaacacaagagcaatcagaagatatagctaaagaattggttgatcaaaacaagttcttcacagaatttgcacagtcaatgaagagaatgggagccattgaggtcctcactggttctgctggagaaatacggaacaagtgttcagttgtcaactcataa

SEQ ID NO: 55037 - DNA, 2076 bp, Glycine max
  Peptide Sequence Number=SeqID_171815
atggggtcgaaaccgtggctgtaccctgctccaacctatcgaactatagaaactgtctgggacaccgatgaagacgctcctggccctcgttgtggccacaccctcaccgccgtcgctgccaccaagactctaggcccccgcttgatcttattcggcggcgccaccgccattgaaggaggatcttcctccgctcccggcattcgattagcaggagtcacgaataccgtccatgcctatgacgttcaaagtagaaaatggactagtgttaaacccgccggagaaccgccatctccccgggctgctcatgccgctgctgcagttggaaccatggttgtttttcagggtgggataggtccggcggggcattctaccgatgatctctatgtgcttgacttgaccaatgataaatacaaatggcacagggtcgttgtacaagggcaaggacctggtccacgctatggccatgcaatggacttggttgctcagagatatctagtaactgtcagcggaaatgacggtgagacaaattcattaccggggaaaagagttgtatctgatgcttgggctttggatactgctcaaaaaccttatgtgtggcagaagctgaacccagaaggtgacagaccttctgccagaatgtacgcaactgctagtgctcgctcagatggaatgtttttactctgtggtggaagagactcttctggagctccactagcagatgcctatggactgctcatgcataggaatggccagtgggaatggacccttgcaccgggagtttccccttcacctaggtatcaacatgctgcggtttttgttggtgcacgattacatgttacaggaggtgttctcaggggtggacggtccgtggaaggtgaagcatccattgcagtattggacactgctgctggggtttggttggacagaaatggcattgtgtcctcctcacgctcaaacaaaggtcatgattatgaccctcctttggagcttatgcgtcgttgtcgccatgcagcagcagctgttggtgttcatatatttatctatggtggtctaagaggagatatactactagatgatttcctagtggctgaaaattcgccattgcagcctgacattaattcttctgagagagcttcacctgttacaagctccaaacaaaatcaatctaacttgacttataatgtaacagcaccaaatttggatggtggaccagatactccttcatttggtcactcaggcatggacaaaaattccttggagaaactgagggaagcatcagctgctgaagctgaggcagcgagtgctgtctggcaagctgtgcagtctatatcaagtaatccagctgaagaaacatctctgtcagatgaaaactcacaagctgcagaaacagtttcagatggaagtgacactgagggagatgtccgccttcatcctagagccgttgtagttgccaaggaggctgtaggtaacctaggtggaatgataatttcaactttgcttaggcctcgcaactggaaagctcctgcaaacaggcggttcttcttggattcttatgaagtgggtgaactttgctatgctgccgagcaaatatttatgcatgaaccaaccgttcttcagcttaaagctcctgtcaaagtatttggtgatcttcatggtcagtttggtgatttgatgcggctatttgatgaatatggatttccttctactgcaggagacatcacgtctgatcccacagagaatgatagtgtagagggtttgagaccaaatgctagaggcccagggcttgtcacttttgggcattctcgtttgcatgtaatagcatttcaatctcatgccgggtgtgtgattttaggaactgcgaacaatgcgggagctatactggtagttggtaggggtttggttgtggttccaaaattaattcatcccataccacctccccttcagtctcctgagacatctcctgagcgtggtatggatgagacatggatgcaggagctcaatattcagaggccaccaactcctactcggggtcgaccacagcctgaccttgatcgtggctcactagcatacatatga

SEQ ID NO: 55038 - DNA, 1299 bp, Glycine max
  Peptide Sequence Number=SeqID_171816
ttggacacgtgtggttccgagggtgatgacgtggctttcgaggctgaggcatggaggccaaataggctcggagaaccgtttgatgtaactgttcccgaggaatgcaggagttctacttctccctatgcattgtttgtgttcttcttctgctttctacaagtccaggcgattctggaccctgccgatttcctcgctctgcaaaacattcgtaaggctctggaagacatgccaggttccgatttcttttccacttgggatttcaccgcagacccatgcaacttcgccggcgtttactgcgactccgacaagatcattgcgctcaacctcggcgacccccgggcgggctctcccggcctcaccggccgcctcgaccccgccgtcggcaagctctccgcgctcgccgagttcaccgtcgtccctggccgaatatacggtcctctccccgaaacgctctccgatttgaagaacctcaggttcctcggcgtcaaccgcaacttcatctccggccaaattccgaccaaattaggtgatctccgcaacctccgaactatcgatctcagctacaaccagctcagcggacgcattcctccaacggtaggaaccttaccggagctaacaaacctaatcctctgccataaccgtctctccggttcggtcccccggttcgagtcgcacacactaacccggctcgatctgaagcacaacggtctctccggttcgcttcctcctgattgcctccctccttccctccagtacctctctctttcctggaaccagctcaccggcccaatggaccgccacctggcccgtctcgaccagctcaactatttggacctaagcctgaaccaattcacgggcccaatcccgggccgaatattttctttcccactgacaaatcttcagttagagaggaaccagttctcgggcatggttcagcccgtggaccaggtttcgatcccgaccgttgatctgagttacaaccggctgtacggtcagatatcgccgatgctggcgacagtgcagaatctttacctgaacaacaaccggttcacgggtcgggtaccggctagcttcgtggagcggttgctggacgcgagcattcagatactttacttgcagcataactatctgacggggattgagataagccctacggcggtgattcccgagagaagctcgctgtgtctgcagtataactgcatggtcccgcccgtagagactccctgcccacttagggctggtaaggagaaaaccaggcccactgcgcagtgcaatcagttgaaggatttgaaggactaa

SEQ ID NO: 55039 - DNA, 192 bp, Glycine max
  Peptide Sequence Number=SeqID_171817
atggagaaggatatgaaacagtcgcttttgaatttgatgaagcattttcagcgagactcgagactcaagaatgctattactactagtcaattgcacaggactcggacaagattaatgttgaacattgtctacttatccaagagtggggatcggatactagtaaattcagccactggagctgacagagactag

SEQ ID NO: 55040 - DNA, 978 bp, Glycine max
  Peptide Sequence Number=SeqID_171818
atggatgaacttctgaagcgagcttccatgtatgagtatgatgacgatggcaacaaacccctgcaaaacttgggggataaagatcaacagacagacccttatagttttgatggtgggggtagtgttactttggccgatatcaccgaagagcagcaacatttgaccatcaaaggagagcccaagcatcaaaagattggaggtaaaaaagatgaaaacccactaggatcgagcctcaatctttattgttgtcattgtacatcaaaaaaagatgagaaaaatgaaaagataagcaccaaagaaaagaaggtgttggagacaccgatattaatagctgcaaagaacggtgtgacagaaatggtagcgaaaatcatggactcgtttccagtagctgttcatgatatggatgccaagaagaaaaatatagtgctattggcagtagagaacagacaaacctatttatataacttcttgctcagcaagaaaaatctaaaggaaagtaatatattcgaaaaagtggataacgagggaaacagtgcattgcacttggcagccaaacttggagactataagccttggctcattcctggcgaagctcttcaaatgcattgggaaatcaagtggtacctatttgttaagggatcgatgcaacctcatttctttagtcactacaacaatgaaaacaagacaccaagagatatcttcagtgaaactcacaaggacctcgtcaggagtggtggagaatggctgaaaaaaactgctgaatcttgctccttggtagcagcactcatagccgctgtagccttttccacatccaccaacgtccccggcgacttcaaagatgacaccggctccccaacccttgaagaaaggccagaattcaaagcctttgcccatcgcatctctcattgctctttgctgctctgtcacctcactggtgctgttcctctcaatactcacatctcggtatcaagagcgtga

SEQ ID NO: 55041 - DNA, 473 bp, Glycine max
  Peptide Sequence Number=SeqID_171819
atttggcattccaaataattgatttgtacggggatcttgtaaactcggtgaacgaggatggcttgactcctcttcatctcctggcaaataagccttctgttttcaagagtggtggccgattgggacgatttgaagcacttgtttattatgctataatcgtcaacgagctcaaagtagcacccagttgtcagcaacaatgtccaacaaccgacaaagaaaaaaacagttatccgaaaaattaccagacatgtatggagtttttgaggatgacaaaaatattcaccttagttgattcattttccacatatccagtgatcaagccctttacacaatttctacagaaaaagttaccaccaaaggatcaaactgttactgaaagagtcgaccttgaagcatcgaaaaaggttgctacaaataatggcgctgtaacagaagcttcagtgagagtcgtgattttcaagttattagtataa

SEQ ID NO: 55042 - DNA, 297 bp, Glycine max
  Peptide Sequence Number=SeqID_171820
atgtttgtttcattcattggagacctcttggactgcaagttcagccagcttcagaaactgcaagatgagagcactccagattttgtgattgaggttatcactatgttctttgatgattctgagaatctcctcaaaaacatggcacgttgtctagaacaagtgccagttgatttcaaacaaatagatgctcatgctcatcagtacaagggaagcagtgccagtattggtgctgccagagttaaaaatgtgtgtgccaccttcagagctttttgtgaggctaagaacctggaagggtga

SEQ ID NO: 55043 - DNA, 171 bp, Glycine max
  Peptide Sequence Number=SeqID_171821
atggagaagcgagggagcaacttcaatttatgggcaccaaaaagtcgtaaaaggcttgtgagctgtggagtgaggaaaagcattgaaagcttgtccaactacccaccggatatgcagacgggggcatcaatgtgcaatagcactttaacatttattttcgacgagatttag

SEQ ID NO: 55044 - DNA, 1362 bp, Glycine max
  Peptide Sequence Number=SeqID_171822
cacatccgtcctgttcttgatgctgttgagaacctgaggcgcctcaacatctccaataaaaggatacagcttccaaccatagttattgttggtgaccaatcttctggaaagtccagtgtcctagaatctctcactggaatcagcttgcatcgtggacaaggtatctgcacaagggtacccttgatcatgaggctccaaaaccactcacttccaaaacccgagttggtgctccagtttaatagcaaaaatgtttctactgatgagtctcatgtctctgatgccattagagttgccacagatgagcttgcaggggatgggaaaggaatttccaacaccccattaactattgtggttaagaagaatggtgttcctgatcttactgtggttgatctttcagggattactagagtgtctattcaaggtcaacctaaggatattttttatttgtcagcaacaaaacctaaagatatatatgatcagattgaggatattgttatggagtatataaggcacgaggagagcattattgtcaatgttttgtctgccacagttgatttgtatgcttgtgagtccattaggatgtcacaaggtgttgacaaaacgggagagaggactcttgctgtgttgattcaacttcaagcggctagtattttcaaaatactgcctgaaaatgatcttcacaagggttctgaaagtgatgctggtgagaagtttttgatggaagaaattaaggtgctagaagaagtcaagaggattggactcccaaacttcatgccaggtaatgctttttcttaccccctcttacagaataaggtcagagcaatttcaagcatgccaattgacaagaacctaattgttaagctgaaggagaagtctataaaacatcttatagaggttttggaaatggagaagctgattgattacactcgtaatcctgaatacatgagtgagtataatgagttaatgaccaaccaggataaattcgtgaagatagttaatacaagcaactatgttgtccttgatggttttgagcatgccattaaggttggtcatctgaggcggtactcaactttacttctgcaagcatttgacttgaaaatgaaactgagagcatactgtaagattgtgcttcgggggctgatgcacagcactgccctacatctgcaactcagcattttcaaccttgttgacaaggatctgggagatgaaattgtgaaggatacgatgtctccatatgcaggtggaattgagaagttgttggaggaagctccttcagtttcaatgaagggtgacaaactcaataggaacattaaacttctcagagaaatcaaaggagttgtggctaggttcaatatgcagtag

SEQ ID NO: 55045 - DNA, 984 bp, Glycine max
  Peptide Sequence Number=SeqID_171823
atgaaggaaaagttggattccccagttacagtgcttgaggactatttcaggagctcagattcagaatcaagttcttccaaagagccttcagcggattctgagtctcaagagctttcaaaacctgcttctaggtggcattcatttattcaattgttgaggagcggatcgaagaaacagatgaacaacacattgcatcctctcagtgttctcaagctctccaaaagaatgagcactagcatgagggagtccattctcccaatttgtctcttagatgcaactgcttccccttgcaggtcaccttggaagatctttactcatcatgagattcaggttgcaaccaattcttttagccaagaaaatttgattgggaagggtggttatgctgaagtttacaaagggtgtttgccaaatcgtcaattagtggcaattaaacgtttaacaagaggaacagctgatgaaatcataggggatttcttatcagaacttggcgtaatggcgcatgtaaaccatacaaatactgctaagctggttggttatggagtggatggtggaatgtatctggttcttgaattgtctgaaaaagggagccttgcttcagttctttatggttcgaaggaaaaactaccgtggtgtattagacacaaaattgcattaggaacagcaaagggtatattatatcttcatgagggatgtcaaagaagaattatccacagggatataaaagctgccaatatattgctcacgaaggactttgagcctcagatttgtgatttcgggctagcaaaatggctaccagaaaattggactcatcacaccgtttcaaaatttgaaggaactttcggttacctagctcctgaatacttgctgcatggcatagtagacgagaaaacggacgtatttgcatttggtgtattgctattagaattagtgagtgggcgaagagcacttgattattcacagcaaagccttgtgttgtgggtatag

SEQ ID NO: 55046 - DNA, 1890 bp, Glycine max
  Peptide Sequence Number=SeqID_171824
atgagttccctcatccacctttttctctttttcttcttcttcctctgtctctctcactcttctctatgtgacacgtgtcccctgaacttcaccatcctgggcagaaccaaacccacatccttcgacacctcccgctgccaggtcatcagccaagccctccgcctcgtccagtccgactacctccgccgcagcggcttcttcctccctcccctcaacgcctccgacacatgctggacccacttccagtcctacgttaacaacttcgaccaaacctacaacatcaccacctcctgcggcttcaaaacctcctggatctcccaaggctgcaacaacgtcaccaccaaacaagacttcgaatccttagtccctcaatccgccctacaaaacatgcgcaacaactgcaaccagtcgctcgagaacaactccccttgcgccctctgcaccacttcgttctccactctcccgccactgggagactccgtcggaaatctcacctactgcaccaagtacgcttctatctacgccgccgccttcgccaaccgcttcggcccctccgaccccggcaccgccaagtgcttgttctcccttcaattctcctccaacaacaacaacaactcctcctcctcctccaagagaaaaaaggttgttattgctgttgtttctgttgtcggtgtcttggtcgtgttactgcttgttctcggggtttgggtttattgcaagctggaagacaaggttgcgggggacaaggacgttcgtgtagcggaaatcggtctggtttctggattggattccatggagcagagcactactttaatcaggtttacttttgatgatattaagaaagcaaccaagaatttctccagagataacatagttggaagaggtggttacgggaatgtgtacaaaggcttgcttcctgatggaagcgaggttgcgtttaagaggttcaagaattgttcagcttccggtgatgcaagcttcactcacgaagttgaggttattgctagtgtcagacatgttaaccttgttgccttaagaggctattgttctgttactactcgtttggaaggttaccagaggattattgtttgcgatatggtgaaaaacgggagtctccatgaccatttgtttggttctaatggtgtgaaattaagttggccaattcgtcagaagattgctctaggcacggctagagggttggcttatttgcattatggggctcaacctgcaatcattcatagagatattaaagcaagtaacatacttttggatgataagtttgaagctaaagttgcggattttggactagccaagtttaaccctgaggggatgacacatatgagcacaagggtggctggaacaatggggtatgttgctcctgaatatgctttgtatggacaattgacagagagaagcgatgtgttcagttttggggttgtgcttcttgagcttttgagtgggaggaaggctcttcagatgaacaatgatggtcaaccctcttctttgactgattgggcttggtcgttggttagaacggggaaggccttggatgttattgaagatggcatgccacaatcgggttcagaacatgttcttgagaagtatgtgttgattgctgtgctttgttctcatccgcagttgtatgctaggccaacaatggatcaggttgttaaaatgatggagactgatgaatcggttccttcaatacctgaaaggccaatccctcttgttgctggaaggcttgatattgagagatctgtgagtagtagtggctctggtcagctctctagtccaacgggttatcgatcatatactatagaaagtgatcgccaatcttctaattctagggatgaaagaagctcaagctctaggattttgagtacagattga

SEQ ID NO: 55047 - DNA, 229 bp, Glycine max
  Peptide Sequence Number=SeqID_171825
atgccgttttggtcctcgaacgtgggttttgggagcgccggtgccatggagaacagggcggcgttgaaggtcgcgacccgaatggcggcggcgaattggccaccggagacggcggaggaggcggcggaggttcttgttgaggagcttgaacatggtagagaagtgggcatggattttgtgagtggaagaaagactaagaaggagaatagtggcttcgaaggaaaatcaa

SEQ ID NO: 55048 - DNA, 828 bp, Glycine max
  Peptide Sequence Number=SeqID_171826
atgttcaagctcctcaacaagaacctccgccgcctcctccgccgtctccggtggccaattcgccgccgctcaaagcccaaagtagtagtgatcaacaagctcggaaagaacgccccaaaagcccaaaccgaagcaagcacaaatttttccgccgcggttcatccgaacgcgcaattgggtactccgaaacccattcgggtcgcgaccttcaacgccgccctgttctccatggcaccggcgctcccaaaacccacgttcgaggaccaaaacggcatcgcttcgaagaaccccgaaaacctgaattcgcgatccaggtcgacgaaggagcgtcccagaagcatactgaaacaatcgcagtcagtgaagaacagagtaaatgacagcgacaacgtgacgaggttggcgaaatcgaagatgagggtttccataaatttaccagacaacgagatatcgctgctgcgaagccgacaatcgagcttctcggaacacgacaaggcctcctcgtggtggggagggggtggggtccacgtgagcaacagaacagttgttgaggttctgaaggaagtggacgctgatgttttggggctgcaagatgtgaaggcggaggaagagaacgggatgaagccattgtcggatttggcggcggcgctgggaatgaattatgtgttcgcggaaagctgggcacccgagtacggcaacgctgtcttgtccaaatggcccatcaaacgctggaactctcacaaaatcttcgatcacactgatttcagtttgttagtttgtcttaacgttgaatttgggtcagtcatcagtggaatcgaatacgactga

SEQ ID NO: 55049 - DNA, 1497 bp, Glycine max
  Peptide Sequence Number=SeqID_171827
atgcaggtggagaagatgaaatctgaaatgcttaacctgcaaatacaactccttggcatgaacacatccactaattgtattgatggattttcccacagcaatgagggtctgagaaggagaaggagtgtttctctcgcatcaaataatgacattggaatccctgataaagaagatcaggttctggggagactagatcatacaataagagaggattctgtttatcctattaatcttcatgaaccatctgcttgtacaaatgtggaaagtccactaacagaggattatatgaagcattcagtggattctcctttttgtgaaattactgaaatagatattgatacttcttctagtgattcaggaaaaaaggaaaaatttaaagggcaagcaaaagaaaaccctctcaagtctgctgtacaattaatcggcgatggtgtttcccaggtacagttcattggaaatcaggcagtcaataacctagtgagcttcctgaatatttcacaagaagattctgattcaaatgaacacacaaacattgaggataggatatatgacgagatggagagtcagaaaactcggcatatatatatggatcgttcttcatctgtgcagtcagataagagttctgatgctgcaagtctgcagttgggaaggatctttcgttatatatggcaccagatgcgttccaataatgatgttgtatgttacttttgctttgttcttgtgttcttatggaatttcagtttgctatcaatggtgtatcttggggctctcttcttctccataacacccaaagatggtgaatggatgtcttctactgacttcaagtttaagaggaatgatctccatgcaaaagatgatcacactagttataactggcaaggtagagcacgggatctgctaaatcagatgattatcatggtgtctatggatgtcaacttctggccagaggatgggattcaacctgagagaattgaatctggaattaatcaggtgctcagaattgttcataatgataagtgcaaggcaaagaacccaaatctttgctcttttgctagcagggttaatgttcaaagcattgaaagaagtcaagagaaacccaatgttgccttggttgttttcgaggttgtgtatgcttcacctgtaattgactgctcttccacagaatggaataagtctttaactccagcatctgatgtggccaaggaaatcctcaaagctcagcgtgctggatttgtggaagaaatgggattcccttatcgtattctttctgtaattggtggaggcaagagagaaatcgatctgtatgcctacatattttgtgcagatctgattgtattctttcttgttgccatcttctaccagtctgtcataaaaaataaaagtgagtttcttgaagtgtatcagcttgaagaccagtttccaaaagaatatgtctttatgttgatgcttaagcttatggagttgttggttcctgatgtggtattagaggttctttga

SEQ ID NO: 55050 - DNA, 954 bp, Glycine max
  Peptide Sequence Number=SeqID_171828
atggtgaaatatggtagagagaaaagggaagtaacttatgtgaataatatgaagggcggtcaagaaatctcaaaaacaccgtcctcttctaagttaggtgttcaaatgcgcgagaggtgtgatgggactctagaaacctcggggtaccacacctatttgtacttgttccaagatgggcttcctcggctagggttagagggtgatgatggtgcaaggcggtgtatcttgtatagtgggtcgggtcggttagttgacatccaacctgataggcaagttattgggttcgggtctccaatttatcattgggctcagcccaacgatgaccagagggtggtgtgctgctgctctgctgttgtgcttatttgtggtggttctcgtgtatctgacatgtcagaagatgcgcctgttgagatcaaattgtttggccgtacagttcacaaccctcaagcattgagtctgaaaggcatgaagcttgttgagggttcagttgatatatatgctgctcagtgcaaaaattgcttgaaatggagagagattgatacacaggaagagtttgaagagattagaagtaaagttgctgaggaaccttttctttgcagcagaaaggctaatagttcctgtgatgaacctggtgatattaaatatgattcctctcggacatgggtgattgacaagcctaacctcccaaagactccacaaggttttaagaggagcttggtgcttagaaaagattactccaaattggacgcttactacatcacacctgcaggcaaaaaactgagaacccgcaatgagattgctgcgtttctaaaagataatccagaattcaaaggtgtgtctgcttcagattttgatttttcttccccaaagataatgcaagacaccatccctgaggttgttgagcagaaggattctgctaacaagaaagttaagatagccaaagatgaggtttga

SEQ ID NO: 55051 - DNA, 567 bp, Glycine max
  Peptide Sequence Number=SeqID_171829
atggacacaagcaggtatgagggaaaaagggtcttgaggtacaaagaggaagatgaaaatgatgatgatgaagaagaagaagaggtgagtgaggtgggttttggagaagacagaagaaggaataagagagtaatgagagatctccatggaaagagatcagggtccaaaggtggaggctcaatgccaccttcttgtcaagtggataattgtgatgctgatctgagtgaagctaagcagtaccacagaagacacaaggtttgtgagtaccatgccaaagctccttccgtacacatggcagggctgcaacaaagaaagttagaaacaaatgacggaattgatgtgctcaaagccaataatcctatcactacaacatttttaaccaataaaaggatatattgctctccattgcagaaaataattcgagattccatgagctatcagaatttgatgactcaaagaggagttgtagaacgcggttggctgggcataatgagagacgtcgcaaaaatgcagttgactaccatggagaatgatttcttctatgggatggacattaacaatcattga

SEQ ID NO: 55052 - DNA, 1092 bp, Glycine max
  Peptide Sequence Number=SeqID_171830
atgaccaaatgctgcaatgggatatgccttttctttgtattaatctgtgttatatgggctccaatgttgaaattcttataccagaagatccagaagtgtaaaaaatgtgctagaataaaactgaaggagtgtgagaaatttgtgaaaaagtggttgatgtatagcagtggtaacccaacgaacattgcaaaccccataaaagatgctagctttcaggttgatatcaagacagcaagtggaaggttgaatttgtatcaaactactctgtgcgaaagactccagtgggatttactaaattcaaatatcaatcccgatccctatggctatttgggtgcatataataagaatgatatccagttgatatgctgtcaagctgatgctagtacattgtggcttgttccacttgttgttcggaccagattgattcaatcccttgaatggaatatcgacatggaaattttttccacctggatactctcaagggacaggccaaaagggaaagaaattgtgaaatatgaaaaagctgttgatcctcaatatcttccaacacggtctgatgttcagaaggttcttaatggctctatgaacagctttagtatttataatgtttatccaagatatttccgtgtcactggttcaggcgatgttagacctttggaagaggataatgctgttagtgctgatctcattataaatcgtgagcaacttgagtggtgggccttccgagatactaatccatcaaatttgagtagactttgtggaggtttgacgggacctatggcaatcatagtatctgaggagacaccaccgcagggaattcttggcgacacactcagcaagttcagcatatgggggctttacataacctttgttctcgctgttggacgttttatcagactccaatgtgctgacttaaggatgagaattccctatgagaatctaccttcctgtgacagattgatagcgatctgcgaggatatatatgctgctagagctgagggtgagcttggaattgaagaggtcctttactggactctagtgaagatataccggtccccgcacatgctgcttgagtacacaaaacctgattaa

SEQ ID NO: 55053 - DNA, 1194 bp, Glycine max
  Peptide Sequence Number=SeqID_171831
atggtgaagttgaacatatatgcagagacagttagtcgaagattggtgatcattcatttaacttatttgggatctcaagaaatgcaggctagtccaacgaacgttaatatatgttccaatcatgaacagtgtgaaggacgttcttcacagtttaagttgacaaaaggtttcacagcaaaagagtcagagaatgtagtaaaaggattgaagttatatgaggacattttcactgattcagaactgtgcaagctgacagattttgtcaatgagatccatgctgctggccaaaatggggaactgtcaggtgaaacttttatattattcaacaagcagatgaaagggaacaagagagagctgattcaactgggtgttccaatatttggacagataaaggaggatgcaaaatgcaatatagaaccaattccagcacttctccaaggtgtcattgatcatcttattcagtggcaattacttcccgagtacaaaagaccaaatggttgtatcatcaacttctttgaagaggtcaatatcacatacttgatactttcccgcttactctttaacttctacctgggggagttttctcagccatttctgaaaccaccacatttggatcaacctgtgtcgactcttcttctctctgaatcaactatggcttttgggcgtatacttatgagtgaaaatgatgggaactacaaggggccactcacgctctcattgaagcaggggtctcttttagtgatgagaggaaacagtgccgacatggcgaggcacgtaatgtgtccatcccctaacagaagggtcagcatcaccttcttcagagtgaggccagactccaaccaatgccaatctccaactcctactacgatgacaagtgcgatgactgtgtggcaacctggcattgccgctagtccatatgctttgccaaatggtgctctaactagctatgagggtatggacatgaacatgatgcccaaatggggaatgcttcgcgccccaatggtgatgcttactcctatgcgtcctgtggcgctgaaccctcacaaactttctggtggtgggactggagtgttcttgccctggaatgtgccatctagaaaacctgctaagcatcttcccccacgtgcacaaaaaggaaggcttctcacattaccttcccctgttgaacctcaaatgggagagtccacttcttaa

SEQ ID NO: 55054 - DNA, 2607 bp, Glycine max
  Peptide Sequence Number=SeqID_171832
atgagacaggctttgattctcctatgcgagattcatttttcactattgtatgttcttcaaattaatttgatctcaactgcactggagaaaaaaggctctttaagcatggaaattgtaatgcaattaggtctccgtaacgaagatagtgcctgggatttcttggaagtagctttacttgcttgcttctgtgcaattcataaccatggttttgagatgttattttcattttcagcgatcatacagcatgcccctagccctcctattggatttggcatcttgaaagctggtcttaacaaatctgttctattgtctgtatattcttcctcctctgtgagaaacagtgatgaaagtttgtcttatgaaagaagaatagcatcatacctgagtgccattgggcagaaattcctatctatataccgatcatgtggctcccacgttgcttttgtgactattcttctcactgtatacatggtgagacctaattacatatcatttggttacatattccttctccttctttggattattggaagacaacttgttgagagaacaaaaagacagctttggcttccattgaaagtgtatgcaattttggtgtttatcttcatatatagcttgagcagcttctcaagcctagagatgtggttgtccaaattaatagatctctacctttatctggggtatgactcaaaagcatcttcttttgacaatgtttgggaatctctggcagtcttaattgttatgcaactttatagctatgagaggaggaagaacaagcagaacaggcaggatcacttggatcagttagaaccaggggctcttgggtttatcaggcgatttattatctggcacagccagaagatcttgttcattgctctgttttatgcatctttaaactcaattagtgcatttggtttcttgtatcttataggcctcatcttctgctccattttaccaaaaacttctagtatcccatccaaatcattcttagcatacacaggttttttggtgacagccgagtatctttttcagatgtggggtaagcaggctaaaatgtttcccgggcaaaagtattctgatatctctctctttttgggtttccacgtattccagcctggcttttggggtctagaatctgggttgaggggaaaagtgctagtgattgtagcttgtactcttcaatacaatgtcttccattggctggagaggatgccaaatacggttctaagcaaaggacagtgggaagaaccttgtcctttgtttgttcccacagaagatgcattcattgatgatgctaagtgtaatgaggaaagtaaatcatcatataattcacagctgccgtctgcaataaaagaaggggtgtcaggcaattcactgcaaattattacctctggtctttcccaagcacctgatactccatcctctaaaacagaaggttcttctgacagtagcagtaaaaagtactcattcgggtttatttggggaagttccaaggagagtcacaagtggaacaaaaagcggattgttgctttgagaaaggagcgatttgaaacgcagaaaactgtcttaaaagtatatttgaaattttggatggagaatacatttaatttatttggacttgagataaacatgatatcattactactggtaagctttgccttgttgaatgcattatccatgctgtatattgcactgcttgctgcttgtgttcttctgaatcggcatattatacgcaaagtctggcctatatttgtctttttgtttgcttccattctcatcctggaatacttagccatctggaaggatatgttacctttgaattctcatgcttcaagtgagattcgttgccgtgactgctggaaaacttcaactctgcatttcagttattgcaaaaagtgttggctcggacttattgttgatgatcccaggatgttgattagctactttgtggtatttatgctggcttgcttcaaacttcgtgcagatcgcctgcctagcttttcaggatcatcgacatatcgtcagattatgtctcaacgtaggaacacatttgtttggcgagatctatcttttgaaactaaaagcatgtggacctttgttgactatttgaggctttactgttattgccatctgctagatcttgtgctgatattaatattgattactggaacacttgagtatgatattttgcatcttggttatctagcctttgctctgatattctttcgcatgagacttgaaatactgaagaagaagaacaaaatattcaagttcttgcgcatatacaactttgctgttattattacttctcttgcttatcagtctccttttattgggggacttagtgctgggaagtgtgagacagtaaatgacatttatgaaatgattggtttttataaatatgattatggttttcggattacagcaagatctgcaattgtagagatcatcatttttgtgctcgtatcacttcagtcatatatgttttcctcgcaagagtttgattatgtatgtcgctacctggaagccgagcaaattggtgctattgtgcgtgagcaagagaaaaaggctgcatggaaactgcacaattgcaacaaattcgtgaaa

SEQ ID NO: 55055 - DNA, 447 bp, Glycine max
  Peptide Sequence Number=SeqID_171833
atgcctagaacaactcctagagctcagcctagcttgaaaagtgtcttgcaaaataagaaagttgaagaaaagtgtgacaaagccattgcaaaatggatgatagatgcttcagtgtcatttaatgcagttaactcaatatattatcaacctattattgatgttattagtagcatgggtccaaggttattggaaaaagatttttctaagttatattggtctccttgtgttgctcactgcattaatttgatgttgcaagactttgggaaatttgaggaacatacaggtgaaagagatatactttgtccaactccaactcaatttgccactaattttattgtcttgcaaagcatattggcccagaatgatgcattgagagctatggtgacatctagagattggacaagctcaacttatgccaaagactccaaggctaaaaaatttgtttga

SEQ ID NO: 55056 - DNA, 519 bp, Glycine max
  Peptide Sequence Number=SeqID_171834
atggcggctggccctacatcactctccgatcgatccacgatggtccctcccccaatgctcgtctccgactccttcgccaaggacgcaatcctcgcctggttccgcggcgagttcgccgccgccaacgccatcatcgacgccctctgcgcccacctctcctccgccgctgcatcctccgcccacgactacgacgccgtcttcgccgccatccaccgccgcaggctcaactggatccccgtcctccagatgcagaagtaccactccatcgccgacgtcacgctcgagctcgccagactcgccgatagaaaccactacgctgccgccgaagacgacgacgccaaacacgaaaccgacgagaaaacgacgccgtcggagagtgtcggagatggtggtggcggtgatgaacacgaggagtatgagtcacccgagagcgagattactgattcaggtatgagaacaacgaggcataagaaaagaaaaggttcgggtgcgtacggtgttacggttaaattggggtag

SEQ ID NO: 55057 - DNA, 534 bp, Glycine max
  Peptide Sequence Number=SeqID_171835
atggaccttctcaaagacactatgatgatgggttgtaggccagctgaaactcctatagatcctaacaaaaaacttggaagtgaagacaaaggagatccatttgatatggcatggattttaaggtatttaaaaagtgctccaggtaaaggactatgttttaagaaaattgggcagcaaggcatcaaagaaggtcaatcatgcacaagcaggcgtatgaacaagtatcatcatagagatatcaacagcatcttaaaggaaaaatttacatacatagaaagcatatactacaaatccattcacgtgaaaaaggtgcttattctacattcatccatcaaagagaaccatgtccataaaacttctacaattaaggtatttgaagactttaagcttacctctagtggcagcgagaggcaaagagtcgcgacgaatgtggctagtaacacggaggaagatgattgtagatgcgatgaagatgatgatgcggaggtgacatggagttacgatagagacgaagatgctacagacgtacgttag

SEQ ID NO: 55058 - DNA, 624 bp, Glycine max
  Peptide Sequence Number=SeqID_171836
atggcaatttcagttgaaagcctattgaaagagaggaagtatcctttcatcttcaccttcatggtcttgctcatttgcttcacgatcctcacattcacctccacctccacctccaccttagaccccattggcttctaccccgatgtcaaaccgcaaccactcgctcatttttcttcgccgagtcctaagcgccaaagattgccactcaagggagaacctttcttggttgatgcaaccattgattggaagccttgtaagggtccattggcgatggattatataccatgtttggataactttaaggccattaaggctctcaagaaaaggaggcacatggagcacagggaaaggcactgtcctcattctagtcctcactgtttggtgcctctccccaaaggatataaagtcccccttccttggcctaagagcagggacatgatttggtatgataatgtccctcatacaaagcttgttgaatacaagaaggagcaaaactgggtggttaagtctggcgattatcttgtctttcccggaggtggtactcaattcaaagaaggagttaaccattatattaaattcatagagaaggtttgcattaaaggtcaatataggttactcaactga

SEQ ID NO: 55059 - DNA, 324 bp, Glycine max
  Peptide Sequence Number=SeqID_171837
atggtggagaagggagtcatgtggtgggttcgaaggcgccggagacaaaaatccattcactccaaaagcctttgcgattcggtattgggacaaaaaagatccgcagcaccgaagccacagtttcttttgtccaaggcgccgccgatgaacgcggcggcgtttgcgaagcttgccgccggcaacgcactcttccaagcggctgccggaattctgcgccgcggcgaagctcctttgcttcccggaggattacttcaaggggcgcagaagatgaccgttggggagaacaagatgtcggctctggatatgaacgatggtgtagagtaa

SEQ ID NO: 55060 - DNA, 293 bp, Glycine max
  Peptide Sequence Number=SeqID_171838
aaacggcggagaaagaggagtgggaaggggtggcggaagaagcggaggtgggagtgggagcggtcttgccgtgtgcagtcatggcccttcttagggaggccgcaacagccgcagttgggtgctgcgaaagccctgtcgggaaggtcgaactcgacgaagaggctgtggaagagatcgattcaaccaggggtgccgtgtgggcacgactagggttcaagaaaaagcaagaggtgctgcaaccacgcttagggttagaagaaggcaagatggttcagcgcgaaaggagaagttga

SEQ ID NO: 55061 - DNA, 144 bp, Glycine max
  Peptide Sequence Number=SeqID_171839
atgaagtattttatgctagttgcatctccaacagctcaacatattatgtttgaagtttctatagggaaggttgtcgattttgcctcaaatattgttagatttgtgggcaccaggtgcaagaggttcaatgttcaaaagagttag

SEQ ID NO: 55062 - DNA, 714 bp, Glycine max
  Peptide Sequence Number=SeqID_171840
atgatgcagaaactgtgtttgattgcttcccatggatgccctccggggctaactttgcagcaagagctggccatggttggctgcaccattaccaagggttgtcaaccattattgccttcatctgtactgaaacctgaaattatcagatacggatccccactaaatccatttgaggagtcaagcaagtcccggaaagagtggttcaattctaatcagattgtcaacgtgaacttgtcgactcaaaggcctatgcttattgatgttcaagaaacatatccaagcccagtagattttggctttggcatcattgaacgatgcagtgagcatgataaaattttgcagtgtatcatgtctgagagtgctgaagctgggataggtggagtacatatatctttgttgtctgacttgatggatttgcaattgtcaagcattgatgaacctcaaaaaccattgacacctcttatcccaaaaagcaaattcttcatcccgaagcttttgcttgatatttttcaagattcgcccattagttcaaagattacagttcatccagatggtcaagtcacttttatggacactgcaattgagataaaagatcttctttctgtagttgctgactcatacttattacgtaagggtgaaaaacaatctatgcttgttccacacttcagcaggtataaatttgtggatttgtttaagagtcaattgatcacatga
